United States Patent 7,420,044 (NUCLEIC ACID AND PROTEIN HOMOLOGS AND USES THEREOF) - sequence listing, part 2

SEQ ID NO: 4346 - DNA, 782 bp, Homo sapiens
tttggggagacccctgaggtcagttaccatgtctgccctgctcatcattgtacatcatggcacttgtattacttgtacatcacagcttggccgagacagcatatggacacagggaacatctgttgaagaaatgaatgaacagtttaggcctcagcttaaatgtcacctacacagagttgcctgcctgtcttccaatctaaattagatctttgttaacttaccttagactacaccgttcttttccactctcacaatttctgcatctgtatgcttattaaatgtctacattcctaaccagactatctgtgccataagagcaggggctggttttgttttgttcagcactatacccctaactcttagcctggagtatagaagatccaagtaaatatattttagagtgaattgaatgaacaaatcaaagcaaatgtggagatgacatataaatgtcatatgtagtagttaagactacaatagggatgatacattaaactcattagtggtctatttggttattgattctaatcaatagatagttatagttataatgtcataaaaatctcttcggaaattttatgtagatatttatcatattcatacattgcatatatttttataaatggcatatctaagactttcaaggcatgaccgataaacactcgtaataagtttttgcttttttttcttctttagaataatattaattagtgtatgagttgttgcatcatgatatggataagctgctaaagtgggtaaatgacgtgcttatagcttgtgtttat

SEQ ID NO: 4347 - DNA, 711 bp, Homo sapiens
aatcagcccgaggccctgcatctagcctaaccctttgctgtgataaccactgttgacatctgcagaaaggccgacacaaagcgcgctgatagctgcgttcccctcctccccccactcacatcttgctgacatttcatggagctcctttcttgctttaatattatgattcatcacctgccttttttgaaccttgctttaaacttcataaggccagcgtggtattaacaaacatgaaacgaaaaagcggcgcgtagttggacctactgttgacctcttatcaggggattgtttttgacacccactgccactttctgtgatctttggagccattatcagttttctaaaatctaaaagacttcacttaataccagctttgaatacatggcagatcagtaacctacacagttttggagatgacaggaccctccaatgaataacacgatgttgcccacgcaggatcagtaaccctcaccactttcttcccacccccgcacctgcaagctgtatgactttcttgccaccttgattcctgattacacgatttattcccataccatattcatgctcgccccacattcaccaaacgagacgcacttcccacgctccccctgagcccccgataccccacaatccaggtcacacccacctctcgctctgatgtccgcccacgatgcccgcccaacccacctactctccccaactggttcgacg

SEQ ID NO: 4348 - DNA, 774 bp, Homo sapiens
cttggaggatcagaggacttctgttctgagattgccagaaaaatgatgaacagaaaattatacacaaccgaacaggcccaactttcaaatggactgagagtgacccacacaagtcccaccgaggccaagggtgacctgcagccagcgacagggaaagactgccacttactggcggcctccggaactggaggagtgtactgacaattgtatctttcgcaagctcttaacctttataccgtcaataaaaaccccattaacatttaaaagggatgtttctgggtgtccacttggaataagagttggaaaacactccaagaaatggatcctgtattaatatcacatctgtcccagatctccaacactgttcactttccttccacggtgccaacaccaagctagctaataggtgggaacagggcagctctgcggttggcccccaagagccagggagtcccccaagctgaccccctggggtggcagtggcacctaacaagaacttccacctagttttccctctctctgttttgtccttttggactctgctcacgcatcacatccagaaagttccctaagctctccagtgggatgagaactctgctctgtgctcctgtggtcctccatgttcctccacctggtggccctcggctccctgcattacccctgtctacttactgacttgccttctacccagtgatgggccatgtgctgtgagggcacacattgtgcgcccatctattcatccctctgggcgtgcgttgattcggtacttactga

SEQ ID NO: 4349 - DNA, 853 bp, Homo sapiens
atcactattcttatatctcttcatcctccttgcttcacaaccataacaacactctacacaaatggctggtacaaagtcaatgatgcaaaccaaatgtggagtgtgcagagcagagattgatcttgagcagcactgagtcctgcaagctgtgaacaatcaatcatttcattcaaaggaagagtgaaatgagacttgatagtaatgctgtgcgcatacatacagcgttggacatctagcttgaagaatgactcagaatataatattaagataccagagggcaaagtcaagagccgtggacatttgttcccagaaagtgggtctgaactcctttcaaggaatgctatgaaccagtgactactgtgtaattctgacacgcttgaaagaagtttgactacctcaaggccattatgcccataagaccttatccagatgctctgccagaaccagctgaggccagcctccccttcccccattaaagactatgatatgtaagtgaagatatcttggaaccaaccaaccgccccttccacatctgaataacatcaaatatcctcagtcaagctaatacagaaaaaaaatgaatcagcaagcttacctctgctggaatttctgaccacaaaacaatgagatagagcaaaatgagtactgtcttaagccactgagttttgggagagtttcttatccagcaaaagataactagagcaataggcattaggttattctaaatttttggcagactatttggtgaatatttttgtatatctccagatatgtttccgcaatagtttttcaataccactttgatactgtttcaagctttcatctatctatacctctccacagagtatatttt

SEQ ID NO: 4350 - DNA, 376 bp, Homo sapiens
agacacttctcatggcacagaacctgccagcagaaagatgaagacacctgtccctatctgcatgtagagtcataagcagtgattttctaacttggcagtgctccttcgagttgacatttccaaaatcacctagaggaccaggaaattcagtcaggctggcagcacaagaggtgggcctgatcaaatccctcctggaaaattattattcaagaaataagagaaaatggaagacgctgggcacatgtcccaaaatactatagataagtttttggaagtaactactgatttccaaatatagaaagttttcgagctttgatttatttcgacctagaagaaaatttaaaaaataaaaagtgaaaaaataaaaaaaaaaaaa

SEQ ID NO: 4351 - DNA, 451 bp, Homo sapiens
acgtaggactgtttggagacacacctcctcaggcctctgtaggtctgcccacccagccagcagcaggatagtcccatgggaccccgtcctgggagcaaccccttctgactcttcatggaagagacacatcctgcccttcatccagccacctgccagaaccacagcctgaagctgtttatccctgtgtgtagggaagtctgtcccatgcccaggggtatatgtgtagccagctgaaatggctgacacacacccaagcgtctccttataccatcaattgattttctgaagagtcatcctgaaatttttccttccggggccactagttcacggcaaatgcctccccagaactcactcttcccgcctacattcatttactctttcatcagttgatgggatgtttttttgccttgcaatatagtataaaaatagctacttcggaaaaaaaaaaaaa

SEQ ID NO: 4352 - DNA, 780 bp, Homo sapiens
gctagaccttggctttattctgttggaaatacttacctttccaaatccctgctgtccagtggtgataatgggactcaattctagccaataagttgtactggttacaccttattggcagagctcaactgggtacaacttatggaaagctgctattatcttccagcagaattgacagaatcaacagacacaagttttttttttttttttttttttaccattaccatatctccttcctcctgcctggaatgcagccgtgatgcctggatgtggagcagctatacagtgagaatgaggacaagagccacaagtgaagaatggtgcatgaggaagctagcaaggatcaggaactttgaaaagctctcaagcagctctgagcaattggctgaccatatctggacttcttataatgtcagaaacatcatgctattacattctttatgcattctattcttctcgggacactctttagattagacttcctgtgtatatctctcttgttcttttggctacgtgactctattatttcacagatttaagagcaccattggggaccttttctaatgaatacactaggatggaaagatagaatcgctgggccgaaatgttatagagagacagtggtaggaactgacaagaaaaaccaagccctaaaagtcagctctgctacatacttggacccccattcactttaacagtgatgaacatatacactttgcagaacaaaatatggacaagcatttcctacatcacaggcaagttaccctgtgcctaatggtacag

SEQ ID NO: 4353 - DNA, 376 bp, Homo sapiens
acaatgtaagtacccagaatcactgaaacaagttagaagaaaaagaagaaatgtagaagacttgggtacttgaatttaatactcattataaagcagatcaatgatttcatggggatggtgattgatgctaatgggaaggataggagggagggattaggggcacaagaaaactactggggtgatgcatatgttcattatgtttccaagatgtgtgcatgtatgtatttgtatagatatatacaaacatttcatgtatatttttcatatatatgtcaaaacatcaattgaatactgtaaatatgtaaagtttatgttaatcatacatcaataattttggtagtcccctctaataaattgcgttaagatctcatgaaaa

SEQ ID NO: 4354 - DNA, 324 bp, Homo sapiens
aggccattattctaaatgaagtaactctggaatcaaacaccagatattgcatcttctcttataagtgggagctaaattatgggtgcataaaggcatacagagtactataatggacattggacatgtagaagcggggagagtgggaagggggtgagcgatgaaaaactacctagttggtacaatgtacactactcaggtgatgagtaccataacacaattcatccgtgtaatcaaaaacaacttgtacccctaaagctattgaaattaaatagtaataaaataaaataaaaaggattgtgatttccaacctcaaaaaaaaaaaaa

SEQ ID NO: 4355 - DNA, 831 bp, Homo sapiens
agataaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaatattttatattatttttcaagacctatttggggggttttgcattattttaatctaaattttttttttttttttggtattactgagcttatagaactttgagaaaaaagggaagcaccaaaaaccttcattaattcaccttattttggaagggatattcctgcccttaaaaaaattggccttcgaaaacctaagagggacagttaccaaatggtttttctgattacttctgaaggctctttctttttaataagaaag

SEQ ID NO: 4356 - DNA, 978 bp, Homo sapiens
taggtctaatggctcatgagttcaactgatgggttggcatttctctggagcaaatgaatgacacttttggagcttagactaaggtaccaagaagtgatagatgacggattcctcaactgacctgagagacaggccacatgcacatttcaaaggcaatttctggtaaccagagagatgactcagtcttgttgaaggcatgtgttccctgtactctttggtctgctgaaggaataagcagagccacctcagacaaggcactcaccagcctttgctccctggaggctaaactacagagcaaagagtcaccaaaaatgccgtgtatctttctatccaaagtcaagtttgctgggtgagtttctgtgacaaataatcataattaatcccaaagtaatgagaggcgaagacagctgagcttctgggtcggctggggacttggagaacttttgtgtctagctaaaggattgtaaatgcaccgatcagcactctgtgtctagctaaaggattgtaaacgcaccaatcagcactctgtaaaatggaccaatcagcactctgtaaaatggaccattcagcactctgtaaaatggaccaatcagcaggatgtgggcggggctaaatcagggaataaaagctggccacctgcaccagcagtggcaacccaggtcccctttgacgccctggaagatttgttctttccctcttcacaataaatcttgctgctgctcactctttgggtcctcactacctttaagagctgtaacattcactccaaaggtctgtggcttcactcctgaagtcaccgagaccacgagctcaccagaaggaacaaactctggacacactctaacattctgaaggaacatactctgcacacacccttttaagagctgtacactcactgcaaaagccgcgggttattcttaaagtcgtgataccaacaaccaccagacgaacaattcaaaactggtacttgctacccct

SEQ ID NO: 4357 - DNA, 788 bp, Homo sapiens
tgattcccgacagagtgataatacctcacctctgcctcctgaacaactcggcctggtttcagcctgtgaaaatgatgccagtcctggaagatgcctagtgacattgcggagggatgacctgctcccaaccaaggattcttttcttccaggatgatgtcctccgtcataggttatgagatgtgccctataaccatttatgccaacaggactggttcattgaaatacatgggcaccagttttaactgttttggtgcattgtgttagaaagtagcagcaattgaatcattgtcgcttgatttctgtcccttcgtttttcatgcctgtcagcaagcaaaagtgggacaaatatttggaatttctttttttctggaacaccttttcttaaagtgtaagatttaaatggttttcagtaccagtcatcaccataatcaattttagaccatttcatcacctctaaaagaaacattaggctagttagcagtcacttccaattatccaccaacccagctgccaccccctctctccccacaccaggcgacctctaatctgttttcggcttctatagatttgcctattctgtacatttcatgtaaatgggaatcacattatgtggccttttgtgactggcttcttccacttagcataatggtgtcaaggttcatgcatgtcgtaacatgaatcagtacttcattattttcatggctgaataatattccattccaaataatatatattccttctatggatggaccacattgtatttatcccttcattggttcatggacatt

SEQ ID NO: 4358 - DNA, 458 bp, Homo sapiens
ctgctgttacccaggatgtgcttgctgtcgcgcaggaagccatcatacgcgaaggcgctcacgcccacagctaccagactctgaagaagatggcatttcctcccgatgttgccatcacttcattccgtcagccaagttcttctttgtggctcaaggaatgttcgctctttgagataccatcaacaaagcacgtgaaattgtcagaggctgagctttcaggaaaatcctattgacaacagccaagtgggagtcagtctccgtcctcagtgacctgtctttgttccttagattagaggaccctcattcacatcttctttctgcggcgatagtcaagatgctcacatggggtaaaaccctatcaatttaggctaattggagggaagaccgtggaatgagggaaaagtcaagtgtattcagtaaccaaaaaatatgctaataaagggttgctaagtagaaaa

SEQ ID NO: 4359 - DNA, 784 bp, Homo sapiens
aggagttgtggttctcctgtctggcctgccaccactggaccatccctgtatacattccttctccctttgaagaaatccacaaaagaaaaagcaaaatacagacaagttttcaaagccatgatttacaggaatgaattctgaaaagcaagtggctaacatccgagttcatcatcaaataatatttctaaagcaccctctagtgtctggccccaagccagatgattcaacgcctggagaagctacagactttttaaaagtaaaatagactcatgtctgctcatgagaagcaagtcagcgtcatttaggatgccttaggaatgtctctctaaataaggattaaaaatggattgctgtagaaaaagtaatacaagtacaaacactaataatattgaatgcaatttaaattccattttaaaatagataatagggtttaaaataacatgttgaaaattacactggaattagcaaaatttaaaatcttaggaagaaaaatcctaatttgtatgtgaaaacgttttgaactgaggaaaattaagactagcaagagtagataggggttgtctggtaggaatgttggacccatcagccatctgattatgcttgcgactgatcctagcgtgtagttttcacccagtaaattatcaagtggtgcagtagaaaaagcatggtatgtaaaatcataagactcatagtctggggtcacctctactactcacttggccatggggtttggaacacatcacaaaagatttatgagccttcgctccttccaactaaatcgtga

SEQ ID NO: 4360 - DNA, 387 bp, Homo sapiens
  misc_feature (1)...(387): n = A,T,C or G
ctggccgatctcttttcattaatttctttctacctctatttaaataccactactaataacaaaaataataaaatcttaatcagatggcttgtcaattgtccactattctaaataacagctccactgggctgaacagccagtcccattaggcatgtctagagttaacgcttagctctttgaaggtccactgaggattccgtagactagagatgtacaggatgaggttatagaggtagactgtccatcaaagattttcttcttggaaaacagtgtgggagttaagcctacttgctcacacttgtttgggactgccgttntnccctgccttgtgttgcttgaannnnnnnttttttannnntnncccttntgcgagttgtatatgagatt

SEQ ID NO: 4361 - DNA, 903 bp, Homo sapiens
cttagggcaccactgattggactatgcccacctaccctgaggaaatttcagaggcagcagccaagatggccgaataggaacagctccggtctacagctcccagcatgtgcggcacagaagacgggtgatttctgcacttccatctgagatgcctgctgtcctggaaaatcttctggatctatacagttaaaccctctgcagcatccccattaggaccccaagatcatcaaatcctgaccccggccctttagccctttcctgttcttacagccacacagaaactgaaaagcaaagggaagggtggcaccttttgaggcctcaggaagactctgggttataggcagcactctgtctgctcatggatagccatggctatcctggctctctcattctgcctgtgtgccaagatgagcataagcaagactgcctactcccggagttataggtggggctaacaggacacagtgcctcttcctcttagaggaaactttaatataattagtgccctgtcactgggcaggacaagtttcttctactttggcatctccaactttcatcatgtctttaaaccctgccctcccaggctcacactgacctgctggtaaagaatatcacttccctctaaacatctccctcttctctctctccaacttaaaggttcttgtggctagatgtcctggatagcgtttagaatggttgctagggccaagccttgagatggggcgggcaattactcaaccctattggagcatctgaagacaaaagttgtgtgtcatggaccgggatcagagctgctgaacttggagctaagaactttaaaatttgtatcattatccgtggtgttgagcgagacggtctaagagctaagaagaaaagatgaggtgaactctaccaaaccaaaat

SEQ ID NO: 4362 - DNA, 775 bp, Homo sapiens
ctagggctgcccgtctcccagatgctgctcttcagggctcctggcgccagtgctgaggtgacagagcaaaggtctgaaaactggccccttcacgcagcagtgtccaaagcggggggcatggcacaccccctctggcttccacatggcgggcacaggccacaggcacaggatctctgcagaaaccaggcagtggaacaacgccaaccccacactctcgggtgcctgtgtgtgccacgtctcatcctgggccatctcctcttggatctgccaggcgtgttggcgatgaggaccctgcggcagtggttgggctccaccagcaagtggtaaagctggaacttctaaaaggacaagtccgggagtggctgcccctgccggctgcaggagggcagggtcttcaagctggctggggtgccgcgcctggccaccacttctttcattctcagtattggttaatttgcgtctttttttgtcagtctggctacaggtttacacactttattgatctccaagtagcaactgttggtttcactgatttcctctatttttttcttttctcaacttcattgattttggctctatttttatcatttccttacatctgctagtttgggatttaacttgctcttttttagtttcttaaggtggaaaattagatcattgatttgagacttttcttttttttaacacaagatattatgctatacattcccctgtaagcaatgccttagctggctcctacatatttggatactttgagatgttgggttttatttaa

SEQ ID NO: 4363 - DNA, 790 bp, Homo sapiens
accttacaggtgcaagcaacagtacttccccagcgtgggagtgtgagggaagccaacgtgacagagagggctccaggctggccactgcgctgacaggagagaccccttgaagcagggttacccaacactgcccttcgtgcgagcggcaccagccacagcccagctgtttccccagatggaaactcaccttccttcaccccaattcactgtgcactgaagcattactacttctgggaaacacgatcagcaactagagctagaatccagagaagcagtcatttccaacaaatcacatcgacagccagatgcacaccattaaaagggtctcccggatctgctctgtgtctgcaacgacaccactaagttgcccagtggcccagtgggctcccagcaattctcaccccgctcttgaaacctggctcagcagaggtgctaagaaaaactaccacgctggccagtcctgagcccactctacgcatccagattggaatggattacttttacaatttttaaaaatagccagtaatgactgaaattttagacaagactatgactccctctttaaatcacctcttttgtctaaagcaaccaaatgattccaataactgtataccctctctttgagcctccaataggcttggcatgccattagaacaaacaggaaggaaagaaagggcttggccgggtgcggtggctcacatctgtaatcccagaacttcgggaggctgaggcgggtggattgttttgagctcaggagtttaagaccagcggggcaacacagcaaagccct

SEQ ID NO: 4364 - DNA, 775 bp, Homo sapiens
ctgtgcaagacactgtacttcccctgcgtgggagtgcgagggaagccaacgtgacagagagggctccaggctggccactgcgctgacaggagagaccccttgaagcagggttacccaacactgcccttcgtgcgagcggcaccagccacagcccagctgtttccccagatggaaactcaccttccttcaccccaattcactggtcttaaaagctgctggtgtgattctagaagactgagaaactcagcagtgatgtgcactgaagcattactacttctgggaaacacgatcagcaactagagctagaatccagagaagcagccattaccaacaaatcacatcgacagccagatgcacaccattaaaagggtctcccggatctgctctgtgtctgcaacgacaccactaagttgcccagtggcccagtgggctcccagcaattcttaccccgctcttgaaacctgtctcagcagaggtgcctaagaaaaactaccacgctggccagtcctgagcccactctacgcatgcagatgtaagcgctgagtgagttcacattgtgaggggacacccgcactcttaatacgctctgggttggaagagtaccattattgtagaaaccagcgggagaactctttagttcagaaaaccgctctcaaccatgcttttgtttcctgagacacattgcgcaatgcaccccctcaactcgctccccacgcacaccggctactggcatttacacccctcaaaggatgtaaacgatgcacccaacaaccca

SEQ ID NO: 4365 - DNA, 572 bp, Homo sapiens
  misc_feature (1)...(572): n = A,T,C or G
atttgtgcacattttacaaatgcaaataattcctttcatgactatcttctctacaggaccatgagtgttaacagagcaggaagagggtctatcttaattataactctgtagccccaggagttagcatatcgcctggaacctggtagatgctaataagtgtgtgttgaatgagtctcatgcatgcacctatgggtgaatggatgtgtaacccaggctctgctgctcctggttatagatagttgggtcaagtcacttcacttcttttggcttcagcttcaacaagtcaccaaggacatgacttctggacttctttgtgatactaaaatgctgaatcagggagggtagggctagaaagggcttggaagcaagttnaatgtccatgagtcaagtctcccataanaaagccaaaaacctggnnggagggaatttccaaagtttccnnntttggcnggtttggntaaaaaanaataaaaaagngnccnttgtttcaatccttgattgaatnnnncnttaaaattntttcntatttcctctngnnaagnttannnntccccnccccccggnaaaccccc

SEQ ID NO: 4366 - DNA, 483 bp, Homo sapiens
  misc_feature (1)...(483): n = A,T,C or G
cgtgattcatcactgaatacaacaactagcactgggatctgccaagacacggaaaaatcaccatgtccctgtgccaaggagctgtctctcattgcttgttgcagagagggaagcatgaaagaaatacaatgcaagagaggttctctgttgctgagtggaggtggcccatagcaaggatctgagattcatcaacagccagcaaaacaatggggacttcagccctacaactacaaggaaatgaattctgccatcaacctggagtagcttggaacagtctttccctaagtcaagctttcacatgagggtgcagctggtcaacaccatgatcccagtctgagaacctgagctaagtacccagctaaaacaccctggactcctgacccaggaaaactgtgagatagttaatntgtgttgttttaacctgctatttttgtgataatttgttgtgcagcaatagagagaaccacactctctaaaagtaat

SEQ ID NO: 4367 - DNA, 694 bp, Homo sapiens
  misc_feature (1)...(694): n = A,T,C or G
ggggggaatactttttgttacaaagtcaacttttaaaagaagaaaatctccaggagctaggagactggagtatgatgatatgaattggactatgatcgaagatttagcaatggcacagaattgactggtctagcacagtgggtctgatttaagattgctctaggctattgattcctattcaccaacaggctactaaacaaaacagatgagctaaaccaaccttagagtggcccanaatgagctacagaatgaacctatacttcccagctcctttaaatagaaaacatcctgagtgggacagaatccctaaggccatcattgagctgactttattccaatgtgaggatttttgagatgagnattataaaatttccttcaggcgatgcttnatttgataagctgttgacactgttatccagcaaaagccttgatgttagagttgttgcatattatttagaaaaaaaaaagtgtttgaatgagtacacaagtttgtattctaatgaatgatacttttgttgacttcatcgccatcattaatgtgaacaatatattcatgtttaattacccgtagaatatatctcnctgtgttgaaatggaatttttaaatgtgtaatcccttactttttgtggtcatgtaaattttagttagtcttgatgataaagacaaatgaaattgaggagtaaaaatataaat

SEQ ID NO: 4368 - DNA, 369 bp, Homo sapiens
  misc_feature (1)...(369): n = A,T,C or G
tgctggagtgaagcttttggcatgataattcaatccacgttactccattgccatttgttaccacgtccttcagtctcctcaatctctcagtccccttatttttcgtgaccttgacaactttnaggaggacttcatcagtggtgaaaataattccaaacaaaaatgataaataccagactcaaattggaagtgaaaggatccagaagatggtacttgctgagagtaatggaacagggatggtgccacaagagttcttggggaagttttgaagaaagcaaagatgttttggggacatatgcagtctgcagtcctccacagagactggagcccagcattttgaaaagaatgccaattggaagaatttggaat

SEQ ID NO: 4369 - DNA, 677 bp, Homo sapiens
  misc_feature (1)...(677): n = A,T,C or G
atgcacctccaatagagcttagtaatgctgagtaaaagagatgaacatccagaacctcgcagtggatccagagatgctttaaataaaaacttcacctcctcaaggacaaatggtcattcattcactacttggctattgagcatctactacatgtnaggcatggtgctggtggctagatactcagcctactttaatggacttggtgaatttagaattggagcaactatagctttcctggtaattttnngaagtcatggaatgcaacacaaatgagacatcaaaaccacctatgagaatttcaacctctcatgactcaatgcctctacacttcaaataccttcatgtctaaaacagaatgactacaaatcatgacttcctgatgtccttcctaaggttggtggactgaacatatgatatatgtgaaagtattctgcaaacttgtgggaactaggcaacnacatgtgtttctgtttgtttgantgagtgtttatttgtagaagcttatttcttggcaccacctgaaaattcctatccaactttactaatatccatattccttcaaatatatttaacagattgattcaaggccaccaacaaaatctgttgctgttttggtacataatagagctttgtgatttcctgtagtaaaatccaagcgtccaatanaatgcgatgcg

SEQ ID NO: 4370 - DNA, 691 bp, Homo sapiens
  misc_feature (1)...(691): n = A,T,C or G
atgtgatggcagagatggggctgccatcttggaccatgaagcaacaagcatgaagacatacaaaggatagttgagtggaaagaacaaaaaaagggattgaagagtgaaagatcaagagagaatgattccttggaagcggcagttgacaaagcaaattacagaatatactcagtgagaatcagatgaaacacgggagataaaaggctccggaccaagaggtcccagagaagcattcagaggagaaaggctgcaaccaggaagtccacatactcacagctgcttccaggccccggtgctcacccagtaacaaagccacttctgtctggaaaaaccacagcaaggcgaggcacgaagcagaaagcctttaattggggtggcgaatgagcggccctgtgaactccaaatgcctccagcaggctggggcacgctttttctttcccttcctctttgcccacccgttgatggcctcgctctncagggcttctcaacaggcattgttggtcttttggcttcttccctgctctgggtcctgagccatctttctgcctttttgctattccgccctgagcatgctatgggccagtgtcntgggttctcagctcaccctctctccatcaagatgtttctatccgggttctacctcctcaaaccttgccaggtgactgggcatctaaactaataatccagtaat

SEQ ID NO: 4371 - DNA, 660 bp, Homo sapiens
  misc_feature (1)...(660): n = A,T,C or G
ttggttgaatctgcgaatgtagaacctgtggatacccagagcctactctaactcatacccccacctagccaaccactagaagcaattaccactggaaagtatgtcaagcccaaaaaatttcatacatgatgtttgccagttgcctagcttattggcaacaatgacttgaaaaaaagataaaccatcatgccaattttcagtatgaatggaacagaagtattaaagttgcttttatctaaattgtccattattataagaatataggccgggcgcgggnggctcacacctgtgatcccatcactgtgggagaccgatgcgggcggatgactcgaggtcatgcattcaagaacggcctggccgacatggtgagaccccatctctaccaaaaatacaaggaattagctgcccgcggtggtgggcaccaggcatccagctactcagnaggctaaggcaggagaatcgcttgaacctgggaggcagaggttgcagtgagccgagntcgcgccattnccttccagcctgagcaagaaganagncactccatctcaaaccanacagcgaaaaagaatataattcttctaagctgttgtacntgcttaaagttaaaacaanaacattttaagaaaccnnaataattattttanagccctaaaaacaaat

SEQ ID NO: 4372 - DNA, 701 bp, Homo sapiens
  misc_feature (1)...(701): n = A,T,C or G
tgctgcttctagtctgccattctttgccacacccccagaaaattctgactattcaatttctactataccaaaattagactcctcctcccgctaaggaaaagtggtgacaacatgggcatatggacattcattcccaccttcagcagagggaggatatgtgttttgagaaatggtactagagcaattcaacatagaagaaaagaagagaagatgaaggagaagaggaggaagaggaagaggaagaaggaggaggaggaggaagaagaaaaagaagaaggaagaagaggaagaagaagaggaagaagaggaagaaggagaagaaggagaaggagangaagcagcagccaagtgcagtgacccagcctgtagtcccagcgctttgggaggtcaaggcggggcanagcaggaggtcaggagttcgagaccagcctggccaaacatggtgaaaccccatcttttactaaaactacaaaaattaagctggggtgtggtggtgtgcacctgtaatctcagcttcttggnaggctaagcaggataatcgtttgagtcctggagacagaggttgcagtgagccgttgatcangcctctgcactccaacctgggtgggaagagcaagactctgtctcaaanaataaataaataaataaataaagatgcgggcacgcncaacccagcgggtggaggnnaatcgcattatagt

SEQ ID NO: 4373 - DNA, 357 bp, Homo sapiens
agggtgtgtttctatgaagacactcagaagcggcccatagagacaggatctaaggcctcttactaacagccagcaccacaataccagccatgtgagtgagccatcttggaagcagattttccagccccattcaagccttcaagtgactgcagccctgactgacatcttgactacaacctcacaagaaaccctgagccagaagtgttcaaattagcagctcccaaattcctgactcacagaaactgtgtaattaataaatatttattgttgcatcaagccacgaattcttgggataatttggaataattatatagcaatagataataaatataatatatcaatggaaaaaaaaaaaaa

SEQ ID NO: 4374 - DNA, 772 bp, Homo sapiens
atttccacctggaggccagtggcttcagtttgtcacaaagacaaatttattacagcaaaaaaagtgccccccactcaagagctgttcaactccagaagactccaaatgaagagaagggatcctgaattctgcttcttgggcaacacaacttgaccactgtggactgagagagaagagtggtcatcaaggtgattggctgagtagaacagaaaggaggaatggagttgtttagaaaccaagccactggattggccatcattccaatggaaagttttgcaccacaggtttgcagctattgaaagaccattctgattattgcaaaatgattagcacataggcttttgaatcaaattgaactgggctctgccctttattatatgtccttgggcaagttacttaaccttgctaagtctccattttcttacgtgttaaaaaggaggataatattagtaattacctcataaaacaattgtgaagattaaatgcaatagcttgtatgaagtgatccttgtttagcatcctggttcataataagtactccagaaatgttagctgccatcaatagcgcataattttaaagaaatgggcatttttttattactggaattgctgcaaagatgacaaatagacatccttccttaataaagggatgtgattcgtttacaaatagcagcacacatttgcatgtagacaatagtgtgataatattcttaaatacagtttgttcagtttgttcttctaagaaaataaacatctggcctcgttggcctca

SEQ ID NO: 4375 - DNA, 281 bp, Homo sapiens
cctagataaacaggtgacaatgtctaaatgctaccaacgtttgcgggttgtacattgctgacaacagaaagtatactgctttggagtgtggggagaaatttgtgctctggaagcactgaggtcttactgggaatgaagtggatcatcaatcagactaatcaacattggacttggcctacagctttgctggtttatagctcccaatggggaaaagtcactgctgcatcttactcatttttttttctgtattaaaataaaaggccctgagaaaaaaaaaaaaa

SEQ ID NO: 4376 - DNA, 373 bp, Homo sapiens
gatccaaggtttgcgggttgaccattgctgacaacagaatgatactgctttggagtgtggggagaaatttgtgctctggaagcactgagatggtatcttgctctgttgcccaggctggagtgcagtggcacaatcttggctcatggcaacctccacctcctgaggtcaagcaattatcctgcctcagcctaccaagtcattgagattacaggtcttactgggaatgaagtggatcatcaatcagactaatcaacattggacttggcctacagctttgctggtttatagcttccaatggggaaaagtcactgctgcatcttactcatttttttttctgtattaaaataaaaggccctgattgtgtcagtaaaaa

SEQ ID NO: 4377 - DNA, 219 bp, Homo sapiens
cctgtacgagactaccaccactgaattacagaagaaaatggagaaaaaaagaagaagaagaagaaaaacccagagatacttcttccaaaatttacagtcttactatttaagactggcaaaagcaatctttgatgaaagaagttgatcccaaactgtagcctgtttgagaattacctggaaggcttgttaaaacctgttaaaagcccaaaaaaaaaaaaa

SEQ ID NO: 4378 - DNA, 416 bp, Homo sapiens
aggctgtgcacattctgcagattactgctcaaaggagtctggacaccagattctcttctggacaccatgaagaatacagcaaaggacaacacaggccctgtcctcaggatttcaccagcagcctgggaacaaatgccacacgaattttatagctatcagagtcatgtgaaagcagggaatggagagattgcttcctactggggaagagaagagtcttcagggaagagggggccctggggcagaacaaaaagtatgtaatgaagaattttgtgttctgtatgctgagaaaacccctccttacccacgccctggcaacattacaggatgtcatgctagggagtgctgttgagtggggaagagtctgtacacctgccatgtaataactgttggtgggtttttcttcaaaaaaaaaaaaa

SEQ ID NO: 4379 - DNA, 555 bp, Homo sapiens
tgtcgaggttatttccacgacaatgttccaagtcaagtaaaacatttaggtgaccaccttcttagcgctttcaagtctcttccgaggacaatttgattcctatctgagcttgggaagtctgtgctcatattactcaggggagtcgcagcagcaccggacctgcctcagaggatctcctgaacttggagagagatgattatggattgcagacaggaatataatatgaaaaatggaagaaaaccatgtcatttgtactttcagtatgtgttgggtgtttgaaaagtgatttttttcatcacgtgtcctatctttattactcctttttttttctttttgttattacgatgaaaagttcatggtcattgtagaaaaatgagaaaccaaggctaagtaagaagaaaactttggcaggaggatcacttgagcccaggagttcaggctgcagtgagctatgattacaccactgcactcccacctgggcagcagagtgagacccccactcaaaaaacaaaaaatttacaattaaggctgaactttactgggcatcaaagacaa

SEQ ID NO: 4380 - DNA, 543 bp, Homo sapiens
gctaggacaatcgtttgcacatcaactaatcacaaggcacagtaaatgaagtataatagacaaagagcctcggagtcaccagacattacaaattttctgcattgccaggacacagtacctatagctgttgacaatactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaagaaaagaggaaaataataaaatgcaaagaatcacatttaaaaaaaactcaaaaaatgttttagggtgctcaaggtttaataattgacttccaagtgattctttttgctttaaaacattttgagttgactaaaaaaatcatttatgcatttatgcaaggaaaattaccaataaatacatgccttggaaaaaaaaaaaaa

SEQ ID NO: 4381 - DNA, 221 bp, Homo sapiens
gctgtccagatgggaaatctgtcaagcatttttgcattcacccctttttccataaccatccatggaaaattatatgctcaatatatgtttataaactaaatgaatcaatgcatgaatgaataactgcagaatgaatggatttttgttagcaaaaaaatgccttcaagttcaggttgtaataaaatgttttccaaaatctctgcggaccaaaaaaaaaaaaa

SEQ ID NO: 4382 - DNA, 459 bp, Homo sapiens
ctagctcttcgagggacttcagagtatatcaggtaccacatcctcctcacgcagagaagatcaagatacaaagcacttaagtgaattccatcaggataacactggaaatgagcagctgggtcaaaaccagacccttgtgccataacatgtacagagggcaggaaacagaagtgacgtcacctgcaatactccagctcagtactgctcaaagttccagtctgtaaaatgtttattaccggttcacactgagataaggggcttgcaaaagaataagggaagcagtgcattaatttatatcctgttgctgatcagaagctatcagtcacataccaggattagtcccaaggataataacttttgagtagcacaactctgaaagaaaaatcacaaaatgtctgattctctccgtaacgatgaatggcattaataaatattactgaagtttcaaaaaaaaaaaaa

SEQ ID NO: 4383 - DNA, 564 bp, Homo sapiens
ctcgctctatgaggacatattctcctcatccacagaagcccttttcaaacattactaagaagtctgataagaagaaaaaacatccactgatgggttctcagaaagaaagcattagatttaactacagggcaatactgccctgattaccacaggcccagctgacggcaaggttgccaggcagctctcgtcctaccaagaatggtggtggaatgaagcaagcgtgtggtttgtattaccatttttcagctttttaaggtttagaaaagagaacgtcaccaacaatgataattcactttggaatgaatacattttcaatgcagtgttcagcaactgctgatgtgtcttaaatcctaaagttcatatgcaacattttacaatgtgaacaagataaagcgcaggagatgtcaagatcctactatatgcaaataactaagtttctggccaaatccttcttttaaaaaagaacgaaaaatgaaaaacctctccagcatttctaagctgctacttacagcctttataaagatagcccaggaaaaagatgctaaagcccaagagtaagctaat

SEQ ID NO: 4384 - DNA, 777 bp, Homo sapiens
  misc_feature (1)...(777): n = A,T,C or G
agcccatggatgcctctcaccacaaccaggaaggaatttgcattgattccttcacattgtgttttcaagaaccagcccatcaggacagctctgcatatatgtgcttatcattatgcatgaaggaagggcatgtgcactagaagaagacccttttgtagaaatgcaagctgtgctgcctggagttggaggagcggtgatgcacacactccctcggccacctcagctggtgtttcactgggtcatgggcaccccaagtctgccagctccaagcccagcacagccctagaactagcccaggaattgcagtccttgtggcttagactgccttttaagtttacttgggaccctagagccctttagcccatgatgatgggggttgctggaactcagattcccactaccaggatggataatttccctgtggctagggctagtctaaaagctccctccatgggtgctggctgaagtctgccttgtattgctttccattatgacagggcagcactgaattccagtgcaaagccccacaattactgtactgtccttcccccaagcgtacagattctctcttctgccccacatagtgccaccagggatgggggagcagtggtatcaggaatttaagactgtctttcctaccctcttcagtgtctcttttctttacatgatgtttaaaccaggtactgtgatcactcacttgctttttggttcttatgaaggggatttcttctggggatagtanttcatttgggtgttcctgggaggaggacagtcact

SEQ ID NO: 4385 - DNA, 831 bp, Homo sapiens
agataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacatgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaccttggtgcagatacagtatattctcatcaactggaaggttattttgcaaaattccttcaatttcactcagtagcttctttttctttttaaattggcaaagtctggctccagctatccaaattaaggtaccctttattatggactccttaatctgggaaatgtgaacaagtaaaattggcatctagatagcaattaagaagtgatatggcttaaagaaagataatggattatttaaaacctgaagggttatagaaaaatcataataaattcccctctttttggaggtgaacaagaaacccaaaaaagctggggactcgaaccaattattcagggaataattaggaaatcctgttaacggtggattaaatct

SEQ ID NO: 4386 - DNA, 775 bp, Homo sapiens
  misc_feature (1)...(775): n = A,T,C or G
agaatttaacccttcttgctacattcaagacatagaaatccagccagaagacaactcgagatattttgtggatctatgcctttccttcagaaaagcaaatatctaccataaaaaaacactggtccaatattcacttctataagaaatgcaggggcaaataaattatggattttattatcgctaatagagtcacttaaccattactccttactacattctgcttttctaacaaaatttcgactgaatattctccctcagagcctccaaaaggaaccaactgatgacaactgattttggacttctggcctcctgaactataacaaaataaacatctgttgttttaagcaagccaggttgtgattgttacagaagctctaggaaactaaaatacttaatatctaagtatcttaaaactaagataccttcttataccttcttatcatgcgatcatagaaaatatgtccaattagtcacaagtgggattgggcaagagaagatggataaggggtgtaaatccttcaccacaattaagaaattatacgtagaaatcgcattctattggtgaagcaataaaatcattgttgggaataagaaccgcnnnnnnnanannaaaannnannnnnannnnnaaannaananaaaaaaannnnaannnannnnnnnnnnnnaaaannannnnggganaannnnggaannnaaanaaataaaaaaaaagaaataaaggataatgtgaaaccttctagtccgccccgagcgccacgttcccgacgccgat

SEQ ID NO: 4387 - DNA, 810 bp, Homo sapiens
tagaagacaacgtatttgtccgttgaaaaatggattgcaaaaatgcttacctcctacaaaaatcaggtctgtattctgtcgctgaagagagtgaggataattcagatgaccctgagcgccaaacaactcaacggtgtaaaaataaggcacaacccctggaactttataatacaagtcataacacaaatgagacctgggtcataaagacccaaaaggaaatcaaagagtagtcacagccctgtgtttgttgccaaataatgtgtaaaccttctattaaaaatgctcagtgagtagttgtactgaaatgaattggattgagacaaaacagtattttctctccagagagaaaattagtattgattcactttctccttgaattattttctattaagaaatgtatagacaaacaagataaattatctctttttgcttataaaatattgtattggaactcctcatccagatgaatactaaggggatctttcatagttcttaagataaagattattttcactctctaggtttccacggtattcatttgggtctatttatgtcattagagtacccttcttgtttttacccaaagtccgtatcataaatgacttgtagatgttctgtgaagaataccacaagatggcagtatttcggaaatgaatccttagattacttctgtatcctatctaaaataacataatagctttggttatatttttagggactaaaaatattcagttgtcattcaagtgattaagattagtgatagataaaatctgattagtaataagtggttccttaaagaatataccataa

SEQ ID NO: 4388 - DNA, 341 bp, Homo sapiens
ttttgtgctttatcaggatggatatggggaccgagccggcgtgggagataaggagtctactttgcaaaggacacgtgtggaagcagagcgtgcatcgtccagatgggctagattctcacaggctcactgctagaacgaatatccttgagactttagatctgaaagtcagcctgatttctgaaagccttggaccgtttccaaaatcaaatcaatactccaggaacaagatctgcctcgactttgcctctacccaaggacgctatggcaacgcagttttcaaacctgctttgagaataaatggaacagggtcccctgtgtccccactcataaaaaaaaaaaaa

SEQ ID NO: 4389 - DNA, 664 bp, Homo sapiens
ctgaacggaatacctggtcatgtatatcatcagaacaattgctcatctatcagcttgtccttccaggccatgccatgggagaaggtgcaagtttgaagaatccagccaccatcacactttcctcttgttcgctgccatccgtgacttaagcatgggactggaatgttcatgagtcacaggctgggtttctgattggcattgagatcaagcaagaatttcttaaaaaccaaaatggctcataagagcagatgtgtattgattctgctatggaaagaatggcccagtgtttaatgacacagtgcctaaccttgtttataagaaaatcatcaccaaagctgctagactgattttattttagtaatctaagttggtttataactcattaacacttatgagacacttattatttagatggtactgtactatttgggggtggagggggaaaggaaagaaaaatagctttcaaatagtttcctatcacatagtaatcataacttctagtaaggcaagacaaagataaatcaagcaattaaagggaaagaacttttctgggaacaataaggtcaaactaaatggggatttcattcattctgtgcctttctgaatgcccttccctgattattgacctagaaataaaattgaaattgggccaaaaaaaaaaaaa

SEQ ID NO: 4390 - DNA, 268 bp, Homo sapiens
tataagttaggaacttggccagggttacgtggtcacatagctgggtagcaaagcactcaaaccctggtctgacactccggtacattgtacatccttgttgaaacctgctgctggaagaggggctgggaagaagccacaagatctgacaaacttcaataaaggaaggcaggacaacttccttatatattatagccaaaagtagtaatactaaaagtgaaacataaattgaaaataacaataaaaataatgcctattaaaaaaaaaaaaa

SEQ ID NO: 4391 - DNA, 404 bp, Homo sapiens
atacttttcttttttttactggtatgacaatgacaaggaggacagtctctgtgccgggatttaaacacgggttttcaggcgagcgatttctgtgtgaactgtcattaaatgtcagataatgaagacggaaccaaatcagcaaatctcaccatcccatgtcatgttctgaaaatggtgtttctctgcttgcatctctctgttcttagacctttccaacagcatctttctgtggtattaacgggttaaaatttacggagaattcgtttttcttagacgaacaattctagccttgtggaatcaatactctcttttacttaattacagaaatataattttaaacatttattttgttaagagcttcccaataaccagggattaataaaagaatgaaacaggatcggccg

SEQ ID NO: 4392 - DNA, 222 bp, Homo sapiens
ctggttcactctcagagttgatggtaaggtcagacagagccatcaagctgtacctcctgcactagaccaactgtaagagtgagacagatgccaggaagaggagcccagactgcagagtgcacatgtggatggggggtcctcatcttcttgtggaaggatgccggagaaagagaaatgaaaataaaataaatgattctaccccacaccacaaaaaaaaaaaaa

SEQ ID NO: 4393 - DNA, 629 bp, Homo sapiens
caggcattgtcctcaaccttggcacaagaaacctctaaaatgagtgagatttgcctcagtcatcatcttctatttacaaagtcattcagcagcatttgaagagcatttggaaaaaaacagaagatcaatctaagtaacacatggctgggtaacttctgttgaagcaacaatcagaacatatattacgtgttaagaattatgtatattgatatgtaaaaagagactcatttacagaaaagggaaattctttttaaagattaaactataatctaatttttaaaaattttcctaactctatgatcttgtacctctgagaaactactggaataaaatattacaaatatggctgaagccctttgtacacctaattacttacctcacttgctcctaccaaatgctactctgaatctggagtttactatcctatgcatttccttacaactttataatgctggtgtgtatatatgagaaagattaggaaagatacatatgtttttgtatgtgagtgatggtgggagattgttttgcatttaaaccctatatgaatggaatcatgctgtacatactgtcttgtaactttagattgtgcttgtttaaatgaaaataaatttgctcatataaatcctcaa

SEQ ID NO: 4394 - DNA, 791 bp, Homo sapiens
agagatggggtttcgccatgttgtccaagctggtctcgaattcttgggctcaaaccatctgcccacactggcctcccaaggtgctggggagaggggatgagatggccaggcttcccaaagccaggaagccagagtgtctggaagatcatgtggcctctgtgaagcccctgcatcgtccgtgtaccaggaggagaagcagaggaatgtacaggcaaaccctgccctcgacagaggtgctgggctggaagggaaagagcatgttgccactgggtcaggcttgaatatccgctgcctcccaggccttccattgatgggactctctgcttctcaaattcatcatatctaaatcggaattcattcttctccttcttgctcttcatctccccacctcaaactgcttttcgtcttgatctcttctcttggtaatatttcaccaaccaccccgttacccaagccaggaaccggggaagtatctcaacatgcccctctcctgcatctccaggatcagatcagtccctaaactccgttgattctagcttgcaaatagctcctagatttgctttctgtcccctcctggcacccctttggttcagaatatcaacatctatgataaagctagatctagataaagtttgtccaacctgcagcctgagggccacatgcagcccaggaccgttttgaatgcggcccaacacaaattcacaaactttcttgaaacattataaattagccaggcatggtggcatgcacctgtaatcccagcttactgggaggcttgaggatgagaatca

SEQ ID NO: 4395 - DNA, 1253 bp, Homo sapiens
atttgtgtaattttcatcttaactcaactacttttacagggcctttggattaataataaaaaagtatgctgtttgtttggaatctgataattggtctgaatactttccatcataaccagtgagagagaagagcctgttgaatcaaaatgtgaaaatgacttttaaaacgtgcatacataaaaggcacagcaaggttatctaacaatgtgtttacttagaagttccacagaagaaaccttgaagcaaatcaggtctctggaactctcttccaccaggagattgcttcaatttacagcttacctctgcctgcgatggctccagccagaccacccagtagatacgacacccgaagcaagtcacaaagcaagtcatgtagacccccatacctcattgtttcctcccctacatgccattcatgtcaaaccctacttttaaaagcccctgtcttctgcctgaagactgagatgctgccctcaaggcaggagcctatactacctgccctcagctagctttgaaatatggtcactttattttttaccagggcttcgctccttttaattggactctgcaaggcatgagcgactggactcggcattccattacaacatgatgcttaagctaataatttttttaactttccattggtgcacaagaaataatgcattggataaaaaactggacttcaaattttgaattttgaattcaaatatctttataataactttattataaaatgggctctgtgttagatgatcttgcccaattttaggctaatgtaagtgttccgtgcacatttaaggtagtctgagttaagcaatgatatttggtaggttagttggatcaaatgcatttttgacttatgatattttcaatatatgatgggtttatttggatgtaactccattgtaagataaggaatatgtatacacacacacatactatatatatgtgtatgtagtgtgtgtgtgtgtgtatggaggcagattatctcaaaaatcttgagatgttacataatttttttcttctgagaaaagtttttatttcccaaacattatgtaataacattacattctgtttttgtgtattgctttttatcagataatctgctttttaaaaaatatgtaatggcttccactttagtgaattaaggtaacaaggtgagactaagttgtttaaaaatagacctttgcctcattgtttaagcattaggaatctttaaatgtaataaaattgcttgttgttaaaaccactaa

SEQ ID NO: 4396 - DNA, 280 bp, Homo sapiens
tggacgcattctttttttatttatagaaatagatttattttaaagacttggatcccatgattattgaggttggtgagtccagcatttgcagtgtgggcacccaggagagcaaattgtgcatatgaaatctgaaggcagtctgctggagaatcctctcttgctcagggagctcattctctttgttctatccagactttgcaccaactgagttaggttgattcacattaagcagggcaatctctttgactcaaagtttaatgccaagctcatccaaaaacac

SEQ ID NO: 4397 - DNA, 166 bp, Homo sapiens
cctagataaaacctttccttcgaggtagtcactgcagactcgcccgtatggattcaccactcctaacaagccctcagaaggaatcaaacctcttgactcctagattttgtacttctgacctccagaactgtaagataataaatttctgttgtttaagccaaaaaag

SEQ ID NO: 4398 - DNA, 355 bp, Homo sapiens
acaattatgatatcttactcttggaacattcttgcctttgctgtcgaaaagaaaactatgaactcagagacattgtacttgactgtgctgatggcagtacaatcccttaccaatacaagcatatcacgagctgctcttgtttagacataggccagaatatattcagaccttcaatgtacatgttaatgcctgacatctccttcccagttttgcgagtgctatggtatttattttataagtaaggaaaaataatcgtttaagaagtgagaataaaatagcgaatgtgagcatcactcgaaaacaatgagttatcattgtgaggaattgtgttctcatgatggaggatcctaaaaac

SEQ ID NO: 4399 - DNA, 344 bp, Homo sapiens
  misc_feature (1)...(344): n = A,T,C or G
accaagtatcggcatttttgactcacagctccagaagaaataaatgaagtagccttctaatggaaatctgagaatccnttctacaggaatgaaattgacaaactgataagaaagcctggatgtcactcctttggcattggcaggagagttaaacgacatgagccctttccagcacagagaagctctcatctctgcctcatcccctaatcgcaataagaaacccaagccagacttcctcctttgctttctcaagccatttatgacctgccctgctttccccagatatctcaattatgtaagtaataaacttacctcaattatgtaagtaataaaccggaanggcg

SEQ ID NO: 4400 - DNA, 343 bp, Homo sapiens
  misc_feature (1)...(343): n = A,T,C or G
tgggcaagacatttttctgaagtgcacacttaaagctctggcgaaaggtccaaaatgatgtcctaagaaggctacaggggaaaacagacaccagttatctctgctgtttgctgtcagttgtgtctgtcttcttccatttattcattaaagaataacttatctctggtctgtaaggaggaattcagcagaatgaggaatatgtgttgtaccagggaaaaacaaaatgggaaaagcaatgaaccaaggacagtaagatgcttctactccaaagcaactggggagagaaagcattgcaaatttaaataaattctgatanggccgtttaaannnnaaagncnntaaa

SEQ ID NO: 4401 - DNA, 333 bp, Homo sapiens
atcgcttttatttatagaaatagatttattttaaagacttggatcccatgattattgaggttggtgagtccagcatttgcagtgtgggccagcagcttgagacccaggagagctgatggtaaagttcccattggaaggctagcaggtggacacccaggagagcaaattgtgcatatgaaatctgaaggcagtctgctggagaatcctctcttgctcagggagctcattctttttgttctatccagactttgcaccaactgagttaggttgattcacattaagcagggcaatctcttttactcaaagtttaatgccaagctcatccaaaaacac

SEQ ID NO: 4402 - DNA, 176 bp, Homo sapiens
tttttttttttttaacagtttacatggcagtttattaaggatagaggagtaaatggagacttctgggagacacggggagcatccatgctcaggaacatagcacgtctcctgaattcactgaattcactgaaaacagccgtcacccaatccacagcagcttctcctgtcctcaaaca

SEQ ID NO: 4403 - DNA, 1279 bp, Homo sapiens
cctaggcccagcacaaaactattaaaatagaaagatgcactggaaacttgttaaaaatggcaaggaagatattattcaagaccattacaattagggacaaagactattggaattaaagttaagcttgaactcaacttccctgaaacaaaaagtaggaggattttttaaatgctcagataaattctttccttcgaggagtcactgcagactcgcccgtatggattcaccactgctaacaagccctcagaaggaatcaaacctcttgactccttgattttgtacttctgacctccagaactgtgtggtcatcttgctcagaaaaacaagaaacaaaaattgaaacaaaacctatggctggtgaggaaaattgacttcctggcaaagtgatatcaggaaacccatttgtctgcaaaaggaaacaactctatctgcatggcaaagatgtctgctgtaaccacaggaaaagagtcaagggaatgtccatgtatgggttctgcaatgctacagaagaatatttccttttgctcttttatttttacctatatctagcttatacattataaaattggttccatgactaaaatgagtcacatctaaattctactacaaaatgagtccattcttgcacatcttctgataccaattataacatttggtggaagtccaaattggcaaacgtgttttttcttcccagtaaccttttgtgccacgttgaatttaaagagcatttatcttctgaaatctcctaaagttcctcaaggcaggaaaaaaaaaagattgtactcttattccagaaaggaaaccccaaaagtgaaaagaaccaacagaagaatcaggatgaattccttaattcctgccagtgtgccatttagcaaattggttgaaatctgggaataattatttgcattatgtttgatgtggctaaaatttttacttcttaataaatattcttgaaaagcaaaaaggatttcaatatcattatgattctatccatatatatcctcctgtagttcccataattcccatgtgttatgcgagggacctggtgggagatgattgaatcataggggcaggtctttaccatcctgttctcatgatagtgaatgggtcttataagatctgatggttttaaaaataggaatttccctgcacaagatctctctttgcctgctgccaccacgtaagatgtggcttgcttctccttgccttccaccatgattgtgagggccccccagctgtgtggaactgtaagtccaatcaataaacccagatcggcagg

SEQ ID NO: 4404 - DNA, 472 bp, Homo sapiens
ttttgcccataatcaaaactttattgaaaaactgacaccaaaataggagattactgctgtataccttacaaaaccaaatgtaattacattatcttggtaaattaattagaattatggaatttatgataaggctttctgtgagacaacacaaaattaaaattcaggaagctgtttgaatcattagtgttgctttcttctaaatgaacacccttctgtgagtctggcctttcctcctgtaggctggcacaacactgttgaacaacctacacaaagaaccactgtctgagcatggctgaaaaccgtggtgatcttgtagcaacctggacattttacatccataaagtaagaatttggactttgtactaggcgtttctttttatgttttttcttttcctcttccaaggacggatgtagtaaatctctagccaactgaacaaagaagaagaagtttaagagagccactgcagcttcg

SEQ ID NO: 4405 - DNA, 892 bp, Homo sapiens
ctagggacggacctgtgacccagtctgcaccagtcagaatgtcctgccagggaatgtgggtcttgagctgagtgatgccaggatgaagcatggtggagggtgattcgtccaggcagcggcctctggaggagacagccctttggttcccacaccctagatcccagcgtctgctctgagtctcatcctttcagcttcctcccagattatcagctgcctcccgtcttccattcgattctttttctgctcaagttggccagattgtttctactgattttgaccgaagcacctggactaacgcgcatcctaagggtggggagaaggggggctgtgcttattcctcagccagtgcgtctcattttcactccttcttcccaactgtagcactttctgttcacggactggggaggagctaagtgagaaaagcaggatcctattatccacacattttagggccagagaatgtggtcttcaaattgttaaagagaactaaatatggcctaagaaggactccgtacttgtatatttgagtccttgtggacaaactgcaaggtagcttaataggtagacaagattgaaaacctaccttaggagtatgtgcctgtaacaacggctgagtcttggccaatcccagcggccgtacttcaaccattcacacactgctgagtgttcaaactgttcaaatcaggcaaacaccaacttttaactaatccagtccttgtatatcccacttccgatttctgtatgttatttgccttttttttgtctataaatcttcttccaccacgtggctgcgctggagtctgtgaatctgctgtgattctgggggctacccgattcacaaatcgttcattgctcaattaaacttctttacatttaaaaaaaaaaaaaaaaa

SEQ ID NO: 4406 - DNA, 687 bp, Homo sapiens
ccttggcaagtctaagaaagtcaatgaaggaatacagcaagtcaccttgaggcacctgctgcttccaaggctcctgcaagctgagcccctggctcactttcaactctgattctcaccacggctcttgcatatctcaatgccaaggtcaatgctgcctcaggccctttgcacttgctgtgccctttgcctgaattgtttttcccataaacccccatgtggctcttcttatactcccttgagctcaaatgtcaccttatcagagaggcatttcccagttaccttatcaaaacattctttccagtacctgttaccttgattctctttactttttttttttttttttttttttgagatggagtctggctctgtcacccaggctggagtgcagtggcgtgatctcagctcactgcaacctgcatctcccgggttcaagtgattctcctgcttcagcctcctgagtggctgggactataggcgtgtgtcaccatgcctgcttaatttttgtatttttagtagagatagggtttcactatgttggtcaggctggtctcaaactcctgacctcaggtgatctgccccccttggactcccaaagtactgggattacaggcatgagccattacactggaccctctttaccatttcaaaatttaaagttttcataatattcaaaaaaaaaaaaaaaaa

SEQ ID NO: 4407 - DNA, 1323 bp, Homo sapiens
  misc_feature (1)...(1323): n = A,T,C or G
ctaggtaggagaaggaggtttggggatctaagagtgacaggagacttgtaccccatccttgtctggaacaccaggagggaaggtccttcacaggagttgcgactggcatcacagcatcatgggaccagtgaagatgaagtaggagagctgaggcaatcccaccaatttcctgtagctccagagagcaacggaggagaagatgaaattaccctgaaaagtacacagctagtcttactctgtcgcgtccaggctggagtgcagtggcatgatctcagctcactgcagcctccgcttcccaggttcaatgattctcctgcttcagcctcccgagtagctgggatcacaggcatgtgccaccatgcctggctaaaatttgtatttttaaaagagatggggtttcaccatgttgaccaggctggtcttgaaatcctgacctcaagtgatccgtccaactgggcctcccaaagtgctaggattacatgcgtaagccaccatgcccggctgattntcttgatatacaaaaaactttcagtacctttttaaaaagtttactttttattanacaaggagaactatancatagtaatgtgcagttcacccacctggaatataccctcatttctggaattttacactggaataaagagagcaaataaaataaagtggtcaaaaattcaatctgtggtaaaaaaaaacaccatacctaagtgacacttttattgctgagaaaacatttggctgaaagatctgaatttacaatatattagttaaatcttaacatatcatcctttctttttccaaattgcagcgtcatagaattgacatgctagctgtcctttccttctttgcctagatcacgagaaactgtgcatgcaaatcattcactggttccaagagtttcccctctaataagtcagactacaaagaaacccattctacccacctttcccttctctttctcccattaataatcaatattagccaaccccatttaattttaaagaatcgcctttgaattatttttcaggaatagacaaaactaacggtaagaggtcaacatcctcaaagccactgttacgtattccaggctttagtacattattcctaatggtgtcccagaagtctagatattttcaacttaggatgattaataaacattaacaaattttttagcctagtgtggtgggatgtgcctgcagtcccagctacacaagaggctgaggcaggaagatggcttgagctcaggagttaagggatgtaatatgctataatcccacctgtgaatacccactgtgaaataaagaaaaagtgaagaaattaaaa

SEQ ID NO: 4408 - DNA, 945 bp, Homo sapiens
aaggttcactggaaacaacttctaagaagatgcttagcatacaagaagatttttaggggctgctgtctggaacaaaagccattaaaggataagcaaagcaagattggacagaggaagaagttaagctgaaatacattgtacacagagggtcagcccatccctctggcagctctgaagctgaccttcaaagctgtctcacatggaagcaaagagtctaagatttttactccctcaacacccactcagtggacctggctgtcccagggagtgaaacatttccttgaatgaagcagctcccttttgccaagggaaacccggggaggtcactgtgctgcgaacactcagggtggccctcccagaaattgagaaaaacgggtgcctccaccctcccagcaactgagaaagcagatgcccccaccgccaagggtgcattgggggctgcattcactacaatttttcaaaataaaatggataaactgagggaaaatatttgatacacatatacttaatataactaattacattaagacatggtggaagaaatatgaaaaaatgtaaagtgtaaaaacaaagaaaattaaaaaatataaaattgtattaaatagaataataaaatatatcttttcttcatgtatcttatataaccgttgaaaaattcattcataggcaacgttagcacacatgttgcacgtttggtaattttgataaaattaactactatctctagtaataagcatacagaatattttattttctccatcttagattgtcatagatttattttgacttttgaccaaaatttgaaaaacaaatagctgttcatgacttaaagtgatgaaactttctttaattctatatatctttaatgaatgtataagttctgtaaattcaataaaattttgtgctataaaaaaaaaaaatcgtcctcgtgacatcagcggggag

SEQ ID NO: 4409 - DNA, 591 bp, Homo sapiens
agggatatctttactcttagatggctcaaaagaaagacgatccttccgacttgtgtccttccaagggtggtccgcagcattacagaagtcaacctactgtgtctcacgtcactgttgaattagaagggttactgagggtggaggttcaaagttggagttatcctcaatatccctctcaccttgatcttcaaaataattatggtatttgcatgcgacattttgaaatattagacatgtccatctgtcaatatggaatgtggttatccatcattttattctactttttcttcttctccttaaatattgaaaaaccgagtctcactctgtcgcccaggctggagtacagtggcacaatcttggctcaccgcaacctccacctcccaggttcaagtgattctcctgtttcagcctcccaagtagctgggactgcaggcacggtggctcacgtctgaaatcccagcactttgggaggccaagatgggcgaatcacctgaggttggcagttcgagaccagcctgaccaacatagagaaacacgatctctactaaaaatacaaaaaaaaaaaatcgtcctcgtggcatcagcggtgag

SEQ ID NO: 4410 - DNA, 698 bp, Homo sapiens
gaggacatggaacttggagaagacatacaggctgaagaaaaaaaaatattttggaagtgatcagcacattctaattgaccatggatgctctctgcattcatgtggtaacccagggagagtatggagtgaaaagaggatcaccaaagaaacttggggtatctcaacatttaggaagtgtgcagagaagatgagatcattaaaatgtaccaagaggttatatttaaatgttagagggaaatcaaaagaatggcaccacaaaaatcaagggttgggcttctttataattgtttggctgagtttttagatggtgaacttagaacgtacaacttgagggagtcatttataggaagtgataacccaaatattgtaacgtaacttcaattactgatgctaataaaattttcagagtgtgatcactcttggcggatgtttgggcaatggaaccaggctgcctgggtgcaagtcacttattatgtgacttagaacttgtcacctaagcattctacctatcagtttcctcattcctgaaaatgcagaagatgatagtgctgaactcatgatgttattatgaggattaaatgagctaatatatgtgaaagcttaagaacagcacctgacatataatcatataataaataacatataataaatgtttatataattgttagccattaaaaaaaaaaaaaaaaaaaaaaaaa

SEQ ID NO: 4411 - DNA, 795 bp, Homo sapiens
cctagatcacatcactccaggatggatccagattccatgtgatgaggcaggtctgtgaagagacccacgtggcaggaacagagggctgtggcctgcccaaatccacctgcgtggctttgaaagtgaattctctcaagttgtgtcctcaagcgaaatttcggccctgacaactgcaactgcctaagtggccttgagccagaggcacccagccaagctgctcctaaggtttcaggcccacagaaatagtgagataataaatgtttgtattttacaccattacattgtggggtaatttgctacacagcaatagataactactacacagtcaaactggaatgaccatctatgggtctgtatgggtttgcctctctctactgagtggggcagatggccatggtatccagaaaaatactcttccttagataaaataggcatcccaaggccttttcacactgggtcataaatgtacatttagtggatcatttccatcactaaaatgtaagatccacaaggaaacttgcatacttgtaataactcatatactgtaagcccgtgcccagcatgtagttaagcattgtatgttcaccgacttcctttatctttcgaacaatcctatgataaatgtattattataatggccattttgcagatgtgaaactgaggcggagaagaattaggttgcccaaagtgatgtcatgtgtaaatggaggaggcaggatttgaacccaggcagtttggcttcggagttcttaataaatatttgggttggagtaaatgagggagtaaaactgaaaa

SEQ ID NO: 4412 - DNA, 1258 bp, Homo sapiens
  misc_feature (1)...(1258): n = A,T,C or G
cctagagtcaacaaaatttttcttttaagctatttatagcttgaacaattgagtaaattacactcctatgaacaaaatttggagcatttttgtttctctctacctgacttccccagaatttggaaactagttggttcacagcgaaataaagactttccaagacaaaagctgagagatattatccatgctagacctggcctacaagaaatgctaaagggagttcttcaacctgaaagaaaaggtgtcaactaggaataagaaaccatccaaagttataaaactcactggtaatagtatatgcacagagaatattataacactgtcattgtaatgtgtaaacggctcgtatcttgaatagaaaggctaaaaggaaaaactactaaaagtgataactacaacaactttacatgacaaaaatagaaaactattatgtaaatagaaacagttaaaaagaagttaaagtgtagagttattagttttctctctgcttgtttcatagtgtggttgtttttgaaatcaatgttaagtcatcatcaagttaaaaataatggggtataagatgttatttgcaagtctcatgataaccctcaaaaagcctacaatggacacaggaaaaaaaagaaagaaagtaaaacactggccgagaaaatcatcttcacaaaaaggaaaacaggaaggaaggaaggcagataagtcccacaaaacaactagaanacaaataacaaaatggcaggagtaagttcttacttatctataataacattgaatataaatggactaaattctccaatcaaaagacaaaatggctgaatggatgaaaaacaaaaaccaagacttaacaacatgttggctacaagaaacacatttcactcttcatactatcaaaagtcctatcattttcaatgctttgtcctatttaagtatactttttagctagctaaggttgtaactattattagaggcaaaaagaaaattaaaatagtgagtatattatgcctcagaaatgtctaatagaaaagctttagcagctgaacaaagtctctctgaaagttttttttattgacctgtgttagaataatagcatcaatattcatttttctgggtgtagtatagagtgatagttaagagcagggtttttggaatcagacaacactttattataatattgaaaaaattatttaaactgtctaataaactttcagaatctcaaaaaaaaaaaatcgtcctcgttggcatcagcggtggagcgttcgaccag

SEQ ID NO: 4413 - DNA, 693 bp, Homo sapiens
cctagatctcacattcatcctgtagaactacaactgtattcaagaggtacctttaacatctctgttcctatttcagtgagcctcaggattcactatggacttctcacctcctccatttcaatgaatttctgtgattcgtaggatgcccacagcaacagataagaaagcagatgcagaaaccaaaatacttttgctctgggataagaagtcacaattatttctcatcagtgctgcttcactagctcccattttttccagagctctggagcctgcttgtttacctggacttagaggagttaaaagtactcgataaattataaatgcctgcagggaaagacaagatgttaatcaatttgtattctctgaatctagctcagtgcttgaataaggtgtccagtaaaagctgtaaaaagaatgcatgttgaaatcttgctcctgcgtgccttcgatgaactatcttgtgaacttcctgactaaagagcaatattatgtataagtacctggttacttagcaggacactgattactaacactgtgtttctgactatggcaatatgacctgaatttaacttgtataattgaaaattaatagcatggcttgaaacaatgcttaagcataaacacaaaattaacatttgtcaaactagacgggaaaagaaaaaaaacatatttttttaatttgttctggtaaaa

SEQ ID NO: 4414 - DNA, 641 bp, Homo sapiens
agtggatgtcagtctttattacacatgatctttattcctgagtgctcaataaatgacttgtgctgactttcaactcacagaatatttagtaatatttaaaagtgagatgaaactcattggacaattttaagaaagaaataatatgacaagaggttgttggtatattgcttaatgatatgagacccagagttacattgcctgggtttgaaatactgactgtttaatttggacaactacttgacctttttgtggttcagacttgatgcaaataaaattagactttttgatagtgttgttttgaggaataagtaaaaaaaggtaaaagaaatggcctggcgcggtggctcatgactgtaatcccagcactgtggagtggattacctgaggtcaggagttcgagaccagcctggccaacacggtgaaaccctgtctctactaaaaatacaaacattagccaggcatggtggcacacgcctataatcccaacttcttgggaggttgaggcgtcagaattgcttgagcccgggagttggcggttacagtgagccgagatcatgccactgcacttcacccttgcacacaacgagactttgtcttaaaacaagaattaaacaaaccaaatatgaggaaaaaaaaaaaaa

SEQ ID NO: 4415 - DNA, 1296 bp, Homo sapiens
caggttcctgacttgtcatctcaacaagactgcactttgcttgaggacccttctctgatccacaatcatgaaagtacctctgagcagaaaaccagggctactggaggcctcacctcatttgattccattctctgaggagacacaatcttgagctttccgttatcaaatgtcatgtctacttacctagtttttttatgaagggagggcaaatctggagctgatcaccctgttatagacagaagcagaagtctgatttggtccttggaatgttgcttttccgcaccagagtgcaataggttttttttttttttttaattaaaaaagaagaaacccaacaaaataaaatctaaaaacaatctcaacaaaatttccgtatctcaaaaagacaaggcaacacttaaattatcataagagcaatacgggctcagttcagaaaggaagataacaagggcctagagtggtccaggaagagtcaacagaagagaattgtgcaaagctcagagagataaatttgataaaaaatacttaaaaataataaagccaaatttgtgtgtgtgtttgtgtgtttgagagagaatatgttccaattttgctgaagcataatggtcttacaggaaaatagatggtgatccagctagaattataagctggggcaatagtaaagggttttaaagattaaatgtggagaaaaggacattctgagtatttgcagaagctgccatttctaactgggaatcaagtccttctgtctgcttgagccattgagtcaattctggagcacaaggagaggtgtcagttcccgaaaacacttttttgttaacggtgccatcttcatccttcagtctgttttaccctggcaatgtcaagtagtaataagcatatcttaaaataacaataacctttcaatacaaaaggttcttaatgtaccctttgctcattgcttaaataagtattgtaccagcactcactccataatgtgctgaaaggcagctatttagggaaagcaagaaaaacccaacaactatttactgactccaagtaatagcaagagtagaaaaggtatctcttttggaacacatggacacatagaggggaagaacacaaactgggtctttcggagggtggagggtgagaagagaagaaggatcataaaaaataactaatgggtactaggcttaatacccgggtgatggaataatctgtacaacaaaccccatgatacatgtttacctatgtaacaaacctgcactcgtacccctgaacttaaaataaaagttaaaaacaaaaaaaaaaaaa

SEQ ID NO: 4416 - DNA, 775 bp, Homo sapiens
gtagggccaccagagaaagccatatatgcacccttaaccaatgaaaaaggatgccctgtttctgataagcccacccacagctctcccatgccaatagcctccaatcagcgctcatctgaagcctacctatcctcacccatcatgaagcttcaccactgcttcgtctactttgagtcgctgcttaaacacaagtgacggtggttgacccctttggcatagcaagctctgaaaaaaatagactttgcttttctcattgggacttcatttattcctgtgggagaaaaagagaaattaaaagaaaaagcaggcttataaaacaataaaaaatgaaattagcatgtcttgtcattcctcatatcatgattgccacagacacacactcaacctctcagaaatgagggtttgtagtgagattacaaagttcagtttccttttgttatatcctctacctaagcttcctaataatttatataacgaaatcttcagaattcatcattttttggggcaggggagacagggtcccactgtgttgcccaggttgaagtgcagtggtgcaatagtagctcactgcagtctaccttcctgagttgaggtagacttaatcacacaaaacaaaaacacttgagtttccctattctcgccgagtcataaggatatctcatttatagctaatatataaaaaatctataaattgtagtctacggtgatgttccgtcatttgtcgacattttccccctcactcgattaacaccagctaccccttgaaatgtagtcg

SEQ ID NO: 4417 - DNA, 810 bp, Homo sapiens
  misc_feature (1)...(810): n = A,T,C or G
tagggcctgtcctttgtgcattgcatgtgagaggagcatacttcacatcctgataatgttgtgcctgaccatgtgatctctttggcaaagaacatgagcagagtgatatatgtttcttctgggcagaggccttaggagccatcacactcttctgcagttcctcttggccttctgccatgaggatggcatgtccccagtaggggctgttcttttattctggactgcaggacttacgaagcagaaccacagccaatatacttgttgcaatatacttgttgctgtaaatccctgggatttggatggtgtctgttgccacagcataacttaccaaacccaagaagagaagtaggtggacacaaatgactactgagatgtgtggagaagaattgcctagcacacaaccaccaatgctgctgaaggcaggagaaattgccagatccacacagcaggataaagacatttaaactaaggagagactggtgtgatcgattcatgcatctggtacacaggctgtcatggagggatcctgctataccttaattcacacattntttctcggtcttttgaaaaatgaaaatctgccttacaattggtgatgtcttagaatctatgcaacgttgtaattggctccacgttgaagttccacgttttattggagaagatcctatcccgtttcacatgccaaattatttgtgcccatttttcaggcatgttgatttaaatctggcgaaggatctgcccacggcaaggcagcttattgaagaaaatgactctggatgtatatccttcaaataaagataaatttgtgcc

SEQ ID NO: 4418 - DNA, 1145 bp, Homo sapiens
ttagtttactcttgttgctcaggctggagcgcaatggtgggatctcggctcacaacaacctccacctcccggattcaagccattctcctgcttcagcctccggagtagctgggtttacaggcatgcaccatcacgcccggctaattttgtattttttttggctgtgaattctaaatcaagaaggctgatattgaaatctacatacatttcagtatcagcaagaattatggtttgatgaaaggatcacaccttctggttaaaatacagtggataaaaacatgagacagtgaagtctcatacgacactgctgagagtaataagcttaggagacatcagcaggaagaagaccatgggctagctcaagtatgacagatcagtgagaatgggattacttctaaaactgtcagacttgcgtgggaggcttccatgctcctctgcataaattcttggctgactgatggaaagttctatagtcaaaggataaaagtatcatctctagagcttgagtacctagtacaactggggaactaattcaaaatatacagcaaaagcaatccatgagaacccagccaaaggaagatgaagaaaagtgagctatgcaagaacagtattccatgaaaatgaaggtcggcttcacaggaaaaacatctcgacaggatttgcatattaaggaagtatcctgacttccaaactttttgttccaaagaccaattaaactgcagaaagagaatgcacgtgatttaggaagccattttgctgggtcctccaggggagaaagaagacgaacaaaaaaaatcctgctttgtggtcttattgagatacagaaaagttgtatctgccaatggataggagcccatacatgcacattcactatttcaatatccaagcaatcacttgcaccttattccagatagcaaaccagagtggtttgtttgaaaatcttattttctgaatgcaaagaaaatgtcacctatgattggaccacattagctaactagaaaatgactgcctttccttatgcctactcaggaacacacttccatcattatagggttttatccctcaccaggagctaggatgaatcctgtctatgtggaatcaaatacatatagacagaagtaaataaaatatcaaagtaaataaaa

SEQ ID NO: 4419 - DNA, 794 bp, Homo sapiens
  misc_feature (1)...(794): n = A,T,C or G
cctggccgaacagctccaccgcttagccacgaggccgattttttttttttgagacagggtcttgccccttcagccaggtctcagaacacgtgttgtgatcatagcacacatgtggccctgatctcccaggctcaaaacatcctcccacttcagactcctgagtagctgggactacagacgcatgccaccacacctggcctattttttctaacacgcctggcctaaatttttgtttaatcaaagtcaggctaccagagggaatggtggaaggatgttaactgtagataaaaataagaaagctaagaagtataattatgaagagacaggtcagaaattctaagcaaacacaccaggattttattgggttttttttactttctatgaatactgccctagactaatggaatattgattaactgtactaaagggggtgcatcacccactggggagagcgcatttgttgcctgagtttcagatagaaggaacactggtggatggccccagggggaaagaaatgggtcctgggctgtttggctgagataaaatgcgcgcctgccgacctactatcctacgcgggagccgcggatttcgctcctaggtgcgagtatcgccgggctctgcgctgggtcggaggtttgtggttttaatctcatcgccggttttgtcacataccattgctagttcgcttgcccctccggtccactaaaccgttggcgnctacgcgtgttgtggtagatggcaagtcgtgtgggtagacctcgcttggtgatgtctctggtatcggagcgataata

SEQ ID NO: 4420 - DNA, 835 bp, Homo sapiens
  misc_feature (1)...(835): n = A,T,C or G
aaactggaccttgaagacctctattgtcacctctatcattatttctgctccaatgacaatggagagcatactgtcaaagtcctccagctaacctttgaatgagagaaacttctgctgatgtcaaatgaccacaaggatattaacaactggacttggagcctgtcggccgctgttggatacacctcctttaccaaggcggctttcttcactactgccactgaccttgcaaacagctccgacaaaggtcggaatggattcattgatcagctagaccgagcatatgacagtctgtgccttaattgaatcccaaaagggggcagactgggtttttattacagaggccagccgatagcactcattaaaagctccacagactgtgtggtttactaattagtttattatacagacaccttgacgatgggcaaagttgtcattttgccctttatcgcacaggggatgttgttaaaagtttaaccagcttacactgaccaagttagcttggccggctgtggatggtcattactgaggtcgcccctgctgttgccnttctgaccgggtcacagcatgatcttacacttaagagagtgtctcttctggtctgagcgctcctgtcagggaccccacataagagttgtgctctgcggggcgcttgaaaccgatgggctgctccgccttgtgaatccttttccgctttccttcgcctgcctgtttccctttgctttctccctcgattcggcctccgcctgtcgctttggtgtgtgtctcccactcaccttggggacccgtctttctttcgggcggcctctgcggtcacccagataaaaaaacaaaacag

SEQ ID NO: 4421 - DNA, 815 bp, Homo sapiens
agggttctacaaggaaggtttatgaaaaccttgagcataaaaatgcagaataatcatatccttatagattgtatcaagacgacagaaattgtatgctcagacccctgaccatcgcctcagctcatcattgcgtcatctggatggcttccctaagctcccacctgggcccagaaaggaaacggcttatgacctgcagtctttgactatcaccatctccattctatttatggccctgctgcacctctgtgcaaataggagaaggtgaccctcttgtggggatggaggagaaggacaaaccaggccgtgatctggccagtaaagtgggactgggctggctcctggtgggctttggtaaggtgtaacctgcaccattggtcattactgcccaaaatgagagccatcagtttgctaaaaatcgcttagcccggaccgccactcttgggtgaagatgcttctttacagatccccgcctacccacctgcaaggcttcgcaagaagtcctgagaagaaccaagaatggaggttgatgcttttaagtgatcactgagcagccaatgggtagggctcgatccctacacttaccaccttatttctgcatttgtggttgaggaatctctcgttgagccccacaaaatctagagtctgccgcattattgcgtcctgccttttgacatgggaaatcggcaaataatatatacctttatacgttgcccagtccttccacatgattatcttgttgtgtgttgcgcctgtaatttattataattatgcctaaaaccgctttaatttcgcagtttctgttaataaacacaatt

SEQ ID NO: 4422 - DNA, 1082 bp, Homo sapiens
gctagggcactcagaacatacattctaagggaaagattcacttaaaaaccagccaagacacagtcatataattgggatctccagggccctgagtaaagacagtctcctcccacttcatcgtcggtaaatcaaactctccacagatgggcatttccaggttttcctgtgagtttcttgcacctacagagcctggccaaatactacaatcctgaaggcccagaaacactgggaatgcacaagggagttcgactaaacatgaggctctgcgccttctcactcgtcttcagaatagtttgtggaaagtccccttgccctctgccccagctcgggtatgccacctgccctcagtccagccttggtggcctcaaccaaatttagatgcgtaatgccacgtgcggttaatggatggtaccaaaagggcgcgcggcttctatctccgccagcgccgctttattacctctgacaaccactcgaggctgggaagagacctgtgtcgtttccactcagctccagcccagcaactaagtacattcatactagggacatcaatctcagatgccaaagcctggagatttgcattgcaaataggcgaacgtggtgacatttcaccactgggagcagaacctgaggcatcttcctctgtgagagctatggggggggaatccactttgtagtcaaattgagtgcagaaggaaggcaagagggagggcagaaattggaccactctaattttgaacgacagaaagaatattgatttttgaaatattgcggtcacttttattttttcccaaaccatgggcttttcctccagtactgagatcagctttctgcatttccgctcccaacccataaacccatagctgaggcccagcttgtgtatatgtatcctatggactgccttttcctgacccgtgtcttctggaagggtttacttaattatttttttcaattcttatgtcccattcagatgtctcacttctgtaattctctatcatttaaaatctttaacaaggattcttatacaaaatggtgataaacatagaatacttttatttgagcattaaataagttactgtataaaa

SEQ ID NO: 4423 - DNA, 1272 bp, Homo sapiens
gctagaaggaatctaactaaaatgcagattcttccttgcaacagtgtggctcccaagattctgcgccaaggtgacaactgatactgatgttccacgaccacacctttgagttactaaatgcaaatagaaaaaaatacatattttagattgctaaaattaaatgaaatttaccttttgaaaccctcatttccattcatggtcacttgcaatttaaaatgtactatcctttgggtaatgactgagtcaaatgcgtagctctccttctctttctctttcctggggtggtttcagtcgtgaggtgataggggaaacgtccacgtggctcaggtctcatttgtgtgccttttctctgtgtcctgatggcatctgctttgctttccccatgttctcatcagcgtgggcttctgtctctgagtctgtgaccttcacagcatggtcagttgctaggaccatctcatctaaatccttcttgtctcaggctcagaacctttgtttcatctgactttcctcaggacttctgaacctcatgaaatccatagctgtttaccctccatgatcctaatgtctcttaactttagcaagcttctcttggaactaacaaacttgtcctgcctggctagagcttcatgacttcttcaaaatcctcatagtttcctagactatgatgaggatgaatgggggctgtaagggaaaactctgctgcccccaagtccttctaaccctatctttggttttatcttctacagtttctactggccctcccctgagactcacttaggatacagtcatgacttgtagtcctgtcagagaaattcacgcacccttaaggtctctgtctttatttaaaatttggatacttcatttgtcgtggatttttttgaaacattgcattaaaatattacttatcttgattactgaattttttggtaccccttaaatgtagcacccaagacaagtgcctttcttgcctactgccagcaagctcgcttcttccaatattctccagtcttctccataacctttgaattataacctcatttgagtgggaaaccagcacttaaattatcatttgtcatcattacctacatttgcttgtggatgatcttactgctttgctccctttggagcctggctttctgactctcaagatcctttatctctttcagaaaatgaacaaacaaaaaaatacctggcacattaaatgtattgacttttataactattgttttctgccacaagtttttctaaataaatatatttggcggctcaaaa

SEQ ID NO: 4424 - DNA, 780 bp, Homo sapiens
cctactgctgtggtctgtgtgacacttctcgacagactcgactgtgatcagatcaacttgcctcatgatgtcctgtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattgggcaagtgacagaaactgatcatccatattcaaaatatttacagaaaaaagtgtcagtgaaatgtaggtctatatggaaaagttaccattaagaaaatatggccatactgcttttttacccctgcactatttcagtgcaccacaggataggattcgagatttacatatgcctgtttgtgattttatctcaaaatataacaactctggaatacattttccttctcactgaaacccttagt

SEQ ID NO: 4425 - DNA, 815 bp, Homo sapiens
  misc_feature (1)...(815): n = A,T,C or G
ctggcaattcttttacaaggcatgtggagacattctgacctttgcaattcaatggcctgggacagaagtggtgaccatgggaactgtttacatcaccgttcgatgacatgaggcactgaggagtaagacagcaacagttctcactttcttctttagtaaacataattntgggggggtgaaaggctttttgtagaaatctttaaaatgtattatgcatatgtgaatgtacatgagaaatttataatctgggaaatctgagtatacagattcttgcataatatacatcagctaattgcatctgtttccaattgtatggtgtgtgataaaaaaaaatgctgtacttatatggggaaatttgaccaaggtgtcccagaacatgtctctgtttaacagaatgcatttggaaaaaaaaaacaaaaacacaaaccttgggatttcttacccactatcataaatgttgaagacagacatctttttttaactctacaatacggtctgcctgtgctttagatgctatctaaagtagaactacatgtgagaagagagaacagctgttaatacatgaatgatgaataagacttcatcatgatgaagtttctgttttggaagatttccgaccgcccactctgatttctgttttgagacttgcctctcaaaactaaggaatcaacagccataccaatacctcttagtaccctgacaatggagtaggacaagtgacattttgactcatcagtctccaaacacttttccttacagtggacctttgtttctatgcaaggactaagggaagggtaaaatgcaatttattactt

SEQ ID NO: 4426 - DNA, 775 bp, Homo sapiens
agagcacgcggggcccattctctttcattctcttcagatattgctacaggctcggataagaattaataatgggatgctgctgtccctggccatcaaaaagaaaggatagaacctcaaaggagcactcaaaggagccataaagatcccttggaactgccttctaaacattttacagatgagaaacttaaagccaagagtcaagtgacaagtcaaacatcgtcactggatgtcaacgctggaacaaggatctcccacctccagttttaaaactgttttgcactctttcattgttcctacagatttttttaccttaaacaagcagtgttgacttttttttccttctgattgagctttggttaacaggaaaacttgatttaaccaactttcctggttaatggaggtctctccttaccacactccaacctcacaccctgtcactagcaggctccaggaagagtcgccttgaatgacagggatgagtcatggaccataaatggtgcttagcaggaaaggtaccgaaaaagtacggaaaagtactgttacccctcactatgatatatccaagcaatataacctttttttttttttttttttttttgaggagtctcgctctgtcgtccaggctggagtgcagtggcatgatctctgctcactgcaaaatccacctttcagggtcaagctattttcctgcctaaggctccctaatagctgggattacaggtgcccaccaccatggtcttggaacttctggtcttaagtgatccacttgcctaag

SEQ ID NO: 4427 - DNA, 827 bp, Homo sapiens
aggaagcacagtcgtctacatttttgctggaaatatggaaaagcactatggctaatggaatgacttgatgccaatgatctacccttcagctaagccatcaggctctgctcctcactctgacagcagtggactcagcccatggcaccacccccacttccagcatcacctgcagggcctgggccagtggttctttgtgtgccatccattttctgccttttcttagatgaatccaactagtaattgattttgttattcagagaatcctagaatcctagtgttggatggaggcttacagatcagcctcttcacaaatttctcctagcatggagatctgagtattgcttgaacatgttttgaagaagcactctctcctcttctaggctttctattccatgtttgtttattgtctcacaccagtcaggaaatggggctacagcggtaaacaaaattgcctctgcagagcttggaattgagtacagaagaagaatcaccccgtaattgcaaagatgttgaaagttcatcagcattgttcactaccgtctttcctaggttgtatctgaatcaaacccacatgtcatgaacacccactcatgtcttcatctgcctgctgaaatttccaggtggtattcttcttctatatgatggcttctgggccacaataaaagagttcttgcccatttcagggggtttaatttctttacttccaccagccctgaaaccttgacaggaattgacttgcaccataaatgcctggctttataaagaatataacctttggcattggaagctggactttggacctaactgaagttggcaaaacctctggc

SEQ ID NO: 4428 - DNA, 878 bp, Homo sapiens
  misc_feature (1)...(878): n = A,T,C or G
ctggtgatactcagtatatttcggcatgtcttcagggaatgtcccagtatgtaataggacactgactttataataagagatttaccaaggctacgcttccagattcgtcatagcttcaccactcctacaaagagatcatgagcctgttttttcatcttagtccacattcttcatcatcgccaagcctcttccaccttacctccagagcttgggagaaacaaagtgtcctctgtctgcctaggttgctcaggctcccagtggaaagcttattcctgacttagcaatggacataattcagaagaaagtggggagtaattgctccaggaggagcaagacggtgggatagaagacttgatcaatcatcctccaaacaaggacatcaatttagcaactatctacacaagaaaagcattttcataagaactatacatccggccctctttccagaccctagctctgaactacatttttggacacaccctgngccagagaggaacttgctactttgaagggaaggatgcagtgggggcaggatatgtcacctgctaactacagagaccttgngccctgaataaccagcagtgatacccaggtagtatattaagagccttggatgaagctctgggaattgctggctttaggtgagactcaactgtggtgactatggggagacttctgcttgagaaaaggagagagaaaagtaaggggactttgtttgtaccttaggtaccagctcaactacagaggggaagagcacaaagtgggctcttgaaggcccccatgccaaactttggcttttagatggcactttctggacccttctctgggcccaaaggggctttccctgcccctggagggtgagtcccagtccaaatgat

SEQ ID NO: 4429 - DNA, 807 bp, Homo sapiens
tcaggttcctacattgtttcttgttggtaacagctcagtgacttcatttgattcaggtgaaagcagattggacggaagtttgcgtgttctattcagaatccttcacatattcaggactttgacagattcataggtcagtgccttctggagcttgtccaactagagaagttgctgtccatgcaaaatggggctgctcattaggctggttcattcatggtccagaccactggctggaatttgacctcttcacaggcaagaccactacactttctctcttgggctgtttttcctctccccagtctcttttccaattacattctcagtccctaaatcttgatttgcctaagtaaatatattgtttccttggttattaatgcaattctcctactctcctgagaagctcagcacatacgggtggtctaataagcacacccttctcaaggagagagctgggtccagcatgtggggaaatggtagacaggaaacaaagtcctaggtgtctgtggctcctccacctgaccctttccctgctgttcagctttaaaaggatgattgtgccaggatgaaggaaacccgaagctcttgcaaaatcaatgggagggctctgctcattgggggaataatggtgtaacatagggaggacctgtgggcccaattagagtcatattatctcaggaaccaaaggattgctttttttttttttaatgaggcctgattctttcagcatagaaggattgaatttaaagacatgaaaattacggaatttatattttttcatactaaatcctcttttgactgtaaggatgc

SEQ ID NO: 4430 - DNA, 960 bp, Homo sapiens
  misc_feature (1)...(960): n = A,T,C or G
ctgggttttctcagatttctgtacaacattacatagaaagacaattaaagaaaacacataaaattttgaacctcaactctaccaactgtgaattctacattcagcaaacttagtttaatctgtggagactaagtcattctcacatttctgggaattaaggaaatctaaaattaatgcatccatcattcaattctatgagacagaatagaaacgcagaattaagtgtttaccaaatgcaccccaagcaatccagactccaagatctgtgctattaatcactgtgtttagctgcttttcatcaaccaaaggatggtttgaaagtactttgtaaactgctattcaggccaatgagctgacaacagaagttcagagtgccttctccaagacgaaagtatacagcagtaggcattagtgcaccattctctgtttcttcgccttcagaggcatgagtggccattgtcagcaggacaaaactgcagcagctcagaccactgaacagctccatgaagggttgtcttggaaaaaactggaattattcatcgttgtcaaaacgtctaaattggggttatacaacatagttactgatattgagttcaccagaaactntagccattgcatcatgaccaagattttgaaagcttcctgaccccaaactcccagttcgcctcgtcgccatgcctcggaaaattgaggaaatcaaggattttctgctcacagtccgatgaaaggatgccaaatccgtccagatcaagaaaaataaggacaatgtgaagtttaaagtttgacacagcaaatacctttaccccctggtcatccctgacaaaaagaaggcagataaactgtagtccctgccccctggtttggcagtgtaggaactaaaatgaaccagaccccctgatttgttttgtattaaaatactaaaaatcctaaaaaaaaaaaaaaaaaaaaaaaaaaaaaaaa

SEQ ID NO: 4431 - DNA, 795 bp, Homo sapiens
ccttgatgtaacttcacgtaaccaatccagaagaggttaaagaacattctatttgatgtggatatacaatagctacaattcagtaagttctacaacagcatctgtactgggtcaagtacactgccacacatctgttcctgtgccactgccagccaattcactctacatccaactgcaatatgaagtaagaaagacaattcctgggactgtgagcatggagatggaaagattttgactcatggatcaggaacttccatttgaaccaattaccaacaaagcagacttaatacctgtataaaaatatcatgaatccatatgtcaaagtgtcttgaagacatattcctgggattcaaaagcagaaaatctatttcatgaattcaggctccaaacgttctgaataagctctgtttcttttgctcagagactaaacaatggcttctccttaaaactttcttttgaaggacaaccaacccaaaatagctttaacacattactccacagtttatactccttttccaatctttcacactctcaaaatgttactctgacacttggttacttacaccatttaatgcagaccgaacccgtgactcattagcacagatgtcacaatgccacctgatgcactgctgtagacttcctgcagctcatttacaatacagaggggatgcagaggaaatgtttcttaggaggcacatgacaaggaaatgttttgacttttggaaagaagggatgaaggaggacaaggaaagagaaagcagccaactggcacatacctacttgggcaagggggct

SEQ ID NO: 4432 - DNA, 925 bp, Homo sapiens
taggttttatatatacctcaagaggatcatgccattggtgaattttttaaaaatcagttatcatctggagattcaactggggaagaatttgcttttgaactcattcagactgttggtagaattcacttagaggtcattcttatttctaagaagtcaactgcgattccttgctatgtggtcttccttggcatgtctgcttatttcattatgtccacaaggagaatctctggatacagtcttcttgaaaaacaaagtcttaagaatgaagttgttgctgaagaaagcgaaagagagggagaacagccggagtcatgaaatcaacctgaagtttcctccactcctggacttgccattattcacatttttgatgtcttttatatttcaaactgcctgagtcgaggttccttggaccttgaaatgcatcatttcctttattttctgctgaagattccttgtaatgaagatgaggggagagattgggggccactggagtttttcaacaataggggaagattttaaataagggctctggcatcccacatccaggcctggtacttcattcatagtgtgccaggaaacacaggtcagtttcccagtgcatgcctggacctctagcctaaggctccagggcaaaccagaggcggagagctgatgttgagggtctgcttactatggagcagcatccactgcatctttcttggtgcctggccacccacttacatcttcttcactcctgagcatcatggcagggattgttttattttaattcaagcagcatagctcatggaagaggggacattttcagatgatttataatttaatataagcaaatttgagatattttctttaaattggatcctcatacggaggaacataaccgaggggaaaagagatggaattaagggtcttaaaagaaaataggttg

SEQ ID NO: 4433 - DNA, 926 bp, Homo sapiens
cttgtggcacgatgctggtacatttgaattccatgtggaggcttaaatgcttctatgtggccactctctcagcagatgattgcaatgatgatgcaacaaaaaagatgaaaaagatcttgtgatatgattgactaaggatacaacagaacaatcatcaagtagtgaagctcgggatctctcaccttaccttttgactaacatccttttggcaaaaaagagagtgaccgaaggaagggagattgaatatacatgcagacaatcatttattttttattgagacagagtctcgctctgtcacccaggtaagagtgcagtggtgcgatctcggctcactgcaacctcctcctcccaggttcaagcaattctcatgcctcagcctcctaagtagctgggattacaagcacataccacgacacctggctaattttttgtatttttttttttagtagaggcagggtttcactgtgttagctgggatgttctcgatctcctgaccttgtgatctgcccaccttgccctcacaaagttctgggattataggcgtgagccactgcacctgcccagatcatatgcagcattagaacgttgacccacagtctctgcagccattgcctcaaaacattcaggacttcatcaataaagatcagtttccctcgtttcacccctatttccaactcagaaccaactggagaaagccaaatgcactcccaaaaccaattacataagatagtttctagtcagcccttcttcagttttcccatgccaacaacttccaatcagaacatattcaaagccttccctttaaaaattattattataaagttttcctactccccccgcatgcctttgggtctctggtaaatgcaagtgatagtggctaactcccgttctataaccagctctgaataaatagataaatattcaaa

SEQ ID NO: 4434 - DNA, 862 bp, Homo sapiens
aggcactattcaggctccggtagggtaggaaaccattgtttacatttgaatgaggacctggttataatgtgtgtttaataagtattgtcaaattaggaaatatgctatcttcggaaatcattttattcttgttgttatggaatccgtgtcatttacttgtctaggacaaaatggaacagagggtcctgaaagaaagatgagaattcaaacaagtaccaaatttctaggacaaatccgcactctgtaatgttgacagaacagataagagaagtggacaaagatgggtgaactaggggggtatgagtagggattggatgtaagctttctgtttcctgatcttgggctgacatggtttggttgtttgtcaccaacaaatctcatgttgaaatgtgacccccagtgttagaggtggcgcatggtgggaagtgcttggattatgggaatgcatccctccatgaatggcttgctgtcaccctggtggcaataagttcttgctctgctagcttacatgataactgatcgttaaaaagagccaggcacctgttcctctttcttgatcctttgcttctccagctgacacactggcttcccttgcctccttccatgatcaaatgtttctgagacctcaccatagtccattatatggcatggcatgatttttgttaaacatgcataactttgcccacaaagccttttttctttcttcttctaccacacagcacccctccccactcctctatcctttaccgcttccgcgtccctatctactccctcttgcattgtcatccataccctattttccaccactcacatgatttcgagcgctaactgcgatctccttgccgggtccggcgtcttgtct

SEQ ID NO: 4435 - DNA, 830 bp, Homo sapiens
  misc_feature (1)...(830): n = A,T,C or G
gttatattttatgaatgtgtgaatttatcaatttgtatctcgggttctcagcacacatgtanacactctctctgttctccaccatgtgaggatccaacaagaaggtggccatctgcaacccacaagaggaccctcacaagaacccaatcacgttggcaccctcatctcggacttccagcttccaaaacggtaggtatttggaagattgtgtgcaaattttgaaagagttgaggtgcatatggaagaagtggaagtggctgctttcctgaaagagcttaagaaaaactgcatgtgaacagtgtttcttcagaaccttgatggcaaaatgtcacatgggttggagtaaagcagtgtttctcctatcagctcaaaacccaccaccactctaataatcaaaaacaaaaaagttgatacttagaaaatcaggtgatagcatcctgggcatggatcctagagactagcagaggacacttgggcttataaaaatgaagtttattctaatagtcttgaagggcagcagcactttacaaggaagaggatggaaagagaagacagctttgcaggatgctcgacgatgaacttgaggctaccaattggtgacttaaaaaaatcaatgggatacactctatagattccacttggtctgcttcttattcgcatttgccatttaaaagtacccactgattttataagaccgtgccacaacacctttaactgaccaatggcatttgcaaaaatcttaactttcctttataatttaaccagacattgacttaaatttcttcactaattggaacgccaacaaatcaccgcaatcaacagacaccttt

SEQ ID NO: 4436 - DNA, 767 bp, Homo sapiens
cagaatactcggaagaacgttaaaagtcagagagatgtgctcctgttcatctggaagaaagcaaagaatcatgctctgaactccttttgggggcatgtggccaggaactgagcgtgacctctagaagttgaatgtggtctctattcagaagaagaagaaaacttattacttcattcacgaattgtctagaagctattgcatacatatcatgaaatgtcagcagcaaaacccagacaggaagcaagtagacaagtatcactctccttgggaagatgaaagcatattacttcattcatgatttgtctggaagctattgcatagataccatgatacgtcagcagcaaaagccagacagggaacaagtagacaagaatcacaatgatctctgcaattacattttcaaatagaaactgttgacaatctacatactgttgaaattaatatttacttctgatattttaaaccatgcttcagagaggactgaaatatttagtagatgttttcactttagtcatgcaattttgtattaaaggcaataagacggtattctaaaaacaacatatttatttgttgtaaatttgaagtgtttggattttctgtattgtatcaaatggcaaaatatcattgctgaaacagtaaaaccgaaaacatcaacaaaaaaaatcacaccaaattgaataatggggtttgtcatctggaactcagcaggattttatgactaaaacattttaaggaaattaacacactcttgccattgttttaacctc

SEQ ID NO: 4437 - DNA, 1097 bp, Homo sapiens
ctttggggtaaccacaccctcaggtcatgactgttacctccaactctttaagtaaaagggcaaagtaaagattttgatgggaaatttttttctcttacaacctcttcaacttctttgttcattagtaaatgattttctcctgcatacaacttcaattccaccttcattcgacacaatcgagtggtgtataaccttggaatgagcaaacgatgtcagcacagatccgacaagacaattcatgttatagaaaattggaaaatcaaggaccttaatgtaaatccaataagagatccagaaatcaaaacacttgccttttcttcaaaagaatgtgactcttatgtgctgccctgctgcttggctgactctttataacaacattgctgaacttatctagacgattgctatgtcgatgatcacttaaatgatcactagtatgaagcagcagggattttagaatgtttctttaaaacctttgatatccatcatgttatttagccatgtctacagtcctcccaacgggctttacataacaaaagtaccacaaacggaggcgcttaaacaagagcaatctatagatttgcgggtcccatggctaaaagtccaacatcaagatggtgatgggacgttctcactgtgaagctgctcaaggagggaaacctgcttctgttttccagtttctggaaacccaaggatcctttaggtgcatgaggatttttttaaattccggcctttgcttcacatgccatctgacccgtgcatgtgtgtcttcatccctttgcgtctccacatttgtgtgtgtgcccaaatttccccttttttacacagtaggaacagcagtcatgttgtattagggcccaatctaatggcctcatcctagattgatgacatccataaagactctaggtccaaatgaagtcaccttccttgattccgggagtaggacttgaacatatcattttaaggcacacatctcaactattaacaggcagtattgattttatgtagagtctgtgctgtaatttttaaccagctcaagctcatttgcttatataggtaataaatagatatctgcaataaaagccattgtaaacataaaa

SEQ ID NO: 4438 - DNA, 1028 bp, Homo sapiens
aaatattacagcacatatgcaagcaagcattggggaccccactgaaaactggactgttcaactcacctggcagccactcccagagcccctggaactctggcccaaggctctctgactgactccttcccagatcttctcagcttagcggctgaagactgatgctgcccgattgccttggaagccccatagaccatcacggacgccaagctttaagtaactctcacagtggaggcattacatggaggaacatgaacagtctgagcattcaaagttcaagatttcaagacaatcagttctgtttgcctgatctacaggatgaaggtaattttaacatgaccttgctactcccttggatgaaaggatcatcacgaagttttacaacaaactttatggttatggaagttctatatttacatttggaagatgacaaagttgccagtagcagatattttaattaaaaatattttccttactgttccaatatctctaatgtttttaaaagtagatttatcttactacaggttcatatgagataattgaaaacatggtgatctcagatacagcagcacacatgtgaggaaacgtagtagtcagtcacattggaataccttcaaaatcttcagtaaaatatgggtgacgttgacgaatagttcattctccctatggagctgtccacagaggctaaaaatagctataaatagaagaatccagataaaatcatgttgtatcatgtgtcatatcaatagtaatatatacaaatgaaaaatattgtgaaaatagtacaggtagaggccacatatgtcaataaagggggtttagagataaaagcatgggataataaatatggcataggtattttgagcccagcttttcaatgatcataacatattctatatttatatagtcacaatatttttggatatatacaacctattcacattcaaagaagttgttgcaagagtgtacaagaatgtcactaagaaaaacaagatttatcaggtaattgcagtgttcgccattacttttat

SEQ ID NO: 4439 - DNA, 444 bp, Homo sapiens
attgaagacaaccaaaaatttaaataaaatccgtgctctgttaggaaattctggagaagaataacttttatgaaccaaattttatcaatattgatagggagatggaatcatcagaccatttaacattcccaaagcaacagtacaaagtagaatacttccactgacttgcaaagccagtttaaaaaccagcaacaatggttttgtcatttttttatagattactttagaaaatttgtattaaaaactaaccctcgtaatggcatgaaaagtattttgggggaataacagatgttaccagctcgaaatttaaacaggattcaaaggataaccaattgctattatcttccattgtatgtattaacaataataatatacattaaaattatgcatagtctaaaagttatctttcaaaattgataaaataaaaattgtaaaaacagaaaa

SEQ ID NO: 4440 - DNA, 598 bp, Homo sapiens
accttagattgcacctagtagaggagatgcccactggaatatctaagaagactaacaccccgcttcatgacctaagaacctccagcacgcctccttccccaaaaggcccccagacatctgacagtgtcctgtaactaaaggcccacttacagcagcagatgctagcccttcaacggcttccgggttggagtgggagggatctgtccagtgtgggcctatgagaatctaggaatgcactgcggtcagcatcctggagctaatcaactcaatggcacctggagctatccaaggtcctgatcagctgggggctcccgaaatattgcagttaactttgaattggtctgtctccgattgcattggtcttcgaattgatggtggttgctgcatctggactgagtgtgagtatctgggaaaataactgcatttgatatcaggcagacctaagttaaaacctctaaccagctggtgaccttaaccgcttacgcctccatttcctcatctataaaatgggggtgatgatacctctttctttttgcctgtgtggattaatgagctaaaaaattgaagtaatctaataaaatgccagacaaatataaaa

SEQ ID NO: 4441 - DNA, 787 bp, Homo sapiens
ctttgatgctactatgaacacgtgtttattcatggaaagaaatgaatatatcaatattaatagaagtttggaggaagctgattccaactttcatgagtgactttgaagagttcaagacttcagtggagaaaatcacttcagatgtggtgtaaacagcagagaactacaattagaaatggagcctgacaataaattgccatagtcacctccacccccagcaaccaccactctaatcagtcagcaaccatcaacactgaggcagcacccttcaccagcaaaaagattacaacttgctgaaaacccagatgattgttaacattttaaaactatacaatatttttaaattaagtagtgttcttgcctggctttggaaaactggatatccatatgcagacaggtaaagttatatccttatcttacattttatacaagaatcaactcacaatagattaaagatctaaagataaggtcagaaactataaagtcactagaaaaatacgtaggggaaaagctccatgacattggtctgggcaatgaattttttggatatgacctttgaaagcacaggcaacaaaagcaaaagtagacataggggattacatcaaattaaaaagcttctgcactgcaaaagaaacaatagacaggttgaggagacaacctacagaatcagataaattatttgtaaaccatatatctgataaagggttaatatctaaaatctacatggggtaaaagaataatggagaatgttgctgaaggattaaaatatttattaaacaggaaggat

SEQ ID NO: 4442 - DNA, 1317 bp, Homo sapiens
atgacattggaccgcaggtgtcacagaagtgtaatctctgacagaggagaagcaaatgaggtgagactcacaagtgccccagctgacaacctggagagagtttccacgccaccatacagaccctgtaggggacccactgtctccaggcctccgtttgctcatctgtaaagcgaggggtgggccagtcaccccggcatgagctttgacattttaggatcccagccttcccgctgtggttgcagaagttgctcttaggatcccagccttcccgctgtggctgcagaagtggctcctctccagaacagcatttatggcgtctggactcccgccccagctccctaacggggcagggagctcgcctgctcctgaagcatccgcctcccagcctcgcgcaggtgaggctcatcaataacgatgggcgaggatgtcaggctgcgtctgaagccaccaggggcccagcaggctgccgcgtgctttgtcataaactatgttgtcacctggggaagaatcatcaccgataacatatttcaggagacaaaaacaagaggtgcattgattttttccacgaggtcagacaacttctgggaaggctcctggaactcaagttgtcacggcatctctccctgaatatcccgtatgacccggggggggaggggccctctgacccaggtgggctctttttcctgatcacgggctgttcttttcagaggccagcaccatcactggcctttctcagaccctgaggatcgaggctgacttggatccagggaagatttgctctctggcttcccctgatctggctccgagaaaggtctgcacaggtggctccgggaggggctctgctgacagccaaatctgccatttgttaagcttatgacacacaccagagtgacctgtctatttccctggccaccacccagcccaaaactgaagacagaatgttcaaaaatacagtatattaatagaaaatctgaggcatagtgaggccaacagatcaggagacaactgccattaaaaaggtagtttgcggccgtgagcggtggctcacgcctgtaatcccagcactttgggaggccgaggtgggcagatcacatgaggtcaggagttttagactcgcctggccagcatggtggaaccaccctatctctactaaaaatataaaaattagctgggtgtggtggcgggagcctgtaatccaagctactcaggaggctgaggcaggagaatcactggaacctggaaggtggaggctgcagtgagctgagatcgcaccactgcactccagcctgggcaacagagtgagaccccatctcaaaa

SEQ ID NO: 4443 - DNA, 815 bp, Homo sapiens
tcagttcgatgtggccatatgatggagttacagccaatgggatgtgtgcgtcatatatttagatgccaaaaaactattgctacaagtgacaacagagccaaaaggattgcaatagcaggacatcaattcatcaggactgcagaggagaggaggcatatgttctgactactctccattgattggtcggctgctgtctccatagcaatccatgcacagctcagacatttttttttccctatctgcattacctccattacatagcaaacaacatcaagattaataaacagacatacttggtgaatgtaatcagacactgaagccactgttctcatggctgattttctaactgtagaaagttacagtctatatcacactccaatcactgacgaagcagcaaagaaatcatatattttgtcatattgttgggaaaaatgacttctatctagatattttcttggaccacatccatatgtttaggaaaataatggagtgtgctttaagctggaaagagtgaatccactagggtttcttcaaatttcttcatttacatgtatatttagacttgcatgtagaatgagcacatttatttaaggtgtggctggcatctaaatagttatttcagactatttaaaactattcctctgcatagtgaatctgaaaatataataattgcttatcctcagaaacttgaacccagaagatatttttcgttcaagtagctggagccctggtctcttttttaatgccaccaaaaattcctgagtcctaattgaatgggaatttggtgcctgaagggaagtggcctctggtttcct

SEQ ID NO: 4444 - DNA, 820 bp, Homo sapiens
tagttcttgcaggctaaccatccaagaccaagatgtcagcaggattggttcctgagggccttgaggaagaatctgttccaggactttccctttggcttgccattggccatattctctctgtgtcttctcacgtcttccctctgtatttgtttccaaatttcctcttcttataaggacagtagtcatattggaaaaaggaacaccctaataacctaattttaacttgattacctctttaaagaccttatctccaaataccatcacattctgaactattaaagattaatgcgtcaatatatgaattttgtgaggggcagggagacagaatacaaccaacccacaacacccagatacatagcgaaatcttcttcttctaggccccctgtgcctgtgtccaccacttcatcccccaattagctatatttgaaaaagtaagagggaaagaacagttggagggggaagagagagagaaagaagactgacaacttagattatgtgccctagatgttggccttacaaaacgggagcaaatcttaaccaatcattgtagcaaaaccttttgtttatgaaggaagttccttttgtttcttttcagtccactctacctgctaattaaaatcaataatatgagatgccgtgctatctttcctacctgagccacttatacctgtattgtcaggtttgggtttatttcattttctgagcttatttgccagttaatccatttgtttttatattacaaagtggttcatctctgccttattacacactgaaagtaatgcctgacaagcgattgtccaccgctaccaaccgtgcctgg

SEQ ID NO: 4445 - DNA, 581 bp, Homo sapiens
gagcacctagtatgtgaaaactgaatgagaaaaacatgccaagaagagagagcgttcatcatattttctgtttgcatatgtccttggtgcttctgaagctttgaggcttagcttcccctcattgtacacaggaaaattcttcttgacttatgtgtgttgttcacaaaagtactaagtagcatcatggaatttgagaagtttaactagaagaggtgggaaaaatctgtggaacctgacgtcctacctggagcagtggatgtggcagtgggtaaaggaataggtgggacctccagctggcactcacaaaccaccatgaatcgtcctctcctcccctccatcatcaatcagaacaacccgggtttacaagattgcacaaaattgctaaataacagggtgactaacacatatgttttcatttgtacatctctctaagaaagatcttttagaactggattggaagctatcactttgcagctgggatggatatgaagaaaagagagattgtgaggagaaaagagattatttctctgttccttaaagacacagatacaggataataaaaaaatgatttgttgttccaa

SEQ ID NO: 4446 - DNA, 803 bp, Homo sapiens
cttaggaatgacggggaaataaagtccctctcagatgaagaaacactaagagaatttgtctccagtagaccattcctaaaggaggtccctgaaacagaaaggaagtgattaaagaaagaatcttggaacatcaaaaagaaataacaggaagaacagaaatatggggagaagacagttgttgacaatccaggaagcaggccttcatcagacaacaaatcttctggcactttgattttggacttcccagtctctagaaccatgagaaataaacatctgttgtttataatctactcagtttatggtagtttgttatatcagcctgaacggactaagatataaactataaccactggaagaaactgggtgaggtgttatcaggacctcactatattatcattgtaactttctggaaatctataattattttaaaaactgtttaatactttgcaatgatgaaaaagttctggaaatagataatggtgatgattgcacaacattgtgagtgtacttaatgtcagatttgtatacttaaaatggttaaagtggtaacttttatgtaatgtatatttttctacattttaaaaaatgactcttcctgatattatcaaattaaatcttttagaaaatatgaaaatgattttggtcaaagacaacaaatgctatgagactgctgatcatggaagattgattcacttgccctgtacatttcattctttcagcatttaacattttaaatggattcattttttagattaaaaaaatcaaaaagtaaaaaaaaaaaaaaaaaaaaaaaaaaaaaaaaa

SEQ ID NO: 4447 - DNA, 976 bp, Homo sapiens
cctaggaacagatggatgctatgatatactccatggaaacagaacatcagagccactcaagattctataagcacaagaatctgtggaagaacaaagcctggatgaactggagctgatgtcaggctgccaaggctgaaatcttcttcaaagacagggtcagagtcacttcataagtttcagggcagaatatcacctatcttaacaggagaaacatgtggggtggtggtgggtaccagctcgatccacaaagattatttctacttcttgttttctatgaaatgttctttatactccatagatgtgattgggtattctacagtaggaattgggtattttacagtagggtattttcaagttcaagatgaaaatcattcctactgtaaaatacccaaggaagtattacttaaattgtcttaggatcttgcccccagggaacttgtatttctttcccaagaagagtaaagggaggccctatcaaacagaggcagagagagttgaatgggagtgctgtctcactaggtataaggtatgaaacaagagataaagaagtgtttatcttactcaggggaagaaagagatttaggaggctgactatgagtcagagagaagtcttcttatgaccacgtcatttgactgcttccctcaaaccagtgtggtctggcttacatgtgagatgccttatgtttgaaaagacataaacaaggaagtatcacaagcttaaaatacacacatatacataaaacttcagatatactcatataacataatgggatcttgaatcccattgagtacccatccacattatttggcttgctatattattaagtcttttaggaagatatatctaaaaataagttagtccctccattcatgggttttccctgtgtgaaggagacacagttatctacagatatatcttaaaagccaactctagaaaagacagtggatgatatataaagcagcaaaaaaaaaaaaa

SEQ ID NO: 4448 - DNA, 801 bp, Homo sapiens
tagatgcctgaaagggcgaagcagtgtgcctgccgagaccactcctgcttttggagtctgacaagattaaaaggaagcttgcaaacttgagtggcctctgcctgggagacagtcacacaatatgatggactaaactacacttcctgtccgtgtttgttacggctccagccgagccgtccaccactgctgtttgctgccgttgcagactcaccattgacttccacccctccggatctggcagagtgtccactgtgctcctgatccagcgaggcgcccattgctgctcctgatcaagctaaaggctcgccattgtttctgcatgactaagtgcccaggttcatcctaatcgaactgaacactagttgctggtttccacggttctcttccgtgacccacggcttctaatagagcttaacactcaccacatggcccaaggttccattccttggaatccactgaggccaagaaccccaggtcagagaacaaaaggcttgctgccatcttgggtgtggcctgccccatcttgggagcggcccaccaccatcttgggagctctaagaacaaagacctgcacgtaacagtgctgggattacaggcttgagccagtgcacccggcctactttctttttctaaaaggccatcctgtagtatatggatccctaaacacccaaatatgtaaacctaagactttagggaatgaccctgcttaccatacatgtaccttggcaggataagcaaatgcaatttctgactgcgggttgacgctgggggtaattaaaatgatacagtgagcgaaatagc

SEQ ID NO: 4449 - DNA, 1320 bp, Homo sapiens
ctaggctctcaggcagaagggacttggcccttctcagatgagactttggactgtggacctcagagagacagagtcttgctgtgttgcccaggttgttctcaaactccattggtcaagcaatcttcccgcctcagcctcctgaagtactgggattacaagtgcaagccactatggttggccctttccagctttattgagctaagctttctggcccccagatctgcacctgacctttaccacctcctcatcatccactctggtctgcatcctcttgaccgcgtctgagtctcctttggggctggatgtctgcttcagcattaggaaatggacacatctatagaatctctcatggcaacacaccaagtattgtaaacttcgtcctttcaacaagttatattactaaaatcgacaaactgaactcacatgaatgtgtacttacagagttgtggctcctgattctatttaagcttcatcagcatctgctattattggagtttggaatagccattctgactagtgtgagatggtatgtcattgtggttttgatttatatttttctgatgattaatgatgatgagcattttttcattgctttgctggctactagtatgtcttctatattagtccattctcacactgctaatgaagacatacccgagactgggtaatttatttaaaaaaaaaaagaagtttaattggtgcacatgtccacaatgctgaggaggcctcacaatcatggaggaagggtaaagaggagcaaagccacgtcttacctggcggcaggcaagagagcatgcacgctggaactctcctgtataaaaccatcagatcttgtgagacttattcactaacatgagaacagcatggaagaaaacctgcctccatgattcaattaccttccactgcatccctcccacatcacatggggattgctacaatttaaggtgagatttgggtgggaacacagagccaaaccatatcatcttctctcaatgtatagaaatcaataaatgtgatgcaccgcataaacagaattaaaaacaaaacacatatgattatctcaatagacacgagaaaagcttctgataaaatccaacacatcttcatgataaaaacccttaacagattagaggcattggaggaacatacctcaaaataataagagccgtctgtgacaaatccacagccaacatcatactgaataggcaaaagctggaacaattccccttgagtactgtaataagacaaggatgcccattcttatcactcctattcagcatagtattggaagtcatagccagagcaatcaggcaagagaaa

SEQ ID NO: 4450 - DNA, 903 bp, Homo sapiens
cgttagatggagtctcactctatcactccagctggaggacagtggcacgacctcagctccctgcaacctccacctcccaggttactgatggatccgtcctaaatgccatccatctcaagacagaggcccacagaagtcaatgtatcttcaagatgggagtacctggagatggctgtagagaccatgtagcaggaaatggtgacagagaagagctgggcctctggtaccaacatgcttcccccccgttacagctatgcgggctgatagtgatgcaatgtgtggtttcaatacttcatagtgtcttacttcacctcagtataaagtactttgaaagcatcaaggaaatggtcctcaaaaaaggcttatccagtcaggacatctggtgctggctctggaatgagtggatgaagataaggccttccagtatggaggtgataaaaatcagggaagacaggtaatcacaatggatgacagaccaggattcccagatatcttggcatggctggaacaatgtacagatcaaaccatgtaaaacttaatgggtataaaccaactcttcactttggtctaaaaaagtccatttgcatggcttctagttaaaggtggacaggctcactttagaatcctattatatacaaaggatttagggggtttagttcacaatgtgctaaagccatcccacagtgaccatggtatgagctgtgtgatttggtttaaatataatagagaatgaaggacaaggttgagggtggtggttacagtcctgcctgattctgtagtgctcaggtgacctttgaagaatgaagaaagaagtcaaaaccccacactattaagacattggaagactgggaatgtttattttctgaagaataaaagatgtaggaaacatgaaaaaaaaaaaaa

SEQ ID NO: 4451 - DNA, 1104 bp, Homo sapiens
ctttgttctctctagggtcaaatgggagattttctggagcttcgtgtaatggaaggaagtcgcctgcatttccaatgtttgttatggccagcagagccacccagctgtacaactccatgatgcattctttcaacttgttcagtgcacaatcccataaactatgaagcaagtatgctttgacatgaatgcatgtgtttcctctgggccaagagaatgccctggaacataactggaatgaactgtcttgatatggtcccaaactggaaagctagcttcctgagctacctctatctggagggatatttccagaaggcagaagatgaaagtgggttataagaggctaccacttataaacttcagcggtgaatcggggaattccagtgtgtacacacctatgggagagattctgaagactccattgacagaggccttggaaaagaaagtatttggatgcttgtcacactcagagatattgacaaggaaggcaggtctgcaaaaaaccctacttagatataaagaattttgccctgtttctaagtattcttttactctcaattaaggaggatctggaatatcaacaaaagagaagaagtagacaataaaacaaaatcacaatgtgagagaagcaaaacccggggttttaaccagttctctgaaatgggttccatagctatgacctcaactgaaagggagagaagacgcgttacattaaatataagcttgaggttttgggttaaactggtaatttcaacccctgaagagtaatggtaattatcaaaaatgaacttatatttgtaactgtgactcaaaagccagggacttttctgagtttttgctatgcagggacagataaaagaggtttgacacaacacataggagttaatgaaaggaggaaaaataaactaagttttgatagcatttaaatcagttcagaaatttcaaaacctgggaaaattttaactccaaatattttttagagactttaaacatgctaacatgttaatctgtttattttgaataaacaatatcagacttaatttatatatgaataataaaacatgcatttaattttctatagtcagaatgaaagttaaaacgacaaaa

SEQ ID NO: 4452 - DNA, 1023 bp, Homo sapiens
cttagagtctagctcttgttggcctgcctggagtgcgatggcacgatttcagctcactgcaacctctgcctcctgggttcagcgattctcctgcctcagcctcccgagtagctaggattacagattcttgtgaatgaagcagaatcattgattgagcaactggaaatgaatgcaaaagtagaagatgcacattgtgaatctcctaagaagcaaatatgaatccattccttcctcctctccaagaaatttctcagggcaacggagtctactgatgcatgagcactcaaaagacaccataaggcgtttgctgcatgacttaattcttttttggacacagagcagattttgatgacttactatgatcattttaaattcagaacactgcatcgccagcatttaggaattgcactaaaggaaagtgagaagtgaaaaatgcgaaatgattgtcatggtcaccacacatccaagattttctgcgacagtcccaatttcaaagattttaccttgttattcctttaattgtactctttcttattagaccaactagtcaagtttggaaaaactgtttttaaagggccactggtattcttaggtatatgttaattaatattttacaaaaccaaagaaagtctttagaatattacgtgaatattctgttcattcttttcttttttagagatgaggtcttgctctgtcacccaggctggagtgcagtggtgccatcatagctcactatagcctcaaactactgggctcaagctaccctccgaccttggcctcccaaagtgctgggattataggagtgagacaccatgcctggcccacatgaatgttttcttaattatcctaggaaaagtaaattcctttattacaaattatgggaaaatacctgaacagtgtagttcttggaatgatattgatgattgctttagtaattttcacattattgtaatggttcttgttagctggaattttgtaatcgtcaattacatgatcacaacatgcagacacaccaaaataaaa

SEQ ID NO: 4453 - DNA, 658 bp, Homo sapiens
ctagagtgttatatccaggtgtatgtgcccagctctcctaccagactgttcatctgcctgtggcacggctccttgcacacagtgataggaatcatctgaagcagttgacagatcatgaagcgggtcctctgagaaatgagaggcattctgccggatggcatttcttttttttttttttgagacgaagtctcaccctgtcacccaggctagagtgcagtggcatgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggtatgcactccactctagtccttcaattagcccatcacattgtcactgtggcatctgtatgcacattttctgcagtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagaaa

SEQ ID NO: 4454 - DNA, 893 bp, Homo sapiens
tgtgcaagaataaaaagctctgtatatgtgtataagtatatatgtttataaaggagaaggtgaagaaaatgaaagtttttcatgattacgtcaacttcagagaaatccagaaaaaaggagtgataaaacttagaagaagacatttctcaatgaacacctagcaatgcttctcgaaaactgtatttcattttgggaccaaaagtgcttcggttatttcttgtacattctctgtataagtgagtttaattgatttctgccagtacttttatacctctacttccattcttgaaagtttaacttggattcacatattagctgaattgttaaaatttttaaataagtttataatgaaagaaagataagaatactttcaaagttgttatatatttgaaattgttgcctcattcagaaaagcatgagttggttcaaaattctacagacacttcttaagtttctttcttttttaattttatgtaagataattaataagatgagttaccctgagggttgttgttgttgtcgttttgcatttttggtgcccaaattcttctacctggggagttatgaggttctatttgttttcaatcctaaaacgtaatatatgctgtgaagatatggttcaatttttgactgttattatgttcttcagaggcctagtatcatgtaaatggctatttgtttcaggaatgtttatcttgattaactgttaacacatgtttactgttataattagtgttattgtcattaacattgtttcgtggtgacccaattttctgtatatggagaaccattgcatatcccttcaaatacccaataattacctatttttaaaatctgcttgtaatctggtttaataaaactgtaataaaataattgcacatgcaaacttaaaa

SEQ ID NO: 4455 - DNA, 1024 bp, Homo sapiens
ctagaggaaatcttggttcctgctgtggagaacatcctcaggacttccaggcaacaacaaagtcagcaaagagctgtgacattcacctgcttctgagctatgcaggatggtgtaccctggggatcggggcatgcgggaaaactcactggctgaccttgacttttcacagaacttgggatgtcatgaaacgaacatgacttagacttgcccgagtttagacctccttctgaagtgtaaccctgtgtctgtccgaattcttggggaagctgaggaaaccagggctgtgactgtaatattctgctgtacctatgatctgtgcccatgatgctctgctgtatccatgatgctgtgcccatgatgccatgtcatgctctctgtaccttgccatgcctgtgacactatgccctctccctgggattctgcagtcttcctggctgctctagaagccagggagattccaccccatgtaaaatgctcctgggatggcctgctgacctggattctcctctcaacatcttgagcccaaccacctctgctgtcaaactacacatggcccaggtgacttctctcacaaatgggagagggaatcagagcatttcatagtcagagcagaggccctggggagatgcccatctgcagcagacttgggacaactgatccaattcaagtccatcattgtgcagagtgggattgtgagcctcagagtggagagaagattcatccaactgtgggttcggtgccagccagagtgggactccaccctgactcccagttcagagctcattttggtggggggtcctgaagttctaccatcatagttaccccttgcttgggtctccaaaatgtccctgttccaatgtatatctgttacttaaataacacatttgcaacatagctatcagaggggttggtttttatttagaaggaagctaataagttatattttatttattataaagacaaaattgtaacagcacaaatgaaaatattattaataaaagaaattctttctgccaccctaaaa

SEQ ID NO: 4456 - DNA, 549 bp, Homo sapiens
cctagaatgagaagacttctctcaaaagaaagtctagaattctatggttgtgaaaagttgtgactgaaagcttggcaaataagtctgctgcgagacaaagtcttgctcacccaggctggagtgcagtggcatgatcatagttcactgcagccttgatctcctgggctcaagtgattctcccatctcagcctcccggtagttaggactataggcataaaccaccatgcccagctaagtaaaaacaaacaaacaaaaaaacaaaacaacaacaacaacaacaaaaacctttttgtagagattggtctcaatatattgcccaggctagtctccaaagatcctcaagcaatattgccaccttggccttctgaagtgctggaattacaggcatgaaccaccttacccagccacaatgaaacattagttgcaaaggtatgttataatgatgaataaataattcaccattagtacaaaatagtatgatactcaggttatgttcaaaaaatgtcctagcatgtgaacagttgtaataaattactgatttcttgaaaa

SEQ ID NO: 4457 - DNA, 791 bp, Homo sapiens
  misc_feature (1)...(791): n = A,T,C or G
taggcacatttcacttggggatcacataaccgaaaagaaagctgacgaagtgcaaccatgctcataggattttccagcccctgaagttaaacccagattcggagtgcacacagctggaaagaaaatagaaattcgtgactgtggagttaatgctcaacagatgtggaggttacccagttactccactgatcttccagagcaagcatagaaagaatttgaaacaattcaagcaaacaagtactcaggctgagtctatctagcaccaaggagagagaccgcatttgtatgagtcattgacagagtgaaaatgattacaccaagtaattctgactccatagatttcccgtttttgtggtgttctctgatattctatgcatatttatgctttatctttttgttcactatattatatttttttctgtcaagttttagctaggcttggctatatatatctgaattcttacattgagtagattttaaaattatctcattgtctttccttattttagtcataattggttagcgtgtttgctgaataaagagtttactgatttttgtttcttttttaccctagtgctgaaaacagcttatgcaactctttcagcatttacaagtctaatatttattgcttgccattctattgcccgaaaacacactttattttgggtttctttatggtttgttttttatatctgtgatctgatgatcanaatatttttaaaaaaaattacttattcacgctagatgtattacacaaaattttaaatccccagttactaccagtgtctacc

SEQ ID NO: 4458 - DNA, 783 bp, Homo sapiens
tctaggatcccttgggctcctgagttgagaagaaattggagaggagcaagtgtaggaaaaaggaggccatttgggacataagtgcattcatccaggagagagatggttctggcttggaccaaggtgcagatggtacagatggtggaatgtggttggatcctggacatatgaatgtgccagcagtatgacagaaaaaagaattctgtatatatgcactcagtcataacaaaggtctaatacccagaatctataaggaacttaaacaattgaatgagcataaaacaaataaccccattaaaaagcgggcaaaggacataaacagaaacttctcaaaagaagacatacaagcagccaacaaacatatgaaaaatgctcatcatcactaatcatcagagaaatgcaaatcaaaccacaatgaggtaccatctcacacctgtcagaatgtctgttattaaaaactcaaaaaacaacggatgctggtgaagctgtggagaaaaaagaaagcttataacactgttggtgggaatgtaaattagttcattcactgtggaaagcagtttggagatttctcaaagaacttaaaacaagagctaccatttgacccaacaattccattactgggtatatacccgaaggaaaatagaatattataacaaaaagacacatgtactcatctggtaattgctgcactattgacaataccaaagacacacattcacctaaggtgcccatcaacaatggattggataaaaaaaatgtggtacatatccaccccggaatacg

SEQ ID NO: 4459 - DNA, 853 bp, Homo sapiens
tggagagcaagcggatcccggttattctatcttacctggaaatggaagtcaggacctagttttcaaactggtttttcgcacttgatactggctttataaacttgtgtattaccattatttccatgttgcaaatttataaactgaaattcatgggagttaaaaaatttgcccaacgcacagagttgttgcagaatattgaatgagagaagcttgcaaaacccacagcacagcatatgacaccgcaattgcatagcggattataaataagagatttgaatccggtttaattatttattaatttaactcgactaccatagcaactgtacctttctaatatattcaacatctatcactttcccaggataacctccctttcggtatttccttacctaacacactctggagagtgttctcttagcatgatcagaggggcctatctgcactcccagcatcagctacagatcttctgcacttctcagaaacctacgagcttcattctttagatgctaaattactgcttcgggaaagtgacaagtgactgcaacatttcaccaacataaacctcactcagtaaaaataaaagaagccttagagaagaagcagccttggagaaataataaataaatatatatttcaagtagactgtgtttggcctgttgtcaggataagtgagtaaatgctaaagaaataaatagcttcagttaatgaagcagagtattaggaaaatagaactgttctgatcatttgtcatataaaggagtgaatctgttatttttgaacagtttcatttcccaaaactgttgttttgtttataaaaataaagcttttagatgggttgtgaaaaaaaaaaaaa

SEQ ID NO: 4460 - DNA, 687 bp, Homo sapiens
  misc_feature (1)...(687): n = A,T,C or G
atcactcagagatgggagggatcccataaggactacaatgagggctcttgcattttatagtccttttgttttgggtacatcaaggcatggttttgatcaagtaatgaaataccattcttacctcccctatacccatttttattcccaatataaaggaagcaaatatgaatactgtagtttgtggctaacggcacaaaacacaattccgtaagccaattatcttttgcttaaaccaatggcttcccccaaagacaaagagaagcaaatcatagcagctaattgctgttacactcaagaagatttcgttataaaatgcaaccttgctgttacaggcattggaatgcgtcacaacattcaagtaatagatcctaaagaactggtagggaaggaaacaaacaaggatgacccctataaaaaataggtttttcagctgagcccagaactcctggtgggatagtaaagagtggcgtagcttctgcaccatcaacataatgatgaagacctgnaagaccaacagaatcacagcaacggctatgacaaaaatgactatcatataggttgatgattttcccatatgtgtaagcaagctctttgtggaaatttaaacagnggnccccattngtttctcttgggatnctaccnggngaaannccnggnncccaaaanngaatacnnagngccnntcca

SEQ ID NO: 4461 - DNA, 1672 bp, Homo sapiens
  misc_feature (1)...(1672): n = A,T,C or G
cagggcatatgccggagcagataacctgtctaattcacaagtttctcaatcaagaagagctgcaacaaaattactacatgtgaaagcctcatgtgtatccagaactgatgcataccatgagatcatcaattcaaccctgaggtcatgatggaataatatacttcaagaggcgtagaggggagtgagtgtaggaggaataataataattttggtcagagaagagaccatggtagcttaaacacagccacaaattaattgcagttcctcctatcaagtgatagagtctatttccccatcccttaaatctgagctcaacttgtgactagctttgaccaatacaatgtgatcaacatgttgttatgtgacttcttgcagcttctgcaccctcttggaatgtttccactatcatgtaaagaagctgagtctagcctactgaaagatgggaagccatgtggatgagaactgaggctggccaacagccccacccaatagccctcagttaatctgctaactgactgcaaactcagatgtaagaccagctgatacctcaaggagccaaagtggctattccagctgagccatgccagaactgccaactcaacagaatcatgagcaaagaaatcattgttttatgccactaagttttggaacatggtctgttacaccacaatcaactgatatattcattgcttcaatcagtctgggtggataattgggggattaattaaaacgggaataattcaatgaattatctactctccatggatagcaccactgtcgagtggttaagatttccactgtgatcacactctcactactccaagaagtaggaatgccaacatcccctacatcctctcattcctgtcagaccaatcatgcatagataaaactcgggttgtgtgtgaacagaaactgcagaactagatatagtaaaataatggctcattaattattggccttactatatttaaaaagtgtgggttatttctcctattgaaaccactcttggcaaattttaccattaactcacttggcaaatctgaagaataattctcattgcctattcccttgctttaaaattcccccaatggtttcagattaaaattaagacttcttaacatgggatacaaggcttgcccatgcatgggcctctgcccttaaggtctccccattaaacaatccccgtttaccactgagcaaagcaaagttcagccttggctgtggcttcgctaaactgtctgtagttctttgaatgtgctgtgttttctctagccccggtgttttttcatgtgcaattcttctggtgtggtgtttcctgcctctttacatcgccaattcctacttagggatgtcaatatttaagaagcagttcctgatgacccctctccactacattcaccaaatactttttacactgttttgtcatcatttatttacctatctcttcaaaagcgaagagctcctggtaaagacagtcgctgtcctttcatctccgcatctagcagaggtgctgggccatagtaggtacttaatggtctgctgagtaaagcagtgaataaactgtagccacacttcaaaaaaaaaaaatcggcctcgtggctacagcggggagtgtgcggccaatttttctctattcccccctccctctctnccccctcctcccttccctcct

SEQ ID NO: 4462 - DNA, 331 bp, Homo sapiens
ctagagcaggaatcatcatgatcatcatcatcatcatcattatcgtcatcgttgtcatactctttctttggctgagagcaacatttgcctgatatcctgaataacagaggcccttcacgcaaaatttccaaataatgtcaccaaaataggactgttgcaccaagtgactagtgctggagagtgtgtgctgacttcgtgggactattcttatattaccatattccaacttggctggtgttaaaatgtaagataaagaaaagatggttaaaaaaaagtagtagggactctgtgtcttgaaataaaattgcctccttagtttgcccttgcaaaa

SEQ ID NO: 4463 - DNA, 349 bp, Homo sapiens
ctagagtatcacccattccctcagggatgatgaactaggacactcatgatatagctgatgcatgtgttctacaaaatgaaaaattaaatcaagaaaaaggagcttataggattctgtgaccacaggtcccaacaaaagagaaaaatgaagaaaatccctgggtcatttttgattaagaaaaattaaaaatgaccattgtgcagccatcctaaagagttataagtccagaatgatgtaaaactcaagcctcagaagagaaatacgtcttcaggaaaattaaaatgacatgaaggctaagtataacatggccaatgtttttgataaaatgttatgaacaaaaaaaaaaaaa

SEQ ID NO: 4464 - DNA, 826 bp, Homo sapiens
ctagagtatcacccattccctcagggatgatgaactaggacactcatgatatgactgatgcatgtgttctacaaaatgaaaaattaaatcaagaaaaaggagcttataggattcagtgaccacaggtcccaacaaaagagaaaaatgaagaaaatccctgggtcatttttgattaagaaaaattaaaaatgaccattgtgcagccatcctaaagagttataagtccagaatgatgtaaaactcaagcctcagaagagaaatacgtcttcaggaaaattaaaatgacatgaagactatgtataacatggccaatgtttttgataaaatgctatgaacaaaaacaggttacaaagtagtgtgcatatgtgtgtgcatgtgtgcgtgtgtgtattattctacactataaaaatttatggaaacttatttattagaaaaatattggcaagaaatatattaaaacaaataattctccacataactttttctaatgattttgggaatttatgccttaccttattcttaagtagatttggtgagttcagctcactggaacatttttatatattatttctaattttttactctaattcagccctgcgggaatttaattatattctttgcctggttttgaaggattacaaatgtcttctgaggggttaaattaacttggtggaacttcacccaaggggcctaagtcatactcaaaactataaaaggagttttggtcaaggaataaaagggatttctacttacctttttaaaagttcaaaaatatggctatggtgatttatagggaaataaagttggaaaataagggaaatggacc

SEQ ID NO: 4465 - DNA, 303 bp, Homo sapiens
attttggctcctataaatgatacttctgggaaattaagatatagatgatacacatcacaactccttcaaccacaagtaaatcaagcacattggtaatcctttacaaaatttaagaaaatttaattacgttatttcttctatttgaattttcaggtgtatggcaaatatctcaccaaagaaaattattagtgaaacctcaaattgagcagttattactctttcacaaaattatatcttatagaatccttgagcgcatcaagtgaactgcaatgtcatgagtaataaattaaaaagaacgtaaaa

SEQ ID NO: 4466 - DNA, 150 bp, Homo sapiens
gatatggcaatatttgtagtgcctcgaggtgccaagttgtttctctcttccagtgcttgcacacggagtaaatcctttacctgaagagtactttttcaatcctattctcacagcaaattattattaaaagttataataaaaaaaaaaaaa

SEQ ID NO: 4467 - DNA, 391 bp, Homo sapiens
tagaagtggctcccttcgccgcactcccacttcggggtaaccgtagagattggcagcaatgccccagcccctcaccagcactgtgcaaagtgactttgacaggcagagaaaagccaacccagtcgaattcgtctggaaagcattccagcaacccagagaggagcctctgtttctctctccgggaaaaagccccaagggttttgctgaacccaggtcttcctgctcatctctcagcagttcagagctacataaacaacttctgaccatttacgcaatcatgtaaacctaccctgacatctccactatgtggaaaagatgttaactggaaaactatttttaaactactgcagtaagcaaataaacatccaactgcaacacaaaaaaaaaaaaa

SEQ ID NO: 4468 - DNA, 545 bp, Homo sapiens
tcactccccccacgtgtagagtactagcacatacaacatcacttgtgtaacgcccactgtacttctggctgcccaattctcaacaggaatgttttcaatacctggccatcctatagttcgtgagaagttccaacatgcccacccagaaattagaaacctgaacaacccctgactctagcacggtctttgaaccccaatctgaattgtatacatctgtcttcaaaagaacttaagatccaacatgaaactcatggaggaaaacattgtcttcacatttagaaggtggggttctaaagcgcgaatttttctgtctggtcaggattgctttcttatttctaggacccccaggtcaattgatactttctcgcttcatgtctctgttcttgaaagaattgcttgactgccaaggttccctgtgatctttaaagcacaaacttacactatgataatatcttacatgtaatctccagtgtatttcaacgtagtgaagacatgtcttttctcaggctgtaaaataaactttaacatgtccaaaaaaaaaaaaa

SEQ ID NO: 4469 - DNA, 233 bp, Homo sapiens
tttagagttctctgtctgccccagtaagagggacaatgagtggagcacaaagggagacaagataagccctcaagaagtttttctgatgaacacacagcaaatgatcatctaacctccatgtgacactggatcaacactaatgaagaactcactgcctttcaggaaaatccattctgtttgggtcagctccagtgattaaaacaaacaaatgaaaaaagccaaaaaaaaaaaaa

SEQ ID NO: 4470 - DNA, 289 bp, Homo sapiens
  misc_feature (1)...(289): n = A,T,C or G
ctgnaggtcactgtctgccccagtgnagggacaatgagtggagcacaaagggagacaagataagccctcaagaagtttttctgatgaacacacagcagtttgctctttcaaaaaattatctgcaaatgaagaatgttattgttccttcttaggcaaatgatcatctaacctccatgtgacactggatcaacactaatgaggaactcactgcctttcaggaaaatcctttctgtttgggtcagctccagtgattaaaacaaacaaatgaaaaaaaccaaaaaaaaaaaaa

SEQ ID NO: 4471 - DNA, 574 bp, Homo sapiens
cctgtgggaaacttgatggggagtactccagtccacagtcatttggccctgggcttcatctcaacttcctggagggattctgttcatctattcatctgtcatccacctctctctccgttcatccattcatctgtccatctactcatccatcatccaatcacttactcacccagcaagtaccaattgggagcctcctatggatgaggaaccctatcaaatgctgaggggcatggaattcagaggcagtgcctcctcctctccaagactggctatgatatggaaagtcgtggcctcacaccacgccactggtgggcattccagaggctggcagagcagctgtgccccagggctgtcatccactaaggcctctctcggtgtccatgggcattttgaggactccagggctttgtcctttcacctcttatttattggttctatgccactgtctctaccgtacataggcctccctctttccttttgtttcctctgtatttcctcctctcccttctagtcttttgttccactggaaagagtggaaaaattaaatgattttaaactgttaaaaaaaaaaaaa

SEQ ID NO: 4472 - DNA, 272 bp, Homo sapiens
caggtaatacatttaccactttgggaagcttaggagggagcatcgcttaagaccaggagttcaagaccagcctgggcatcatatagatgtctcttctaaaagcactactaatgcaataaaatgtattctcgttgaaaattacatctgcagagaataaaacaggaaaaatctgctgtcttttcacactcaattgtttatcttctgatctgattcatcttgccattgtatgttgcatataagttgtaataaactaaaatttaaaaaaaaaaaaa

SEQ ID NO: 4473 - DNA, 217 bp, Homo sapiens
atggaggtgggcagctgtgcaagtacctgctatgtaagctccaaaattcagatgacacctgtcttcatcatgctgccccatggaggattggggcctgggaaattctcacgtgatgttctataagtaaatacttggtcttttctctgatctggaaacctcgcgttttctatcaggataaaataaatgcatataaaaataaaaaaaaaaaaaaaaaaaa

SEQ ID NO: 4474 - DNA, 404 bp, Homo sapiens
ctaggctgacatgagttgcacattctcggctcactgcaacctccgcctcctggattcaagcgattctcctgcctcagcctctcgagtagctgggactacaggtgcgcaccaccacatccagtgaatttttgtatttttttagtaaagacggggtatcaccatgttggccaggatggtcttgatcactcgacctggtaatctgcctgcctcggcctcccaaagtgctgggattacagacgtgagcctgccttgttatgtttttatagtttactatgcttcatctaattcagtatacacatgctcatctcgaactgtgtctttgggtctttgtttccttatgaagccttcgttgttacaaaaaacttgcattaaataaatctgaatgctcttcaaaaaaaaaaaaa

SEQ ID NO: 4475 - DNA, 1036 bp, Homo sapiens
cctgagagaaactattgtattatctttcaatgcgtgaagcataacaaataagcgtaatcagaggaggagacagttggaaacttcagataccgagggtaactgtattagtccattttcacactgttatgaagatactacctgagactggataatttacaaacaaaggaggtttaattgattcacagtcctgcatggctcaggaggcctcaggaaacttacagtcatggcatatgaggaagcaggcaccttcttcacatggccacaggagagcaaatgagaggggggaagtgctagacacttatcaaacaaccaaatcttgtgagaactcactcactatcaggagaacagcatgggggaaaccatccctataatccaatcacctcccaccacatccctccctcaacacctgcgaattacaatttggattacaattcaagatgagatttggatggggacaaagagccaatccatatcagtaactcaatcaggcatgtacaatcaaattattatttttaaaagtctcttggaatagctcctctcagtttggtcacgctactctaagacagaggttcatttgttttattttacttctaattttgcgaggttgctttttaaaatttcactttgttttacgattatgtaaagcgtttccatggctccacagtcaaatccacaaaatatatattcaaagaagtctaggtcctgtccccaaccctctactctattctgcctacccctttttaggtaatcatttcttaagtgttttttcttccattgttttattttaattatatagtcctacctcctccttaaataaagagtagcatgatatatatacttttctccatcttgctcttccccccaaaccttgaagaatgcagaggctataagtgccaaccttcacgcggtcaaaaatccaagtaaaactttttagtctgcagaaatgtaactactgtaaccactaatagcctactgttgcctggaagccttactgacaacataaatagtagattaacacataaaaaaaaaaaaaaaa

SEQ ID NO: 4476 - DNA, 847 bp, Homo sapiens
cgaacaagatcgtcctttaaaataattttcaaaataaagaaaaattggtgccccagctctgccgtccctgaatgatgggttggaggtccttagattccaacaggactcttcctacctctcagtctccccaagacatggccaccccaactctgcagctctggttgagatgtcctcctgaaagccagactgctggacctgacttcccgctggccatgacttcctactggccatgacttcccgctggccatctcccccaggtgtccgcatgccctacaaagtcaactttaaattgtggccattacccctccctaatccacttgcttctccaagtcccagtgagatcgtcatgagacaaatatctgcctgtggctcttacctgctcaaaacccttccacggcatcctattgcctacaagattaagtccaagatgttgagcatctttttcgtatgttcaattgccatccgcccatcttctttggggaagtgtttgctcaaatcttttgctcattcctcattgggctgtttctttttttctaatcattgaagccccacgactcccttataaattctctggacacacctcccctatccaatatccgacccgcccccgtttctcccacctagttgaccaacccttcattctctccgcaattaaaagagcatacctcaaccacaaaacaaacacggccttcctcgccctcagcagatgaactttggccttctcttccccttaaaggaggtacattcactaatccttgctaacctcctcgctcccccccccattcctgttgtggatgtcggcctatcttcctcccacgcgctgacaccgtctgcacaccacccgggc

SEQ ID NO: 4477 - DNA, 696 bp, Homo sapiens
acaaatacaaatatgaaacaaaaacacctggcgttctgcaccaataattcgctcgtcttctaaaagtaatgaggattgccattgtaaaacaagccaaaatttctaaagacctatcttggtacagtccctattaaacctgaaaccaaaaaactggtaattcacaatatattcgtaaagtcgtcaagttttcatcgacccttgtaaatgattttaaaaaatgctatctgaaacaaattttggctccctcaatagcgcggtgcgcattgttgcaaaattgactcccggaaaatcgaaaaagaaaaggccaattgccctcatatcgacttaaccacgcctaaataacaaagtcaagtttttatccaggaggaagcgcttaaaagggccaattaaaacccattacaataaaatacatcgccattctgagtaggaaaagccacctgcctgcagggacaccatcagcttacctcctaccccaactgtttgttgagagcagtgctgcccccaccagttagggactggctgcacagcatacttgttgggggtaaaacttgttgcttttatgtgtgcttgaaaacattttccaaagttacccaccagaaatgcaatcatattgtttatttttaagtgttctataatgttaaataaagctttgatcttttaaaaaaaaaaaaaaaaaaaaaaaaaaaaaaaaaaaaa

SEQ ID NO: 4478 - DNA, 836 bp, Homo sapiens
gattatattacaagattagagtttttgttgtgtaatcgatatcgtgttggccagcatttcccacttggcgaaggactttatagtcaaactactgattttggaggctggtcatcgcatgtcagctggccaggccctggaccatccctgggtgatcaccatggctgcagggtcttccatgaagaatctccagagggccatatcccgaaatctcatgcagagggcctctccccactctcagagtcctggatctgcacagtcctctaagtcacattattctcacaaatccaggcatatgtggagcaagagaaacttaaggatagtagaatcgccactgtctgcgcttttgtaagcagatgacctctaaactatttttgcctattttaggaccatttcatcatgattagggcaccctcaagctccaaagacacgggactccatggtattgttggatactattgatcttgacttttaacattttcttgttctataatttttcctatacctgtattcattttcccaaaatatactgctgcaaatgattaacagtttagtaaatactagctatgtttagataactggaaacaataaatagataagaaaatctttacagcatgtaatggattaaataaaatacaatactatagaaataagggatgtatatgtgaagggatggggaaccagagacatagcaggaatagatagatttggggaatttatgtattgatcctgcaattactgattgttatttaagcccccagctaccgtggttacctacggaacactccgacgcctcccaaaggcctgcccaccccaccttactccggagatattcatga

SEQ ID NO: 4479 - DNA, 1131 bp, Homo sapiens
gatctgtcctctacagccacagtggataagggcaaattaggaataagaaagaagcaatcttaagagcagaaagaaagttgggctgtccactggcaagaaggccgctatctgcaaaccaggaagagagccctcaccaggaaccacattggtccacaccttgatcttggacttcccagccttcaggaccatgagaaataaatctctgttgcttaagctgcagtctatggccctcaatagagtggatgatgacacccgcattgaggaggacaatctaccttacccagtccgccaattcaaatgtcaaccttatttggaaacactttcatagaaacacccagaaataatattcaatctgggcaccccatggcccagttgcctttacaaagaaacaggcatgaaaaatagccttccactcaatatgccaaggaagataatttactcagaaattacattgtcctggaaactaatttactgcacagcttaaatgtgagcagcttattcccagaaagttattgactcaccttgactcaaaataagatcaagtatctttgccatccacagcacagagttttctaagccagagaccccaggactgtgtataacttactctctaagatagcaagccacttggaagtcactacggatgtgctttacatccacccttctcagaacacaagacccttcctagatccctgaggattgggggcattcctagcacacttcagagttttactttttttgtttgttggggaggaggcagtaatgccaaggtgggagagaagtgagctcgggtaacacccccaccatgataactgtcatgaaatttcatcaattctttcactgctttctgtttgctcacccctccccgactctctctgttgtactttcattgtaagagaagaagccatgtctctgttcccaccaccattcctgacctggagcgaacattcaacaaacgtttgtggactgaatgaatgatgggactttactccatttcatcacttcccattttccattctctatttttcctccttttttgctgatggttcactctttatttttttggaaagccagttctaagataaacagtagcaaaagcaatagctgaaataaagacaaaagaattaaaag

SEQ ID NO: 4480 - DNA, 696 bp, Homo sapiens
accgcagatgtaattgaagaatacatagcggctttagctgtaacagtgcaaaactggaaaacaaaaacatccttcaatgaatgaatgaaaaggagaggatgaaaagacaagctatagatcagaagaacatccaattccatccataccatggaataccactcagcaacgaaaaagaatgaactctccctacatgcaacatctcagatgaactctaggccttatgcagagcaaaaaaggccaacctcaaaaggttacacgctgtgtgattccatatatttaacattcttgaaattttccaggcattgggaaatagagggaagcagggttcactatagggggtgtgaggaagatctttggatgacagaacagttttgtgtcttgattgtgtcacacaaatctacacatgtgataaaactgcaagaactaaatatattacacacacacacacatacacacatgcccacatgcagatgagggcatataaaattggcagctgaatggaatctgtgcatagtaccaatgtcaagtttttggttttcgttttgcaatctagttatgtgaaattttgtcattgtggggaactgggtgaagaggacgtgggttttctctgtacaaactttctctttaaaactttctgtgaatttataatcatctcagaagtaaaatttttttaaatgcaaaaaaaaaaaaaaaaaa

SEQ ID NO: 4481 - DNA, 499 bp, Homo sapiens
attgtaggcacagaagcaaggctatgtaaagacccggccagaaggtgcccatctgcaagcagaggagggccaggacccagctctacaagcatcgtggtcttggacttccagcctccagaactataagaaaataaatttcccttgtttaagccaggagtcctcaaccgaaattgatccgtggcttgttaggaatccggccacacagcaggaggtgggtggtgggcagatgggaccatttagctgcaggaaaacaagctcagggttcccatgattctacattatgtagcccaggctaatacgaggagagaggaagagaagaacaatggcctgcccgtcattggattctgtgtgctctgccacagaatgcatagagactgccatcactcgacccaggaggtaatctgacctttattcctgcgagtatggtttatgattgaagtcccagaaataaacagactgaatttgcaggctggaaatgccaaaaaaaaaaaaaaaaaaa

SEQ ID NO: 4482 - DNA, 847 bp, Homo sapiens
tattaaaattataattataccgtttcgtggtatgtattaaaacatatttataacatgtgacttggtagacctactttctgcatacagaagagtcaacattacctgataaccacaaaaaatactatcctctagcccatgaaactggacagggaaaaatatactttctagaccttaagataactgcagatagataaagtctcaattactgcaggtcatgacaacacaaagaaattgcttcataaagttgattttacagaagaactaaagcaactgcctaatagattgtctatattatttagagctttcattgtctttggatgttaagtcaatggtgtgtaagatacccaaatctaaactatatcatataccagcttttgtatttgtttttgcatgtgaatgcaaaccttagaaaaataatcatatataaaatggttctgtaaagaagattctcagggacttaacgatattaagtttctaatcatagtaaaggttgcaattgtgaataactaagagattataccctcccaactcactctatttttagagggagaaaaagaatctttggagaacctatatatttttttaaaaataacattggccatgtaaattactaggaatatgggagggccactttaacctgaataatgccatttaagatctatatgtttcagtttttccacccataataagggtgaaatattataacagtattactttgattactgaagcaatttctcagagtgtgttgtatatcacaagttagtaaattatggcccacggccaaatctggtttgctgcctgtttttgtaaataaagttttattgaaacccaaaaaaaaaaaaaaaaa

SEQ ID NO: 4483 - DNA, 730 bp, Homo sapiens
aggcacttaaccagtactgggtaatggaacagatcaacgttctcttcttcttgacgtgatgggacagaccaacatcacgttccttttgatgtgatgtcctacggcaaataccacagcaattctacagcatttctcctaaagaaagcataacctcaatctagttatgaagaaacatcagaagccaaactaaaggacacgggacaaaatgaactgtgcttttttaaacatcaaggacatgaatgacaaagtaagcctgaggaacagttctaggctaaaggggacgaacaagcatgacaactggtatagtatataattcttatataattcttgactcaatcctggtttggagaacatgtttgtaacttattggacatattggacagctcagaatgtttgaatatagactttggattagataataatgttacatcaatattaagttttctaattttcgtaacattgaggttatataagtaggtgttactgtcccaggaagtatacactgaagcatttaagagtaacagaccatgtttaaagtttactcatcaatggtttatatttttcaaatgcaaagctataaagtaaatgataaaggaaatgaagtaaattttaagtaactggtgatacttggtaaaggctatttgggagttttaaatatggtatcagaataaaaagtactaaaataaaataaaaaccttggaagtcaaagacaaaaaaaaaaaaaaaaaaa

SEQ ID NO: 4484 - DNA, 427 bp, Homo sapiens
ctggttttcttgcctaaagcccactcccttggcctgcacaggagcatctcagaaatttgggagccaagaacccccggatcacacttccattctcgccatccgtgggtcacgtctggggagccttctgtgcacactccagtgttcccttcggaatcaagcccattgcctgcagcaacaatcttgacacacactcactccccttccggtggattttccactggatgccagtggattttcctctgccctgtctctctctcctgcttcctggaaccccctccttccctgacactgaccacctgcacccaagtcctcatcccaggcttggcttttgggaaacccactctatggaagttttccatagagagatgacaccttacattttaataatactttctacttcatgaaattgaaaaaaaaaaaaaaaaaa

SEQ ID NO: 4485 - DNA, 656 bp, Homo sapiens
cgttctccattaaagcttgccacttcttgagaccatatcttccttttacttctgattttctccaaagacaagaagaggacacaaggtggaacaaacgagagtccgcaaagttatacgagtctgggcaagccatcaaggctgaactggaaccagaatttgaaattaagtgacttgtgggttgttacatgcttccaggttgaatttccaaaggaatgacattgaatatacagatattttctctatttctaccctctgaagaaacaagcatgcaggagaagataaaatgattccaattttaatatcttttacattttaagtaagagaactatgcattattctttgtggactcttaggctctgaaaatctttttttaaatttaatattataaacttgtccatggaatttcacaaggaattgtagatcgacaggactctggtctctacaagtttgctgagacctgaattgaaatctgaaaatttacatatcaaccaaaatctgatctttctttaaagaaaattcccattgactttattgtatatcaccagtgggtgagaattcaccatgccacaatgctgggatagcttgtcatctcacaccatgaagtggtggagcactcttgtggggcagggaaaaaaagacaaaaaaaaaaaaaaaaa

SEQ ID NO: 4486 - DNA, 116 bp, Homo sapiens
agatggaccaataatgtgttgacaatatatgtgtccaaataaaaatgagaaaacataagagcgccactgcactccagcctgggagagagcaagactccgcctcaaaaaaaaaaaaa

SEQ ID NO: 4487 - DNA, 796 bp, Homo sapiens
aaaaacttaggaggaccggagtcttctgctgtcatcaaggaagctgtgtcaggctaacttgttggcttaaagaatgcagactggatggctggaacatgggcaactaacggggccatgaagcaaaagccgcatgttgaggatggcagaggtaaaaaaaaaaaatcaagagactttggaatcccaacagcacacagtgccatgcctgcatagcttttcctgaatccagacttccagaacaagagagaaaaatgaacttcaattgcttttagctactgttattttaaactgtgggctactctaagctgagccatactgtaaaggttacaatggcaaaggatcaggcctctatttcaaacataggttcctaggatgttggcagaataaacataaatgcagtaagaatatcataactagcatccgacttcggaaggagaagagaaatactccgtcataatttctgaagtcctagcaggactctgaggcttctatcactgtttacagaaatctaatatcctgctgatatcatgacagaagaagttgaaaaggcctcttttggagctgtcttccagaatgtaggaagtgaatcacacttctccattcattaaacaggttgcattaacttcctagaagatcagaaaattaatacagaatagaggagcctacctcccagagaaaggacatttaattagtagatctatgagagttaccttcctagctagagtttttcaatttgggaacttttctgagcagctattacacaatcttaacaagaatgtacagaaaatcaataaacttg

SEQ ID NO: 4488 - DNA, 497 bp, Homo sapiens
gtgttattttcctggtgtggagaataaattgtggtggtgggtgcctatagtcccagcggctccggaggctgaggcagaagaatctcttgaacccgggaggcggaggcaggtgaatcctgatcagcactcacttcccaagcttctgcttagacttcaggctctgattactcaactccgccccaccacttcctcaatgctgcagaaaaaccatcacaagtgaacacccgccaactgtggatgctttcaaggtggaagttcccctttccttccagtcttggccccaccataagccatcagtgagccttagttgtctcagttgctgcagcttctcatttctaagtgatcgtacctgaacatctatgaaaggaagaaatgaagatttagagaaataattcactttttaaaattggaagatttttttaaatcaagtatttattagtgatattactacttacttattaaatacttttttccccaataaaaaaaaaaaaaaaaaa

SEQ ID NO: 4489 - DNA, 471 bp, Homo sapiens
cccttgaagcaaacataagcacagtacaaaatgaaaaggtatacgttacaactgaaaccacagaaagacgaaacatcattggaggctagtatgaatatctctacgctcacaaactagaaaacctgcaagaaatggataaatttctagaagtatagaacctcccaggatgaaccaggaagaaatagaaatcctgaacagatcaataatgagtagtgaaattgaatcagttaattaaaaacttcccagccaaaaacaataaaaacagcccagtaccagatggattcacaatcaaattctaccagtagtacaaggaactaataccaattctttgaactgttcaaaaacattgaggagggaatcctccctaactcattccatgaagccattttctcaaacatataatgtgtatctattatatacttttgtgttatggcaataaaaattaaaatggttatgataaaaaaaaaaaaa

SEQ ID NO: 4490 - DNA, 795 bp, Homo sapiens
gagaatgaaaagtatggaagctttaaaacaatctacagaaatgtgataacctgctgaatagccacaactagaagggggaagaaaagaagaaaagaaaacttctacacataatattggatgaagttcaatatgccacacagaaatccatcaatagattctgacaaactagtattaagcaaagaaaattcatggttccttttcccagtaacttggttcagataaaaaaaaccctaggactaaggtcacatatatagcatgacagtcagttgggaaccaatctatttatctttgacctgacatctgacatttagttgtccctttgtatgctgaaataattgcatgtatatcaaatgactgcaagaagtgaaaaccaaaacaggccttcatatcctgcacagggaatatgcaccatttggcaagacaccagcctcccaggccacgccagcatttgagaccaatgattatcaatgatgatgtcatcagcaacaagtagccaggaatcgcccaatccagacaagtccatgtgatcttcatgttctgctttcttgtgcaaaggcattcatcttttacgtacccgatcaaacactgaggttctaataaaagtagcttctatggagtcttcggatcttagggaaatatcttcatcagccaaaattaatacattcatacattatttttttaaggtacactatttcttgtctagtttgcattttggttaatttgtcaagcacaagataaatgctttttggccaaaaaggagaagttttcaataaggaaaacttggaagaaaaagaa

SEQ ID NO: 4491 - DNA, 785 bp, Homo sapiens
  misc_feature (1)...(785): n = A,T,C or G
cagtgtgaagcccatgacttatatgtcagattaagccttttgttaagaagatataagcatcgtcatgagaaacaccagactttggtttaagtaactgctctgcaactttcggacctacgtggccttacgaatgcataaacttcttcctggaagctggcgctacacaggtgtggactgttccatatatgagcaagcttggacacagatatttttgtgaagggcagtaaggctgggcacaatgcctcacgtctgtaattccagcactctgggaggctgaggtggaaggatcgcgtgaggccaggagttcaagaccagcctgggcaatacagcaaaacaccatctttacgaaaaaaaaatcattaaaaaaaaatagctgaatgtggtgatgcacacctgtagtcccagctactcatgaggctgaggtgggagccacttgagcccaggagttcgaggctgctgtgagctgtgatcatgccacaccactgcactccagcctggaagagagtgagaccttgtctctaaaagtaaagtaaaatataaaactgggacaatgaatgctcaccacaaagtccccatcccccttcttgggggtccattgtccattacctcacatcatgtctncatcaggacagcctgtcagtcagctctagcacctctcagctctaaactgcagtagagagggaggacagaccagaacgaggagtctctggaataaatcccatcttttcaaggggattccttgcctcagagagggtcagtgaagccgaanaggcactgtgaaggtg

SEQ ID NO: 4492 - DNA, 206 bp, Homo sapiens
agacccatgccctggaatttaatgaagcactttcttctcaaatctggctttcctcctgaccctcccaatttctctcaaacggcgaggagaaagaagaaatacccatcgacgttgaatcatgtttggcggagaaataagcttgttttaccactgtttgtcattggaattatcttacattaaaaagattacagtgaaaaaaaaaaaaa

SEQ ID NO: 4493 - DNA, 572 bp, Homo sapiens
atggaagcatcttcccaaaacactgagcagagaattccagaaggactctgagaaaacacatggcctctgcagtcagcagcagatccaaggcctcttctgtggagtctgttccctcttcccacccacacatctctggatacttctgccagccatagattttccttctgtgtttacctcgtttgaggctcaggtgaaaaaccagatgacttacaaaggaatcagatatcgccattggccttttctcacaagccaaaacatcatgccactcgatctgtttttgtttgctttttaacatgaaaaaaatgcaggctgtgtagaatggaaaatttgtgagaaattctattgaaagagaaattcattgaacttggtggacatcgacaaaaaagtttagtcatacttattttctaaataataaactatactttggttgggtaagtttggaaaatgtaaagcatgaataaatgacacacattccttaatcctaattctcatatatgctgtttacattttattgtataatgcctatacacaataaacaaaatccaggctgtattcttttaaaaaaaaaaaaa

SEQ ID NO: 4494 - DNA, 995 bp, Homo sapiens
tctgcgggttcagggcatacttcctgtcacaacctgagagaccccaagtggatctttctctagtcaaactttcagatgagaatacaacccacagacacttcgatttcaaccttgtgagacgttaagcagagaattcacctacaccaggctcagattcctggtctacagaaactgaaataataaatagcggatgttcgaagctgcaaaatttgtgataagaaaactgacatgaagagtttacattatttgccaaaagtcacaccgttaataagcaatgaagccagaattcaaactcttggagttcaataaaggagcctcaactcttagccaattgtaattacactatactctgttgcctcccttatatacggactaaatgttttttgcttgtacttaaaagtacagaattcaaagcgaaaaaagccaaaagaaaagaatcaagaacgcttataacttctctgtacaaattgttcactgtttttttaacatataatgcaactttacaacttcattcaacattcactattttggatatttgtgttttatttcagccactttaattctactgtgttaaacatattatatagccacaaaatttagtatactaacctttgattttttttctctgctttccctctgaaatgattattttaaatgcctttcgacagaactcattttatattagatactgtaagaggtcacaatagcaacatttgtataaaaagtcacgaaatgtatatttggtcatggtggagggctgaaattaaatgcttgatataatttataataatactatttcagaatttatattttatgtggtaaagtgccaaacccatttaaattgtatccccttaaatttttagagatgttgggaaaactttccatatttattaagcctttggtacttgtcggcgtgtggagttgcgagagaattgctcttttaaattttgggccctggctccaattttttttatcctatagttacatcacggact

SEQ ID NO: 4495 - DNA, 231 bp, Homo sapiens
cctaggatgaactatgatgattggtacctgtgagttggaaggccactggcggacactgatacaggcttaatgacatggacttccttcacagccatatcatcttgagcttgtgctcacttgaagtccaggattttactttactttttccacatgagctgccatcacatcagatatgtcctggcccattaaaaaaataaatttgcacttctgattatctcaaaaaaaaaaaaa

SEQ ID NO: 4496 - DNA, 324 bp, Homo sapiens
agttaattccctgtattctgtccaataaccaatttgaagatgaggatacatctttaaagttgcagagaaattaagctttgcatcactactgagttccggctaacaaaaagaagaaacaaaaactcacaaaacttctaaacgttgctttttcatttcttccttctgacacctggaatctaaacacaatagctgaagtattagaaccatgatatgaccctgggaaaagaagccaaactgagagaagtgccgcttccttagaacatcttctagactgttttacccccaatgtctttaacaggaaataaataagtttctacctcaaaa

SEQ ID NO: 4497 - DNA, 425 bp, Homo sapiens
tttgggaggccgaggtgggcagattacgagatcagcagatcgattggtatctcctggctaacacggatttgccagttttatctccaagactgatgacttcaaacaagaacaccccagaacatattggaacattttgacctgatgacgactcctcttatacaagacccgttgcacccttctttgataagtgattgtgctggtttatccactttgcctaattaattatctttatcttgctagatgtcacactgcaaaaatgtccacttacactttttacccagttagagctcaccctcttttctccctcaaacttcaattctctgctccaattattctcaaaatatttccatgtttgtttgtatcaactaaaagcatttttttcattgaataaatatttatttatttagtacccaaaaaaaaaaaaa

SEQ ID NO: 4498 - DNA, 437 bp, Homo sapiens
agttttctcgaagcctctctcattcattgactgtgggccttcctccggcttcaaaaccagcaatggtcagttaagtccttctcagatgaagtcactgtgacctctgcttctggcttcacatcccctgagccagagctggtgaagagaggtgtctctgagtcacactgtgcgaattgccatggaacagagttaagctgttttcacattgatccgtatcacaagtcttgatgggagcaggactgtggaaggtgacactgcggcttctccctccttaacagttcacctatggtctgtctgaggacagacacagtgagaagatggccatcaacaaaccagaaagagaagccccaccagaaaccaaacttgctggcaccttattcttggattgttagcctccagaactgtgaagaaataaaattctggcctcgttggcctca

SEQ ID NO: 4499 - DNA, 931 bp, Homo sapiens
  misc_feature (1)...(931): n = A,T,C or G
atttattttctagatgtttgttgaggatccaaattgcaccaggctctgtgctagactctgggggagacagagactaaggatgaatttccccccacttactcctaccttcagggactatgacggtgttgagatacatctcagattagttcattaatgctgactcacgtcataacactcattccaagatgagtgaggtcgggggcgaccgtggacagtctcacactggaggtaggactaagtgcagttgggctgtgggaggagagtcggtgttttagggagcacagagaagcaaaggcaatgagtgtggatatcagagagaagaatcccgagggctgagggctgatattaaggcagagggagatcacactgccaggaaagctagggctaattggataatccaggaactaaaaggcttcaatggaatagtccagagacagcaaaaaatgaggtacacctgctgctacatctttgttttgaaggggagacgtcattaatcaaccaccttcttacggggcctgggccctttttcaacccggtggatccagggaagccaaccacaagcgattgagaggggtgcgtacattgatgaacccctatttagcgatgtggtgaggtctggcgttcttctgttccaagctgggagagctgtgtggcaagaatggagagtgtgtctggtgcgtaggagtggcatggtgtgggcgcgcaaaggcgagacggattaactgagagccactgggcgtggctggttgccgcgagacgcgctgcagtgagactggttgacaattagantggcggtcggcgaaagggcgtggagagacgagntgcggaacataaacgcgcgtggcagaggcctggatggccagaaaagattgggatagacaggtgtgaaccgcagaggcaggnagagaagtgtggagattgtgcgagtggc

SEQ ID NO: 4500 - DNA, 516 bp, Homo sapiens
tgaaatccctctcgagggttcaggatacaggaaaagtagttatgcctgaagataagttgctgacttcgcttctacttcagtcacccctttctgatcttcccaagaagaaataaagaatgaacattaaggacaattatgaagcaatacccacaataaaacaagaatgagatcattttattattcaaggtactatatttggaaattgaataatgcctttttttttccagtctaaccactctggatgttatttcaatccaattattttgttggaagaagtttttagattattttaactctggctaatgaatacatcccattgatattaaaaagaactgagttgggcactgactttgagggcccagaagtgaattattgtcttagaactgacttcatctgaaattcacttactatcaaatgggcaacccagcatagaattcacactaaaattcctaatgatgacacaatcattctttataaataaataaacctggagttttaacactaaaaaaaaaaaaa

SEQ ID NO: 4501 - DNA, 828 bp, Homo sapiens
atcacaataatgaatatatttcaatagttacgaatgtatagaggtgggtgaatgcgaggtgctggaaaccatttgaacagaatggaagtaccaacacaacttggagttgataggaaacttacaggcatgctggttcacatggtacccaagctcctttctgcagtatccttggagatgtaacattatcttcaaattagaagaagctaatagtttagataatttctaataattactactttaaaaatattttaaatcatattccctaaaaatgatgttttcaaaactccaaaaatacatgtcaaaattatctatgataaacaggtcacaatgactggaacaactgacctcctctctacatgcggagtctgatagctaatcacaaagaattgtcttgtcgtaatgcacgttaaagagcgagaagatatcattctggtattccattctccacattctcaatttttagggatgttttccgctggaattgttcctggcttttacacagatggactaggcaagctatttgcttttgttcacgaaatggtaatctaagaggtctgttttgaaattgacttgttaggtaagttcgggggagaaaactgcctccaccacccagattgaacataaaacatatggagtttgcgagatgtgaactctcgttatgttgtttcggagtctatgaaacgtgctttctataacaacttctatgttgatatagataactaatgtgtccatgttgcgtggggaattctaccatgaatgtggtgtgaagaaagtgtgacgcccggcgaccataatgtgtggtgagagggagggtataataaataggtt

SEQ ID NO: 4502 - DNA, 471 bp, Homo sapiens
tagatacaaaagctgatgcccagtaaggatgaatgacttaacctaagacatcacaggccgtctggagaagtactgaaatcgcaactctggtcttttggccatattcagtgctttatacttcagttttacagtcttctatatgccaggcactgtaataggtgtcaataagatgttagttccccgccctggagaggcaaatggtcacgtggagaagagatgtaatttccgaataataatatggataaattatttgagatattacaaaattccatgagaacatgggagatgtcagacaatgccagctgggaattaggggaacttcgcaaataagataatatttaatcagagttttaaagatgaataaatattgatcaggtatattttttgcattcacagatacttactggattactattgccagtttagataagtgccattttaaaataaaatagaaaagcaaaaaaaaaaaaa

SEQ ID NO: 4503 - DNA, 508 bp, Homo sapiens
gcagctgctcttaagagaatggacatgaagagggcaagagcagatatgaatgggcccactgcgaactaaggacagcaactaataaatcctatggaaaagaacaaagcagaagccaaaaatatgcaaagtataaatgttcaaagttccagaatgtcaactcagtccaacttcttaagtgttggcagaatacgattaacaaagaaacaaaggtgatgggatggtggagggctcaatgacactgcagaagacactggaactgccaggaagaaaacataatcagcaaaggacccagtctttgctttaatatcatcagtcgctagagatcatgatcaactgtgatgcaggtgtgactcatcgtgttttcatggtgaaccatggctgactcaggcaaagcactgatgaagacaaacacagggacaattctaagatgttatgcaatcattcctcatcttataaaagaaattttttaaataaataatatttagaaaaatcatcaaaaaaaaaaaaa

SEQ ID NO: 4504 - DNA, 305 bp, Homo sapiens
cctaggagagactgctggagttacattgtcacagaaatgccctcacctgccagagcgacttgcagtgctctgtagaacctcactctcttcgggaatcagaagataaatcatttccacacaatatccgaaaaggatgtcactctttctactatgtattgtggattctaagacacacacggtttttcactcttggacatctctgaagctggggatgtatcttataatccaagttgctcagttataattagcattttttctttctcagtggtatataaaacaatggtacaacttcaaaaaaaaaaaaa

SEQ ID NO: 4505 - DNA, 836 bp, Homo sapiens
tacaataaaaagaatacgattagagcacactatactaattatattttcaggttgacgacaccatgctgacccttcactgaggaccttagatgaagcgggcactaattcaagaggaaacgtccaggccgttccatctgccatcatgtcatcctttggaggaactgaaagcaagtctcgcaatttatatgtttgcatctcaagttgggaaatgtcctattaaaacaccaactaaaaaaatgcaactcacaaaagtctggggctgactcttcacttagacatatgcaaaaccatgcccaaattatgctacttacttttcatcctgctgttaactgtcacgatgggaaataaacaaagtcccagtgttctgttaggcaaatagcaatatatatatcaccctcttttggtaagccttcacactgattttgtattcgagagcatcaacaccctatattttaataaagaaaaaaaaattggttttgttggacacaaaaggtgattttctgcagcccctctctttttgcgaggccatactcacgtagtctcgctaccgagacttcctttaactgggttgtaaatagtagcacagaagcgtatcgtatgctaccaacagcagatatacagtcactcctgagtagagagtggtcgcatctgccacgctctctgaagcttctatgacatgtgaacgttatttttctatagaatagtgaatgttattgttcatatgtttaaatggcggaatcgtagatggcagtataagctatgttcctagaaatcaacagggaaccaccccctccgcaattctaaaccaaggatacccccagttaaacgagtagaca

SEQ ID NO: 4506 - DNA, 330 bp, Homo sapiens
tcctgtaacttcaaaagtatgatcacatcatttcctgattctctccatttctaggctactgttaagggtaataaccgtgactgcaacactgtctatgctatcaccacaaacattcaaactacaaacgaagaaatccatcggttgccactgctatcctcattccaccatctaaagaaacatagagctcaacacctagaaatctcaactggctgccctctggactcagaaaatggatttatagtctgctccaaccattcatcttcgtttccctttttgtttccatagaaatgccccccattaaatgcctggtcactctcaaaaaaaaaaaaa

SEQ ID NO: 4507 - DNA, 240 bp, Homo sapiens
agtagctaccaatattaaccctcagtccttctctgaagcatcctacttgattgagcaggcaacacactctggggaacaggcttttggaccgatatatttatttacctaaggaatgcactcactaggaaataaaaacaaccaaccaaagaacagataactcgtgaaacagaagaaggattgacacagcaataatgtaaatatgaatgcaataaaataattcaagagataaaaaaaaaaaaa

SEQ ID NO: 4508 - DNA, 238 bp, Homo sapiens
agcggagaaagaacataccaaggattaaccctcagtccttctctgaagcatcctacttgattgagcatgcaacacactctggggaacaggcttttggaccgatatatttatttacctatggaaagcactcaccaggaaataaaaacaaccaaccaaagaacagataactcgtgaaacagaagaaggattgacacagcaataatgtaaatatgaatgcaataaataattcaagagaaaa

SEQ ID NO: 4509 - DNA, 238 bp, Homo sapiens
agaattaggaacccctccgctctgcccagcacactccaaagaggctccagtgcaaaggcaccgacgttcacagccaaatgtgtgtgggggttccccaggagtgggacgcttccactccgctccagactgccatgaatcgacagaaggttttatgtcaccaaatataccccattaacaaattaccctaacactcagtaaaaaaataaataaaaatgcatgcaccccaaaaaaaaaaaaa

SEQ ID NO: 4510 - DNA, 294 bp, Homo sapiens
caagacaaaacgcccatataaaaagatgtaaaatcatgcgcacttcagttccacgcaaagttctggtagtcactgccccacactatttatcattggtcttaagtgctgaactgccccactcctggaccattgctgaaaggtgtggcttcagatacatttgcaagcactttcttctagcacagcactccttgtcactactggctcattctgaactttgtgattctactctgaacaagacaataccttctcagccccaagaaaaataatatctatttttaagcaaaaaaaaaaaaa

SEQ ID NO: 4511 - DNA, 246 bp, Homo sapiens
taaaataaatacaccgacataaaacagatcgatcacaaattatagaaactttcagatgagcccagcacaatttccttcaagaaggatctgcagtcagcatgttcgtcttttaaatggataattagaccttagccttgtgcactcttatttcatgaatctttgtcaatgacttgtgattgtaataattgtgtatataataccaattatagcagctgcttttgtattcaactcttaaaaaaaaaaaaa

SEQ ID NO: 4512 - DNA, 783 bp, Homo sapiens
tcggttcttgggtcttctctctcttattcttcagaatgagtcttccctccagaaactcctctgagatttggctgtggtctcccacgccctgtcaggcagcgactgcaggcttctgtggttctcgtttccaaacctcgaaccatgagagacatggaggctctttgaaatgatggtgacactgctctcctggggagggctggacatggatcgtcctttcccagctccgcttaatctgaagcaggaggatctggctgagagctgggatgaacttcaatctggttctgccggatacaaaatcgactgagaaatgatgccaccaaccaaaatggtttctgaagtttgggaatgtaaacatttttttccttcttttagagattttcagataatggagtctggtccctctgtccatgggccatcagcacctgcagttcacaccacactttccagggaagaaggcatctacagcacaccacccactgcaggaacagtgcagattcccacatctacagcacagcacccactgcaggaacagtgcagtttcccacatctacagtgcagaacccactgcaggaagagcgcagaatcccacatctacagtgcagcacccactgggagaacatggcaaatttccacatatacagctcagcacccacttggggaccgcgcaaaatcccacatctgccgaaaagacaccttgtgggaacagtgcaattccccatttacggtaacaaccactgtggatcacggaaaatccctcctttcggacgggaccctcggagaaca

SEQ ID NO: 4513 - DNA, 784 bp, Homo sapiens
ttttaaaaaaaagtgaaattaaggatactggttcagaaattgcctgagtatacagacatatattccctcctttcaagacccagtgatatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttcaaaaaaaaaaaaa

SEQ ID NO: 4514 - DNA, 294 bp, Homo sapiens
caggggcatctaaagaaaacaacatgcaactacaattctctagcttccttggattttgcacgcagcttcaccagacagcagactgtgacccttttcatcagaccatgctagaaggaaagaaagactctgagcagaaggggtgagatgaagcagttctggccgaatcttgataatgattggacctgggcaatgatttcataagagcttattgtgctcatctccctactactatgtatgcttgaatatttgaataatgaaaataaaacttcttttttttttcgaaaaaaaaaaaaa

SEQ ID NO: 4515 - DNA, 752 bp, Homo sapiens
tgggagcttgaagattcctaactgatgcttcccccacggttacaaaaatctggaaattttacctatttcttttattcccataggagttaacatctattctggaatatgaactatataaaatgaaaagtgaacaaaaagcacaatacaatttataaccacaaataaagaattgtggcaactgttaaaggtgtttaaagcaataattttatttaggccagaaaagatagtcaaatttaagctaaagtaacaaactattaaaatgcaagccaatggaactttaaatcacccctcaaacatttcaatttttgtaattttgatgttttattgctaaacaacctgacatactttgcttcctgtactgtagcatttaaaaatttcaaaaagattatatgtgagtctggcactataaaattttctattttgtgttaacttttaaatgagaacttacttttatatttgacgtctgattccagaattcattatgcatgcgattgcaagaaatatgcgtgcgcactgcgacattaagaacacaacggtgcattacccaagccgtgcggtgctgtctgtcgaatacatgtgacaaatatcccggcgttcgtgtgatttcgctccacaacctccccaactataaccttacctgcagccgcggtacatacacacgctacctcgcccctggacactcagcgcgggactggccataaatcgaatcggtaatcgaagaatactgagcatcgccaccagacccttcgcat

SEQ ID NO: 4516 - DNA, 337 bp, Homo sapiens
  misc_feature (1)...(337): n = A,T,C or G
aattggtcacaatacaggtaatatatttttggaatccanagaggcatagggtctcactgtttgactgtttgacccaggctggtctcgaacttctggtctcaagagatcctcctgtctcagcatctcaagtagcaaggattacaggtgcatgccatcatgcccagcaagtctgcatttctaacaagctctcaagggataccaatgatgctggtctaggaaccactctttgaggaacaaggcattagagaattagttcattcacatagttgcaaacttttttccttttataagaagtatttgtgattaaaatttgatggagttgtgaaaaaaaaaaaaa

SEQ ID NO: 4517 - DNA, 683 bp, Homo sapiens
acatggacacacaagatatacagcccatggcatatccagtaaccaggaaagcaagcattctcacgacccagccgaactccttctaaccatcaacctgaaattccagctttatcaagactcataaagtaattgtgcatgcttcttgctcaatccctaccaggaaacctgtatctaccaggagttgtcatagaataagaagttcaaaagctggaagaaatcttcagggtcataatttcagcctcctgcttccagacagaactatttctccaccactgaaatgcatatagattttgaaaaaatttccagacataacctttcttaagtgtttggtttcaggagtcctggtagagtatataaaaatgatgacattctttgctatatatttgaaaaaattttttaaacttctgaaaaactgattgtattctttttgttctgatgaaaagatgtaaattcagaagaaaacaataagaagatgaaataaactcaggatgaggaaaataatctaaaaatagttattaaaattgaaatttcctcctatgaaaatttggatttctgatacttaaaaaatatatggggacatgtatgaatacaaccagttaaaaaataatgtgttataaagacaagaacttccagagatcacatgaatataaatggtgtgattcgctgaaataaaaaaaaaaaaa

SEQ ID NO: 4518 - DNA, 804 bp, Homo sapiens
cagactaaattgaccaaggaaaatgtgaaaataaggaaaagttgcattggtatttaaagctaaaggaagattgccagatgacacaaacactgaaaaatattttaatagagctctaaattaaagacatatactcaatgaagcttgccatttgcatttacaaagaaaacagcactgcctttgagaataaaggacactcccaaccccatggtcatttctcctaacttagaggaaaagaaaaaccatgagaccaataggaaacacgccactgggaatccatctgtctgccctaaaatgacaaaatgtaaagactgcaatgcaacagagctctgtagagaccagcatctggggtaaacagaagtcttatggcagtaatgagatagaagtggaatgaggctgaggagaaggtggcaatgagaggtgaagccagctggacttcctgggtccagtggggacttggagaacttttctgtctagctagaggattgtaaatgcaccaatcagcactctgtgtctagctaaaggattgtaaatgcatcaatcagcactctgtaaaaacacaccaatcagcacactgtaaaatggaccaattcagcattctgcaaaatggaccaatcagcaggatgtgggcagggtcaaataagggaataaaagctggccacctgagccagctgcggcaacctggtcaagtctccctgcttgctgcggaagctttgttgattcattcttcacaataatacttgctgttgttgactctttgggtctgcccaaccttaaaaagctgaacactcactgggaaagccacag

SEQ ID NO: 4519 - DNA, 357 bp, Homo sapiens
ttagggtcaagtttcaggtgaaatcactagacaagaaatatcattcagactgcctagggctgtgttctgaagctacagaggtaccttgatgtcaggaagaatagcaatggcagaaaatgtttcatcttgcatgccagcacagaccaatggcaatggatgtctgaatcactgggttaacaaggaaaagaatgctgtgcttaagtagcaatgtctgctctgagcatggcaggagaaattattggcacctctgtcagatatttgatatctatttcttaaatagaatacatacatattctaagaacaagaaaagcataaacaaattaataaattactttctgacttctaaaaaaaaaaaaa

SEQ ID NO: 4520 - DNA, 583 bp, Homo sapiens
tcagagaaaagcaactttgctaccaaacactcgggaagaaaaaggctatcagatagaagcgggtgaagaagctgagaaaacagaagagaaggatggctgccagctcgggactcaaaatggccatctgggcgtagagacacagagaccctttgcgcagacgtgcgccgagggtcttgcaaagctttcgttttctttgtgtgccgacctgcccctagaagcggttttcgatgctattttaaatgatattcctaaaatttccgaattgcttgttgcttatatatagaaatacactggatctttgtatactgacttgggattcagctccatgctaaattttgaattaattctaatggtttatttgtagttagttatcgattttctatacacaatcacgccatcagcaaataatgacagttttgcttccttttcatctttgtatcttttattacttttccttgccttattgcatgcactgtctacagccttcagaacaatgttaaagagaagtagtaatagtgtacatcttatttttgttcctggattcaataaaaatatttaatattttactttaaaaaaaaaaaaa

SEQ ID NO: 4521 - DNA, 247 bp, Homo sapiens
  misc_feature (1)...(247): n = A,T,C or G
ctcttcatatcagaactgatttggggccattggggaggagatgctgaccttctaactgtaatccaactgcacgcaactattctaaagaagatgaaagcatttttcacccctttgttgtgtaataaatacagtctttatattttgtcgcattttaagtttgattttataatgatctgtgaaacaaaattgttttcaataaacagacttagttgttggttactttcttanaaaaanaaaaaaaaaaaaa

SEQ ID NO: 4522 - DNA, 616 bp, Homo sapiens
gctaggaccgccatcacaaaatacctcaaactgtgtgacttcaacagaaatgtattgtctcagagtcctgaagcctggaagtctaaagtcaagatgttggcagagttgtctccttctgagagctgcaaggggaggatctgtccaggctcctctccttggtgtctcttcttctctccagccatgaagatggctgcctccatgttcacatcgtgttccccttgtatgtgtctgtgtccaaatgtccctttttataagagcatcagtcattttgggttagggcttaccttaatgacctcattttaacttgattattacctctataaagaccctatttccaaaaaaggagacattctgaggtagtgagggttaggacttcaacataggagttttgggggacataattctccccatgacaggagcacaagagaacgttttggagctggaaccatactactctatcttaattgtgatgatggtcccatgtatgtgtgtatttgtgaaaagtcataaaactacactttttagtctgaatttagggtgaattttgccacttgtaacataacttgattttttaaaataaaaaataaggcagatctcccaaaaaaaaaaaaaaaaa

SEQ ID NO: 4523 - DNA, 303 bp, Homo sapiens
aaaaaccatggtggatctacattcgatgcttcatgagaacatcgctgaagattttacatcggctgtgataattccccaggctcaaggctattcggcattcctctatggtagaaagtttaggcattcaagaagcagctgttgtcatattggaagacactcagatttatttcccagcaaaattcccgttttgtcctcaagcaaaatgtatgctatttgttgtgagtttttctgccttgtgtcatccacgaggaaaaaaatctaaaaccaaataaaactgacgcatcaccatcaaaaaaaaaaaaa

SEQ ID NO: 4524 - DNA, 487 bp, Homo sapiens
cagggggatacaaaagcaaaatatttgaagacatggaattttgccctactgtgaatatcagatcttttctaggagcaaatcgtttttcaagagtaaaagatatttcaaaggctatgactgaatacctaagaggagtagagaagaaccgcccaacaaaggaaaagggatgtggtggagagatgaagacaggttctcactccgtcacccaggctggacttcagtggcatgatcaaggttcactgcagcctcgacctcccaggctcaagagatcctccctgctccacttccccaagtactgggattacagacatgaagccgttgcacccacccaatgactaccttttgtattttttaaacatttaatttaattctttttcaatatgcctatttcttttcatagaaccctactatttatttatggtctttatttctttttaaaatattttattcattttaaaaaaaaagaaaaaaaagaaaaaaaaaaaaa

SEQ ID NO: 4525 - DNA, 678 bp, Homo sapiens
aggcagagcttcgaagctgtgtgtcagtctcctctccgctcaacctttctcagcctggatctccaaatgacaagctctgaaacagaggccccaaaaacccataatcggcattcagaacctggtgtttcttccctctggaagatgcagcatttaagctttcatcttggaaacagataccggaccctcaacagatggtaaaccagatggcgccttgatcttggacttctcacgctccagagctgtgggatcacatggaattgcaacagactgtggcaaagttggacctggctactataaaaacctcagtctttctgttacccacagttgagaaggaaaaggtttagaatggtttgaggaacgtatgaattctgtcataaatgaccgatgaggaaatagaagtacagaatccttaagtgactttcccaagggcacacaggacgtggacgggagtaaaggagagactaaaccagagtctggtttgggaatagatgctttctctagtccaaaagaatattacaatatactccttagaaatattttgcctagagaactatatttctaaaaagaatgtataataaataataataatacaataaaacttacctttcaaaagttatatatgtattaaataaagaaaattaaaatatgaaaaaaaaaaaatcggccttcttggcctca

SEQ ID NO: 4526 - DNA, 484 bp, Homo sapiens
aggggatacaaaagcaaaatatttgaagacatggaattttgccctattgtgaatatcagatcttttctaggagcaaatcgtttttcaagagtgaaagatatttcaaaggctatgactgaatacctaagaggagtagagaagaaccgcccaacaaaggaaaagggatgtggtggagagatgaaggttctcactccgtcacccaggctggacttcagtggcatgatctaggttcactgcagcctcgacctcccaggctcaagagattcttttttttccacttccccaagtgctgggattacagacatgaagccgttgcacccacccaatgactaccttttgtattttttaaacatttaatttaattcttttttcatatgcctatttcttttcatagaaccctactatttatttatggcctctatttttttttaaaacattttatctcttttaccaaaaataaatgttctcgcctccctgccctcct

SEQ ID NO: 4527 - DNA, 786 bp, Homo sapiens
cctagaaactcttgtaacagaaaattgaaatatagaaagtgtcccaaagcaaatcccaccaagaccacctgaaggtctcaccaaaactgaaaaaatagaatcagagatacacgttgtacgtggtgaaggttttaagactgttgcagcaacacgttatgaaacaataacagccatgaccaacctggccatagtaaactgtcaagtatatgggagaaatgcacttaatctgaagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagatcccagtagaagttcagaagttactaaaatggtgagcaaatgctgaagcccttttaaccaaaatatacctttaagcattaaaatgttcttcattacaggcttagatgacagtgtcactaacatgcacacatactccatgacacacacaaaaccatacacacaattctttagatcgctccatccagttcttcaggtataataatgtaggctgaatccggcccctttgtgtgatattttcaaggttgttcttacatccagtgcgaaacatgacttggccctatggctgtgagcttaatcttttcccaaaatgtccaaaaaaaaaaatccgcctccatgggctaaaag

SEQ ID NO: 4528 - DNA, 615 bp, Homo sapiens
agaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccttagtaaactgtcaagtatatgggagaaatgcacttaatctgaagggcttttttatcctaaattgtccagacttaacacctttggctttccagttgatatatcttaatttatcatttaatgatcttcattactttcccacagaagtgagtcaacttttattgttatgtactgatataacttgtcgtgaataataattataataaaaatagacgtcttttaataccttgaagttactataaagtactgtaaatgtattttggattgcatcttttgaatggcttattttcagaagcacaaaatgtacagtacatctttcttaggaaatcccatgatgtaatcctcaaagactatgttatagcgagactctcaaatgtgttctcataattctataatgtatattaaatatttatttctttaactctgaaaaaag

SEQ ID NO: 4529 - DNA, 892 bp, Homo sapiens
  misc_feature (1)...(892): n = A,T,C or G
agatgaggaactgaggcatagtagtaaaacaacacacctgatgtcacccagcttcgcggacagtgggatagccagcgccccccagctccagtcaggtctcactccccgcaacacgagcaaatggacatggccatgggggcgaggactggggggcctgccgaggagctggagccatggggtccccagaagtagaggcctagaggcagcaccggtacccactgcacctcagggctgctcggtgaccgctctcagggcagccctgggctgttctcaagatcaacttcaccctcaggagactaagttatgcccagctgaggatgttcacaaggacacactgcaggccctagaggcaatacccctggagaggctccaggcccacggaggacgaggcgggccggaaccggcttccttctcaaatgagttactcacatgtagccactgcgactgcacagcagtcaccctatggccccaccacttgcaggacacagttctcgcgaagactcggattcccgcgactagcctggctttgggttgttgcaggaagacagttgagcaccactgaagccagatgactgtgcctgtcccctgtccccncctggccagacaggcaccacttccctgtccctgctgtctgaggctgatggaagctgctgctccctgactcaggcagttctgtgcaaaccagaccgtggagacggtggctggtacaggctgagcatccctaaccccaaatccaagatccgaaatgctctcaagatccaaatttttggagtgccaacgtgacgccaccagtggaaaatttcacacctgacgcctctgctttccaatggttcagcaaataaactttgtttcttgcacaaaattattaaaaatattgcataaaattacaaaa

SEQ ID NO: 4530 - DNA, 463 bp, Homo sapiens
agggatggtgggagctgcatctccgtctcccaacctctagtggcagacagatggatagagctatatattcatcagtggaagtgtgtgatattctgtcttcacaaaccatcgtgcaaagcagaaccaacggccttttgtctgcttttagaaatgtctgcaagaatccctcccacctgtcaagttatggggatgaatatgtataaaatgcatcatgtatgtgtacctgtagagaacactggattgggatgtgcagaggaaataaagctatctgttttttaaaaagccaatgtgatatttaatttgtattgtggcaacattaaatatatgtttgcctcagcactgcttctaaaaacatcttttattgaaatttttttaaaaaaatcaaccaattaatgttttattattatttaccagtaaaattaccagtaaaaattattaaactgcattttgttatttttgaaaa

SEQ ID NO: 4531 - DNA, 944 bp, Homo sapiens
ctccggtttcagaaggagcaaccataaggaagtactctcttcttgcgggggtcactgcttacaacacaactgtggaaagtcaaataatcttccagggagaagctggccatccatcagccaggagagagctgtcaccagagattaaatcagcaagaactctgaccttggacttccagcctctagaactgtgagaaatacttgtctgttgcttaaggcacgttgtctgtggtttgttatggaaacccaagctaagagcctgtcttaaatcccaggttaatgacagtatcacaatcccatacctcttttggggaccagaagatcccaatatcacaggaagaagaagcaaaatgtcttgccagtgaatcgctaggagcaataatgagataaatcactcccattttcaccccttcaatcttggacccatggattctagctttggaaaaaactaatatattggtcattgatctagagtgtacagcacatcctgaaaaatattattccggttctaggaggcattgccaccaagacagaagcatcacttaatcttcacaaagaaacatacactatagtttgggtatttgacctctccaagcctcgtgttgaaatttgatggaacaaatgttggaggtggggcctaattagaagtgttagggatcaagatccctcatgaatgactgggtgctgtcctcatgataatgagtgaattttcactctgttaattcctgcaagagttctcctgagagctggttgttgaaaagagcctggtgccttcctcccatctctttcctcctctctcaccattgaagctttacctcctttgccttccaccaggactgggagcagcctgaggcccccaccagatacaggtgccggcaccatgctacttgccagcctgcaggaccatgagccaaataaaccttttaaaaaataataataatttaaaa

SEQ ID NO: 4532 - DNA, 717 bp, Homo sapiens
caggatctctagatgaaagactagaatcacagatgtgtgctgcagggagaaatggtgtaaatgaaagtcagtgatatacattttcctatggatcctattctgacctttggttgattttattaaggcaaagaagctgcttaactgggtgatgtctgcagactcaacttattttattaaatatattgaaggaaaaaaagaagcaagaagaaagtatacactatcatccagtcactacttaaacaaaacaaaacaaaacatgcaaaacttttactcacataatgaaaccattctctccttaacaacactaattttttccttgactcacactagaatttcttctaagtaagataggagagacttcatgtttccctggaggctaaaatttggatgtatacttctatccactcaaatgaaatgaagaaagaaagcgcatatccacacatgcatatttatatttttctctacaataacacagatatatcttcatttggaagaaaattatattttgtttaacattttcaaatttgaagataagaaatatctttagcttttattttttaacttgggctgattaatataagatgaaacatgaaaatttttttttcaaataaagaataagaatattatgttataacttatattattgaattgtatattagcatacatacatattcaacaaagaggacctagttaggaaaaaaaaaaaaaaaaaaaaaa

SEQ ID NO: 4533 - DNA, 705 bp, Homo sapiens
ttagggacatggattgagctggttgccattatccttagcaaactaacacaggaacaaaaaaccaaataccgtatgttttcactgataagtgggagctaaataatgagtacacatggacaagaaaagcaagaagctggtgtacaaaacagaagagaaagaggtggttgctgcatgcaatgcctttgtatatttaccaaaagcaagaactccttctgatatcctttccttcacttatgaaattgcctcttctactgcctcctcctcctcccactactcaatatttgtttcttttgaaatgtcagttttgaaaaggttacaattcacttttaagtatgcatccttgtgtaagcatttgaaaaaaatgtaatcagctctccttagggggttctgtggcaggattcttggtacacagtttccccattaaaactaatctgagtgtagttgatggctcgcagcaggaattataaagctgttgctaattgaagaaatttatatgaaatcatttacccttcaagggtctctccataccaacccctaccacagtagcctcttcaaagagagttgacagaacaatagatggttttgtgtgggatttttctcatggaccctgcagcaaaatcaatcttgatgtgcaattaatacatctttaatatgaccatatagagcatcaaactagtgtagctattaaaccggagtacctcaaaa

SEQ ID NO: 4534 - DNA, 548 bp, Homo sapiens
taggttattataatatgaaactcgaatctatgtttagcaaacggaaaaaaagaacatttaaatctaatgaagatcaagaacaataatcttaggttatgcagacctccttgatggcatccagaagtctgatcagaggagggatggacacagctttgactaggagatctcacctcccgcataccgaccttactcataaaagcttctggttatgttcaaaggcaagtcggatttgagaatttgcctctcgcactctctcattttggccaaatcaaataatgcctttctctcttcctaagcgctgatgtatcagtgtttggcttattgtgcattgggtactcaaacttaaatttgggggttttgtaacaatttcactcttctgcaatcaattgaaataaattttctcctttgatttctgtttgttctttcactcacctgcaatgattctaccagaaatgttttaatcagtaaagatatagcttgaatttttatacttaacccaaatttacatgtcaaaataaaaaatgaaaacaataaaaaaaaaaaaaaaa

SEQ ID NO: 4535 - DNA, 581 bp, Homo sapiens
tgtaaggagaattatatatgggcaccccctgtgacaaccttatgataaagacttttgaatgtgctaaagtatcaagtacaggacttcataagcagaatgttctcaaaagattgtgtgctgagtttttgatggaacgttttccttctcaatccaaactggctatctacagagacttaaatcaactcccatacacttaaaaaaccttgctgtggtcttgttagacagtaaaactttctgtcagttgtgaaaccttatcattatgtccacgtttttagtcactttgaaatgattatgattttgatgtatatgagttgagatttttaggaaattgagaacagcacaaatcaatgcttgagttgtagtacactaaatattttttaaagttctgataacattatttaaatagagtgacaactttgataaaaaagcttcatagataattaattgcatatgaaatgtgttaaatatttggaaaaccaaatccgaaataatacatctacaaggatgttcttaaaagtttcaaagtgccccatttcgagaacctgttcaataaaattttattgttctgaaaaaaaaaaaaa

SEQ ID NO: 4536 - DNA, 658 bp, Homo sapiens
gctaggggatacaaaagcaaaatgtttgaagacatggaattttgccctactgtgaatatcagatcttttcgaggagcaaatcgtttttcaagagtaaaagatatttcaaaggctatgactgaatacctaagaggagtagagaagaaccgcccaacaaaggaaaagggatgtggtggagagatgaaggtaaagagaatgcagatgaagctgcctatttcatcattttgcctaaggatggaagtagcagctatgaggatgctcactgcagacatcctgtaacaggaagtgaaactgacccaggggccccctgctgttttatgaaatccttctcagcctttgtcccaaggctccactcttcacaggcagctgcctggcaaggacgagacaggttctcactccgtcacccaggctggacttcagtggcatgatcaaggttcactgcagcctcgacctcccaggctcaagagatcctccctgctccacttcccaaagtgctgggattacagacatgaagccgttgcacccacccaatgactaccttttgtattttttaaacatttaatttaattctttttcaatatgcctatttcttttcatagaaccctactatttatttatggtctttatttctttttaaaatattttattcattttaaaa

SEQ ID NO: 4537 - DNA, 693 bp, Homo sapiens
cgacactagcctcccccatcataccgcaccgcccaaccccaccgcatccctccacagctattttttcacaatcttttttggcctttgcaagcaagaagggcaactgcgggcttatggagcttgactcctttcctccattggagaattaaagcacgccctttctgacaaggcatgtgtgaaagcctttgacccaaagacaacttgcttacaggaatgccttatcaccaccttccaggaagcctactttgtttcagaaagttttgaagaagccaaagaaaagatgagggactttgcaaagtcaattacccgtcccttctcagtatacttcaatccctacacacagagtattgaaattctgaaagacaccagaagtattgaaaatgtggtgcaggaccttcgcagcgacttgaatacagtgtgtgatgctttaaacaaaatgaacctatatctggggatttgatgcctggaactatgttgttgccagcatgatctttttggggcttagcagcagttcagtcaatgtcatataacgcaaataaccttctgtgtcatggcttggccaataagcatgcaattccatatatctataccatcttgtaactcactgtgttagtatataaagcaccataagaaatccaatggcagataaccactcattgtacgaaatagcgtattatgtttaacacttttaaa

SEQ ID NO: 4538 - DNA, 513 bp, Homo sapiens
taggcctgtagtttagaggcaccttctctgctcactgcaacctctgcctcctgggttccagagattctcctgcatcatcctcctgagtagctgggactacaggcatgcgccaccacactcagctaatttttatagttttagtagagactgggtttcaccatgctggccaggatggtcttgatctcctgacctcttgatctgcctgccttggcctcccaaagcgctgggattacaggcatgagccactgcccctggctcagtttttttaatatataaaaagatggacaatcctccttcagactgattttttaaaaaaaatatttatttcctctttcaggaaatttggatacagacacacacagaagaaagcccatatgaacatacgcagagaagatgaccatctgcaaaccaacaagacaggcctcggaagaaattaacctggctgacaccttggtctcggacattttgcctttctgaattgtatgaaataaattcctgttgtttatgtcaaaa

SEQ ID NO: 4539 - DNA, 241 bp, Homo sapiens
agacttgacagattgactgaagaagaagtacaagttctaaaaaatgagacaatcaggaggtgatgtgaggaagagatggtaactggaagtatgatgaccatgctgaaaatgttgactgtcacaaggagaaagatcccattttatttccatgattcccttggagcaactccaagatcaccaagatttctgccttaaatgtattcttatatcaagtctcacttaaaatttaaaaaaaaaaaaa

SEQ ID NO: 4540 - DNA, 632 bp, Homo sapiens
gtaggtttctgaattcttgttctgaaggctcagaaatgaaataatcataagaacctagagacagcctctgttgcccaggcgggatcacagctcactgtagcctcaaactcctcaagtgatcctcctgccttggcctctcaaagcactaggatttcagcatggagtgccatatttgtgggcatcaggagggtccagatggcaactttaccagacactggagataaactgatttgtttaaaagcaggagcttgcatccaggaaaagtggtctgcttcaggctgcaggttggccgaacttagctacctgttgaagtttaggtctgcatcatatttctccacatttatctcggaccagcagatatttaggctattggcagaagcatacccgggcaaaccaaaccatgggagtactttctaaccccctgttcacattatgttcaataacatcctactggcctaagtaagaacgatggtcacttagccaggtgtcgtggtgtgcgcctgtagtcccagctactcaggaggctgaggcaggagaatcacttgaacctgggaggcagaggttgcagcaagccgagattgcgccattggacttcagcccgggcaacaagagcgaagctaagtcttaaaaag

SEQ ID NO: 4541 - DNA, 418 bp, Homo sapiens
atgtaacagcagaggccatcaatcctcctgcccaaagaagccaactggggccaaccagaacatctctgctgcttgctaagggaatgagtttgttttctggagctgctgcctatgattgcagtggagaaagatgatctgaaaagtcagccgtgaatttattgctgcccattctccaagttgtaggagagaaaagtgctgtaaaggaataaggatatccctgcattttaccaggtgacagcttcggcagcactgtgggcggagccataacagactggagcttgtgggaccggcttctaaagttgctcctcccgtgaccttggacaagtcacacttcctcctgtctgatacctcatctgctctgtgggggatgtagctgcttgcctttttataagaattaaatgaaagactggaaccaaaa

SEQ ID NO: 4542 - DNA, 884 bp, Homo sapiens
ttttttagcaggagcccattccccttgtttacatttgttcccacaagctcctcccccctccccccgttttaacctggccaccctctccgcccgagaattccaaaagcctatgttcccagccccccgcccgggtaaccctctgggatatttgccctaagacccaacccattctcacaggataccccccgtatttctctaaccccctcctggagtggaacgcccatccctatggccccctgttatttctttggtactttggcaagcccctgcctgagaaaggggtcactcagatggttggacgcctgagaattttgttttggtctatattacaaatgccaggatctcagtcttttgtgaaccccatgatgtccttatcccccagtacagagatgctcagggacttgccagattatactctctactgtcctcaagagactgatgatcttcataagacttaaaaacacagctaagtcctgtgttccagaatgactgcaagcaggtactttatacactacatatgagaaggacaaatggcaatttctttcaattccaaactgaagctcagtaccgaggaaatataactgctggcaccaagaacctcaagcacctggaaatgcattttctgctctcacaccaacaaccttgtttgagatgtcagaatagttctattgatatgattgttttataaatgtaaagaactttatataatatagatattaaggagaaggtagaaatatttaacttctaacacaattatattcgccatatgaggagcctgtaacattttaaacaatattcccctagtcatatcttttgatatcaataaatacataaatgtaaagtttcaaattttaaaaaataaataacacgacgatgccgccgga

SEQ ID NO: 4543 - DNA, 863 bp, Homo sapiens
attattctattacaatcccaaacccctccgcccatcaccccctcatgaggcaaacttactctgtctggatctgaatgcagcagcttcacctgggaggtagattgcatgtggaggaggagaggcaagagtatgccagctcagtctgaaactggcttaagtcccaaatcaccaataacttttcaagaaagtgaaccccatttcaatgaccaacctcaagctgaccttcaggacttggcttcacagtcaaagggccagacccccaccaggaatgggaatgtcttcaggcgcactaggcctgcaaactcagtccggtggagatggtggtggtgagattcacggagatcgatagaatattgtgtattctctttcttccttccccacccccatatctaaattctcagatcacccacatcccataatgagcccccactcacccaactacattatacctaattaatttttttactcaaagacacacatcccccctgcgcgatttatatccccattatactctacaattcgcacttctagtaatctgctgcgccaaacgattactactcttctcaccgagactttataatctaacctctacctacctattctcctcacttgaacaatactttaactcaccacccccactagactagtacaatattctagtcccaacatgtcccatcttactcctttcttatatcaatatacatatccctactccctcctttctacatagtacttttcatcattacatctcacttttatcctatatccgtcatcgtctttccatatttacccctccccacctctatcctccttctctctctctctcttcactaactatttctctttgtaataataaacaaaat

SEQ ID NO: 4544 - DNA, 522 bp, Homo sapiens
tagatcccctgaaagattttggagaatttcctgattggcactttgaaaactgctgctgtaaccaattctgtgatgactgctgacttgatgtaaggtgaatgcagaaagtctcctgctaggactctccctggcattgcctcattcacaaaaaatttcagacactatatatatcaattcagataattcattcagttaaatgtttattaaatatattttcaaattgtttattgatatataattattctatcaaggacacatataaaataattaggaataggaaaatataagaaagaaaaggaaatcaagattaggaaaaaataacaatgcagatattcagaccatatagtactataaagttggctcattattttgctaatgtgtttactgagcacctgttctagacataggaaatgcatggatgactacaattgctccagttgttatctcattgagattacattatattgtacttgtaaaatatgcacccccactcatggctttaggcaatacaaatgaacaaaa

SEQ ID NO: 4545 - DNA, 263 bp, Homo sapiens
ctgatagttatgcttactacataatttcggaaaatacacacaagcaaaatgaaaaaaaaatctccttattattctaccactcaaagacaaccagctacttttgcagagattattcttttggacttatatactgaacatacacattcttacctcttcctactcttttaagggatttttaatgtatctacccttttaagcctgaattttcacttaatatattatgaacatgttgtcttgttaataaacgtgtttcaacatcaaaa

SEQ ID NO: 4546 - DNA, 342 bp, Homo sapiens
tcttgatcccaggggctgtattttattaaccactgtggtttgatgcctaggataattctggcacataacagatagttcatgcttactacagaaatttcgaaaaatacatacaagcaaaatgaaaaaaaaatctccttataattctaccactcaaagacaaccagctacttttgcagagaatattcttttggacttatatactgaacatacacattcttacctcttcctactcttttaagggatttttaatgtgtctacccttttaagcctgaattttcacttaatatattatgaacatgttgtcttgttaataaacgtgtttcaacatcaaaaaaaaaaaaa

SEQ ID NO: 4547 - DNA, 636 bp, Homo sapiens
cctagctgtctgggacctgcctgtagatttcagccacttctggatacacctgagacagggctgatacctttcactgtcttacactgtgaagagcgggacaaaccgatgagtgacagactactgaatcaatccccttttaagctgcttaatttccagaattagttttaaagagaaaaaaaattgtcatctttttaaaaaaactgcatcttctttctcctaatagctaatatttattgagcattcatgacacgtatacactattttaaactgccactgtgggttgatgtcactcccccattttataaacatggagactttggtaactttctaacagtacttggccagtcagccaggcctgtgctcttcagaggcgcaatggggtctttatactacacactaatgctgtttgcacgaccatccctatcactttgtttttaatttaagacaaacatgtaatttcctataattgaaatatatatgtgaactaaatgcaattccttttaggtcatacatttaaaattatgttataatgaaaagtatttcctttataatatagaggggggtccacattaatgagaacataatatatggattataggccgactactcattaaaaaagagtgttttgctttcaaa

SEQ ID NO: 4548 - DNA, 375 bp, Homo sapiens
cctaggcttctggaggtgctgaggtagtccaaggaagcaggacagacagagattcagaaaattcacaaatggggcagactatttacctactaacaataaggaccggaggcagtgggtggctgtgaacataccccacagcaacactgaaaatgagaaacggacagagcctggtttggggagcttttggaagaatttttcaatgacaatgtccgcaacataaagcaacggtttgtgtccgttaaatcaatttcttgttttaaagaaagattttacgctacctatggtaaataaatggcttgcctttcaatgtttaaaaatgagaacagactggcctccacatgttaagtaaaacatttactcacaaaaaaaaaaaaa

SEQ ID NO: 4549 - DNA, 587 bp, Homo sapiens
ttagggatggaggttggagtgatgaggaaaactgcctgactaatgattttggaaggagaaactaggcatggtgccttgctctttctctttcccttaagacgttgctgaccattgagagcatgaaatctaatgtaaacgactttcttatacagataaagccatattttccatactaactttgttcataataaaggagagagaagtgcctggcaaagggagaaacaccccttataaaacaatcagatctcgtgagacctcgctcactatcacaagaacagcacgagggtaaccgcccctgtgattcaattacctcccaccgggtccctcatgacatgtggggattatgggaactacaattccagatgagattttggatggggacacaaccataccatatcagatatcttcatgagtctcaccaaatttaatggagaagtctgttgtccaaaacatcaatatatctactaatttgttcattccaacaataggcataaaatagctaatcattttggaattactaaacctatacaacaaataatactattaaaaaactaaaaaaaaaaaattcggcctcgctcggcctaaga

SEQ ID NO: 4550 - DNA, 222 bp, Homo sapiens
cctagggatggaggttggagtgagaaggaaaactgcctgactaatgattttggaaggagaaactaggcatggtgccttgctctttctctttcccttaagacgttgctgaccattgagagcatgaaatctaatgtaaacgactttcttatacagataaagccatattttccatactaactttgttcataataaaggtaatatttttatccttaaaaaaaagaa

SEQ ID NO: 4551 - DNA, 588 bp, Homo sapiens
taggactcaacacttctgagaaatatgagagagccaaaaactctacattattaaagcaatgcttccaaggatgttatagaataataataagcaaaaaaacaaattcagcagtttatcggatccaaagagccatgtagaatgtcttgtggctgagaatgaatgaagaaagaaatgaatgaaggaagaaacataagcagctgaaaactgaaaagaccaaactccaaaaagggttcagtagaaagggaacttgatctagatgctggttttatagaaaaatcagagttacagaacctgtatcaccccacagacactgtaaaaggcctaattaatatttaagaataaaggagagatgaggagcaaatataaaacagtttaggtcagctatataacaaaaaatcaccaagccagtgataatccagtttttcactctgcagtgctctaaaagaagcatccttcccagaacttaaaaaaattatgattattgactggacattgagtttttggacttggaaaacactgagctctctgaggtttcatttcttctgatagaaactaaataaatacctagaataatcttttaaagtaaaa

SEQ ID NO: 4552 - DNA, 278 bp, Homo sapiens
ccgcgaagcatccaccaggtgcattatcgtccgaataacagaatcagagagaagtaccaggatcataattacagagagaagtttgaccaaatccctttctgtaaaaatgttaaatataaatatatgtcttctatgtttttgtcctaaccctaaatactaaatatttactgggaagtctcttaatctgtgaaagactgcattcatttacattaaataaaatatgggaattgctaaattttaaattcagtattccctatgaaaaactaaaaaaaaaaaaa

SEQ ID NO: 4553 - DNA, 447 bp, Homo sapiens
atggattctcagatgttggtaccagaagatagctgtacggggtttcatcctcgacgtgctccaagcttggcttgccccaagggctcatcaaaaagcaggaagatcctggacttctatttttagtgatagctgttatttaccccaagtctaatagtgtatatggaaacttctgcctcctcattgataaaatacctaatattgcttttaaagaaggttgaaaaggaatttaaattgtattttcctagtaattaataatacaattattgtattattccggctatgtcactagctctattaattttagatatttagttctttttttgtaaaggaaatgagccatctctcatacacataaaaaagtacttatggcagtttattcacatatcttttataattatttgataatcactcagtaaagtagattgacctccccgaaaaaaaaaaaaa

SEQ ID NO: 4554 - DNA, 1038 bp, Homo sapiens
catgtaggagctgcactcctttctctagtgttgccaagatttccatcactggaatgtgaagcccttcacctctcagaatgccagagagaaggagtccctcctgtggtcctgcagtgtcaccccaaaagctgcccaggttgccagatgtgtctgagagaagtgaggccacctgactcatttagcccagtgcaggggaacttctctgaatgtggcccgggtgcttgaaagagctctaccccacaagtggaaacccctcttctccactaggtattctgctctcagatccacccctgctgagaatacacttctggtggagaggcactgctcctaagtgctgtcagcaatgaggacttcctgtctggagtagggtagtccctgtgaaactgactatcactacagggcccggcccacctccgttcgtgtaccccagcacaccaggccacatcgcttactgctggttctttacatgccagccagattcagctgtggatgctgtaggcatttagtttagagatcttcctccaccctgggcagtaaaacagtgtctgaagttgacttaatggcctcccaagcctggtctcctacccgctgggcaaaagctgcaggatgggtcctgcctcggtcatgggaatgaatatgaaaccgaaagagccagtccttcaagatggatccctagtggctaactgggcctaaatttaacattgagcctagtggtcatttattgactagacatcacagatgtactctgtgtcaacagaaaacccatacctctgttcaactttgggactttcagaactcacctgaaccaaccaatcagaacttagcttcatcaagtaattagaactaagcaagtttgaatccttcatttgcataaatggacttgagtgggaacccggacaggaacttttgctgtcaaaactgaaacctccttttgctccctggaaggaaccttcattttagaccacaggtcacatctccccattttgcaaactgcttagtggaataaagtctcttcccttccaaaaaaaaaaaaaaaaa

SEQ ID NO: 4555 - DNA, 397 bp, Homo sapiens
cttggaataaacaaaatgctaattatttctacaaatcttcaatactgtgctagaggactaaccccaaataataattttgatgagaaaaaagaaagaagaatcgttggaaatgaagagtcatctgtcattatctgtagatgacaagatgatgtaaatggaaaaatcatggaatttaatgaacaagtgtataagagcaagagacttaaactattacaaataaaggatttagttttatgagaagggccactgtgaatgatgccactctagttttagtctcttcttatccaggtggaaaaattaattttatattgaaaagcctggttattttcataagaagtcaccttgttttctttagaaataaagcttctatggatttatgtcattaaaaaaaaaaaaa

SEQ ID NO: 4556 - DNA, 746 bp, Homo sapiens
  misc_feature (1)...(746): n = A,T,C or G
ctgacctgtacacttcccctttgccttccacatggttgtaaaattcttgaggactcccagccatgcttcctgtacagcctgcgggacggggtgtcttccctgcaaaatgccttgggaacagtcttcatgttatcatttgcaaaatgctgactcacaggagatattgaatatgtgtttgttgactggctacgaaatggaaatgtattgttttcactattatgaagagaaagtgaggcagagcaagcagttggaggagaacgatatttaactgagaaagaaatatgtccacaaggaagtgatcaacaatcctacatgctgcaaagtgattaaggagaataaagatcaagaggatgtagaagcctgattataactggaaagaaagttaatacatcctgaggacagcagtaggtgtaaacaacaaattcatacattttgtagaaaatagaggtgaaaaactggttacagaagctcagtgcacagcaagggcaaataagcttgtttgcaagctagaagtcttctgttgatgccaaagaaagaaaataccccccttatgtaacaagaatggacagagaaagaacctgtgaaatttatttttatggaaattcacttaagtgtttttgtacttttatcgtatattctaagcaaaataatattttcctaattgactcaataattttataaaaattggcatcatatacggntcccgaacaattaaaatgcattcataaattaaaaaaaaaaaaaaa

SEQ ID NO: 4557 - DNA, 471 bp, Homo sapiens
ctgagtcctgcccagagttctgcacaccaagaccgtgtaaatgaatggaattgcatctgggagctcgaggcacccatgcaaacctgtgctgccagtgacttccaccagagggcagcggcagcaggtgccggtgctggggcaggactgggaggagtctcactctgggggcgcctggttccccgtggctctaatacttgccgcatcaaatgcatacacccacctttaggaccgaacccaatggaggaggaccgctcctcattccacatgttggggaaatgaagacaagcaaggatgcaggaagtggagggccaggagaggtggacctgggatgggaccaactgaggcagggccaggatttggaaccaaaccccttctggatttgaccacttccagggccctgcttggacaaccaaattatctattccttttctcattcaataaacatttattcacctcctaaaaaaaaaaaaa

SEQ ID NO: 4558 - DNA, 166 bp, Homo sapiens
caaccatggagaagattgtatgctgagatggaagacccaaaagattgaagcagcctggataactcgggtaccacacagaggacaactgccctagagagttgccttgacccgcaaaagacattgcctgagatgaaaataaacttttattgtgttaaaaaaaaaaaaa

SEQ ID NO: 4559 - DNA, 426 bp, Homo sapiens
ctgtttattccagtaccgctgtcgtcttttcaatataccgatgtgctcctggctgagaaagagttctgcttaagcagaaggtggacgtgcttggcacaggtggggaaaacgatgaaaaggatccctgagtgaacatcattgaccatgaacataaggtccttctcaagatttacttccttctcagatgaagcgtgttgtgtgaaacaacttacatgatgattttcccagctggtggcagtttggaaaggaaaacgctgttctgtatttctttctgaaccaaaaaaatgtttcaagagcctcgcagtattattataacaacttttagcatttttattacgaatgtttactgtggaaatgtttgaaaatataaatggaaaaacagaaaacagtttaaataaactacgatagtcactaaaaaaaaaaaaa

SEQ ID NO: 4560 - DNA, 610 bp, Homo sapiens
cttagagctaccttcagaacgtctcagcagtgactgctgaccactgaattttcgcgtaaaacatcaccagataaagttagccccgggtgaccctgctcagcaattcagaagggaagggagcttcagaactgctttctatcctcattctaaagcctctgggtgggacccaaggtgaagacaatctctctgtatcttgacgcccacactactattataaaactccatggtattgtaatctaaagggagaacaaacagttgtacaaaacaaaagggtcaataagaaatagacatcagaggctgggtgcggtggctcatgcctgtaatcctggcacttcaggaggccgacgtggggggatcacctgaggtcaggagttcaagaccctgtctctactaaaattagcagggcatggtggtgtgtgccggtaatcccagctacttgggaggctgaggtgggagaatcgcttgaacttgggaggcagaggttactgtgagccaaggtcatgccactgcactccagcctgagcgacagagccagactctgcctcaaaaaaataaaaataaaaacaaaaataaaataaataaatgaaataaaaatataaaaaaagacaaa

SEQ ID NO: 4561 - DNA, 786 bp, Homo sapiens
taggacccagggatggagcagtgtcctcactcattgcactcaccctacccaggatctggcccaggactccaagctcccagccttgaaacgccttccttaagctcaggacccaggcccctggccttatctcctccgttccggtgacacagatttttagagaaaatcccttaatcagaaaggaagactaagagaaaaaggaagaaaagatctacaaagcaactaggaaaaagtaacaaaatggcagtagtaagcccttacctatcaataattaccatgaatgtaaatggattaaattctccagttaaaagacagactggctgaacggactaaaaaacatgacctaactaaagttggccattgaacaatatgagtttgagctgcaggagtccaatgtcatgcagattttcttccacctctgccactccgagtcagcaagaccagcccttcctcctcctctccctcagactcctcgatgtgaagaccacgaggatgaaggcctttgtgtgatggtcacttccacttgataaacattaaatatattttatcttccttatgagtttcgtggtaaccattttttctctagggtcgtttattggaagattagcggataatagattcaacaaataaaaaaataaaataggcctccgttggccttagcgggggaactttgcggccgctttcctttacggggggggtattcatggacccccggtaatgactcgattaggctcggtcgttcggctgggggggcggttcagctactccaagggggaataaggtataccg

SEQ ID NO: 4562 - DNA, 537 bp, Homo sapiens
caggacccagggatggagcagtgtcctcactcattgcactcaccctacccaggatctatttttagagaaaatcccttaatcagaaaggaagactaagagaaaaaggaagaaaagatctacaaaacaactaggaaaaagtaacaaaatggcagtagtaagcccttacctatcaataattaccatgaatgtaaatggattaaattctccagttaaaagacagactggctgaacggattaaaaaacataacctaactaaagttggccattgaacaatatgagtttgagctgcaggagtccaatgtcatgcagattttcttccacctctgccactccgagtcagcaagaccagcccttcctcctcctctccctcagactcctcgatgtgaagaccacgaggatgaaggcctttgtgtgatgatcacttccacttgataaacattaaatatattttatcttccttttgattttcttgataacattttttctctaggttgctttattggaaaatatagtgtataatagattcaacatataaaa

SEQ ID NO: 4563 - DNA, 496 bp, Homo sapiens
ctcaggtgaagctcactgtgcaaatttgtatccagcccaaactaccgattcagctgaactaacttgtgacgagaaaaaatcttttgagtttctgcaaaagtggctaactaacccaagtgatcgatgagaaaggaaagctcaatggaatgcaaagtctgccctccattttctcaccaaaacacaaaacctcagcaaggatgaagttaaaggagatggaaggacagtacttttagatttaaatggtgtgtgtgtgttttatattttaaatagttttttaaatcaagttcttcctttgtgatgtttagaagcatcaaaccattccaacacttagaaattaattgtactagaggatcatgtgcatgctaattattggttgctacagaaacagactggatttcctagaactatgtcaatttcatgtaatcttgttgttttcaaaaaagcccatttatgaaatgcacatatgtgatttgattaaatcattttgtaagccaaa

SEQ ID NO: 4564 - DNA, 313 bp, Homo sapiens
tcatactccaacagggtgaactcaaatccacaaaaattgattggaactgcatccctgttgcacatggttcctgcttcacaaggttgttcagaagccgacatcagaaatgaggagcaaaaacacaagcactccctaagttctggaaggccatcctacaagactgcctgccttgtttagagacatgcaccagccagacctcttcattgttctcacttttatgggtaaaggccgctaaaaggccctgatgtcctcagacttcataatatccatctctgttttcaagtttattaaacatattttttctgcaagcaaa

SEQ ID NO: 4565 - DNA, 788 bp, Homo sapiens
cctggttcataaaagctgactttgtgcctggacattggaagtgacccgtcagtgcttactgaatgaataggcaaatgaacaaaacctcctgcaatacagctttcttaccatgcctcaagagactcttcagtccatcctactgtagttgcttttgattgggttctccctgagtactgaccctaggcccagattcagagatttccccaaaaaaagagcttctttcaaagacatcattcctattgtcaaccctgttggcatagacacaaaatgtaaacgttggacaaaggcaatacttgctgtgacaaaggcgatatttgttgtaacaaaacacaaatgtctgtccatcagtggggaacgagaatgctgggatttgaagagaccaaaaaaataatactgctctctcttttgagaaagagaggggattttttttttttttttttgaaaagccataagcttaggacagatgaaattcaaaatcacactaaccttcactggagaatgtaagcaaaatatgaggccacaggtgagctttctattcccttcctccactctccaagatggcctattgatatttggctgtgtccccaaatctcatcttgaattgaagttcctgtaatccccatgtgtcatgggagggatccagtgggaggtaattgaatcatgggagcagttactcacttgctgttctgtgatagtgaatgagatctcatgagatctgatggttttataagggccctttttcccctttgcttggcaatctcccggtctgccatcatgggaagagggag

SEQ ID NO: 4566 - DNA, 516 bp, Homo sapiens
accacctttaagaattgttcgtccacaatcagcaagtcccctctagcttactgtctgtgcattttcttaacttctttgcttgaactgaagcacttcccctttaacatattcttgtgttagtctgtttttttttttcttaaaaacatattttaagatgtggtccaaaaccaaagattttcttagggataatgcttgtactatggtttgaatatggtatgtccccaccaaaactcatgctgaggcttggtccccaatgtggcagtgttgggaggtggtgccattaggagattaggtcattaagatgaattaatgtatttctcaagaatctgggttagttctcaaaagttgttataaagtgagcttgcctctcacgctttaccctttctgcatataccaacttccatgtccattttttctgccgtgatatgaagaagcacaaggtcctcactagatgctgcctggtcttgaacttcccagcctccagaaccctaaactaaataaaccttttttctttat

SEQ ID NO: 4567 - DNA, 525 bp, Homo sapiens
tctccatgtccacttttataagaagattgtgtgaagacacatagacacacaaggaaaaggcctatttgaagacagtggcagagactggagtcatgctgccatgggccaaataaggccaatgatagctaactaccaccagaagataagagaagcaaagaagggtccttccctcatgcctttaaaggaggcagggctctgccaacaccttgacttcagacctctatctaccagaaatgttccttcagtggacagcactgtgaagacatttggtaaaggatcatggctttggactgatttctccaactccagtttaatatcacaggattcttcctttccttctgacattacatatgtttactttcctactgccatagtgaaaacgctggttcctggcaatatcactaaatgtacttgtttcttctatcttatgatgtacacaaaatagttctagaatcattatattgataataccaccaaaaaaaaaaactaagtaaaaatcacaattgtccggcaaaaaaaaaaaaa

SEQ ID NO: 4568 - DNA, 679 bp, Homo sapiens
gcccagggagggaagcagtgtcctcactcattgcactcaccctacccaggatctgccatgaactttgtggggatgaaggggtctttgcccaggaagtcactgagcagtatggcttctagaagatgccgcccctgccccgagctgccttaaccccgtttgacgttcgaagacgcagatttttagagaaaatcccttaatcagaaaggaaggctaagagaaaaaggaagaaaagatctacaaaacaactaggaaaaagtaacaaaatagcagtagtaagcccttacctatctataattaccatgaatgtaaatggattaaattctccagttaaaagacagactggctgaacggattaaaaaacatgacctaactaaagttggccattgaacaatatgagtttgagctgcaggagtccaatgtcatgcagattttcttccacctctgccactccgagtcagcaagaccagcccttcctcctcctctccctcagactcctcgatgtgaagaccacgaggatgaaggcctttgtgtgatgatcacttccacttgataaacattaaatatattttatcttccttatgattttcttgataacattttttctttaggttgctttattggaaaatatagtgtataatagatccaacatataaaataaaaaaaaaaaaaaaaaaaaaaa

SEQ ID NO: 4569 - DNA, 882 bp, Homo sapiens
agggcttttccctgtgaagtgctattttgatccatgaggtgtggaaaactgaacggtggccatggctttcaaacttcagcctttctgagaatcacctggaatgcttttggagaaggttgcttcctggatcccatcctttgaaccacacaccaagaggaactgatctggaagttcgtttggacccttgtttattaaaatgttagttctttcattgtcaacacgtttcatattagggatttattaaaagtcataaaatgctaggttttggtagctgttatcttctacttcctcaacatgctatgggctatgaatatatacagttaatagggagatgactttgaaagtagaaactctagcagcctacaattacttggaaaagctcctttattcatttgaagcacttgcatgaaatacacatcagatactaaaatcattgtttcatgtgactaaagttggagctactcagggacaaataattgactctgatttaaagatagcgttttcaccaaactggccagtaatcacatttcatcaatttctgtgtataagcagggaacttcattaaaatagataccagtatattttaccaagacagttgttgatgaaggggaaatttgtaatgaaacagatgttcagctcacaggctacacacctccttgggtcatttatcagatttttaaccttgaggacctcagggttagctcctaggctctacccaaaactgccctcctccatgggggacttgaaaatactgtagtcccatcctgtgcaggtcattcgttgacaaagaggggaactagtccttggagatggggacctatcttttaaatattgctactgaatatttcttgacaagcaaaaataaaaatctgactatggaaa

SEQ ID NO: 4570 - DNA, 784 bp, Homo sapiens
tttgaacacaggacacagacaaggacttacgccattggctccccagttctcaggcctctcaactcaggtgaattacaccagcttcaccagctttccagcttgcagacagcaggtcatgggatatcttgacctccataatcattttgtctcttccagaatcaaagctgtaaaactacaaatctttcttcaaacggagccccagatgcagcccatgactaagatctaccacagacccctggaccgacttgctagcccatgctctgttgttgatgacatcgaaggcactcctcctgaggaaatctcaactgcacaacccctactacaccccaattcagcaggaagcagttagagcaatcatcagccaacctccccaatagcacttgagttttcatgttgagggggctactgagagacaggactagctggatttcctaggccgacaaagaattcctaagcctagctgggaaggtgaccacacccatctttaaacacggggcttgtaactcagttcacacccgataaatcaggtagtaaagagcggctcactaaaataccaattaagctaaaggcaggaggtaaaagaaacagtcaatcatctatcacctgagaacacagagggagagacaatgattgggatataaaccccaggcattcgagccaggggtgggcaaccccctttgggtcccctcccattgtatgggagctctatattcactctattaaatcttgcaattacaaaaaaaaaaatcggctacgtggcctcagcggtggagatctcggccag

SEQ ID NO: 4571 - DNA, 632 bp, Homo sapiens
gacacctgtcttacagctgtgcaactggtgccagtacagtgcctggaacagagaagtcctcaacatgcagttgcgatatctataaacatgaatgtcttcagcgctcttaaatctcaagtgaaactagctttttgtaagtctcttgtaaactgaccagcaagcttttttttgataatagaaaactgtggaatattaactttattctgatttcaaagaaaatgaagtatagtttcggacatttaaaagaaaaaaacctccttcagaattcagaaaggcatttcatcaagaaaaattccaccactttcctagattagctgagtctaggacattaggaaaattacctacctgtatcagggatgaagaggaccacctcacaagtaactatgcagggaaaatgtaaacacaggtagaccttatcaaaccatcacattcagagaataaattcaagcctcttcaatgcagttgtgcagccttgcagtgtttggggctccattactgaccccgggaacacggttctaaaggaagctaccttgcaatatcttgggccacaaccagaagttaagacaataaataaatcaataaataaataaattaataaaacagaacgaaataagctatacaaaatacgacaa

SEQ ID NO: 4572 - DNA, 538 bp, Homo sapiens
gttagctaaggacttccaaaaaaaaatatgaacatgagtgacgagagggaaggaacatctctgcctgctccccacctcagtgggaaagtgttctgtctctcaccataaaatatgatatcagttaaagttttctcatatgtacctttattatgttaacgtagtccccttttattcctggttttcttggagtttcttttatcattaataggtggtgaattttgttaagtgcttttatatatctattaatataatcatgtggtttttatttctataatttttgtatgcagatataatccatatatggcaaaatgtacttacttaaatgtacaattcagtgttttggggtttttttagtatatttacagaagtgtgctagatattgctattccaaaacattttccttatccctgaagaaaccccttacccattaataattgctccatgccctccttctcccagtttctagtaatgactaatatatattctgtatctatggatttcctatccaaaacattcagtataaatggaattgtagaaa

SEQ ID NO: 4573 - DNA, 457 bp, Homo sapiens
acccagggatggagcagtgtcctcactcattgcactcaccctacccaggatctatttttagagaaaatcccttaatcagaaaggaagactaagagaacaaggaagaaaagatctacaaaacaactaggaaaaagtaacaaaatggcagtagtaggcccttacctatcaataattaccatgaatgtaaatggattaaattctccagttaaaagacagactggctgaacggattaaaaaacatgacctaactaaagttggccattgaacaatatgagtttgagctgcaggagtccaatctcatgcagattttcttccacctctgccactccgagtcagcaagaccagcccttcctcctcctctccctcagactcctcgatgtgaagaccacgaggatgaaggcctttgtgtgatgatcacttccacttgataaacattaaatatattttatcttcaaaa

SEQ ID NO: 4574 - DNA, 696 bp, Homo sapiens
ctagaaaactgtggaagattgaactaaagataataatttagagcatctggaggaaaaaaatttctaagcagcaaaccattcaagatataacctgggtgcttctaaccatctatactcagatgcaggagcaaagaaataaagtataaatttatatttaaaggggaagcagagcataaaagtttcgaaaatttgcaaaatagccatgtggcagaaaaataaaagcctttttcaggagaataatttaagaaggctgtggagcaaccacttgccagagagatttgcataactaaaaaagagccaagtgctaatagccaagacaacgaggaaaaggcctcaaaggcatttcagagatctgtgtggcatcccctcccatcagaggcctggaggcccaggaggaaaaagtggtttcaggggctgaatcctgaaaatccacaggggcagagccttctaaggccttgggagctcactccttgtaccagtatacactgggtgtgagacatagagtcaaaggagattattttggatctttacagtttaatgactgtcttgctgggtttgggacttgcatgcagcctgtaacccctttcttttggctgatttctcccttttagaagaatgtttaccctattcctgtacccctattgtaccttggtaataaagaaattgtttcaactttaaaggctaaaaaaaaaaaaa

SEQ ID NO: 4575 - DNA, 209 bp, Homo sapiens
caatatagctgcacgggctgacagtagctggactaacccttgttcaccatcaggtgatctgaacgatagaagacacaaaaaatggtagaacaagacagaggaaatctgagttctgataccacaccagccctaagctatctacctctagactgtgacatgaaaataaatgtatttccctcttgtctaagccactgctaaaaaaaaaaaaa

SEQ ID NO: 4576 - DNA, 781 bp, Homo sapiens
aggtgcccctgcttctgctcccctacacctactgtagctgcacacgtggtcaccggccctggggcatttgcatgaggaggcagcaagttcacagtggaggacatcgaggctcagaggggcaagtcccttcctgtagtgcacacagataataggggactgcacaacctttcgcctccctcctgccagactgtggaagttcagaattctctgaagatctggtattgacttctgggttctgagagaaaatagaactcttctggaggagccatcgctgggctgtgatgatgaagtatattaccctttgagggccaaaccttggacataaatcacatttacagcctcatgcctagtgactctatgagtaaatgacagcatcacattttcctttataaatcccgagtgcatgcatttgcttctgaaaaagaaagcttgctcttggctaaggatgggatcccaaagatctggaatgggggaactcccttcaagggaactagaaaatactgacagttcagggtgtaccagaacttccgtctcaggggggcagggcgctgggttagagttggcccttccctccatcccttcccaggcactgagagataatgacacctttcattcaatagatgacataatgacatctttcattcgatagatgatataatgacacctttcattcgatagatgatagatttgatagatgggttcctgatactcctcatcttgaccaaactcctcaagatataaattacttcctctattttacctatatgagtaaactgaagtt

SEQ ID NO: 4577 - DNA, 441 bp, Homo sapiens
cgtatcacaataaagtaaaattaccaactgaaatacaaaacccaagaaaccctcaggggtagagcagcttacttatgctaggtggctgatggccaaggccaaacccaaagaccactgcagcccagtcctcaggaaatgaagtccatctctgcagcactggaggaggaagacttctccaatcaagcaacgagaaggcatacctggcatccttctctgctcagagaacatgctgttaggtctactcagtaaacatttcctaccgatgacttagctgatacaaaatatcaatttcaaacttcctctgacacacatactactatccctgaaactattttcacaaagaaaaattatttcacatcctcaactgaaattttatcaattttcatttttattattttatcacagtctatattaagcctaataaaaataaatatttggaaa

SEQ ID NO: 4578 - DNA, 787 bp, Homo sapiens
aggatgtaccaagagttcttgtctgttcctgtccccagattgctttcacgggcccagcctaggatcataaggtcaacacaccgctttctcctttgaagacatgcaaatatgccaccttgcaaagataactaggatgtcctgctcaatatcccagatacgaacaactgatcggtacagaacaataaattacacggttggaggcaacaaaacccgtgtgattttgtgagaacatgtctaaaattgtggtgcggctgttttgcagactaaatgtatctcaataggaaacagaaaaccaacgggtttttttcttcaactcaagcttgagagtagactacccagtaacaatgtccagtacaggaaaggacattttcatcatgtacatgttggagattttgaggctaccatttcgttgcggcacaaacgtctttaagtagataagttactcaactgtcaaaacaattgttctttagaaattaatgagaaggtactgtgaactttgtatgaaacaaccagtgtcttattaggaaaagcttgtcacaacaaataaagcactagaatgctgtaaaaactaatattttttttaaaaaaaaaacagaaaacatcagagcttgaatattttggtgtgtagcatacagtattccagtgtgttatacccactaaaccttttcttttgaacaggttgcttgaataaatcccaaggagcaagaatcacttaggaagataggaagcaaaatggtttctgcaatatttggggaatgatctttgagaggctgcactttgccactga

SEQ ID NO: 4579 - DNA, 128 bp, Homo sapiens
attaagtttattaacagagacatactgctttacttacctgaagatatcagaaaattacaatttgtttcatctttgttggtagctgcactagctgttccattacagaggaggagttgatttatgtgcag

SEQ ID NO: 4580 - DNA, 829 bp, Homo sapiens
ccacgataaaccaccttaattgacattggagaagaaaataaattcagactgctggtacagcctggtagctggagcccacctacaaccccttgcatgttcaaagccacctgtactcacacctgagcagcatctatgccaagcctcaggggcggctccacccacactgggagagccgagctccgagaaagcatccctgcaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtggtgtcccactcctcaagtctggaagcgacacaccccagcctgtcctttctccagcaaggactttcattttctttagaatcatttggctcctgtttacacaggtgaagaataaacacccagcagggtttttaccattgttaggagcattcataacctagaatttctttttggagccttgggtaaacaggtggatgagggcaaatcacctttggtaaactggaccctcagaacaaggaaggaggttttgaaagcttataatacaacagtgagattgaattccaagcccaatttagagacggggcgcttcaactaaaac

SEQ ID NO: 4581 - DNA, 804 bp, Homo sapiens
tcagttcgacttaatataggccgcgggaaataagagaagctcagagaggcgtcttgctaagttgatcaagctggtcttaaactcctgaccttaagctgtcctcctgccttggcctcctagagtgttgggattacaggcataaaccgctgcgcccagacctggaatcatgtattctaaacctaacaaggcgggttgttgcactgcctgtgtctctgccagagtgcttatatgttgttgtttttactgttttaatgctcctcacttactgtgtgtttgataaaagaattaatgaaatgtgtggctgcaaaaaataggatgagtcatgacaaagactctctcctttaaccaagctagaatcaggctcctctgagttcttctgactaatcaccaactttgggctctgtccttcatccagtgactctgcccacttaatccagttttagcaagaaccctgctgcatcagtttaatgaaagtccttcacacttgctatctgaccattctttttgtttttgtttttgaaatggagtcttgctctgttacccaggctgaagtgcagtggcgcaatctcagctcacttcaacctccgcctcccgggttcaagtgattctcctgctttaagactcctgagtagtctgggggttacacgtgtgtgcctccatgccttgctaatatatcgctttactaagagagacaaggtttctgcatggttggcacggccgcctccacttctgacctatagttgatccgcccccctgtgcctaacaacgggttgggaccatgctggtgtccactttgttagcttt

SEQ ID NO: 4582 - DNA, 739 bp, Homo sapiens
acacaactcattactccacttgactctctcagttaagtacagttttaatattaaccctggaaagaatccatgcagactggactggaagccagctcctcatctaccgcatgtaacttctccatgaaagtactatctctggtctgtttcggctttggagggggcgggggccccatgggcactacctcagcactgatgtgcctgatggctggtgtggtgactttctcagcctgattaaaagaggtgactgcatcaaaaaaggaaggagtcatctcagaagactgcctcaatctggatttctttgccccacgtggagatgaagcagtgctttcaacatcactttccaataagctctacaaaataaatccagttcgccttaatatttatgcccctacctcattccacaaagtctgaagtatctcaagagaaggaatcacaaaatatcaatcactcagcctggccaacatggtgaacacccgtctctactaaaaatacaaaaataagccaggcgcggggggctgcacctgaatcccagctactcgggaggctgaggcaggagtatcacttgaccccacgaaaatgaggctgcagtgagcccagatcaccccactggactccagcctgggtggcagaccgagaactctgtctcaaaaataatcaattacataattaataaaaatccattcctcaactaggtaccgtaccgaaataaattttaattcgaacctcaaaaaaaaaaaaa

SEQ ID NO: 4583 - DNA, 959 bp, Homo sapiens
cctgagggactccttgaggttttttcagcatctttatgtcaagctgtgatctgagtccatgccctccaggatccagacatctagattcaagtcacacagtagccaatggattgagaatcaacagccaacccctgcctatctcctggatttctttagtatggaattggtgttgaagcccattgttttcccagtggactactccccatagtggttgtacctgccctcatggcttgaagtactgactgtaagctgttaactgccaagtctttaccctcagaactcataccagagattcagactcacatcaccacctaccaaccaagtaactccacttggatttccacagacacccaaaggatctcattatcttctaaaattgctcctctttggtcttgtcatcatgtcttttctctcttagtcaaagatgctaccatctcaggtcatctaagatagagttcttaatgtcaaccctcatctctatccagccctaaaaccagccttctcattttgcatctccaaagtatttcttccatagcccttaaataatcctagtatgtaatatattaaactttgaaatagagtgatctcaggttctgttaaacatgctaatattgtttaaacttaaatgcctttttcctttttccatcaccactactacagctcagatcctcacggatcattacccggactattgcagtagacccctaaagtgatcttgcttcaagatactttcaagtcaagcctctctcctaatcactctcaacatttcagccacagttttatttctaaaatattagtatattcatttcactcttatgattattttgaatcactctgggaaaccctgtttgtttctcttgagtaaggtcatcctcaggggatggtgtatacaagggcttttatatcatgattaacacattagaaggcttattttgaacttaacgggtctgcatcccctt

SEQ ID NO: 4584 - DNA, 764 bp, Homo sapiens
ggggtcttgctaagttgatcaagctggtcttaaactcctgacctcaagctgtccccctgccttggcctcctagagtgttgggattacaggcataaaccgctgcgcccagacctggaatcatgtattctaaacctaacaaggcgggttgttgcactgcctgtgtctctgccagagtgcttatatgttgttgtttttactgtttaaatgctcctcacttactgtgtgtttgataaaagaattaatgaaatgtgtggctgcaaaaaataggatgagtcatgacaaagactctctcctttaaccaagctagaatcaggctcctctgagttcttctgactaatcaccaactttgggctctgtccttcatccagtgactctgcccacttaatccagttttagcaagaaccctgctgcatcagtttaatgaaaatccttcacacttgctatctgaccattctttttgtttttgcttttgaaatggagtcttgctctgttacccaagctgaagtgcagtggcgcaatctcagctcacttcaacctccccctcccgggttcaagtgattcttctgcttcaacctcctgagaactggggttacagggggggcctccctgccttgctaaattttggattgtaaaaaaaaccagggttactccatgtgtcaaagcccggtccacttcttgccttaaggtttccgccccctgggcctcccaaatggtgggacaccaatgtggacccccccgctaaccttttagtccttcttgtatcc

SEQ ID NO: 4585 - DNA, 504 bp, Homo sapiens
tttttttttttttttttttcagagttagtctagcatttaataagtatagtagacagtatacattagaagacaattgcaaaaaataaaaaattataaggctccagatatgttaatgttttgttttttaggttttatcagattttgatgttcctgtatggccattgtaaaatctactgacaacttgaaagcatgtctagcttctgaaatattattcctatggaatgttgattctcattctgggaagaagagcagtcttttctgtcattcactcagaagatagttattgagtatttacgatggtcaggtgctgcactttgatactgtgagatccttgaaggtggagtcttcatgttatccacctttgtatcctgaacactcagcagggtgcctggtgcattgtagatgtgcaatatatgttgtctgaatagaacttacacccaccagaccgaccaaaggtgcatgtgggttccaacttgttgtaaaatattgggattgataaagttg

SEQ ID NO: 4586 - DNA, 790 bp, Homo sapiens
cagtctccattgtttccctagtttcagattagacctgcttttttcattcagaacagtagtttcatttctcaaggcagcgttttcctcttgaagcctctcaggttcgtatctcacaggctcttttgctggatctcactgcacgtgacttgccggccaggcatcatcaacctctgctcttcctttcctccccgcgaggaggcctgggatgacaactctctccaacttcatcagctcctgtaaagtttttctccagctctaattctgttgtgagggcctgaagcagaaatgtttaccttggaggcctggaaaagcaatgctttcccccgtataacttgattctgtactcttggctttccttgatgagtctgaattgttccatgtaaccaggaaatctcatatactgacactaagagccgtgcactctgacttgctgaaggtactggttttcttatttatactcctttacaatatgggacacattcataagtttggacacacattttttttttctgtgtttaattaaattcaagtacctttcatcagattcaatttccaagatatctaaatgagcttcccagaaggaagagcaatcacagtgcaggagggtttctccaccttcctagtaactggccctttaaaaagcccaggggatttaccttctaccaagacaatttcctgtggtggctctattaccttttttggttacttacgaaaacagcttgaaaagggttaaggtttaacctccatggacttttctgtattgctttgagtcttttgataccactctggt

SEQ ID NO: 4587 - DNA, 668 bp, Homo sapiens
caattcagtcaaaaatctgcaatcaccaagtcaggtctggtaaatgaatcctttctccatccaaaagagacttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaatagtagttagtaaattctgcatgaattttagtaaactttaaaaaatagattttttccctaagaaagaatgtttgtagaatttaaagtggacagatgcctgttggggtaaaatcaactgcaactttttgatgttaatttttttccctgtgcaattataaactataagcaagttaagtgacaagcaaatgtaataaagactagttttaatatgaaaaaaaaaaaaa

SEQ ID NO: 4588 - DNA, 412 bp, Homo sapiens
cttcaatgtggatatgatggctggagctccagcagccatcctgtgaccctgagaacaagccattcattgaggctaatgaagcaggaagaaggaatcctgagtccttgggaaacaaggatctacctgaatagctccgaatgcctacttctagatgtccttttagaaagagaagcacacccttgtgtatttcagccactgctatttaaggtttaacctaatcatgatataattggtttttcttggaatgattcagtggtaattttttcttccataagaagcaatcccaacccctaccactagggggtggccttgccctgtaggcctcaacatgacaattacatcactgcatatcagagtccaacatcagtgcattctgtgtaattcagtcacaaataaacaacgatcggccagg

SEQ ID NO: 4589 - DNA, 774 bp, Homo sapiens
aaggttctataattgcaatgcaggttcagttattgttttttttttgttttcggcaatgctgatgtatccattggaatcaagttagagaaacagaagccacttttggatttcaaacagaatttaacaaagagaatgttgacacagttgaaattagagctaaaaaagccaaacaaaggataagacgatccagaaatctgtaatggcaggaagttgttaccatgattatgctgaaagaagaaacccagaagaccaccttactggatcttagaagccaggactacctgggagaagctggaagtacactacacaacagacctccattcatgcagtaaagggttgtttggtgggtaatggagccactgagaaaaactggccatcgctggacttaacagtagaggtagagagctacagggaaaaactgtggagtgaaaaaccttgacttctcattctatcctgccttcctatttctattgagtgtgccccattggttggcactagttgaaagccagtgggcaaggggttctggaaaatttattttcctctgatatagataaaaaggaggaaaagttggagaatgaaaccgagagcaaattggtaaagtggaatggcctatgattttaagtagaaaaatgttcactcttaattctttatatggggcacattcaacccttatcacagaattagattttattctttcctgaacgcatttttacaaatgctcaaaaacaaatatacgaagagcgttttggacctaaattactatatggtttattt

SEQ ID NO: 4590 - DNA, 303 bp, Homo sapiens
cttagaactggaacacagtatgccagctacctttttggatatatacatcagtaaatcttggacagcgtaaagggatagcaacagagagttctgatgctgccccctgcacccacccgtggagatggggatgaataattaaaaccttcgtattttggcagatgtgcagacattttcacaaaccaaagctatcagttagtcagtcgggtttcccttattattgcagtgcttcttaattcttatatatatacaattatgtttggggtaactaaataataaaaacattgttgggtaaaaaaaaaaaaa

SEQ ID NO: 4591 - DNA, 983 bp, Homo sapiens
ctaatacttgactcccccattcacgaacatatcaattacgattaagccattatccataacgtaagcttggcataggctattcttggccaataagcatcactccaggggttgaaatgaggatttcatctagggttacagaagctgaaattccgggagaagatacaaaactgagtgctgaaaggaaaatgaagggggtgcatggaagaagactggcctgctttcgaggacatcatcagagcccagagttcaacagatcatgaacacttcgagacaaatgaagacaggtgcaatctccttgaagaaataaaatctaagtaccaacatcccttctgagtcaagaatctcctctcttaaaaatgtaaagctattgatcagggagggaagtgtattaagcagagcatttttgatcaatggctgtatacttcctcctccctaactcccaaactccagacacaactgcagtaacacctgagattcttatggagcaggagagcagataaatggaggagatgaagcatgaggactgaatatggaaattagggtgctatatgtttaatattgactgatataaatcaacatgcatatatcaatgtgtcacactttccagtttctaggcaaagatctttggtgctgatcactccaccctctgtacaccagttaattgtggccccctctctctctaaccaaagatggtagggattgtgaggagagggtgggcttggtagaaatgatcgccggatcttaaaaaatatatatctctctctctatttgcttccataatggaaccattactctacatgcctgtttggaactttttcacttaaataacatgacactttctacttgatgtcctacagatcataaataattcatttctctctatattttgatgactaactgagttgctttgctgagccttcggccccattatggaacatgaatttttccgggctcccaagacttgatggagctgtttctcggtt

SEQ ID NO: 4592 - DNA, 842 bp, Homo sapiens
cactacctctcacacagcaaatctaatatttatacaaccggagcgcatcctaaccattgcgctagcttgtatattaaatgccattgccacaaaatgtgactgtatttgaggataaagcctttaggatggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgccttccagcctccagaactgtgagaagataactcttgttatttaagccacctagtctgtggcacattgttatggcggctctaaggaatgcatacaacttacaacaaacacacctacacacgtgctacctgattctctgattctacctttaaaatatatctagaatcttacaaatattccatccctaccgactttaatttctgggaaccacaccacttacctcttactacaagaagctcctcctgaacataattgtctccaatataccccttctgaggccttctcaacacggcatccttgagtgatttacttttaacaccacattttttccctggcccttggctgcagaaaatcggtcgaaagcttccaaatggctcctataaaaaagttacccacgattgctgcggaaaaaaacaacaaacaagaatggctttctttggccttcacaggaggagctcccagagaaccttccctttatgaagagttaatcattgcccctcgtcattacatactgacctgggccgtg

SEQ ID NO: 4593 - DNA, 907 bp, Homo sapiens
  misc_feature (1)...(907): n = A,T,C or G
ttttttttttttttttcattgaaaagcagtgaaacattttttttttaattgaaggtgagaaccaaaaggaagtttaaagaatattccaagtgagcagagggggtggcgggatcacccaaaaatgctactttgtggttatggtcattataagcataaaatatatctaaaatacttgaaagttatcactttaataaaacaacaaagagatagaaaaagccttgctgaagcaagggaggctgatgtgcacaggacgaacagaagtgaagtgaggaagaacaagggaaacttcgtggcccaggcccgcgtgcatgcctagctgggtttaccacccccgcgagggccccatgccacgcgtggacaccgtcagcccagtggccagagcctggctgggtttaccacccctgcaagggcctcatgccacacatggacaccgtcgggccagcggccagagcctggctgggtttaccacccccatgagggccttgtgccacacatggacactgttggcccagaggccagagctccccaaagccagggctgctgcctggagaacagttacccttggggtgggagcggtacctcccacgagctgcaatgggactgtgtgtgccgccggcacctggcattgcgcattatgcgtgtgtcccaggaggaccctgtgcggagactgttccacactttccacatttgcttctcctgcgagtcgcaatgggactgcgtgtgccgctggcccctggcattgccaattgcgggtttgtgccaggaggaccctgtgtggggactgttccacactttccacatttgttctctggtagcaggtgagctccgggattccgtcaacgctacctccgcggtnccctgaagttatattttattatttgtatcaaacttgtctgtatatttaact

SEQ ID NO: 4594 - DNA, 553 bp, Homo sapiens
attatacaatttcctagattaaacaatacatacaaatgaggtaatgaattatgtgttttaagagcagaaagagctatatttgttatagaatattatgttaaatcttcattgacaacattaaagagtcataccttttatgggtgttagttaattacgtatacttatttccttggaacaagatatatttttacaaataaaaaagtttttctataatattttgctctcactaaaagtaataatagattatacaatacattttattaaaatctaaacaatcaagtttgctagttgtttatgtcagttctttgatttaaattttctgagtctaaatgttacttcactctaccttacatttttctcttctcttgaagaaaataaaaattattatttttatctgtttatgtttgggtttataaattagacttggaaattctaatactcataggatgctagctaggaaagcttgtctgaacaaatcttacccttcagccttgatataatcagtttcttagtaaaaagctaccatcttagttctttgagaccttctcaataa

SEQ ID NO: 4595 - DNA, 444 bp, Homo sapiens
attaaatgaataaaattatttttataagaaaatctattttaaaattagtatactaattttcattcttcaaatgattttcccctaacattaatttaaaacaatttcttatgatattcttacatgttttataatatatgagtattatctctacagatatgaagaaatcggctgggtaaggtcgctcacgtctgtaatcccagcactttgggtggctgaggtgggtggatcacaaggtcaagagatggagaccattctggtcaacatggtgaaacccccgtctcttctaaaaatacaaaaattagctgggcatggtggcacacacctgcagtctcagctgctagggaggttgaggcaggagaatcacttgaacctggcaggcggaggttgcagagagccgagatcgtgccactgcactccagcctgggcaacagaacaagactacat

SEQ ID NO: 4596 - DNA, 603 bp, Homo sapiens
gattgtgaagctaagtgctgtgagggaaaccagaggcagctgagatgtcgtggaagtaacagcgaatgaagccaggatgctggattctgaccttggaactgttctgaggaatatgtaagacatccagagggagtgctcagataactaacttgaaatgctcagaaggtgacttctttgtggtacattatgagcaggcaatcaaaggcatcccctaaacagccagaggaaagctacttgcaagagcatttggaaccaagatgcactgaattttcaaatagaactctgacaataagaaaaggtccgagcggggtcaaaagttctctaaataaaccctaaagaaaatcccgagagtaataatgactgatagtacttaaaagttagtgagaaaggcacatgtttatacctgggtgtttccttttctttacaaactgtagtaaaaacagagaatgggggcacacagcatatgaatttgatcatgtgcaaatcttgtaactttagggacattgagtctaaagtttttatttgggatcattattatgtttctgctttcagaattgaaatcaagtgttaactaccttgtaagctactgatgatattaaaaat

SEQ ID NO: 4597 - DNA, 170 bp, Homo sapiens
atttacactttatgcagcttaattcaataacaattttcctggtaagtgcttctcatgtgccactggggaacaactgctttgctacactgcacttaaaaggagtttaaactaaagagacacaaattttaccctcttatctactgtggctgttaatatgctaagaaaatcgt

SEQ ID NO: 4598 - DNA, 917 bp, Homo sapiens
  misc_feature (1)...(917): n = A,T,C or G
tcagagtgccaaggctgacggacagaactatgtcaaaagaggagcttcagtaggacctcagcactagttgttcaatactacatcaagtcccttctccccacatgctggctcagcactctaccccagatgtagtaagaatgcaccatctatgaagcagagattatgctctcaccagataccaaatctgccttgatcttaaacttcccaacctccagaacttatctccaagcctatcctgaagttgctgccagggcttgggagaaacaaagtgctctccttcagccttggttgctcaaatgtccagggaaaagataggctcagattttttagtcttatcctaaagaattttcactatattcagtgtaaccttttgaagaacaagaccctgnaacactttgtgtacctagtcccatgaaagttataaatatgaatggagaacatgggccaagataagcaggcatgagaaatccgtagtggtaataaatgtggtttcatcagttccagccaatggtctaaatgggttctcactatgtaagggaatgaatttaaaaaggatgcctaaattagatcaaaacttccttagtctgggtggaatatgtggattttactcttggttcaccataattattaggttaaattatagaatgtatnattttatcattcaaactttattataaatttgacntagttttcctttaaagngttgttctttttctntgtttttcattccccganaatatacaaaataggaaacttttttanaaaagggcnttgntgataanagctcaaaagnttanatnnannngacttggaatggcattccttctctgatattaatcaagcctgttcaccttgaaatatcacataatgccaattnttctntgntttttttaataagcnggtataatgatcagaat

SEQ ID NO: 4599 - DNA, 768 bp, Homo sapiens
caggtactcatccactaaatagactcctggctaccagattcacttcgagaaaaagttttcggttgtcatttagcgctcatttttgaaagatggtccgcctggtgcccactcctgggcgctggatgaagtccaggggatgacagcaacatgaactcgctgtggataacaagtcctctgttatgactggatgcgtttgcagtgctataaataactctatcaatattgtgataatggcactttaaagaggtctattttacaagtgctgaatgtaagagagaccacagctgcactcattaattctgaagtatgcctccctctatgtacaacttgcaggtgtaacaataggagtgttgactcagtgaaagtctagataatgtttggattaaggaaaaggttagagtaacattgttagcttctccattgtgtttggcataatgaaaccaaattataatagcttaattggaaatagggggaaaaggcaaaacataactttgttacagatttcagatgctcacaaatagctcctcccccctcaagagcaagtatcataattgacagcagtagatcttttgataattaattgcagtaaattatcacttggcacaaagaaggcataattgtaattaatttacaaccttcccagcataacgctgaattaaaaatgggactggccgtaatttttccaagggaggaaccggggggaaaaaaggggagcctttttttttttttttgaactcctttgaaagtggagccaaccctgcgttgggg

SEQ ID NO: 4600 - DNA, 662 bp, Homo sapiens
tggtatgacaagttcctggccaggcatggtggttcatgcctgtaatcccagcaatctgggaggctgaggcgggaggattgctcgagcccaagagtttgagaccagcctacgcaacaaagcaagctcatcaaactggcccaaggatcttggatgcatcgcccttggcagattgtgtttcttctttgaaattctcctttgaagtggccctcattgccaaccaccaagcctgcaatggggagacttcccccagtactcctaccgatgcctcccaccctgcctactaccttggacacatgacttcatgatatggaaagaagaatctcttctggaaaagagtgcaataaagaaatccaaggacctgcactcaaagcaaatgttctccgtgggtgattagtataaaccctcattcagcataagttggttattagatttgccagtctctaacatgacctaacgggaaaaatcaccaagtactgaaatgttctgatggaagggtattagaaaaaaccactcaagcaatatttatttatttatgttttcagttgggccaattcagaaaaacaaaaatttgcaggccacatattttgtccaagatgaaaatagctttattattttttcctgattataaaaataatgctcatttattattaaaaaaaaaaaaa

SEQ ID NO: 4601 - DNA, 428 bp, Homo sapiens
ggggttctggctactgaacaaattgcaagctgagacctgacgtttggtgcaaacctccgagggctcaccacttcagtagaacatgcatggttcaggtggttttacaggaacaacactaacaaagtcctctggagaccctttcttggatcccgctccaccttctcaggaggtttatgatcacctcggagttgttcagcaatgagacacttgccttgaacaaaaaggtttcaaggacgtagaagagctccttttgaaaactatgttgcagcctggaggagaaaggtggtacacttggtataggccggttggtcccctgaacttctcctagagactcttcctggcagagcctgaatgtaaggaaactgtcagccaccaaaaaaggcagtgaagtcaattaaaaatcaagtgtaaactcaaaaaaaaaaaaa

SEQ ID NO: 4602 - DNA, 966 bp, Homo sapiens
ctagatgaagaagctgaggtgctgtgagattggaaactagcctgaggggaatagctagtaagcagcaaggccaggacgcaaacactggcaatctggtcccttactgatgccatgcttctcttcagagcgcccagcctttcagcaagattctccaaaaaggtaacactaatcagaagccatctaaaggacttaaactcaacacttgattaattggacctaatagaaatctacagaatactccacccataaaccacaagacatacattctttttatctgcacacagaacatatttcaagattgaccacatgctcagccataaagcaagtctcaataaattcaaaataattgaaatcataccaaccatactctcagaacatagtggaataaaagtagaattcaatatcaagagcatctctcaaaaccacacatggaaattaaacaacttgctcctgaatgacttttggataaacaacaaaattaaggcagaaataaagaaattctttgaaataaatgaaaacaaatatacagtacagcaaaaatctctgtgatgcagcaaaagtagtgttaagaggaaagtttatggtgctaaatgtctatatcaaaaagttagaaatatatcaaattaacgatctaacatcacacctagaggaactagaaaaacaagaacaaactgacctcaaagctagcagaagaaaggaaataactgaaatcagagcagaacctgactgaaattgagaccccaaagtccatacagagaatcaacaagaccaaaatttgttcttctgtaaaggcaaagaagattgatagaccactagctatattaacaaacaaaaaaagaaagaagatcccaataagcacaattagaaatgacagaagtggacttataactaatcccacagaatacaaaagcttctcaaagagtattacgagtacctttatgcatacaaactaaaaaatctataggg

SEQ ID NO: 4603 - DNA, 647 bp, Homo sapiens
gtaccaactttatgcaccgccgcccaacccccttcacccccccggccgctactatatcttcaaaggaacattttggagcccactgatgcctatattgaaataccgaatattccaccataaaaactagaaagaagctatctgtgaaactgctttgtgatgtgtgaactcatcttaaaaagctaaacctttcctttgattcagcatgtcagaaaccctctttttgaagcatctacaaagggacagttgagatcccattgaggcctatagtgaaaaatggaatatcctgcaaaaaaaaactagaaagagtctaactgtaaagccgctttgggatgtgcggattcatttcaccaagataaacatttcttttgtttcagcaggttgaaagcactctatgtatagaatttacaaatggacatttcagaactttatgtggcctatagtgaaattccaaatataccatgataaaaactataaagaagctatttgtgaaaccactttgtgtgtgtggatttagcttacagagtcgaacctttcttttgattcagcagggtggaaacactctttttgtaggatctgtgaaagaatgtattggagcccactgaggccttttgtgaaaaacggaatatcctgtgataaaaactataaaa

SEQ ID NO: 4604 - DNA, 769 bp, Homo sapiens
cagatcattgcttcattggctttaccttggacaggattcatcagtgttgtgcttcatacaccaggtggtggcccacacagtccacatgatgtggaagaaaagggaatgtctttttacgtattttatttgatcttcagtggatttttttttgcatgtttcatactgaacataattagaacagtagtacttgtgatattctataagtaaaataatgtatcagggtactcatgtaaaactttctatacggttgtatatataagttgtttagagatcactagtctacactgtaaggcaggagttagcaaactatggcccttggaccaattcaacatctatcacttgtgttcataaataaggttttattggaacacagctatgtttgaatattttccataaaggattttgggctataatgtcagagttaagttgttacaacagaaaccttatggcttctagaccttcaaatatttattccctaggcatttacagaaaaagtctgctactcactgttctaaagagacaagaattcaggtcaaagttgtttgtagacaaggcggaaatcataatatcgcttagggacttggttccgggctttataaatagtcgttacaccttgaaattttctcagctaacaaagaaaggtgcaaatgtatcacattttttttttagcccttaatgctaagcacactttctggactggttctgaaattagagccttttctttattgctaaaggttaatgaccttggccaagttacttatttactttg

SEQ ID NO: 4605 - DNA, 631 bp, Homo sapiens
tgggatgcctggagactggaagaccactttactgtggctatgaatgagaactttgataagcattatgaaaagaagatggcagggtccgcactgaacttctgcctggagatctgagaggaacaacaacaaactaggtgacagagactatgccaactagttcgccttttattctgttgagcaaggaactgtgactgaatgtggagcttatgagcttcagtccatctcctatagtgtggctagtttgctataatattaaaacatgatttaaaatatcaacaaaccagttactccagcaaataaaataagagaattagagagcagagtccgcctacatgagttttgttgtttgtttgttttttaagtacaggtatgttttattgtgcatgactgatagagcaaaaacaaacaattgcatcatggattcccatgtgtgatcccaagtagatttcacaagaaaattatgcataggtattacaagccccattgttaagagagaatgtaacagcttgaagtgtacattctatacttttatgtataaataataacttccaagagaaaagagctgataagtacatctcagagtcaccatttctgtaatagaatgatataaaaataaattactactgcaaaa

SEQ ID NO: 4606 - DNA, 786 bp, Homo sapiens
cagaaaagaaatcctaaaaacaaatgaacaaatggactcggtccacggacacctagccaagactgtctctgagaagaatgacatgccttcagcatgaagtagctacaagaacgggacatgtaattaaggaggaaaaaaaaatcagaaactggagccattaaagagactgtgatatgaggaaaacattgtacaggagatgtgaccgaagatttcagatctgagaactgaaagggaatgaaactagttaaaattccactgctcattcgctccacgggagaaataacattcctgtgcgatgccacttgccacttcatttttagaaacaattaaaagatgcaaatatttatgaatcactgtgtatgttgtaatcctattttgaaaacaaacattgccttgtactttaggttctcaatgctggttgctgttgggattcaggggttaaagcaagcacttcaaaatgagctcactactgctacccagacaaagggatgcaactctgagagtgtgttctgtttgcctgcaaactgttgcctatgccaaatgagcattttaaaaaccattcaaattaagttgaaaatttgtaattatattttcccttttaattgtaacttatgcaaatgttatattccagctgtacaaataattttcatttcagactacaacattcacattaaatctaacatgtaacaccctgatacaagattttttccaagctgtagttgcagatttagagggctagagttggctctgttaatgatggcttccattgttgtaccctgcagataa

SEQ ID NO: 4607 - DNA, 287 bp, Homo sapiens
caggtgtctgatgcttggcctcctgaaaaatccaaagccttactaagggaaatggatttggatctgttctctgcttcagagatcctgaatgctgagcctcttcaaaaatatttaaagatgggacttcccctgtcaccataaaagcccatttctaagatgatagtgctaaaccagacgattcccaaggctctactcaagtctaacatttttttctttgcaatttatttctacattagtaatgagatgatgcattaataaaacatattaaagatatcttgactataaaa

SEQ ID NO: 4608 - DNA, 656 bp, Homo sapiens
taggaccttctggactgacacagtgagcaagaaatctgatgtgcccaacaaccctctctctaaatgatttcaaggaagaggcagcaagctgcacagatactggaaatgcgtgatgtaaccttttacattcagagaaagggctgtccctaattcaagccatatttcacccaatgaagtagacttatttaaaactggaaaacatccaaagaagatatgaaattcaatatatttcagtaggtcgtggcctttgccttcttgtggccccaattacttccctgtgcccagatgggtcgtccctctttcctcgtgctggatacttcctaatgctcattccaacctgagctctcaagtgaggcatctgcgggtgagaaatctataatgcacttaaaggttgttgagagcttcccaggagtcaggctatgtcctaaaagctgtaatagattatctcatttaaccccactgtgaggactctacagatgaaggggtttttaaaggaggggtattttataaagtcccccctgtattatgtattaccacaggggtgaaaactgtgatttatttacaccaggattttttcccctttctcaaaatagcaagggacatgtgggtccttaatacatcctgtgtattggggcacaaagggctcttcctctcat

SEQ ID NO: 4609 - DNA, 789 bp, Homo sapiens
  misc_feature (1)...(789): n = A,T,C or G
agctgctggttcagaaaatactgctggagttcctctcttcttcacgtacagcagagagcaatttgcaaagtcatgcaagggtgaaaatgtgattgaaatatagggatctttcttaatgaaaaatgttactgctttggaaattacggctaaaactatctcagaactcacttatattcttaaaccttgtgacataatagtctccatttataaatatactatcaattgtaaattacttggcaccaaatataaagccttttttctgcttattttttttgactgttatatatttacatacatttatattggtgtggtggagtattttgatcagtttttgtttttctctaaatgattaaatgtcaagatcattaaaatcaaatgtaattttcctcatcaaaatgaaaatgttactcaaaccttaaatcaaaagggggcatcttttgatattttctaaacttctaaatatgtattgaggttcaacctatgatttaaaacatgactaaactgaaaatgatagttctttgaagtactgtttcttgtttgtaagctttaatagtgtgcccaatttaaatttggatgtagcttaaagatcctttgttcaaggaagcaagtagaattgacctaattttacatgaagatgaaagaaaaaaatgacagaaacttcaagcagaggtagcactntggtttttataatttatataacaaaaatctaagaagtatgtttaaaataataatctttatttaaactctcatgtaaccagcacacaccaaaacatttttttgcaagctaac

SEQ ID NO: 4610 - DNA, 602 bp, Homo sapiens
gctagctgtgcttggactataagaattaaaagtgaatagtcctggctaaacaacagctgcactcctatattcttggatacagacccaagttttcatataagagggaataaaatacaagatttgagaaaacactggagatggtaataagtatattttctcatatatagaaggaacatatttttaaatgtaacattttatatttaaaattttaaatgtaaagtttatataccttcttgttttattttaaatttaactgtattatacttgctataatgaagagacatacaaaattaggctcgagagtatgggcttgttttctaaattctagttttttacctgtgtttaattggttggctatatttttcagcttttgaatctacatatttgcatgcaagatgagaaaatattgaccttattattattattatttaaaataatattttaaagcaatggtttataatgtatgcttattattatatcattgcaaaatttataatatattatacatgtatttttacagtgctatttaagacaacttaggctaataatatatacttagaatttaatactatttttcttgacgagctggaaaaaaaaaaaaa

SEQ ID NO: 4611 - DNA, 780 bp, Homo sapiens
aggcaaggctgcaggaggcagctgaacatcacttctggcttgaccatgctctttcttgctactggcgaagtgaagcccacccaggggagtgttcccacatgcacagaaagcacacattgacccggcagatgtgatatgaacatggaattgggacctacggaacctgcccattttatatgggcaagtcttggtgtttagaatgatgtgctgatttacttaggattaagcttatgtgtctttgttcacttagttaaagcaagaggctttttttatcccagtgatgccaatatatgaaagaaaactccagggcagcgtttatcacagtggacatcttgttacaaagcatgtccacttcagaaaaatgcaaaaaaaaaaagacataattgcttttttgcttcagtggagggtatatttttaatcatgtgagctctttataaactcaaatcgactttattttttaacgtatatgtcttgcttggaaagaaaccttcattcctttcctcagttctgtgacttcaccactgcacaagtgccacttgtcacccttggacttgcccgtcttcccagaccagcttattccactcagaacagcaatggcaatgcagtttctggaactttctcgctggtaaacaccagctccttctgtattccgaataccttattgttttgtgacttatggtgatgtccgaggaatcattcttggttgatcctgagattactgggtctaaaaacatttgttcgtgtgaatttgtttcacggccctggccttaaataagaacg

SEQ ID NO: 4612 - DNA, 797 bp, Homo sapiens
cctagacttctggaagaggggctctgggagggtccaaacaacaaaccacgcggcgttctctggtggctgtgctgtgacgagtgggtggaaacagccgcaggtctctctcttctcttcagcctgaaactcactgcacaaataccagaggttttttttagagattagataaatttgcatccttctccccccaaccccgcccctaagccagaggaagtgcttgaggaagtaatgtgtttaaagaatgtgggggaggggagcttacattaggaagcaggactcttagcgtgtagccagaaaccccaataacctttaagctgttaacccttgaggatacggctcaatggtgtacccacgtggagttcattatttatctccgaaagccctgtctgtctctcattccgacccttaaacgaatcatctgcagtttggccaacaattcagttccagctccctgggaataccagcaaatcccgggacagctgttccttctgctgataacaccaggaaaatccgcccaggagctcaggctgtttgaccagaaagcctggtgtttgtcactgtcagagagcacgaacagagggaagaggaggtccttggctgggtccttcatttttttctttttttttttttttttggcctcgggagcttggatgagcttgtctttgatgccttaattgtttctgcactcttttctccctttcataaatccatttgaacgatatatatattttaagagtaaggcaaacctcaaattaggctgtctgtagaactgagcctctggcaagagaggtattaat

SEQ ID NO: 4613 - DNA, 809 bp, Homo sapiens
cagtattgagaggcactgctcctcattgcatctgctctctattcaacgagcctaaggaagaggatcattgatggaagggacatcctctctgtcctgctctctgcaccacagaagaaacataaggagttcaccagacttgagtctgggtatgctacaaaaatgtgacttcttttcctgacaaagcctggattttgaacttattttcaagttgtagatgcaagctaaaatctaatttgacagtcaaagctggacaaggactcccctgtgttctggtggggactatgttctgacaccttttccctgaagcacggaaacccattgtttcaatgagtgggaagtcctaaagcaatgtgatctacaggataagaagacacaccaaaaaaaatatcctgaagttgctgatgtaagaaggatggttggagaacagctctatttcaagaacatctgaatatgatgtttttcataatcttaaaaaaacctgtatcggtaatcaatacaatacattccaagtgaccctatttttttgcaaaagaagaagaaaatctctagaaaaccatttgcattcatataagctttacaatgcctgaaacaaatgtttaggcctcagtcttttccagttcaaagaccaatgaaaataatttgtagaccacacttgaacaaccacaaattgagtgctgttcctaaaggaagctttcgcagctgggatgcctgacacaattctgggcttaagtgggtggatattattattaataatatttaattaagtttctacctgagcaccctgctgaagactctctaaaaatagtctt

SEQ ID NO: 4614 - DNA, 287 bp, Homo sapiens
aattcactacactaatcactaaacaaagaattataaaaccaagaacaatttgaggtgtttcctgagctctgaattattttgctgctcggattgatcctggcacactagaagaatgctgctcaacaaatgttaaacaatgacgcaggggtttatcatctactctcctccttgatcttccacatctgctcttgtgctgctcggtttaactttatagactattctgaaaactaatgattcctaaaggttaaggtttttcaataaatataaagtcatgaaaaaaaaaaaaa

SEQ ID NO: 4615 - DNA, 774 bp, Homo sapiens
cagaaggtacctgcttcccctttgtcttccaccaggattgtaaattacctgaggcctccccagccatgcggaactcctctatgttgagtactgagatccagcataaaacaggagacttgtttcctgcatgaaacctgcagtattctgaggattaaagatattagatcaacaaccagagaaaagaattatttaagtgtttatgcaaaaaactgtagagagtcctatggaaatacaccagtgaaatagaatatgcacagaatgtgatacactgtacaagataagtgcaccaaaaccatatatttgaactgtgtgactagtatatgacaaagctagagagatttgaattgtgcttctaaaataaaataattactttgcaacttgcgataaaaaaatccatcaatggatcaatcaaaacggcagtgctgtcaaattgtgtaatatagctatactaaaatgtatatatttttatacataatcacaggaaacacaactcatagtcaattatgttatcatattttcccattcaaaaatgtggtatgaaagtattttgcaaattcagtatcaagtagatagtttgtcaggtgtttttacaccacacagaataaatcttatcttttctagacaagaataagtggctagttcttttgtattctgaactttaaggttgaggcagaagtgccacggaaatcaacttctgacttagggaagataaataaactcttcaagaaactgaacctgtcaaagcagatgaaaaaaacatctctgttgaatgct

SEQ ID NO: 4616 - DNA, 249 bp, Homo sapiens
ctaggagggagagacatagaccacagtatccatagggggaaaaggccatgtgaccacagaggcagagatgaagtgctgcagccataagccaaggaactccaagattgcaggtcaccaccagaagctggaagaggcatgaaggatcttcccctggagacttcagagtgagagcggccctgctgacaccttaattccagatttgcaggctccagaactgtgagaataaatttctattcttttaagacaaaa

SEQ ID NO: 4617 - DNA, 767 bp, Homo sapiens
  misc_feature (1)...(767): n = A,T,C or G
gataccattacctgatttcaacccacacaagatttcgctgggttttgttgcttgttgctccctgtgccagtgggttatagctttgaataaccaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacttttattccgttgctgataaacaactattagcaaatcggaaaacaatggccagcaggcgctttcagtgtgcgtcagtcttactaactgtcctggaagatgagaaggcatgacttactttggtcttatatctcgtccataattcctactgggcccaacaacccccaagatgttattttcactgcaggctgtatcatataccttctaaaactatctaactatccagtttcttattgggatcagtagacatcctattcacatatagaaatcctgtttgagtcgtctcaaaacagaagtaacagaatacatgtatctgatgttatctcctgttctgaaaacatcagcacgcttttctctgatgaggcccaaagtaaacctttcaatgaaaatgtcattagttttccttttctagcactgggagaacncaagctgaacatatacaacatggggtggaaccacaaaggagaagatgtctttgtaaattaaaaagaaatttttccctttttgtttttaagagagaagtaaggt

SEQ ID NO: 4618 - DNA, 443 bp, Homo sapiens
  misc_feature (1)...(443): n = A,T,C or G
ttctaccgttccattcatgccatgattgcatcctgtagcctttctgaaaaccaaataaacaatgccggatgaagcctacagtgtcttctgagtttgtctgaactcaagatcaatgctgttatcaagcagagatggcatggcaatcacagaacagattnggctcctatgctaggaggctagtaaacataattatgaagagtgctctttctttgaaaatatgtcatagattccaagggaaaacttcccagtaaaatatgatcagacttcagttaatttggaagaaggaattgaggctgcttaggtctcccatattttcgtatctaactgtttaccaagaaggcctattctattaaactcttatttgaacctattctgtccactctaccctcacttccattgtattggttaataagctaatcacttcatttntagattagttcaat

SEQ ID NO: 4619 - DNA, 830 bp, Homo sapiens
atttcttttaatgtattttcatgatcaattatagaacttttatgggagaaaataggtttcctgaaaagatactttggttatgacttttcatcagtagggattaagtgttaagtattttgaagtctgacttgtcatattcgccagttagttcaaatcaaggatggcctggatggttctctactgccctccagtgggaaagctagatggaggtcaaagcatttttgaaatggaaaatggactggtttatgtgtctctaatattgggacgtaaaatatatagacagaaggagataaaagaactgaaggatgttttcttctcaagtgtgttcagaaataagtgaactgtggaacaatgaacccattcagcaccatgacttcttacaacttcaaaaggatattgtaaatactgtatttaaaaccgaggtctcggccaggcacggtggctctcgcttgcctataatcccaacactttggcgggccaaagcaggaggatcacttgaggtcagaagttggagaccagcctggccaacatggtgaaaccccatctctactaaaaatacaaaaattagctgggtgtggtggcatgtgactataatcccagttacttgggaggctgaggcaggagaatagcttgaacctgggaggtggaggttgcaatgagccaagattgcaccagtgcactccagcctgggtgacagagtgagattcgctcccctctggtaaacaagatgccaactctagggtacggtggaaagacatactggatactttcactgtgttcagcaaatggattgaacatggagccaaaaacatgcgaagcactgggacaat

SEQ ID NO: 4620 - DNA, 551 bp, Homo sapiens
gatctctgctcactgcaagctccgcctcccatgttcaagtgattctctgcctcagcctcccgagcagttgagatgacaggattccagaggagatcaggtggtgatcaaagaggagaccctgttggcaaagctcccttctggcactgatgaactggatgtgagtaaactgaggctcagaagaccgatagccaatgtagcagagataagatttagaggccagtcttctggcctcaaaatctgtgctgtttttcaccatgtctaccatcttctccagatttctcaaacccattctgtgtcccatccaccaacaaagcccacacattttatatggctggtgctggtatggaaaaaacttgagactttttaaaaattccatggctattagtttaattatctcatcagtcagttaaggaagtatctcctttatttattggtgtgtttctcatatttaatgcatgttattaatgtattaaattaataatagtaatgcaaattaaaactgtagcatctggtgttaagcggcaatgcttgatatacaaacttaaataaat

SEQ ID NO: 4621 - DNA, 697 bp, Homo sapiens
  misc_feature (1)...(697): n = A,T,C or G
tggccaccacggtgggcgtatatggttctgccaaacaggaagaagccagctgccaagaggccgattttccccttcctgagggctccactcaactaggaagttccttgtttggcttagtggaaaacagtgatccatgaagcatggaatggangagacaggtaagaagtgtcttttgcttcccgccatgaatctgaggccttccagccatgtggaactgtaagtccaattaaacctattcttattcccattcctgggtatgtccttatcagcagcatgaaaacaaactatacaggcctattttctgcaccttattttaccagtncgttatgtccacttgtcatgcaaaaattccaaagagccaaaaaacataatgtgaggagactgaccaagcgttagaatactcagataaagcaggcatgttcaatttaatgaccaggaatttaaatcaactatgaatagtgtgctgagggatttattggataaaatgataacatacaaaaaaaatataaacaaagacgtggaaattctaagaaagaatataaaagaaatgctagatatcaaaaacagtataaaaataaacattgcctttgatgggctcattagtagagaagacatgcttaagaaagaatatctgacttcagggtatgacgagaaacttcaaaaactaaaaggcacagtaaaaaaacactgcataaat

SEQ ID NO: 4622 - DNA, 886 bp, Homo sapiens
  misc_feature (1)...(886): n = A,T,C or G
ctcttgtgaagaaatntttaacatcagagtaagtgtcctagagattaatggctgctgtttggcaaggtccatagacgtcctttcctgccaatacaaatatatacattgttgaagcacaagactatatccacagataggattacatgttaactgaaaagattcaaggaagagaagatgggccatcaatgaaaaatggtggttacaatgaagcaactgatttcacagctaaggcgagagcactgcactncctcctcatgctttctggtacactccatgttcagagaaacttctctagtaacaaactatgaaaatggctcctcaaagtatagaattttactttatttttcaatgtttttcaatcaccagttttgacaatggcattggcccgtgtcaccattgactttattacaattgatttctattgttcaggttgtaaactcccactaagaagcatgannnangagcaagatgcacttgangagataaaagcatgacctttgaanggaaacccaaacattcagttcangttgnaaccttagagacctnaaanngatatttccaaggtttttggngaaggtttaaaaatgngctcttttngtattggaaaaaattaattcctngatgccggncggcaaccgnaggtgggacctccagctttcngttcccttttantgagggttnattnncccctttggcgtnatcattggccatagctgntccctntggtgaaaatggtattcgntcacaattcccncaacttacgatccggaancataaagntgtaangcntgggtnnctnatgagggagcttctcncatnatncttncgcttnntggccgtttncaatcggnaaacctgccgngccactgcnttattgatcgccnnt

SEQ ID NO: 4623 - DNA, 490 bp, Homo sapiens
  misc_feature (1)...(490): n = A,T,C or G
ttttccatacaaaagagcacattttaaacttcacaaaaacttggaatatcttttccggtctctaagttacaacttgaactgatgtttggtttcccttcaaaggtctgctttatctcctcaagtgcatcttgctctttttcatgcttcttagtgggagtttaacaaccagaaagcatgaggaggaagtgcantgctctcgccttanctgtgaaatcagttgcttcattgnaaccaccatttttcattgatggcccatcttctcttcctttgggagaataagaaggggaagatgcagtcttgaatcttttcanttaacatgtaatcctatctgtggatatagncttgtgcttcaacaatgtatatatttgtattggcaggaaaggacgtctatggaccttgccaaacagcagccattaatctctagaacacttactctgatgttaaatatttcttcatcaagagccaaccagttcctggttgacttcaggat

SEQ ID NO: 4624 - DNA, 304 bp, Homo sapiens
tggatgaaacgaggcttcacccctgagtctgcaaccttagacaagtttctccacaatgctactctgagatcaagatctcaactgtacatcctggagacaacacaacaacacaagggaataaaatcttatacaactgtcagaggtattgtggagttcaaattagatgatatacaatgacaccaaggaaaatacattgtgaaatttgacgagattctgaactcaaaaagagatgctgctctattcatttcaaaacaactcataataaaagtgttccgccgggcgcggtcgcttaaaaaaaaaaaaa

SEQ ID NO: 4625 - DNA, 665 bp, Homo sapiens
  misc_feature (1)...(665): n = A,T,C or G
tctctaataaccaccgctacagactacagttgaccacaggaaactgaaactgcatttgaaaaagaaaagcctcaaatgaagattgactactgcattcagaagcacatggagaatgaaatctttgccttgaagaataatcttgctctgtcacccaggctggagtgcaatggcatgatcttggctcactgcagtctctgcctcctggattcaagtgattctcctgccccagcctcctgagtagcgggactacaggcccacaccaccacacccagctaatttttgtatttttagtagagatgggggtttcaccatgttgggccaggaatggtctcgatctcntgacctttgtgatctgccctccttggcntcccaaagtgntgggattacaggcatgtgccaacccaattcttttcatcctcctcttcccctcacctactccctcttcccagtttctgttaactacctttcactctctacttccatgtaatcaaatatttagctcagacatagggaagaacatgcaacatttgtctttttgtgaattggagtatttcatatcatttgctttggaaatgctgaatatgtaatacggttaaaactagttatacataatttaatgtcttaaataattttaatattctttgttcatgttggaattgatttca

SEQ ID NO: 4626 - DNA, 750 bp, Homo sapiens
cttattagcactactcctggactagtgcaaagaccagagcagtatggcctgatggcaaagagcacagaccgccctgcttgaatcccggctctgccacctaaccactgtgggatcttggatcatttccagagacgatggtgatattggaaggagacgattacccatctctagtcctgacccttcgctcaagccccactgctgcctcaaacaatccatggccatggcacctcaaacctctcctttgcatcactgtcagagctgtccagatgggttctgcttggttggtggattcgcaggccttgagctgtggggctgactcgagataatttccacacaccactgagcatttttactgggaagcgtttctttccttctcctggatgatggtgttatcggacttgtatagattaggagggagaccttaggtttcagaatcagactgaccttaattcaagtccaagctacccactagtattgggcaaattattgtactcagagtctcataaaacacaactcacaaatatgttagcaaaaattagatacacgtagataatgcacacaggaaacgtggcacataggaggcattaaataaattttttctcttgtattaagaaaaacaaatcgagctcgatggactcaccgatgcagctctgcgcgcggttggctttagcgaggaataatgcatgatgctcggtaactgaatcactgcgctcgcacgagcggctgcccccaccgttatagtctgctcag

SEQ ID NO: 4627 - DNA, 607 bp, Homo sapiens
tagggtctcattctctcacccagtgctgaagtgtagtggcacgaacatggctcactacaacctccacccttctggctcaatggaacctcctgaggatccctgctgccccagcttctcaaataatgggaactacaggcatgtgccatcaagcccagctaacttttacaattttctgtaaagaggtggtctcaccatgttgctcaggctggtcttgagctcttgggctcacatgttcctcctaccttggacttccaaagtgttaggattagaggagtgatccagttgtagtattgagaaggtcaaaattagtggtcaatatagtaggttttttggttcccaaaaccataatacagacattggtggcaaagagaattgcatttttgtttattcacttttcatataggactgataagcaccaagaatttgatatgtatatccgaacaattacaaaagaaatgtaggtataaatcgtgtttcaaaattcacatttattgaaatattatttatattaggtgtacagtttgatgatttatgatacatgtaaatgattgtataatcaccactacaaataaaatattgaaaatttgtattaaaaaaaaaaaaaaaa

SEQ ID NO: 4628 - DNA, 775 bp, Homo sapiens
agctcccttatggctgaaattgaatgtttcacacctgggccatgctccacaagcaaggcagaaagtgactgcacatgcgctcataagtggaatgaaagggagaggagctgggcgctaggatgctggcccattctggagctggtgtctgcaaacatggtacctccccagtgtctcagacagacttcatgttgtgtatgtttctcaggatatcaaggtttattgggagacatcgaccttcagtatctggaaatggccagagatggtgcaagctcaagtttcaataatcatgatttcaaacattttatttttttgagaatgtattacatgccagtagcagtgtaaaattttgaccattccatagcctattcttaaaaaccctatggtgtaagtacttttatgaaccttatttacgagtagtaatattgattacaaggctaatgatgattgaacacttactatattattggcaatgcactatatgccttacatgtatcatctaaataaacagttctgtgagatttagaaaattgagactcagttaaaatatgtccaagtttatatagatcttagatgttggagctgggatttagaaggcaatttgaattttcacaagttaaacgcacctgtataagatgtgactaacactcagctcaggaaattgaatttaaccaacatcccaggaagaccctcatgctgtctcctggtcctttcttttcctgacccaaaggtaccactatcttgacttctatcacaataattttgtttttttgtttct

SEQ ID NO: 4629 - DNA, 861 bp, Homo sapiens
agttcaggtactgcttgtgtgcatcttttcatttcaatggctacgtcacgaatacctgcaagaaactatcacattatttccctgccaaatggacaatctcacaaaagtgacagaattcctgctgatggagttttctggtatctgggagctgcaggtgctgcacgccgggctgtttctgctgatttatctggcagcgctggtggggaacctgctcatcattgcggtcatcactctcaatcagcatcttcacacacccatgtacttcttcctgaagaacctctctgttttggatctgtgctacatctcagtcactgtgcctaaatccatccgtaactccctgactcgcagaagctccatctcttatcttggctgtgtggctcaagtctattttttccctgcctttgcatccgctgagctggccttccttactgtcatgtcttatgaccgctatgttgccatttgccaccccctccaatacagagccgtgatgacatcaagagggtgctatcagatggcagtcaccacctggctaagctgcttttcctacgcagccgtccacactggcaacatgtttcgggagcacgtttgcagatccaatgtgatccaccagttcttccgtgacatccctcatgtgttggccctggtttcctgtgaggttttctttgtagagtttttgaccctggccctgagctcatgcttggttctgggatgctttattctcatgatgaactcctatttccaaatcttctcaagggtgctcaaaatcccacccagtaccgagtcgaacaaaaagccttcttcaccctgttccccccagcttattgtcatcatgctctttcttaccacaggggtatttgctgg

SEQ ID NO: 4630 - DNA, 775 bp, Homo sapiens
  misc_feature (1)...(775): n = A,T,C or G
agaatctggaagacattaaatgtcagagagatgtgctcctgttcatctggaagaaagcaaagaatcatgctctgaactccttttgggggcatgtggccaggaactgagcgtgacctctagaagttgaatgtggtctctattcagaagtcagtaagaatatggatgccttagtcatacaacttcagggaaatgaattttgtcaacaattaatgagtttgggtagtacgctgaggctccaatatgaattgggagcccagatgatttttagccgggggtcctgagcactttgttaccttgtaccataactcccgtaccatggaaactgtgaaataaatttctgtcattttaaaccactaacttgtggtaatttgttattcacaaacaggaaactaatgaaatcactgttatgcgatgaggtggcaactaaaaaccagttagctgcttcttccattgtcaacgacttttactgttagttattagctaaacattctcttttatagatttgtttatcaaatttaaacacagaattaaggggctattggaggaataagagaaaattaatcattttattttaattgtatattgcagtgtaattccgacataacattgtttcataatatgcagatattgataatctaaattcaaaccatatattgggcagttaattttataaaatatgtgaatgttatttgacagagactaaccctccctactacatttgtagctatnttttggtgatattaaatgtggatattctttaaattacatctatttt

SEQ ID NO: 4631 - DNA, 763 bp, Homo sapiens
gtaggatattttttacataaagcatactgcatgggagtcctactggtgatggaaaaagaaatgaaagcatctctcaaaagggtcaaaccaaggccaggttttatttggtgtttgagaaaacctggattatttgggtcaggagaaaattttggacttcctgctaatcacaggatttcaacagcaagcgtcttcagatcatgtgtgacaccccctggctgataagagccttcccacctcatctcaaggaaggcaacacctttcataactactagaatgactacacttgcctcactaaattgtagttgttgaaccacaaacttgattcctacttctgtaaaaataaaccagaattagaatgattaagatatggaattgagcctccatgaggtttcagcaggcatccataacctacagggttataacagtcatattttctgaatcccaaatcaggacatgggaccatggaaatagagaagaccatcaagcagaacgtttgacttcagttctgtcgtgaagattctgggttttcaatccttcttacaacgggactagtgaccacaatgtttattggccattaagcactcattagtgctctattaccttctttccttggaatgtttgttttatatcactttttatttttctcattttatacccactacttgggagactgtagtatgagaatcacttgaccacggcacggtgaggcttaatgatcccgtactgtactacttcctttatactgggctcctaacagactttg

SEQ ID NO: 4632 - DNA, 442 bp, Homo sapiens
  misc_feature (1)...(442): n = A,T,C or G
aacaaagaattgattcaatgccagactgtctggagccagtagaactgaagaaaatgatgactactagggaatagattttaatatgtgtaatatggtttagttgaccacaattattaacaatcaacatatcatagaaacaatatattgttttccctaataatcaggcctgggtctacagagttgtactgagaacaggattagtgtagctgatgatatatgaagagttatctttgtcacacagcctgaaagattattaaatgtctacttggtcaagcacttaaagcatgcattctttagctatccttttctctcttaatttcttttataaaattcaggagatgttctgatctctgagaatgtaaaacttacaagtgcaaatttaaacctccaaattgatgataatcttttggggataaggcacagaaatacacgatngnngtta

SEQ ID NO: 4633 - DNA, 564 bp, Homo sapiens
  misc_feature (1)...(564): n = A,T,C or G
ttttgtacctgttcccatggcaatgaaaatttgagaatgagacacaaatatgatcagcaatagaaactgggttacatcattgcaattttgaacacatgctgacccgaacaaccccgacaaagcttcttttgaaagaaggatgcagaggtgatctgtaccagtgtaagtctcctataaccagagacaaatgtcatcttgcactgaaggccagagagaaattctattgcaaatgagaagcatactgctgtgagccttttcagtatgacacaacatccgttcttcattttttatatgagtgatcaagattgtctgatgccctctgatgcaagctttgataagagctcctgattgtcattataaaggactttagagagcatattctccgaagatggcctttccacttggagaatctagtctgtatccttgaattttctttgttaagaatagaaaaaaaataaaaaaataaaaaatncagaaagatacccnagaatnatatnacccctgganaccnaccccggaantggcntttggttaccatttggttaaagatttttaaagtctcct

SEQ ID NO: 4634 - DNA, 508 bp, Homo sapiens
tcaagggtacatatgcaggtttcttacacaggcatacggctctcttctggtacccacagtctccaagccttggccagagaggaatggcctgcctttcctttttggaaacgtctccaatcaatctcttgtgtatcgcattatctttccggtgttctgcctttctccaaacgcccccgtgcgttttcaaggtttatagacgcgtatcttgaactttaggtgttgagattttttggtccatctttgacaacacatctgcaggaagaaagcatgagttgatcaaaaaggaagaaaaagctacaaaatctagggcattattattcagaggacattttctggtagagttaggataaattttttccaataaattaattttacagacttttaagacagagcttttagattaatggaaatattacttaaatttaagttcagcccattaagtcatcaatcatattgttgttgtaacatcatgtatttcatgttcatgacacacacaaataaaaaacga

SEQ ID NO: 4635 - DNA, 361 bp, Homo sapiens
caaacatcctgattgtcagtatacttcttactcaaaagaaaaaaaaaagaaaaaaaaggaaggaaggaaatgaaagagaaagagaaagaaaaagagagaaaaaaagaaataaagaaggaaaggaaggaagaaggaaggaaggaaggcaggcaggaagcaaggagggaaagaaggaaggaaaaatagaaactactgtaaaactagaaactcttatctaatttttgtccattatctaaagccattatcaatgactccttctttataaaatactatatgtcttcttattctatactatttcatttcttccaacttgcattgcatatttttatgatgtagtttcgaaataaacacagatcggccg

SEQ ID NO: 4636 - DNA, 755 bp, Homo sapiens
  misc_feature (1)...(755): n = A,T,C or G
aggtagatctaataggatttcctggtgaattagatctatggtctgagagaaaatgagtcaaggatagagttaaaagatgaccctaggattttgtcctgagcaatggtaaggatagcgttgctgttaactaagatgcggaagactggtgaagaagccaatttgtgttagggggctgggagcaggatttcaacttggggcttgttaaactanagctgtctaacatctaagataaaaggcagttggatagatatatgcaactaaaatttagagggagtggtctggcctgagcactgtcaatntgtagattatatttaaagccatgagactagataagatgataacagagtgagtgtagctaaagattaagggtccaaagaccaagttgtagagtatgctgacactctaacatcaaganaccaaggagaaatgcctgtaccggaatagaagagaggtttcaaatcagcaacttaaggttctnccttaaaacaaaaaacaaaaaaaggcagagtgtgatggttcactcatgtaatcccagcacttagggaggcaaagttagagaatcacttgaggccaggagtttncaaactagcctagacnacatagtgagacccccccatctntagtagaaaataaaaanngagagagaagaannagactntctacccccaagacaccacntaaaanataagacnaananatngnnacanttatanganatnagaanagtatnanannanacgnatannntngataga

SEQ ID NO: 4637 - DNA, 543 bp, Homo sapiens
  misc_feature (1)...(543): n = A,T,C or G
ctgaatcatttaatatgtnttntaacatagtcattcacataaatatgaagcatccaagatcaatactaacacttactgggtggtttgaaggccttgggttctatactagaatatgctttaggcatgatttccatataagaggaagatttgtctagtgatgaccatcaaagtgaagtaaagccaaatacccatgaagctacaagtaaggtatttgatgtccttcaaaaactactcgtcctaagcttttctttcctaatcaattttataggtgctatcacatgttaaaagctattctagttcagttaagtaagaaagttcctgaatatgatttcaacttcccaaatgattcagcagtactatacttgcctcaaggcctatccacaatactcaagttacaatatagttagaaaagatttttaaaagatactttcaccttatattttaaaaaccaaagctctctgaagaacctgcaaatttgtccttttcccaaaaacctagctatagcaacaattcaatttcatcctgggtaataaagaagagcgg

SEQ ID NO: 4638 - DNA, 448 bp, Homo sapiens
  misc_feature (1)...(448): n = A,T,C or G
acttcacaatagctcnttganaaggctgttcctgcagctgccgcctaaatcacaatnagtaagccctgtgatgtcagctatgcgccagagaaaccagaaagcacacgccattccttgtcagccatcacctgaaattactaaagtgctgtattgggttcgttcatctagagaccagctcctaatcacaggatgctgttttacaaggtcaaaaacatgccaggcaaacccgcaatgccaccgctcagcttgagggagaaaagttttacatccctgggaggagcttctgacgatatgattcaccatgttctgtcttgctgatgaatgtatttaatttttttatgttttaatttttattttttgtgggtacatagtaggtgtatacttgatgcatgtattttaaaactagagaagaacaaaactaaaacaataaagaaaaaataaaaccaga

SEQ ID NO: 4639 - DNA, 592 bp, Homo sapiens
gtaaggttgagataatctttttaaggaaaataaagtacccctaagggccaggcacaaaacaactaccatccacttgcaggtcctttgtcttccctttgaatgagctctaagggggaagtcaggaggggaggaaagtcgctggccttgctgagtttggctgctgaaaagatgatcttcccctgctgtgaaatgggcatagtgataccttcttgtgatgtgctcatgtacatgaactcgttgtctgaaggtcatgaaaggcgactcctcttcccagttgaatctttggttttgttgctttttttctggcgactggttgctatcattttgtgttggtcttttagtctaaaacagccgtaagcaatcaactaatatattttaaaggttcatcatgattgatatatgtttttgataaggcacattcttctactgggtgctttaatatcatcagggaattgtccagcaaataactgaagacctcaaagctgattttcacctatgggactttgactacagctgtcagttgaagcagatcatacatgactggtggtcactgcgatgactggaccagagcggtggaaattaagagagtcac

SEQ ID NO: 4640 - DNA, 569 bp, Homo sapiens
  misc_feature (1)...(569): n = A,T,C or G
gatctagttttgttaagcccctcattcgttatattttattttaacttcataaggtatgacataaatattattttggctcctattttatagaaaagaaaaataaggttggtagatagtaacatcatagtaaatattatattattattcatgtaggcctaaattcacaaactatgaataataattagaggatgctggccaggcacggtggctcacgccagtaatcccagcactttggcaggctgaggtgggcagatcacgaggtcaggagatcgagaccatcttggccaacactagccatctctagtaaatatacaaaaaattagccaggcgtggtggcgggcgcctgtagtcccagctactcaagaggctgaggcaggagaatggcgtgaacccgggaggcaaaacttgtagtgagcccagatcatgccactgccctccagcctggaccacagaacaagactccantcgaattgnggnagaataaaaatgacagatgngtgagaaattgnacatgataaatcaggncttttttttttaatcttccaaatngnccgatagtttaatatgcc

SEQ ID NO: 4641 - DNA, 156 bp, Homo sapiens
ctggaattctgtgaagcacatgacctcaagtctttggataaatggaaacgcagcttatgccggaaagatggaaggctggctgtactaatatcagaaatggaagaggagagacatcactagagatcccatggatattgaaaggataataaagaagga

SEQ ID NO: 4642 - DNA, 610 bp, Homo sapiens
  misc_feature (1)...(610): n = A,T,C or G
ttttgctctaggaatgatactgccgttacgttcattctttgatctacggaactctcctacaaaaccattttacaaagaaggaaacaggcttatagatattccataatggtcacataaagcggcagagctgggaattgaatgcagtcacctgactccacagcttgcgatcttaattcttttccaatttacttgagactaccaggcaaacatacaagccctgattaagtggtgatgtggtggtctcctggaggacaaggcctatcctatcctacactttctctggggtccctggagcacaccgggcccagagcagtaaatacagcagaactgtggttttagaaacagagacctttgtgatcctctgtgtgtgcacaatcctaaattgccctctatgaaagaaagaaaatagtgatatgctanccctcagtgttnggcatcaccagcaccagcagtcagcctttttaggaaggcagctttcacaaagacctctgtgctagtttcaggagaatggaggagttggctccaggaggagagagcagccccagngctggctttgttccgctgtgggtgccgcgtctntcccacctgcggaattcaaactgncctccgg

SEQ ID NO: 4643 - DNA, 773 bp, Homo sapiens
  misc_feature (1)...(773): n = A,T,C or G
actctgtcacccaggctggagtgcagtggcaccatcttggctcactgcaacctccacctcctaggctcaagcgatcttcctatttcagcctcccaaatagctgggaccacaagcatgtaccaccatgcccagaatgaatgtgggcaggaaggatcctgaaatatctacttagctgcatttccaatgctaggtcatacatggcaatacaacttctgccttgtttgctggaacacttgcaatggagcactgttttggcagataccttgcaagcaacttaatgaatgaatggatgaatgaacatctccattttgaggttgactcaccagaacactcacacccttcaagattgatattcattcctctttgagatacgagcagatgcttccaacaactgtctacagccacgataccgtagccttggcattcttattctgtgaaagggctacacagctatgnttggggattctaatcaaggtgtctttggataaggatgatcgtcttgtggggcttcaagtttggactcttctgactaccctctagttttttctggtaatcctgtaaactgcctggcttttcaggcaaagctgttcttcctctgcgtgggtttacnagagagttaggnagactatctgctgcttccttttggggcaaaggtgggaatcatgatgatgnagcatttagcaaatgaggcaaataacaaatgcctctttgacatgcaaataaatgttaataagaataaaacgggatccggctgtttcctttagtgaggataa

SEQ ID NO: 4644 - DNA, 630 bp, Homo sapiens
catttgatattaagcccctgctaaacatcaagcttgtcatgaagaaatgaggtcagcacacaaagggaatgccccttggagaaactcagcactccatttggagctaactggaccaattcttgaccagtgaaaagataaatccagtgtaaggtgcaagcacctgcttttaacatgatgccattgtgattttagctgctgctcacaggttcccaagacatgaatctacagatgatccattttcccagatccagagctgagccctgatgaagccacacatctcacctcacggtggtgcagttctgtggggaggccgtctctgcaggatggaaccccttccctctcaagagggtctcttgcagaacaaaactgactctgggaaaagaaagtcttcagtattttgaatccactgatacacagctggagatgtcatccttgtcccacaaagctgttctgtctgatgtaaagccatgttcaggtttatgcccaaggtgaacagaagacgggcctggtgcggtggctcctgcctgtaatcccagcactgtgggaggcccatgtgggaagatgcttaccatgttcaagaccagcttgggcaccattgtgagatccttgttctacaaaaaataaaaaaga

SEQ ID NO: 4645 - DNA, 225 bp, Homo sapiens
  misc_feature (1)...(225): n = A,T,C or G
ctcctggataaagagtaagatattttgacgaatatcctatttgcacctcngctgagatacangttgtattttctggcactggtgtgtactgttaaggcttggagagtaatacagaaatgaatttagtgataaaggaaatactaaattggaattcncccactctntagattattgtaaactctggggacttgcatgaatccaataaataagtgnaataaagaacga

SEQ ID NO: 4646 - DNA, 811 bp, Homo sapiens
agtcttgctcttttgcccaggctggagtgcaggtggcacaatcatagctcactgcaaccttgagctcctggattcaagtgatcccctcacctctgcttcctgaccagggctgcagtcatttgaaggcttgactggggctggaggattttcatccaagatggctcactcacccagctgttggcaggagacctcggttctttgacttctccgtaagactgtagtctcccactgccgcccaggctggagtgcagtgacacaatctcagctgactgcaacctctgcctcctgggctcaagcgattcttctgcctcagcctcccgagcagctgggactacaggagcgtgccaccacatccggctaattttgtaattttagtagagatggggtgtcatcatattggccaggctggtcttgaactcctgacctagtgatccatccacctcggcctcccaaagtgctgggattacagacatgagccactgtgcctggtctcaaatatatttctacataattttcaaattattgtgaaaagtatatagaagtgcaatagatttttaaaaaataaatagagacaggatctcattatgtttcccaggctgatctcaaactcctgggctcaagtctgtcccagcttcccaaagtgctggaattacaggtgtgagctactgcaccagagcaaaattcagtagactttaaaatattggccctacatcctgtgactttgctaaattcccttattagttcagttttgattattttgggttgtctaggtacacaatcatgttatatatgaataaagacagatgcggcg

SEQ ID NO: 4647 - DNA, 730 bp, Homo sapiens
atatggctctcctggagacgatcctgcacttatgctatgagaagcagcttattagactagcaagttggcatatgtctgcgagtcctgggtctgaaacaaatgggggtcaagagaagcttgcatttattaagaacagaaaaatatgatgcacagaatatagatgacccttggacaagggatataattctttaaagtccacagttgtttttttcccaacacagtatttggaaaattctgagatacaggataatggaatgaacttggattccagaaaaaaaaaaaacacctgggggctgataaaagagtgagtttgcaaaattctatcaccagacagcctgctttcagatgatgtggacttcgtaacccaaggcttccttcctcctcctctgccggcaggctgattcctgcttaccaccctgtgacggtagcgacgccagcaggaaggagtcaaggaggaaatgcagtggagagaagagagcccgttagtggatctgggctaaatcccaattctaccatttatcagcagtgagactcctcacttctttgagcctcatttttctcatgtaaatggggataactattctttcctcagacctgtgagacttaagggcgataataaatgcagtcattggtacagaagtactgtagctcccccttaactgcagttttgctttctgtggtttcggttcctcaaggtcaaccatggtctgaaaatattaaatgggaaatt

SEQ ID NO: 4648 - DNA, 1110 bp, Homo sapiens
agtcagaaagttaaagttccaatgcctcttgaaaattacttttggagccaagacaagccgtgccatcacatgccgttctcagggaatattgaatcacttgtttaaatattaaaaagaagatgtaagataccatagccataagatgtttgaacaaatggagcagtaaggaagttacaggtaaaatttgtataaagaaaatttgaccttgataaggttatcgtaagagtggaagtacctaatgaagaaatagttaagaactatatgatttaaatttctgtacatcaagctatgggatttgaacttcttgcctcagtatttggagagacagattgtgtgaaaaatgtgtatttcagttatttacatattatagataaaagtattgattatatgttgatttttcacatattgcctctcagccattcccttacccttctatactctgctatgtgctacgaggcctgggagtctgtgaatagtatctccagctttcttttagctgacttcctcgtagaatctgaccatggagccattgggaaataactgatagatgagaggagggaaacagagttgggtttactgttccagggaactccagctttcttctgtaccccctagaccatcccagtgagcttttttttttgtttgagaagcagccatgcagcgtctacccctccacaggtctgagcactagcctaagtgtggctcctcctgaaatccaaacaccagccacatgtgcagctacacgaatgtgtgggaacctcactggagaataccatgagagacataaaatgtctgtaagataaagtgtctacatgtgtcacttagcagtatgatgcaacctggccaggggatttccaggagacaagaccacctcagcacagatagaattctcataaaccttgaaacaaagcttgcccttacaagaatagcttaaattacctttctaaaagaaatacctggtaactgaccctgcattaacacagatataaaaaaggaagaagaatcccgtaatctctgagaatagtcttcagacagagatctacctgactgtttttggcccataccactggcctcctcccactgtccctcttttgagaatgttgccataat

SEQ ID NO: 4649 - DNA, 547 bp, Homo sapiens
gtctcactctgtcactcaagctggagtgcaatggcacgatcttggctcactgtaactgccacttcccaggttcaagcaattcttgtgcctcagcctcccgagtagctgggactacagggtggagagccccgcgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaaaaaagtcgatcgggctt

SEQ ID NO: 4650 - DNA, 395 bp, Homo sapiens
acacgaatagtacttttgctttaatttcaaaagacttgtaaatggacagtcttcactttttcatcaatctaatcagcagaatactgagactacgaagttaacatgaacaccctccagtggctggctctgcagcacaacagaaacatttttaccctgaactcggatttcactgccgatatttctgaatgacagaaaatttggggcttatacaacagattacaatcatataaattttggtaaaattccaaactttaaaaataaaaacatctaagtcgctactttatgcctctatttgcaaaattctcatgtcaaaattttctctaccaaggtgttaagatactattttaataacagatataataataattttaattcccttttgaaaaaaaaaaaaa

SEQ ID NO: 4651 - DNA, 353 bp, Homo sapiens
ctttgttcaagagagtgagaaaggcattattctccctcaatgtgcaattttaactctccacacactggcaaagtttggcttgaaattgtatttataggccgggcgcggtggctcacgcctgtaatcccagcactttgggaggcgaggcgggcagatcacgaggtcaggagatcgagaccatcctggctaatacggtgaaaccctgtctctactcaggaggctgaggcaggagaatggcgagaatctgggaggtgcagcttgcagtgagccaagatcgtgccactgcactccagcttgggcaacagagcaagactccatctcaaaaaaaaaaataaaaataaaaataaaataat

SEQ ID NO: 4652 - DNA, 519 bp, Homo sapiens
attactcaagataatcccctccaaataaataataatagctggtcactgctgacatcatttgtactaaagctgcaaaccacacaaaagaagtcagactgcaaaagtagccctttggattcctgatgcaacacaggagacctaaggaaaaacaaaaccacgaaggctggcatgttccttctgcacaaatgggaagacattaggtgctggaaaacccccaacacatgtccaagatggtaaagcatggagcatatgtagggaccacgtagagccacgttcattcataaatccaacctccctgaacgagccggacttcctgaaggtgcctgggtgaactggaggctctcatcccatcatcctttccctcttcactctgtcccaagtgcctaccacgcacgggcagaagagggttttccagcttccatggctccttttactttccccttttgccctccctctaggatgcttccctcctcttccccactcactgtttaaactcttcactccattccttctcaaaat

SEQ ID NO: 4653 - DNA, 119 bp, Homo sapiens
acttcctggaagggtgtcaagatgaccaggagtccgtagaccacactctgagaatcactgacttggagtagaacagaagagaaacaaagtgtgaatgaatgcaaaagatttggataaat

SEQ ID NO: 4654 - DNA, 921 bp, Homo sapiens
  misc_feature (1)...(921): n = A,T,C or G
cagtggtttgaattcatctgcagacaacacatggtagattaaagtgttggacttttatctgaagtttagatacccaatttttctacccacttataggatataaacttcctagaaaatcttggctaacacttcacccagaaatgtctacaaccatcttccctttatttactgttgaaaataaagcactctatctaatacccagatgaggactgggccttgggctcctttctggaaacagaaagaatctcttggggaaatggtgccatgtcagtagtggtagctatccatgaccacaagacttatgtcttattcatccatttatatctggcacctggtgaatgacagatgctcaaaaacatatctgtgaaagaactgataaagatttgaagccaacatgactaaatggagacaaataaattactctggaactccaatttcatttatatatcctttcacatgttccttctaagatagaagcagatggtagtcaagggagacaagggtgactgggggtggtggctcaccccttgtattcccagcatttgggaaangttgaggtggcaagactgcttgggccnaggtgtttaagaccagcntgggcaacatggcaaaatcctgtcattncaaaaaacatncaaaatttagtcaagtgcctataagtcccagctactcagaggctgaggtcagcgggggatcacctgagcccaggaagtggaggctacagtgagctgtgatcacaccactgcaatccaacctgggtgacagagtgataccctgtctcaaaaagaaatgaaagaaaaaataaaagaaaaacagacagacaagggagaatgaggttctaagacctttttgggacaagatttttcaaaaggactcagtgagaccccagcaattcaatacggagtggtaacaaatctaatt

SEQ ID NO: 4655 - DNA, 749 bp, Homo sapiens
aaataacgccacatatctacaactatctgatctttgacaaacctgagaaaaacaagcaatggggaaaggattccctatttaataaatggtgctgggaaaactggctagccatacgtagaaagctgaaactggatcccttccttacaccttatacaaaaatcaattcaagatggattaaagacttaaacgttagacctaaaaccataaaaaccctagaagaaaacctaggcattactattcaggacataggcatgggcaaggacttcatgtctaaaacagcaaaagcaatggcaacaaaagacaaaattgacaaatgggatctaattaaactaaagagcttctgcgcagcaaaagaaactaccatcagagtgaacaggcaacctacaaaatgggagaaaattttcgcaaccttctcatctgacaaagggccaatatccagaatctacaatgaactcaaacaaatttacaagaaaaaaacaaacaaccccatcaaaaagtgggcgaagaacatgaacagacacttctcaaagaaaacatttatgcagctaaatatgttctttaaaaagtaataaagggaaaagcaatagctgctgcttttacttatcaaggttagactttttaaacaagatgtaatgtgctctgaaacattgatgtaggcagcacagcaaaactctcatttatggcagaattatttgacttgaacttctatctggaaaataaaaaaaatcctacaaatcaataacaaaaat

SEQ ID NO: 4656 - DNA, 326 bp, Homo sapiens
  misc_feature (1)...(326): n = A,T,C or G
atctcactctgtcaaccaggtgggagtgcagtgacataatcacggctcagggcagcctctgcctcctgggctcaagcgttcctcccacctcagcccaccaagtagctgggaccacggtttctactgagagaagagttcagagtttatgtatttgatgntacactgaaattgccaagttttatcggaaaagaataacttctttaaaggaaaatggccatcactattttaaaatcttganttatactcaagttctcttgattttatatacatatataatttttttaagcacaaggtgaaaattaagaaactgtctaacagcctataat

SEQ ID NO: 4657 - DNA, 385 bp, Homo sapiens
ctctgaccttcctgtcctagatgagggtttgtctttctctgccacaagagcatggaaggcaacaagacatggatcacagacatcaccctgctgggattccaggatttgctgtaatgtatgataagaaaggagaagcctattcaacacttggatctcagctatgggctactcagctcagaaagaagttgcattaatcaaatatgggacataccaaacaggactatttttatcattttttaataaaaagaaggaacaaatcatcatggatacttagtaatatatggaaaaccctaaatataatttaagtgtagaagccatgaaaagagttttattacttgaaacctaggagtcatattaggaaagaaaaatgaatgaaagaagaaat

SEQ ID NO: 4658 - DNA, 341 bp, Homo sapiens
attatacaatttattgaatgaaataaactgagtataccccataaacttactgtagaataatctagctatgtaactctaatacattattgacaaaatcacttccagacttagagatgtcaacaattaaaaatttaagtgtgcaggcatccatcctatcttccaacttggctggcactgatgcacaggtggtgagacattgccagggctggcaggaccactccatggtagctttttaagagaacagtttcagagcataaccagaggtcaagttcagcaaggtccttccaaatgcagccaaccagacaaagaaagacccaggatgagctagaatgccagtccag

SEQ ID NO: 4659 - DNA, 522 bp, Homo sapiens
cggcggatctttttttattttttacaaactaagttgacaacttggaaatccctttgtgcagtttataaaataatgaattctaaatgagggcctagattcaccaacagaccaagcaattatgtaaacaatttctgttccccaatatggctccctgtcattgcattttcaagtcaaatcacttgcacgaggtggaaccgtaatatatatgacacatatctttgaagcattagcgatcagacatggtgagatgccagttccccgatgttccaatgacaagaaaggtatcctgtgttatgtttccactcctgatttacactcagagaagagtcaacttttgccacctcggtcttctcacctcttggctcagttctggtttgtgttcctcacactcatccaacacctctcaatatcagtgcctaagtgaagaacttgtatgtccagggtatttcatgaccctttcttccaatgctttcttcataagcccatctgaggtctctcccacatcagccataggaggtagca

SEQ ID NO: 4660 - DNA, 539 bp, Homo sapiens
  misc_feature (1)...(539): n = A,T,C or G
agatggggtttcaccatgttggccaggatggtctccatctcctgacctcgtgatctgcccacttcggcctcccaaagtgctgggattacaggtgtgagctactgcgcccagtcattaaagctaatttttaaaatgtcatcattcactggatttactggacaatcttcagaggcatctgcgggtcggaaactgaataaactacagaggaatgacctggaccaagagccaaaggcatttaattattgaaagactgtggggagtacacacctattcttttaagtgtagaagagaattatccctcactggctttctgttttctgagcactggacctgtcaacaaagcaagtcaggaatggagctcatgatctgcttctagcagcaggacctccagaagatgtgtggctagctctccatcaccactcgcggcctctgngcccgtgtctgtgtctgtgttcttgttgcccacatatcctcctccctgctccctcacgcaagtccttggtttagcgcagaggcacacatcttcacacatcatttga

SEQ ID NO: 4661 - DNA, 728 bp, Homo sapiens
gaacctcaagctgcagtggctctcttaaacttctttctttaagttttcatgcttaaagaagcatgaaagcaaaaccagcactgaaggattgttatctgcggtctgagagaggggccagagtccaggttaggcagtagagtggttctgagcccaacccacaggtgggcattgtgcttgcagcatactgtcattggctatacggcatatctactatcctcctaggcgccacaactgcagataggggaatgtgggggatggctgcaagagggtgaaggttagcaaataatgccaccatagacagaagagtgagcttcatcttaatccggttaaattattaaaatttataatgagataaatccaaatttgtgaaatgttgccataccttcagacacagtggtagagtctctatgcaagatgtagccatttggttatagaaatggagatcctgctggtgaacacagaagtccaacaccggggaaatcacaaggttgtgcctgaccttttcctcctcattcaggacaagggcttgagggtcatcacgagatattccctggggatcatggccttcagaaatggcacataacccaaatacagttttcacaacttaaggtcatcacactaacacatgttgagcaggtatcgctggatgctcataataagcctttgacttaaggtccttctataacccctactgtacagataaggaaacgcgatgcggccgccaccgc

SEQ ID NO: 4662 - DNA, 240 bp, Homo sapiens
cggccgatctttttttattcatgaaaagacctttataagctcctgtataatgtgttaatagttttgaaacattagaaaaggaaacttggaaggaccatgttctcagagggaggagttcttaatggatggactggaagagatggatcctcatcagacggtggagtctcagaaaagagacaaaaagcaattgtgaccatttgattggaagacatggaagaactgagcatcattctgagagat

SEQ ID NO: 4663 - DNA, 363 bp, Homo sapiens
cggccgcatctttatttattttataaccacatcacatctgtgtgcaccgtaattggaaaacaaatcaataactgaaatataatattcatgaaaagacctttataagctcctgtataatgtgttaatagttttgaaacattagaaaaggaaacttggaaggaccatgttctcagagggaggagttcttaatggatggactggaagagatggatcctcatcagacggtggagtctctgtttggagagaccagttcacaatcatgtgtcacagcaatagactttagatggccagaaaagagacaaaaagcaattgtgaccatttgattggaagacatggaagaactgagcatcattctgagagatt

SEQ ID NO: 4664 - DNA, 511 bp, Homo sapiens
  misc_feature (1)...(511): n = A,T,C or G
caaatgcaccatagattatctcaagagaattccgagccacaccatctggagaaaatattggagaaaagttaaaaaaagatgagtggaagacagaagatgcacttagttgtgaagtggacacatacactttcattcaaaccaccttgcatcaagtaacaatcatgggtcaagttcatgactctgcagagaactggatgagctgggagacagacaaacagagacagggatgtgattcatgttatacgaacaagccggaagtcagtgtgtgagattttttttgtgtagtgatgaagtggttgcttactttggaacaaagtctgttttcagaaatatgaagcattactgatatttcaaaaacactgaaatgccttcagctcaactgtgactttttcttcagagatttgagattttcaantactatctttcctgctcanaaaccaaactctaactgttctgaggacanacctaccccaataatttagaccttaattatagtgaataatttttaaat

SEQ ID NO: 4665 - DNA, 528 bp, Homo sapiens
  misc_feature (1)...(528): n = A,T,C or G
attttctcaatctctcaaggggctctgatttctgccagtagctaaaggaaagagtatcatgctattctctctgaaaaactgtctgttttaataagagntagtgtgncttgaaacaattaantgttaagtgtgtgntggtatgcctaagccacagattatcggaagaattntttgctaagatggggacaagggtttcctggtataccntagcttagtccatagaaagacatncgtacgatgttaataaaatggggtccantnnnaccttnnattggcctcaggaacagntatgtgtaaaatcaatttggcctgagctgagtcncactgtgaggcattttggactaccccatttggattaacctaacactttgacgtcttaacacggagggcgtcctcatatggactttttatttcctatgtgactcactaaaatgttgtcantcatataaaggctcanggtgttngtatcncnnatgcacaactttttnnatagccctaggaatctttncancnagatcaaggaaaaat

SEQ ID NO: 4666 - DNA, 617 bp, Homo sapiens
  misc_feature (1)...(617): n = A,T,C or G
cgtggtggctcacacctgttatcctgacaccttgggaggaagaggcaggaggattgtttgagcccagcagttcaagaccagcctggacaacacagcaagaccctcatctctacagaaataaaaacttttcaagtatccagtcatggtggtgtgctcctatactttcagctactcaggaagctgaggcatgtggatcacttaagagcccaggatccaagagtgcaatgagctacgattccaacactgcactccaggctggtgaaatataccacaacagtgatggcagcagcagcctgcctggagtgggcactgtgaagatgccagctgcagtgggaaaggcacagctggggctgtacgctccacggagccggcaggtgtcagctggagccaggaacaggcctgcccatggaccaatcagtatgcacttcctcccctctgaagcccataaaagccctggactcagccagactccggcagacatggggatgacctgcctgtgtaggggagctacccnctgtggatctcctctcagctgagagctgagtagatgtccggacgacctgcctgtggaaagcagctacccacttcagtctcttgagagctgtacntgtcactca

SEQ ID NO: 4667 - DNA, 299 bp, Homo sapiens
acattggggtcattccccaaacaagtatctcatctgatgaaatcaggaaggtgcttctggtgtcaaagggaagtgtctcatctccagggagggactccaactttttggccgggggagcaagaacatctgtttcagtcgtgatccgtcctgttggctgagctgtcggtgggggtgtttgggatgcagccctggaccttcatcggaagacactgctgtggtcatcaaaggatatttgccatggaatccaggacacacccatagggaataaatacacagttataaaaaattattccgattag

SEQ ID NO: 4668 - DNA, 402 bp, Homo sapiens
attatcttaaagttttataggtcataagtccaacacgggtctcacggggttaaaatcaaggtgcaaatctttctggagtctctagaggagaattagttttcttgtcttttccagtttcagaggctgcccattttgtttggcttttggccttcattgaaaacagcaatgctgtgtcacactgagtcttttttcatgctcacaaccaggaaccttctcagtttttattgaatcatgtgattattattgtatcttcctgaagagatctttgctttgttattcgagtattccacatggggtattttgccaaaataggcagaaatgaagttccttcttgagttctggaggtactgtctcaggaagtcagatttgctccattaactccaatacagaaaggaagctatg

SEQ ID NO: 4669 - DNA, 484 bp, Homo sapiens
aggcagccaaggtgggcacaggaaaaaggactcaccaaaggtcacgcatcaggaagcagctgagccatcaagtcccagggtggggcatgacccctttctgtcgtgaaagctgctgaggaacccagcttgggaactgactggatgagccccagagactcaagaggagacagaccctctgtccttgactaggaagcacagctggctccaacaggtggaggccccagctcagcagatggtgccaaactccacccagccccctgaggccagaaagcatccttgtcatctccttcttccagctccatacctggtccatcaccatgtcttgttagggagacctcccagcatcacttacaccttcccacctcttgccaccctggctgggcccactctagggccaggcaccttatcttttgcctgaacaacctcggcagcctcctccatggtcttcctgcctccatttttgcccccttagaataaaacatat

SEQ ID NO: 4670 - DNA, 486 bp, Homo sapiens
aatggggaagatatatacttctgggatgtgcaaccggatatgcccactgaggtggaatctgagcactccttgctttccccaacaaggtgggaatccacctgttgtacacaacaatgccattgtaaaaaacactcagatcatttgcaatatctttttgacatcttctctactaagttataaattccatgatgacaggggaggcagctggcttttttactatatattcattttaaatactgtgcctggaagagagtaggtacttacaaattatcttctgatcattgcctttataaataagagggagaacaattcagacagccattctcctcaacatgataagggagctctcacattaaaatcccaggtctaggaagagaagacacctctcctttgaagcagtctataagtcatactgtagagaattgtttcccacaaattgctttctgtaacacttagttccatttcagaactctgaaaaaaatcaga

SEQ ID NO: 4671 - DNA, 358 bp, Homo sapiens
  misc_feature (1)...(358): n = A,T,C or G
gtctaaaagaaggagctgctccagaggaccgaacataaagtcagcaagctcatcttanaaaccccgggtggaaggaaattagaatcctgaaagttattttggggtcaagaagtccagtttggatctgtcagaggtggaaacaggccccagtgggcctctctcagctgtatctttggaaaaattgatgtctgcattttaattctctccaacatgtcattaaccccacagacacccttccactgagacaagacccatgatgagggttgtaggaagagaaagaactttctctaagggttctgtcctttactcagtaaaaaggatctattagaggctgncaacaataataggannggcgtac

SEQ ID NO: 4672 - DNA, 516 bp, Homo sapiens
  misc_feature (1)...(516): n = A,T,C or G
accccgctacagagtcaagaaaacttttaagctatttacagcttgtagcaattgaataaaatatatccctgtgaacaaaatttggaacatacctgatttctccaaaatttggaagctatttgaatcaaatttgacttgtaaagtcaataaaagccccttgggaaaactggcctcatatcttgtctacacagtccatttgcagggttcctgacctgtggaacactcactggtaagggaagaatgcctcaagtgagcatgtgcccaacttcagtacacacactgagcatgctccctcccaagtgctgtcatcccactgtgcatgcagacagcccaccccaagggaagaatcatggggagaaataatgcaaaacccgcngaagccgtgccaacatacaaaatcccaagtcagaggttgagccgtgcacttgactctctcaagttgcctgcttggccctcttccaagagtactttacttcctttcattcctgctgngnaaattttttaataaacactggt

SEQ ID NO: 4673 - DNA, 502 bp, Homo sapiens
acagggtcttgctctgtagcacaggctggagtgcagtggtgcgatcatggcttaccttgaactcctgggctcaagtgatcctcccacctcacccttctgagtagctgggattacagagtctctgtcatccaggctggagtgcagcggtgtgatcatggctcactgctgcagcctcgacctcccaggctcaagtgatccttccatctcagcctcctgagtagctgggaccacagatgaagtcttgctatgttgcctgggctcaagcaatcctcccaccttggtctcccaaagcattgagattacaggcatgagccacgacgcccaaccagaatactctatgttctatatcgctagtctgtacaggtctcagtctttgctcacagacttttagttgttgaggttaaggactgctttaattatttctgtgtctcttacccccagcatcatacctgggctttgcatccagcatgctcaggaaatgattgaataaaataaaaccgga

SEQ ID NO: 4674 - DNA, 561 bp, Homo sapiens
cgctccaattaaacagaaaggacgagacagccttcatttcgggtccgcgcaaaataatgagccaacacagcagcagaaggtttcaatttttgacaccaatcattgtgatgtttgagaatgtccccgtgactgcaggatctccatgagagaagcactctcagatacactcgactctacctctagaagacactagaatggtggagtagaaagcgcaccctccccaaccctccctccccctctgcctccaacaagcaccgagggaaaagccagcactgccactgtgaaggagatgcaagaaaatgaagaaatcaacccgacaaaatgtaagcggccggcacgtcttcattctcaccactaatgatggggagaacagtatggcagttcttctcaaagtcaaatacaattacctttccaagcaaccactcagctcctaaggatatactccaaagaggtgaaaatggcaactcaagcaaatccctgtacacgcacgttcatagctgcatggttccctgtagccaaaagatggacacaaacgcccatcaacagatgaataaatccggt

SEQ ID NO: 4675 - DNA, 164 bp, Homo sapiens
cttccctgaagagagagatatccttgaaagctgcccaaatcaagaagaggaaaccacagttctgtagctcaatgagacataacatgatgctcaggacagccacagtgtttggcaaatgctctactggtgtcgcacttcccaaatgttcacacataacctataat

SEQ ID NO: 4676 - DNA, 514 bp, Homo sapiens
  misc_feature (1)...(514): n = A,T,C or G
gcgatacagccctccttcctgactgccagccccgatgaccaacagcgacccnntgcccacaccagacaattctctggaaactcagagaggcggtagccacaaagaggcaacaaggttctacggaatcaaggttctacagaatcaaggttcaaggtgacggcagagatggagtctttgctatgttggccaagctgatctcaaacttcaagcctcaaaggatcctcccgtctcagcttcccaaagtgatgggattacaggtgtgagctactacaggagcctattgttgtattttttaaaaattgtttttaatttttattctaaaatctttattatcacctcttagaatgtgtagcatattgttgtatttttaacctgtgatcttaaatgcttcttatgccttattgtttgggctggtgtgcgaactcttaacttgctgagtgtgaagttctggtattgataatattgtaatacgtgtttgcctacttataaaantcagngaaataaatcgagatcg

SEQ ID NO: 4677 - DNA, 392 bp, Homo sapiens
  misc_feature (1)...(392): n = A,T,C or G
accacctctacagccgcatcacctggacccccgggacctcgggctgctagtccagtccaacgggagacacaggcagcagacgaccaagtgccgcatccaagactgggcctcatgcgaacggccctccctgggctccgcacactttgtcccctccatgccaggccagccctggggagcagaaccctttccagtgctctctgggtgcctcagtttctcgtgtctgttccctaaactcacccgtccctctgtaaatgggccctgtatttgtgttctgtctcgggccggacctcacctggggcagtgaaggcagaaggaagagggctcctcagacctgagttccactcaacagaccatgttctcactgcttcattcaaataacccgatcggngtta

SEQ ID NO: 4678 - DNA, 513 bp, Homo sapiens
cattattagaatcaccagagacttgagctcacaagacagaccaccacctcgaaatctgaagagacagatgaatacaagtaactgcagctgaaacttttgtaccagaaacgaaagctcttgaagatgtatactgataagatggttaaatgtgaattttaataaattctttgaggttgagtgtagattagcttgagagtaaaaatcctgctaggccagtcttagttttccccacactttgatgagttttaacttcaggatccccagtggtttctcacaatgaaaccttttccccacccctccagggcttgtctgtggacggtgacagggtttgaggagtggtggggaccactgaggcaggtgtcagagggcagtctggtggttcttattctaggaatgagtcggggctggatggcagtggctgcacctgtggccagtcagctgctgctgtccataccacagccctctccctcatgatgggaagggaatggtcaggctggctgctgccattttgtc

SEQ ID NO: 4679 - DNA, 298 bp, Homo sapiens
gaaattacaccaccattctacatatttcagttttgataatggtctgcttgaagaaaaggaaagagaaaaaaaggagactccaaaatctttttcttgtcaaagagacacaccaagaagattgtcactgctcctgtttctttccaaagtcattgattgcccttgaccttaatacagcctcacattaagatctatggagatgaacagactgtattagaaactaatctactttcagaattctagtgtcttctcagaccctgtattgaagatctgggatcaaacctcaccaccattttcagct

SEQ ID NO: 4680 - DNA, 526 bp, Homo sapiens
  misc_feature (1)...(526): n = A,T,C or G
aggaaaaaaagtatcaacagcaacttaagcccactggatggatttaaggttctcctacattcccaacacgtctatcataaagacgccaatgaaaggttataacccagatggaaacaagactccaaatgccagtaaaccaaagacaacttgagatcagagacggggttttaccatgctgctgcacactggtcttgaactcctgggctctagtgatccacctgctcagcttcccaaagtaatgggaatacaggtatacatgtgccatggtggtttgctgcacctatcaacctgtcatctaagttgtcacatgccaatttcaagatttaagataggagttcaccaggagcttagttgccattctgagaatctgagcgacttcanatgaaaanaagttttatgaaacatttntncaaaatttnttggntaaggngttatacatanaaaactacacatatgtctattgattttgtttttgaattganaaaacccnaagcaaagcnccaaaaaaaaaaaaaaaaaaaaaaaa

SEQ ID NO: 4681 - DNA, 341 bp, Homo sapiens
agtttccctgaacaagctctctttgcctgctgccatccatgtaagacgtgacttattcctccttgccttccgccatgattgtgaggcctccccagccattcagaactgtgagggttccagactccagagtctccctttacctagttcttgggagtctagtgcagctgaagacgaggtactgcggatgaagaggaagacgaggtactgcggatgaagagaaacccagatgatccaggcacattttatagacaaggcctcaacgaccccaaaggaacctttgaaatcacccttttcctgggttcacgacgacttgtaaacgataccatccatccctgcttatt

SEQ ID NO: 4682 - DNA, 578 bp, Homo sapiens
  misc_feature (1)...(578): n = A,T,C or G
gaaacaatttttttgtagaatctacaaatgcacatttctgagccaattgagacctatagtgaaaaaccgaatatcccgcaataaatactagaaacgagctatctatgaaatgtgtcatgaacgtggattcatctcaaagaatggaacttgttttgtgattcaccaaattggaaccactctttctgtagaatctacaagaaacatttctgagttcattgaagcctatagtgaaaaacagaatatctcaagataaaatgtaaaaacaagctattacaattattcataatgtgtggatttatcttacagaatggaacctgtgtttcaatttatcaggttggaaacactctttttgtagaatccaagaagggacatttccgagccctgtgaagtatatagtggaaaacagaataccccacgataaaactagagacaagctgtctgtgaaaatgatttgtgatatatggattcatcacacagagttaaacctgtgttttgatttatccggttggaaatactcttattgtagaatctaagagggaaaatttttagcctatttaagttncattgctaatgtccac

SEQ ID NO: 4683 - DNA, 880 bp, Homo sapiens
  misc_feature (1)...(880): n = A,T,C or G
tggccgatcatgctttatttttattacactaaaattagaaacaaaatgtttatcaacaagtggatgcataagcaaattgtggcatatccatacaatgaaataatatttagcaatctgaaaggtggatgtgcaataacatggacacacttcacattgattaagctgaatgaaaaatgctaggaaaaaagcccttactgtatgattttaatttatataaaactccagaaaatgcaaaaaaatctatgatgatagcagatcaatgataatgaggggataaagaagagtggtgggaaggagggatttcaaggaaagtgtggaaactttggggtatgatagatatattcatttatttgattatggtgatgattttatggctgtatacataggtcaaagcttataaaattgtgtactttagacatgtagtcttttatggtatttattattctatgataaaactgttaaaattaacccatattacgttggtgcaaaagtaattgcagttttggactggtgaattttaaatcattataactaggctcaaacacccctttattaatcaaaatcaaaatagggagccatttacaatcacacatttttgccaacaagaaattaatttctttatcgcgggtagggtaaaaatctgtgccttatgattccacgaatactcagaaaagcttttcttggatcctgctcttttgggaagtgtttgctcctgataaaagcgctgaaaatgctcgaacaagtgcgatattttccgccttaggtttntttgatttgccaaataatggaaatctcgtggggccctcctagacctgtttaagattgcgtcctaactcgcgacaggcttcttcacactgtgccttttgttgccaattcccct

SEQ ID NO: 4684 - DNA, 540 bp, Homo sapiens
aggtgatcttcaaggcctactctctcacttccttcaggactctgctcctaatactgaacttggacacaagaggaagaagtaaacaataaaacagcatactagcaaatacataatttcaaatttgaataagtgcatgaaggaaatatattatgacaagagtgttcagtgagaaaacaccaaaaaattcttggttctaaaaggttagcttttggataaagttaatattcaagataatgtaataaaatcttacgtttttgaaaccagtttcttttcaagaaattttctatattttgaggtactcaacatgcaagttatgtagtttttccttaaataaatacattagttaaagtactatttatactaaagtattatactaaagtattagctatgatttttaatctccacctccacctaaatcccaccatactatagatagcaaaatacaaaatgagtgtaagaactaggaataggattgtgcaacctttagcatcataaattcaatattttgttttctaataataaagctaatttcttaaattt

SEQ ID NO: 4685 - DNA, 596 bp, Homo sapiens
attccataggtgtttgccctaggaaacatcacggcagcataatacggaagcctcagacgaatactgctattgggcatctaaaggtcacaaggggatgcgatactacaagtggctatggactggtcttttccctccttgttcttgttctctgaccacagtttttcctggaagccactctgtcttccctcttagcctgcaagttttgagtctggagccctgggctccagagctggaggctttccccaagctaagctatcagcacctgccaacctggccagtctcaaccaagaggacttagccaaagactttttttgagcttttgttggcctctccttccggcactggactgtgtgtggtggatctgggaatcccaagttgcaagaatcactgcagggagcctgagaatgaagtcaactcaaagaaagtgaagaaaagaggggatatcacctgagtcctgaagaaagctgtatctgaagtcacgacatcgtgtggacttttacatgagtagaaaatacttttttgtttaaactaattggagatgttcttcccccatttgcaataaaaatcgatcggccgccaccgcggggagtctggcc

SEQ ID NO: 4686 - DNA, 435 bp, Homo sapiens
cccgatattcactcgtctgtctttgtttccccttattcacgaagactccttttggtctacagcttcggtaacatgtttggcaagagcaagggacttctctaaacagccctacattgttagtgctgctgaaaatgggtaggcatacatcctcagattcagcaatcacagaaaattctaggataatgaaaataaaccactggagatctgatgttaaaacaacagaatgccaaagaaaaagagaagatcctgtaggtagacagtgagaaaaagcagtttatttaccaaggagtgttaattaagcagagagctgacttcccaactgtaatgacagcagtgaaatcccttcaaaaagtggacagaaaatatctgtcagcttggaattgtatatccaacaaaaacacttttgaaaaattggggcgaaataataaagccaga

SEQ ID NO: 4687 - DNA, 588 bp, Homo sapiens
atgtattttgtgtcatgacttctcaaaagaagacagaagagtatccttttgcagatatatttgatgaagatgaaactgaaaggaatttttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaaagaaagatgcgcc

SEQ ID NO: 4688 - DNA, 715 bp, Homo sapiens
gtaggcagttcctgacctcatggagctgaccttccagacacatgagatgtcagattgtgaaacaagaaacagaaaaaataagcagaagagaaagtcggggaagggaaaataaggcagcgatgtccacacctgagggccacagaaatggaaagaggaatcttggcactagcagcatttttcctgagcacaccttgtacttttgcaagaaagggttggctttctggaagaatgatatcatgaagaccagactaccagcaggggaaaaaatcaacaaaaactgtgattccatagtgcttcttgctttttacaggaaagcacctgttcatcaatcaaagttctggctgttcaaaggctgtgaggggctgcagagaccacccctcagcctgcctagcaatgacccctcaggactcacttattgagtaatcaaataccatccttcttgctttctccgtgaatactcgctgagaccagtgagtacgtaagattctgatactgttttgaggaattcatccgtacacaggtgccatcaactgggagttaaatgtcagtgattaatcccagctgggcaggtacattgctggaagtgtcatggcctgtgccagccagggttgcagctgaacctcatgacaacccacgagggaatatttagcatctcatatgatcacaccacttggataacacaacaaggccagtcttttaaataaataaataaaga

SEQ ID NO: 4689 - DNA, 552 bp, Homo sapiens
atagcaacggttcaaactcctagtgagagttaggattccatggaagtgcttcggggacaattttggagtggagtcggtgcaggaaagcagaaagaaggagcaccaggacacttcactttaatacaaagacggggtttcaccgtgttagccaggatggtcttcatctcctgacatcgtgatccgcctgccttggcctcccaaagtgttgggattgcaggcgtgagccatcgcgcccggccaagggcaccaacttttgagactgcacaaagcaacaaatccctgggcatggcacaggaaaccttttctctcctaggcctctgagcctgtgatgagacgagctgatgtgaagacctctgacatgcctgggagacattttctccattatcttggcaattaacatttggctcctcattacttatgcaaattcctgaaacctgcttgaatttctcctcagaaaatgggtgtttctttcctagcacatcatcagggctgcaaattttctgaacttttatgttctgcttccctttaaaacataagttccaattccaaata

SEQ ID NO: 4690 - DNA, 598 bp, Homo sapiens
attatttttgtgtcatgacttctcatgagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattctagaagaacagattgctgctgaaaccgaatcaggagttatgttgcaatcaatgttgatcagcggtcaaagcattccagatgaacttgtcataaagctaatgttggagaagctcaactccccagaagtctgtcactttggtatgtttattttaatatatttacagcccacaaagcagccttaaaactcatgctttatctgaggcaaaaatagtttctggagttgccctttcttttgcctaagcataagaatctcattatctctattcagttgaacagctcagatggttttatttgcttgtttttatttctcagattgtacatttgttttaaaaataagtttatatgacccaatcttctttaacattgtgttatccaaaaagccagatgcgcc

SEQ ID NO: 4691 - DNA, 591 bp, Homo sapiens
cgaggggaaatggaaagaagtcaggatccagaacagtaaggtctgcagatgtctgggcagtttgctggaacacaactggggttatatctgcaaatgctagagcccatctacacacagcaaaatatctcacaatgaattcccatccacagcctcagcaatgggctggtgtgtccccagagaatgtcagctgattggacagcagtctgcaggagaaggtgaatcccctaatttggaaggaactgaagcatgaaaagatgctgagatcacaatgaaaacagacaaagtcttctggggatgaaatgttaaaaaggggagatgtgcaaggaacacagttaggaagaataagttcaggagatctgttatacaacatggggatgatagttaataacaatgcatggtacatttggggattgctaaaggaacaccttgtaaagatttccacccttcctcttgaatgataagtatgaaatgtgacggatatatttcttagcttgatgtagctgttccaccgtgtgtgcatatatcaaaacatcacgttgtatcccataaagtgtatatcgtttaaatttgttaattaaaataataaataat

SEQ ID NO: 4692 - DNA, 701 bp, Homo sapiens
  misc_feature (1)...(701): n = A,T,C or G
catgattctaatttcttctaacaaatcccattcttgcccttggcgacctgtaagttggcactaaagagttgcctgttgtatcaaccaggacactttctgttacaaataacagaagatctcatcaaaattggcttataaaagataaaatagaatttactggttctcatttttaagtaattcntggtggtagacatagcttcaggcatgatgatacaattgctcaagggatgttatgtgtatcttgttcatttctctgatgttgctattgactgcactgtgcccactgaaaattcagatgttgaagcccaaacccccaatgtgaccatctttggagaaagggcttttaagatggttaaatgagatcataaggatgtggtcctaatccgacaggacttaggacctgagaagtttagagaattaaggagacttaatttagattaagttaaccaggctaaaagaaaggcacacacaaaaagcagagaagggagaaatatgtgtggaagagcatgatgcatttgaggactcctaaggatatcgacaggattggtatccttacaagaagaaagagtgagctttcacagaggaaggccacatgaggacacagtcagaagcctgtaagccagtaagagcgtcttcgtcagaacagcaccctgcatgacaccctgatctctcgacttccagcctccagaactgtaagaaaa

SEQ ID NO: 4693 - DNA, 491 bp, Homo sapiens
atgtgggttgtatgccgctccacgtgccgtcagcttggcagactcttctggaggatcccacgagtataaatggagatttgcactggaagaagacttcggacttataggtgaaacttttcccactaagtcgcccttctgcggggatgccagggtctccgcagaacacagctatggaagataaccaggaagaagtcagccttcaacgtccctggatcagcttcaccaattgagcttggagaggatggcggagtgagagagctggtaaccgtccatgcagctgtaacttatgctggagccccagcggaaatcacttccctccactgttccattctgcaccggcggcggctgaggacacagcacggctatttccaaagaacaaacaagatcaacattccggagctcccgctgcagcggtgatgttcaaacgattcccattttaattttacctgaattacaaatgacatctacataggttttttaaaaaaaataat

SEQ ID NO: 4694 - DNA, 655 bp, Homo sapiens
agcttgccatgcgtgtgagacatcctacagagagaccatatggtgaggaactgaggcctctagccaacagccagtgaggagctgaggcctgccaaaacccatgtgaatgagcttggaaaaggattttccagccttagtcaagccttgagatgactgtagtcctggccaacagcctgacgacaacttcacaagagacactaagccaaaccacccagcaaagctgcttccagattcctgacccttagaaactatttgagatagtgaatttttattgttttaagctgctaaattgggaagaaatttgtcaggcaccagtagataactactgcaaggaaattatcttcttttcataattttctaagttaatttcatcaaaagttatttttaatttcttgttttttaccatttccccattttatcatttcatttaatatctcttttagaatgagtctataattttaatggactgttcaccttctctgtcatgatgacattcactttcatctatatgtatttgctacatggatatcagtttggtccctcaagctaggtagcttatctcttgaggaccagtaccttctagtgtgcacccatactcctggagttctaaggaatataataaatcttgatcggccgccaccgcgggagtcgcgcc

SEQ ID NO: 4695 - DNA, 650 bp, Homo sapiens
attcatcaccgccttctgctagctatgcaatgctctccatcctacaggactcacatccagggtgacgagctgcagatcaaggtggattaaacagagctggaggcaggggttccattgaatagaaacacagaagcagagctgcctgggagactgcatgcagggaaatgatggcaggagctctctccatgggaggttatagcagctcttgatgggggaaaatgggaatctgtgagttcttagaagctgaagaaaaaagatcctggaactttaccatagggcagaggatgatggaagacgtaggatccgacgttggttctgccctttggaatttgtacgtaggctttagcttttcccaacaataagcacggcaatctgcaatttcttcacatctgagtggcagtgacttcactcataggtagtatcaaatggcctgcaaccagtggcatttgtttattctgccaaggtattatgccaacactgcctggaatctatgctcattatggaggaggcagagcaagatagccagatagaaccctccagcgatcatccccctggaggactatcaaattgaactattcacctaagaaagcaccttcataagaatctacatcaggccataaaaaagcattggttaaataatatcgatgcgc

SEQ ID NO: 4696 - DNA, 573 bp, Homo sapiens
cctgaaatggacagctaaggatagctgtagtgcagcggggtgagacagctttgcaagcacctcaaacacagagtgcaggctgacagtaggtgagagaaggatttccgtctgggaggcggcctaggaatgagcagcaagggctccttctaggacatgagaagaggcaaagctgctgcttgatcaccctccaaagacgatccttcttgtccaatgctgccaacttcagggaagcagaagaaaaggggaacagattgcctgggcatgcaaggtggctggaagccaggcctgccaagcacccaggccaccaggggctcctgaggacagcatctgactgccccatgtttcaaatgctgtgggtgacatgcgagggggctgagcagcccaggggagatggcagggccactgagctggcaggcagcccctctttggtcaggaggggccctgacacttccatgtccccaggtttgtgagacaactggaagacggattcctgtgtgatcggggcacttgtccaaatctctctggacctcagcttcctcggctgtagaatgagaataataaaaactgatgcgc

SEQ ID NO: 4697 - DNA, 510 bp, Homo sapiens
atgctgtgcttctagaacatgttctgtcttcagaatctggttggcatcaatgctgagatctaaaccacaagctgtgcttctagaagcatgttctgtcttcagaatctggttggcatcaatgctgagatctaaaccacaagcatgaggccctcaccagactccaccagaagtggccacccaatattgaacttcccagccttcagaattggggatcccaccagtccctttctatgggggagaacttggagtggttctgctgtcagtttacacagtgagatcttacaccatatgtaactctcaaggctggagagatgatatgccgccaacatggttgggaaacatggagaagcagaaagctcgtagctggactaccctacaaggagatgtggcttctgtgaaattgtaaaatgctgcacactactgctcttcctccctggttattctccttctgaaccctcatatattattttaaaaattttaaacaaataaacaagcaaaacacaaggaaaa

SEQ ID NO: 4698 - DNA, 475 bp, Homo sapiens
catggtctgcacacctcattcctctttgtcgtgagacaagaactcagaacttgctgaaatgcagaagtgaaagagcagtatcactccatcctgctgaactacgggagtgaagaagccacagtaggactttactagaagtgaggattggagaacagaatctttccaaaagttttgaagaagcttccatgttgtgagagagcatacggagggggccacgtgacaaggaactgtagtggccactgagtactgagagtgctgagtgctgaacatagaacctcagggcaacagttgcaaagacatgaattccaccaacaacatgaaggccttggaaatggattattctctagtccaggctctgatcaccacagccccagccaacacctgaatttgagccttgtgagaccctggagtagagaacttagctaggatatgcctgacttctgccctacagaaacaaagacataataaaccgaga

SEQ ID NO: 4699 - DNA, 314 bp, Homo sapiens
gtcttgctctgtcgcccagactggagtgcagtggcacgatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataaacctgga

SEQ ID NO: 4700 - DNA, 410 bp, Homo sapiens
gcggtggcggccgatcaggatttattttgcatagtgtctcagggctgcggggaacagaggtttctgcccattcttgatgttaatctgtccctaggcctggcctggaaggatagcctgctctcgccagtttccagtgctgggatagggtcagagggcctggttccacttctccatcctatcccgtcttgggtcccctgggaggtcctggctggggctgctgctgaacaccgaccagtcctcaaatactgctgggaatggtagagcttcacctggacatgattctttctgggcctccacttcattcccactgaatctgaggccctggttcgtggatttggaaccaaggataaaaagagatatatgacatagtcccagcattcgatagcatctcaatctggtgagagattcag

SEQ ID NO: 4701 - DNA, 321 bp, Homo sapiens
  misc_feature (1)...(321): n = A,T,C or G
ctgcttgtggctgnccaggaaaattacaattaggaagcagacactctagcgggccccacaagaatacaagatgacagaaaaaaaaatcaagactacaatgaaccaaacatctgcataattttagctactatgcaaacaatagggctgcagtgttttgtgcatacagaaaagacacagactcctgccaaaaatgagaaaagatgctgaatttatcaaaagtgggaggcctgcttcaaggatttgttacattatgctaatagcactgcaaaaagtttaacttccttttaaattgtgcttgcctccacctctaataaagctcga

SEQ ID NO: 4702 - DNA, 617 bp, Homo sapiens
  misc_feature (1)...(617): n = A,T,C or G
gtgatgatcccattttgaggttagcatggccaacaacggatgtgaagtgcatcgttttgatcctagtgtcaagtcagctcacattctggagagtcagcacctttggtatcaccgcttgtccattgactggcgggatccccatccagctgttgctgcccaaaaaccacatagcaacaccagaaaactgggaagcattttgaatgaatttggacatcacaagattgacgttctcaaggcagatctggaaagtgcagaatggaaagttttggaaaatcttattctggaagatgttcttgagcagattggacagctcatctttgagatccatctccactggcctgggtttgaggaaggaaatctgtcctggatatgacaaaaaggctgcaataaggaaaaggagccagatggtaaccacctaagtccagtaacaatgtgatcttgagactttttatgctgaaatataaccccactcatttatgtactctaaaatgttgtgtagtcatgacttagtgccaccactaaatgaatatggaatgtgttaatgtgctctgagggtaccngccatgtattttattatataattataaaccccactgatatacctgaataaaccagga

SEQ ID NO: 4703 - DNA, 577 bp, Homo sapiens
cttttgctgaagaagccttcattccggtctaggtggtggaggagagtcactgggcaggagaggggatcagcagacaaggtggggaagagaagaaagtgtgctgctgatgggaaaagttttatgtgtgatgagttgctgtggtcgttcctctggttcttcagtcagcaaaactacaagtttccaccagagttttagccactccacaggaggccagactaaagcctacacctagtcaaagagccataaaatcataaaatcagaaaattctcccaatgccattcccctctgccaaatgttgccctgcattctagtttctatgtttgaggtcattcttaagtgcttttaggttacttttttttctggtattaattatgtccagaatcagtagttgttatttgtaaaagatttggcccaattggacctactctgctattactggaagcaaaaccttgctactgctttttaatactaggatcaatgtccactgaccctgttattattacactttggttgtctacaaacatttttaaaactttaaaaagaaaattctacaatctatgtgttcaataaaacacga

SEQ ID NO: 4704 - DNA, 367 bp, Homo sapiens
ttatggcagataccgctgattgtccacccaatatctactctttcctcttccctgcggacagaccctgattttgttaaggatagcaatgtgcccaacttaaatcttctcagcctcccctgcacccaaactggccacatgacacagttctggccaatgagatgtaaacgctggaagtgggatcatatgctataggtcatgggtgtcttgtaaccagaaggtgatgagcatgaggacacaagccacaaggtcaggctgggcatgcagacacagaaggaagcagaacttttggtggcacagcggagccatcactccagtcctaggctgcctgcttctattctccttgttacctaagaaaaataaaacccga

SEQ ID NO: 4705 - DNA, 679 bp, Homo sapiens
  misc_feature (1)...(679): n = A,T,C or G
ctgacaatgagcaatgttcatcagagaccttcccagaggcagagagcacgcgcctcaccatgcttctccaacacgcccacagtgatctgcttgtttgggacctgttgccccttctgcagctggtgcaaggagtctttccttaagaaatgcccttgtgcccaggagagagtaggctctggaaactgctgtaacagttgtacagagaagacaatgccagctgcgtgcgtctcgtggtctttcttcatcctttaactcatctgtgtctttattaaaatgactctctgggctgggcatggtgacgcacgcctgtcgtcccagcagttctggaggctgaggcagaggatccacttgagcccaggaatttgagaccaggctgggcaacacagtgagatgtcatctctacaaaatataaacaattggccagttgtggtggcgcacacttgctactcagaaggctgaagtgggaggattgctggagcctggcagattgaagctgcagtgagccgtgattgggccactgcactccagcctgggtgacaacagtnagatcctctctcttgaaataacagtgcctttgtagtagncagcatatactttggtcttaattttctatccagcttgaaaatctttggcatttaactggagtgttgtntatgtcattgttaccaataaactgcga

SEQ ID NO: 4706 - DNA, 659 bp, Homo sapiens
  misc_feature (1)...(659): n = A,T,C or G
agatagttgagtgtgttcctggtcatcagaagagtggagtcttttccatgccgttcatcagtccaggatcccagactgacatggattcctctatcttcagctcccggtttccagcgtcacccaggaaaccacatgcagcctttaggatggaatgtggagccccctgcatggaggttttcatggcgcaggcctgggagaagcacagaccactctgcagtagtccattcccaagaaccggtgcacatgttggaggcgaggtgaaaggcagctgagaaatgtgcagggctcagtgtcccgggggcagccacctccgcaggacaggtgtgggagggggagtgcgtcattgcctccaactgggttctcttctccaccacatggcacagagtgggcactcagcacattgcttaatgaatgaaacccacttcatttcagtgtcgtgaccctgagagagtttcttaaatattttcacatgctgaagcaactgcaattctaaangtcatttgtggaatactatatttattgatgtaatttttcattaaaattatgttacaatcataaatataaacaggtttttaatttttaattttattttttctaaaaaactgattaaagttaatacattaaaaccaaaaaaaaaaatcgggctcgttggccctaag

SEQ ID NO: 4707 - DNA, 624 bp, Homo sapiens
  misc_feature (1)...(624): n = A,T,C or G
tttttttattttttgtagagacggggtctcactattgcccaggctagtctcaaactcctgggctcaagcaatcctcccgcctcggcctcccacaatgctgggactgcaggtgtgagccaccttgcctggcccatttgtaatgtttatggccatggccatgttcccctcctcggggaataacagcactgtcaagggagggcagatggaccaagcatctcctctgtgccagtccactgctccagcctttccacgtggcatccccttttatccccgaagaaactggcagctggggcgtgggggtcggntgtctggctgggctgtctcttctttcctggcctctgctcaccctcatcgctgctcatggaaggcgaggtctttgcccacttttacttgaagaggggcagtggganggcttcaaaatgggngaggggaacttgctcgntggaagaantgcctgggtgcccnagggcttggttgggcccccnagccaagaccttttcttaaccccacccggttttgttccaagcttgtnnaaggccttttccccttgttttggtttgagnaccnnnnttgnggtngaaaaannccggacccanntancccgtngttttacccccaacttgg

SEQ ID NO: 4708 - DNA, 634 bp, Homo sapiens
  misc_feature (1)...(634): n = A,T,C or G
ctactcactcaaggagaagggagctgccatgtcctgaggacagacaagaggccttatgggaggctcatgtgaccagaaactgagcttattttgtccctgatattgttgcaaaaacgtgatttctctggcctttgctctgaggtttgaaggaggggaagaaagagactgaagttagagactggaatacatcgacgttctcccttgagaaaaattctaaatgtgggattatctagctttaaaaaaaaaaaacaacaaaacagaaatcttcgactacctttggcagactattccagaaaggaacttgtcaggatctgcaagcatcttgagtcctgtaagatcggttcataacgtcgctacagcctggagtcctcagcaatcagaaacccaatagatgcagtttacgaacacaatttagacaatctggaattggcaatggtgnagaaattcctttatattcactggtaaagcagctttcagatacagagagaagcatatccaagcaaactaaagttggaggctattatgaaaatatgcaatgtttctaaagttgctttttgacacaaggactttttgtttcttagcaaatagaattttagacccaaagtcaagaaatctgaacttaattttgttaaat

SEQ ID NO: 4709 - DNA, 465 bp, Homo sapiens
tttgctatgactcaatgacaaaatgaaatgtcttgtctgatgaagcatcatagattcttcaccttccataatgttatatatgcctgcaagcttggttcaccccatcacccttctctctacaacataaaaccaactgacgagactttcaaaatgaaccaaaaccgttaagtgcacaaggagtgatcctgaattctttgaagcttagagatgatgtatgataaaattatttgcaagcttaaaattggtaatttctcttctcatctcatctctgtgagtactcattcacacatagaagtacaaaatctatagccattcgaaaattatctcatgtattatagtaatagaacttgacttggttttacatcccttagttggacactgtttgtatttctgactatctgagtaaagttttaaagtcaaaattgatagtacttcttttaaatccctggataaaataaacctaga

SEQ ID NO: 4710 - DNA, 493 bp, Homo sapiens
agccacacaaccaaaacaaccacagtaaaataagaagaagctatcacaaaaatctcacttaagaatcagaacaaaagctgtaccctcagtgtctcagctaccctttgctgcataacaaactactacgaaatttggtggtttaaaacaaaaagtcttctctgggctttgcctgagctcactcatgtggttacactcagctggaggatcagatgggctgcagggtccaaggtaaacaattgctggattacagagaggttcatttcctacacatatgcatatggctttgtgtactgaaagtggaagatttctttcaattttaaatgtttcccttggacaatgatcaatttttttgtgagtggtgttttatcttttaatttaactgcttgaaatggaccagctgcagagtgggaagtgtgttgacatttatccgaagtcttatctttattaaatcacttgtattattatactacataaacaacttaataaacacaga

SEQ ID NO: 4711 - DNA, 522 bp, Homo sapiens
agtaagagaagatccatagacacccaggggagaaggccatgcagcgacagaagcagagattagagtgatgccgttgcaagccaaggaacaccgaagactgaagaccacaaccagaagctaggacgagccaaagaatctgctaagagtctcagaagaagcctggcccagctgacaccctggacagctgtttcttctgcagctatttcctgctttggatattctattttactattctaccaatttgaagagtactgtgacataatcatcgcatgttgttatgggttgaattgagtctcccaaagaagtatgttgaagtagtaacatctagtatctcagcatgtgactgtcagaagctaaaagaaatacatggaacagattttgtcttagagcctttcagaaaacgcaaccatgccaacaccttgatttcagccttcttgtctgcaggactgttggagaataaatatatttctgccatcttaagccatcgagtttatggtacattgtatgccagccttagtaaat

SEQ ID NO: 4712 - DNA, 475 bp, Homo sapiens
  misc_feature (1)...(475): n = A,T,C or G
caagaaatgggcccttgcttttgttgcctaagttgttcttgaactcttggcctccagcaatcctcccacctcaagcctcccaaagtgctgagattacaggtgtgagcccagccttctaagtctcaagcagagtgctaaaaataagtcctggaaaanagacatggaggtttccatacgactgcagtgccatcataaagtatggacaaaaatgcacaaaatcaaacagcgttgttgagttgtttggctctctgaactggacatctgagctaatttgaggcagagggatatttgacccagagagaggccaatgtgaccacataggcagagactggagagctgtggcattgaggagagagtgctnacagccaccaggggctggaagaggcaagaannnnnttcccccaggagcctccagtggcagtgcggcacagcccacaccttgattttggacttctggcctccagatctgagagaa

SEQ ID NO: 4713 - DNA, 467 bp, Homo sapiens
ctgtcgccaggctggagtgtagtggcgcgatctcgactcactgcaagctccacctcccgggttcacaccattcttctgcctcagcctcctctcctgacctcgtgatccaccctcctcggcctcccaaagtgctgggattacaggcgtgagccaccgcgcccggccaagactttctttcgtcttaagtcactaaaatgaaaacaaaagtactgaggcaccctaataaaattgcctttaaaagtatgactgaaatactcaaagtataccacagtggtggcctggagatggggcagggggatattgactggaaatggcctgagataactttttgcagtgatggaaatgttactcgggtatataatttgccaaaacgcaaaattaaatctaaaaatatgtttaaacaaatttgcctttttggaacctagtaaaaagtaagtacctttttttggctaatgaataaaacccga

SEQ ID NO: 4714 - DNA, 617 bp, Homo sapiens
  misc_feature (1)...(617): n = A,T,C or G
catcatctcaaaccaccgatggcatggaatcggttatagtcaaacctccttgtggagggaacagcaagtaggtcggctactagcacgccaggacgagagccctcaccagacaccaatcatgctggcaccctcatctcggacttccagcctgcagaactgcttcccccagcaactgaaactacatgcttccttagtcctatgtctctctcaagagtgagaaagtcttccttctgagaagcccataaagtctatgctctattctccttggctcagcctagctccacctgacattttactgtgatcggntaaagagcacgagtggaatgaatgcgcaccacacttagcgttgaaggagaagaaacacaaagaaatcgagatcaagagataacgtgagaagtaggaaagaatgaaagccaataaagaatttcaacaggcagaaaaccaacatcgaatgcccagagagatcaaataaaataaagacagangcggccgtaaaannaaangnggtatctcnnngcntggagatannnnagnaaataatangtannaatanaatanagangaagaagataaagnnannatanaannananaanngaganannnntnaaatangtg

SEQ ID NO: 4715 - DNA, 569 bp, Homo sapiens
  misc_feature (1)...(569): n = A,T,C or G
catcgcgatttcaccgccgaatacgccacaaagacacctgcagggaaacgagaacttacctttgtccctgctctcgacccagctggacaccaccctgatgttccagtacttggagatagccagtaattgaacaattgatgacctgtgttgaatagagagggcatgccgcctagggtaatggccaccagcaaacacaaccctctggatgaaaagactgttgatcatctcagtccgtggaacanaacagggggtctgtgggtggtggacaccagaagcatagggcctgaacattagtgaacagacataacaactgatggccactaaggacatttcctggctctggctcctctgcccttaagaatccggacagtccatgagcactgttacgggccatctcttagctgaanaagtcaactgggcattaccctccactggaacatgaacttccagatgcaaggagagcagtcagttcatctgagaatgtatatccgcctgcccagaggcagggagaagatggcatggtgctatcctctccaggattcagctctgaagcctcttaactggcactt

SEQ ID NO: 4716 - DNA, 285 bp, Homo sapiens
  misc_feature (1)...(285): n = A,T,C or G
tgcctgagaataaccagaacggtgctggagtacatcatgttctggttagataacgggggactaaccagaacagactgactctgtccgaatcacccctggagacaggaaattcttcaacactttagcccggcaagtcatgctctccagggtataaaacccaaggccagcttcgggcacttgaagacaagactccatccacccaggcagctttcccgagcctcaggggagcaactcctcatgaatcccaggctnctgttgtcntntctgcccnnattnagcgcaaaa

SEQ ID NO: 4717 - DNA, 461 bp, Homo sapiens
  misc_feature (1)...(461): n = A,T,C or G
tgacaggtatttttcacgagagtgcacgggtggaaattagagatggatgaggagatgacatgacacagcataaagagacgctgatgggaagatgcatcagagagagatgcatacagactccaaggaatcgctgacagctaccaggagctggaagaggcanagaaggattcctttccagatcctttagtgggccgtggccctgccgacaccttgatttcagctgtctagcctccagaattgtgggagaaaaagtttttattgttttaagccactaagtttgtggtgattcattacagcacccccaggaaatgaatatagtatcccaagtaggattagccctagttacctactgtggtggtgagctcaataatttaagagttactttttcttcctttcttaggttgctcttcccagttctccantcttgttccctatgatcatttcccaaataaaacccgata

SEQ ID NO: 4718 - DNA, 872 bp, Homo sapiens
  misc_feature (1)...(872): n = A,T,C or G
caggggctgcagacacatgacaaactggttgtgagcatgtttctggatatagcagaccttcaaaaggattcgggaagattgagctacctgaagggacaaacaactttataacttcacagaatctaagaagagagagcntattgtgacctttcccataggagctcatagcagtnggctgcatgcattcatgagggtctggaaatggccatcaaagatctatgtccgtgcaaaggctcagtgaatgaggcccttgctgcgtgcagtcatgagacacctacttatgccctatgaatgctgtctggagactgtgagagcagaatgcttgagtcacttagacagtgaacaccttgtcacatgtcctaccctactttaatcaattcactgtatagtatacccctgttgcatccgcattgcttaaggtggggttactaatgaggcctgccttactgactcggcaggctctggttttggcgcccggccatgggtatcaccaatctcaaaggcgctattagcgagtccccagatccttgaattacgccgaatgagcatcttgcgaaagggccttatatggaagaatccgaaaaaggccgcggggccggcttttttcattgggggggacccttgacgagcctccttaaatactcgttcaaggcagaggtggggaccccgacgggttttctatttccaggcggtattcctggattccaccagagcgtttatctccggaacataacgttcaccaacccctcgagttttcaattagtaaaggagctcgttttttacttatctggggcgatcaccagggagactcaaagtccggtgtgttgggcggcgacagccttaactaacggttccttactgcgttagtcctt

SEQ ID NO: 4719 - DNA, 432 bp, Homo sapiens
ctcctctggaacacactacctgcttccatcctcatgaaccagaaagcacgtgcctgtggcagtcaccagtcatgtgtcttcttttggtacatgcctgatgttccagatggtctgtgaggcagggtccttgtcttgtcctctgctgatcccgagtccacacagcatcttgcatggagcaggtgaccccctggagcgtgtgtggatccagccacctcctcttctagggcagctcagcctcccagagcgccatcctcaacatggccagaagatggcaccaaggcttctgtcagcgccacctggcagcaagaggcttcaccgggggggccagagaagatggccatcaggaagcccgacacagcaggttagcccaggcttcttcatgtagcaactggctttcatgaacacctagagaataaaccccgatgcgttcgt

SEQ ID NO: 4720 - DNA, 392 bp, Homo sapiens
  misc_feature (1)...(392): n = A,T,C or G
atggagtctctgtcgcccgggctagagtgtagtggcnccatctnggctcactgcaacntttgttccccaggttcaagcgattctcctgcctcagcctcctgagtagatgggactacagaagtggcaagatgcccagtccaatcttgatgcataaagctgctggacaatgaaggggtcatgtgaattctctccatacacctccagggaaagcactctgccttatccaaattcaagtgactcaattaggggacacccaaatcattcctccttgtaattcgtgtactattcaatatataatgtggaccacaggattctaatctttcttgtacttatgtgtcaaagttttaaaaacagctgtcacctacctcctatagaataattccgatgcggcg

SEQ ID NO: 4721 - DNA, 302 bp, Homo sapiens
tttttttttttttgaggctttaatttttgctagttgtttatttttttaaaaagcttttcaagtccttgagttaggtgcttttgttttccacaggcagttaccacgcttcttgagcttcggtaggtttcctgatgtcacacagctggtatatggtgatcagggcttctgaggcagcaagtgtgattttggagacagtactttgttggtcccaaaccatacaggaactgtagtcccacaatccatattctacggactgtcttctcctttttccactgattacatgtgagtggttcttagataac

SEQ ID NO: 4722 - DNA, 448 bp, Homo sapiens
  misc_feature (1)...(448): n = A,T,C or G
cagatcactgaaatccagagaataccactgagacagtgagaaaactgagggtgagagttggccctatggcttccagaggccgagatggaatttgagcccaccgtctgcctgactgctgagtccatcctcttaactcctatactatactctcttcagcccacaactgaacttccagagggagctgttttgaagcattcaggattttgcctcatcaagcacgatacaaaactaagtaaagaggagaagcttcagagaaaacagcttcagcataagcttcataaggaagagatgaaatgaaatgccataaacgctaatacactgaaatcaggagcgtcactggaagttatgtggtgccaatcaaatcacattatccctaaatatatagcaaatggcttaacagcttttgggcccatctcccgncnaagtattccaacattaataaaccaga

SEQ ID NO: 4723 - DNA, 338 bp, Homo sapiens
accctccgtaaggtgcgctcctaggaacacgctgctccagcagggacggcagctctgggtgcctgtcagtcactccaggacggacaggagctgctgaatttctcatcaccaaacagcttttaatcaggaaacggcagtcctacatcacaaagatggcaggagaccctgtgcattaataatggttacaatacatttagtgtaatgatttgacctcggccaacactatagatgccatgattcatatgaatttgataaactacttcctgtttgtagacatgtcatatgttcctaaaaggccaagaatggctttttaccttgcaaataacacagatcggcgt

SEQ ID NO: 4724 - DNA, 353 bp, Homo sapiens
  misc_feature (1)...(353): n = A,T,C or G
ttacctttggacaacatgggcttggactgagtgaatccactcatacttgagattttgttctacctctgccactcctgaagatagcaagaccatcgtccccgttcctcctcctcctcagcctattcaatgtgaagacaatgaggataaagacctttatgatgagtcgcttccacttaacaaacagaaaggatgcagaagttacctttcacttgcacaaccaagcaaacaaatgactatgggagaaatgcaaaatccacatggnaaacatcaaaacatcaccctcntcttatataattaanatttttaggaacccnanngtggnccctaattcggaataaatgagatgcggngta

SEQ ID NO: 4725 - DNA, 198 bp, Homo sapiens
cttaacagaaatacttgtggatccaaatccatggtaggaggtctgattaagaggatttgcagagaggcttttgagaagttggatgctcactgctggttagaaactactgctctggaatgagccacactctgtgcagtatttgatattaaaatattctcctgattgcttctaattctacatataataataatcacgatc

SEQ ID NO: 4726 - DNA, 384 bp, Homo sapiens
  misc_feature (1)...(384): n = A,T,C or G
ctatttnanagggttctcagggattagacaataatcaatttaagcaaggcctgaagctttntgcaaattgaggaagaaaatgctttttaanaaaaaaacatatttcttatgcaaattttacaaaaaacaataggactatatggacacatttctagagttcctcccagaggacctaaagctccaacttcattatcatcactaaatcctcctctgctgattgtccaaaagaaactgcacaactgattgactctttcaaagattctcctgtgcccaaaataaattttaaccctagcaaactgagaaatttattaaaatccagaattaacattacacgtcacattaactgtgtttttatatagtaaacaggaaaataattgcgatcgg

SEQ ID NO: 4727 - DNA, 762 bp, Homo sapiens
agaatttcgatataaaaggggacaacagagacacacgggagcagtgagataagcgtgcgaagagtaaccaagtgagcagccatctgcaagccaaagagaaaggcctggagcagagcatcccatttttgtcctgctgacatcctgatcttggacttccagactccagaactgtgagaaaataaatgtctgcggtttaagctacaaatctatgatattttgttatgttagccttatcatatgaatatgatagtatgtaagtatatactatagacatcacgtgtgtctaattatgttcttgcagtcagccattaatgtgacaggttaagttcacccaatactttgtggagttgcttttggaaattgatactacaggttccttgagaccatcacaaatttccaggatcctgcaaaaatagaatgctgtatcgttgtgcttaatgttacttctaatttgcccaagaatcttgctcaacattcctgctccaccagttttcaacaggacctctgtgcccaaatcacacaaaggtctctctgcaatcttgctcctcctcattgacagcacactgatatattttatatgtgaaacaatcatgacagaaacctttcggaagctccccgcgtctaccgaactggacttattgtacacgcgaccccgtgcaccagcccctgcgtacctgactctagtgcttaaatacaccgaactcttttttgcgtgcgtagatggacagaaaggaatgacaaatgtatactaactaaaacgag

SEQ ID NO: 4728 - DNA, 325 bp, Homo sapiens
aactgctgtgaggactcaaaaattcttatttctacttgtcctctgtaattcctgatgatcatttctgtgtcgtcatcttatacattacctggtaacaaagagtcttcattcagccttcatcataacaccctccgttcttgaaacaattttaatactctcattttataagcaagacatgattattcaaaggagataaataatctatatgaagtcaaactgtaaattacctgtgtagccaagaaaaaacattattattattggttttcaaggaagtcaatattatactttattcaataaaaattgttaatactgaaaaaaaaaaaaa

SEQ ID NO: 4729 - DNA, 192 bp, Homo sapiens
tttttttttttttggaataacaattttatttctatgattcattacccatttaagtatataatttgacattacttatgtcaaaatgcattcatttttccataataaacatggttcttattttcatgtgcctaatctgggaggtgacacctgctgccagaggagcttccattcaccgcttcaacttggaaatgc

SEQ ID NO: 4730 - DNA, 226 bp, Homo sapiens
aactttattctcacacaagttgaacagcctgatctgcaagcctaagaagcactaacaggatcaaagacatcctaaaaagccagctttataaatggatcaatctccagaaatatgtcttaccaggatgggttctaagtgtgcaatgttcattgctaatctggaaatcctcatataaactcaatcctggagccaaataaaatggatttagtcctacaataaacccaga

SEQ ID NO: 4731 - DNA, 272 bp, Homo sapiens
cactctcaccagtgccatgtacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccctggctattgaataaacccaga

SEQ ID NO: 4732 - DNA, 255 bp, Homo sapiens
  misc_feature (1)...(255): n = A,T,C or G
tgtcaaaacaccatcatgagaaatctatgagattgaagcactttactgactttgtcttctatgtcagagatgacttgtaatgtagcaagatgaatctttctccacatcaaatccataaaaggtataaacaatgtgaaggcaaaagacatgctatacttgcttcatgcctgtactntttaccactttnttatangtatcaacctgttgaaggcagctcctatgatagatttgcaatgtaattttaataaaaccaga

SEQ ID NO: 4733 - DNA, 392 bp, Homo sapiens
  misc_feature (1)...(392): n = A,T,C or G
attcggccgcatcttggtttattgaaaaaatatccttatgcccttcagatttcacccttattaattcttcagcatttataagnctttattcagcagattcattaatattttgttttagttgaacaagtgagaatttgaaatgagccatgttggaagtagctggccaaaagcctactctcttcagtttagccacattgccgttctctgtatatcaatggccgcatttctcattttcccctgtgtcaggcagcgctgatgcaagcacaaagcttcttttgaattaatagatgagcactggggtcaatttatcagaccttttcttaggttatagtgtcagtttgggtcccctgaagccaggctaacattagatgatcaaaagaatcttgaggaaa

SEQ ID NO: 4734 - DNA, 179 bp, Homo sapiens
tcctagtttatttagacattcagagttgcacctggcaccactcaaaagcatgagcccatagctgaccataaggataatcctggcagagaaattctcaggttcctgggaggaaatggcacacacgattgctgtgttgagcctcgcagtatgatttcttcctcgcgctgcaggaaaataac

SEQ ID NO: 4735 - DNA, 227 bp, Homo sapiens
atttttacagagcaccttctaaatgtctcccaataatggaaaagatgatgagcaggtctgactcagtttaaaaggaacttatattccatgggaaaagacacatcagaaactgccacccaaataaagacaagactgaattaaaaagctgaagtgtgagcaaagatttgaagaagactttcctgaatgttgttgaaatgccattcattctttcatgcaataaactgaga

SEQ ID NO: 4736 - DNA, 450 bp, Homo sapiens
  misc_feature (1)...(450): n = A,T,C or G
tgctctgcaatactaccatgaatatgctatttttaaaatatatgttcagtatattcagataaactctcacttgcataatttcctcttggaaatggcttattccatctcaaagtgtctttagtcaccccaatcctgcattattctatctgaccaaattaagaatgtttggcttgtaagcatagcctccagttatttttctcttagatgctttcaatatactattcagagattagttttccccacacagagtcattgaattcagtcatctcaaaataggtaaaacaaagcagtatggatcagntccaggntcaatggtcacnctataggaacacaattcatttgttaattaaanccacnctaggtacnccnctgcctcctggtaggttcaaatttctgnttgtgggcnctttcagnttgtttaaggaaaggaaaaaattcggaaagggggcc

SEQ ID NO: 4737 - DNA, 609 bp, Homo sapiens
  misc_feature (1)...(609): n = A,T,C or G
tcgcatcttctttatttcttaattcctttttaacaatatgagaattttaacaacctgaaaatctaagtggacttctatactaaagttatttgcaatgcagctaaatatgctggctgcaagtttggttgctacaggattggtgtcacctggtatcaagagatatcagtgagaaactcttccccaaagtaaatttaaattgtttccaaaggtttaagttctattcattcaggtaacatttttggatctactagattgtctggccttgtgctagccactcaggatagtaagggcatacaatctggctcctgtcctcataggcaacaggtaagacaaaaaagtaaagaaataattgcagtgtctgggcaggatagaggtagaaactttattcattccaactctggaaactgctacagggatgactttgtcatgaccagcagtgctgaagtcacttggaagtttgaccagggatcaagctaccatggctgcgagctaacagatggtcacactggccaagttgtggcttangaacctgtggacttcatttcttcatgcccagaattaacactgcatccaagacaaaacgttgctctccagatcttantttccaag

SEQ ID NO: 4738 - DNA, 1206 bp, Homo sapiens
cactgaacgagaaaatgaggacattagtcctacacctgcaagaaacgagaatctactaacaaccagtgtcaccaagttgcagatgagattgcagcactggatgatgcttggattttagccagctaaattgtactgactcctggcccacagaaactgtgagactatggaaatgatgttagacaaaaaggaaatttgagtgattttcttattcgagttcaaaatgggtcgtaaagcagtggagaaaactcaacatcaacaatgcttctggcccagtaactgctaatgaacatatgtacagtggtatttcaagttttgcaaaggagatgagagccttgagaatgaggagcatggggtttggctgagtggaagttgataacagccaattaagaacaatcatcgaagctgatctcttaccccttcacaggaaagttggcaaaaaccttaatgttgaccattctacggtcattggtcttttgaagcaaattggaaagggaaaaaggctcaataaatgggtaccttatgagctgagcaaaaatttaaaaattgtaattttgaagtgccgctttctcttattctacacaacaacgaaccatttctcaatccgattgtgacgtgtgatgaaaagtggatttcatatgacaaccagagacgttcagctcagtggttagactgaaagaagctccaaagtacttcccaaagccaaacatgcaccggaaaaaaggtcatgatcactgttgggttgtctgctgcaggtttgatccactgtagctttctgaatcccagcaaaaccattacatctgagaagtatgttcagcaaactgatgagatgtaccaaaaattgcaatgtctgctgccggcattggtcatcagaaagggcccaagtcttttctaagacaatgcctgaccacatgtcacacaaccaatgcttccaaagttgaatgaattaggccatgaagttttgcctcatcctccatattcacctgacctctcaccaaccgactagcacttcttcaagcatctcaacaactttttgcagggaaaacgcttccacaatcagcaggatacagaaaatgctttccaagtgttcctagaaccctgaagcattaatttttatgctacaggagcaaacaaacttatttcctgctggcaaaaatgtttcaattgtaatggctcctgtttagattaataaaggtagatgcgccaagc

SEQ ID NO: 4739 - DNA, 879 bp, Homo sapiens
  misc_feature (1)...(879): n = A,T,C or G
tggccgatcctggtttatttcatgccttaaaacaaccagaaatatcattgtcatggctaatttccaaattatgaactaaaaattgacaaaaaatgaacatacattggactttcactatgtgccacacacatattaatacacttaacatgtattatgttaagtgcttaattatctcacaactctaaaaagtgagtacattagcacatccattctacagatgagaaaaggaaggctggaaaaagacatgatgaatccagggggaagagcagggatttgaattcagatctgccctgacgtcaagttcttctttggggtttcatgattttccattttgtactttgcacatagccatgcagctgtagagtgaagaaaatctgttgcttttcaaagttccctggctagttcctgaagaaatgttattactttgagcacactgatatggtttggctgtgtccccacccaaatctcatcttgaattttagctcccataagttcccacttgttgtggggaggtgattgaataaatggggggggggtgggtctttctgtgctgttctcgtgatagtgaataaantctcaccganatctgattggttttatacaggggagttcccatgcacatgctctctttttttgcttgccaccatgtaagatctgactttgctcctcctctaccttctctcatgattgtgaggcctccccagccatgtggcactgactccattaaacctccttcctttataaattacccagtctcaggtatgtctttattagcagtgtgagaacaggctaatacacacattaaataattatgctgtttcctgctcatttggagtggtatacacataagggctttctctcttttttttcccccaaggc

SEQ ID NO: 4740 - DNA, 674 bp, Homo sapiens
  misc_feature (1)...(674): n = A,T,C or G
tagagacggggtttcaccatgttggccagactggtcttgaactcctgacctcaggtgatccgcccacctcggcctcccaaagtgctgggattacagacgtgaaccacaatgaccggccaagactctgtcttcaaaaaaacaaacaacaacaaaaacaagaagtgatgagcacacagatctttacaaagggaagaccaagtgaagacgcagggagaagatggccatatacatgtcaaggagagaggcctcaggaagaaccagtcctgccctcacctggaccttgcacttcagcctccaaaactgtgagaaaataaatttctggtgtctaagcccccaggctgtggtactttgttagggcagcctgaggctttctacagactaggcgggagagacatgtgtcctggcaggcggtactatcccagctcctagggcccccaatctcagaggtcagggatgacttggaaactccctacccccacaatgcccagattggcaaagctgggccgggaccctccaccagctcatggaggagaaaatgacaaaaagccattcatacttgtcaggagcttagccctttttggaactcaacaccttttaagtgtcctccagagaaaggaagtggaagtactgctggggattagccaagcaatgaataaaccccgatgcnggccagg

SEQ ID NO: 4741 - DNA, 758 bp, Homo sapiens
ctgggccggaccgggatttattcttgatcagatttaacatttgacactttttctgtcagaggaaagtacatggaaatatcaagtcatgcttatagtgcaatcagtttaattagtttgtacacactagtaaaatatcaaacattggcagagtcacatcttatgactgtgccccttaccatgaatgcattacattgttgccatggagtttcatgttaaaacactatttcatcttttcacactccaaaacactatttgttcagccagttgtgccaaaacaattgaggaagagaaaagcaggctgcaaacacaaagccaaccctttgtggtgaggtgggatcgatggccattttaatcctgcaccattctgtattttcttaaaattttcctcagtgacagattaaggggcctaaggaaaagttactgtgcaaagaacttgaagagacagaatgaattccagaaattgtcctgatcagaaactggtaagcccaacaatagtcaaactgagagccaagtcaggaatgcaatttcattcacaattgccacaaaaagaataaaatacccaggaatacagctaactagggaggtgaaagatctctacgatgaagtttacaaaacactgctcaaagaaatcagagatgacataaacaaatataaaaacattccatgctcttggataggatgactcagtatcattaaaagggccatactgcccacagcaatttacagatgcgatgctattcatattaatttaccaacga

SEQ ID NO: 4742 - DNA, 540 bp, Homo sapiens
  misc_feature (1)...(540): n = A,T,C or G
actaggcctgcagtgacagattgccaggacgccctcctctgacaaaattgacctttcttcacagtccaagatgcagtggaattatggggctgtgcgtggagcttttgtgagcctggctgccactcttatcaaatgtgacaggaaggtctggttccgcatccatggcaaggcccagtatggagaaacagcaacatggacgttggcggtgagaatagatgaagccaacttatctctcaaataaggagacaaggacttggtagctaaaaattgatatacttagttggcaaaaagatagtacatataggcttgatcgtctgttaaatatataaagataagtgggagtccttggagaacatcttgcattgttctgccttcttcaattaacagataaatgtatgtgaccaatctgctaacataatgttctcctgggttaatccttatctaaatgtgacaagttgtaattatcaacaaagctgaaggtcccattcattgtttttaaattactttttaataatataataaaactcgtatgcgnccagg

SEQ ID NO: 4743 - DNA, 278 bp, Homo sapiens
cccagtgatgaagagaggctttaaaaagcagcccggagaaaagaacgtcagccgattgagaaataactattagacttgcaactaactgctgccctgcggccatggaagacaaaggcagtgcaaggcttccttcgaagttccaagggaagagaaccatcctacaattctgtctttcaagaaaacatcatgaaacaattatgttttcagaagaatgaaaactgaaatcttttactactatcggataatcacaaaaagaactcttagtaaataaagcccga

SEQ ID NO: 4744 - DNA, 693 bp, Homo sapiens
  misc_feature (1)...(693): n = A,T,C or G
aggagaaaattgtttccagagagacaaagtgccttgtttaaggctaccagatgaggaaactgaggcttggtaagtgagacacaaatgcctgatcatattctaagatgggctgaatcaggccctcctgatagctatgaggatgatgaggatgatgatggaggaagaggaggggaaggagaagaaagaaaaagagaaggactcatgcccaagactgcctgactcaatagcacttaactccatatgggtgccaccattgtgaaagagtctggacccnggagctcaaaagagttgtctcaatcttctccgtatatcagaatcacctaaggagctttttaaaaataccaaggcctgagtctcaaccttagagattcagaatcagttggtgtggggtggagcctgggtatcaacataatttattcaggtgattttgaaaaccacactatccagatgatcactaaggttgcccggtcctggtatttcaggcatctctgatcatcctctattctccctaccaaggaggctgcagggaaggaagtctggcaagacatctcaaggaggagagggagctggaaaagccagagtcaagtgagccctgggcaaggcaggctatgaactatgaaagaacatgtgaattgggcctgggcactgccaccattttcctcaactntannnccatctgctgattgtggggca

SEQ ID NO: 4745 - DNA, 439 bp, Homo sapiens
ttaaagaaggccatgtgagaacacagctagaaggtgaccatctacaagccaggaagagatcccttcaccagaaaccaactggccaaaacaacataactttggacttcccagcctgttgacccggtgagaaaataaatttctgtggtttaggccacctagtctatggtactttgttatggcagttcaaggaaacatatacaagcaggaaataactctctggaatgaggatggggtgcagcaaaccttcagagggcgaaggggaagcttttcattggcctctacacctggtttcccacttgattaattggcctcctgaaactgcccagctgttcgaaatgatttatgcatctatgtggcatggatcacttcactatgtccagtactaacctaagcaatgcaggctcttgcccattccaaatgaaactctaataaagcatga

SEQ ID NO: 4746 - DNA, 476 bp, Homo sapiens
attgaaggacagaagaaactcaaaggaagaacatcttagaggatggagtcaagaattttggaaaactggacaagagaacccttccaagacataagaactgcaatttaatacgggaacattctctgtgcctaagtaccttcctggactctggcttgcggtgcaaaggcaggttagagggcgacccactcctgacactgcgatcctcaatctcatcaccagatggacatcccaaaaggatcctgggatgaagaccaagaggattgggcctctttctataccatgaaaatcgtttgtttgcaggcaactttgagatataatcatgggaattttggggatatttctaccataagcttttttctgctgaatacctctgtacctaggatgcttaataaaacacaaattttctagaaatgctgtgacctccttggctacatctgaagccaaataaacacaaaatatgtttaaaaaaaaaaaaa

SEQ ID NO: 4747 - DNA, 409 bp, Homo sapiens
ctcatgggcagaagtgacttgccttgtttcagatgagattatggcccatgaacttttgagttaatgctgaacagctccaccttgcagagatgctgtcaaatatgcacaagctcttatattatcagtgtcttcccaagatgaagccaagtcctgatgagctgaagctaagagttcttttcatcttgacatactggcagccagctaacccaaccatggccctattttctccaaccattactaaacatgtggatgtgatggtggagctggaatagctgtgacttggggaatggaggccacaaatggcacagcaacaggaagaaagaagccttgatctttgataagttgagtattctaactcatttggaatgcttatgtttagactcctatttaaaagataaataaatatcga

SEQ ID NO: 4748 - DNA, 448 bp, Homo sapiens
atcctgtttggtggaagcctgctgagtctattggcagaggggaagccattgcaacttatgacagcatacaagatcctaaagccctgcaggtcccctggagccatcttttggagtaaacagactctgcaacatcatccacttgcctccaccccctgccatagccctcacctgaggatgctgtgggcaactgcaggtctccgccctccaggctgctgctgccagaccccgatacctccacacttgtgtagaagcccctgctccccagggctcctgccatcctgctgaacaccctctgcccctcctaggaagggagcagagaaagtcatgtgtgtctgcaacgatgggttcgcaggagatggtcagatccactagggaagcatctgcatctgcctggctcaccacatggtaaagctaataaacagtaactatttccccaaaaaaaaaaaaa

SEQ ID NO: 4749 - DNA, 506 bp, Homo sapiens
acagaattcttcaatgggtctgaaatatgagagagtttcctggaagcagagaaaccacacaaatttacttcacactgaagcagcagatatcctctccgtctaggatggccaacttcacagttgtccctagcatgaaagggggaggagaatggctcatgactgtgtccagcccattctttgaaattgattttgcattcatcagccttcgagtttccgttcattgaccaaaacaggtggaaagtttaccttttaacgttgcagaaatggcaacttgcccagtttgggcttcatggtccccagctgttttcagaggtccctacaatatccaggtgctctcagttgtccgtaggctcatccttgtccctggaccccagtggaagccaagctctcttcttggaattttcgtctcatggattgaaagtgactctcacaaccacagatgctccagtttaagaccaaaagaaggcctggtttcgctataagcaaataaaaatcgttccggccag

SEQ ID NO: 4750 - DNA, 448 bp, Homo sapiens
  misc_feature (1)...(448): n = A,T,C or G
aaggtaacctggatgtcaaagacccaattctgaacagccagcactgagtcggcaaaatgctttgaaagaagggaaagatgacccatccatcttccgcctcccagataggcagctggtcttccaacatccagacctcccagtcctccctgagcccaggctttcctctggctcttccagcatcctgctcacattctcctgccactccgggagctgcaaatttggaggcagaagttctaggagttggcagttgaaatccttgggtcaccataaggcttggctggttggtgcgtgaggccatcaaccctgctcagctgtgtgaccttggacatatgagttgnccncttttggcctttattttagacattccaggaatttaggcattagngcatgtaanataggggttggggaattggcttaaagcctattttgtaaataaagtattatggga

SEQ ID NO: 4751 - DNA, 519 bp, Homo sapiens
  misc_feature (1)...(519): n = A,T,C or G
agctaagcaccttggaaagacactatgttcattncccgaaaaaactttgacttttacagtaaaataaaatatgcaataaaatatatttccctnattaggtnatatctgctataaaaaaggaaaccatcaaagcataatatggtgcactctagaagaacttgccagtgacgtgtctactacaagactgctgataccagtgatccggataatcaaacaggctcggatgtgttaaaaaaatgcacagaatcttcctttctttcattccagtctgcacattttcttcagtcctgttgtataatcacattctcaccaacattcgcaccatggagagtgttcttaaagcttctgtgggttttaaatcaatactctgacttgtaacacacaacttcctttgtggaactctgacttaaagatgcatttaccagccactcatgtcaccagcacagctttgatggtgctccccgctcttctttacttccgtgatgccggcatctcattgagtccagcctctttggttat

SEQ ID NO: 4752 - DNA, 647 bp, Homo sapiens
  misc_feature (1)...(647): n = A,T,C or G
cggccgatcgctgtttatttttgaactcattttgaacaattatgttttaaggattagaattaccaatccatgtcagacctgcatgactcagagcaacaaatgaggtccctgcattaattttctattgctacataacaaatgactacaaatttaacagtgtaaagtaatgcatatttataatctcacagtctctgtggttcaagaatctgggttctgtttagttgggcccttagctcaggatctcaccaggctgcaatctaggtgtcaactggaccgtgttttcatctgaaggttaggttggggaagaatatgcttccatgctcactcatgttgttggtagaattggtttccttgaagctttcagacccagaacaccagtttttctctggcttctctcagttcctagggaacactggtcattctggcttctctcagttcctagggaccaccggtcattccttgctatgtagacatctatgtaggatctcttacaacatggctatttacttcttcaaagcttatctttataacaatccttacctccaaatatccactggttcgtgtgatgatgaatgtctgtcttgcattagactgtaatttccacagaagaanggaccctgtttgggctcacaattttatcttcaatg

SEQ ID NO: 4753 - DNA, 335 bp, Homo sapiens
aagagctttctagcttccaagaaaacctttgaccagcctgttaccatcagagattctgtgagaagacattataaaagctacttcccgtatgcataatatttattatttgcctaagtatttcctccaaatattaatgtaatctgcttgcctcataaagagaacaaatgccaaatacttcttttattattttagcttacatcctatcctggcaacagacatggttaactaggttatttctatgccctttcctctgagtcccaccttgagcataattgacggactttatggtgcttcttgaattaaaggatgtcaaagacagaacaaaaaaaaaaaaa

SEQ ID NO: 4754 - DNA, 576 bp, Homo sapiens
  misc_feature (1)...(576): n = A,T,C or G
aatttattacagcagcaataagaaactactacactggctttgaagatggaagaatgggccgtgagacaaggaatgcaacaagcctctagaaggtgggaacaactttcactgacacccagtaggaaaatgaagatttcagtcctctaaatacaagggactgaattctgctaacaatccagataagcaagaaatgtattcttcctcagagcttcaagaaatgaacacagcctgaagactccttcatttaacccattgagacccctttggacttctgaccttcagagcttttggtaattagctccctgagctgttctcattgtaaatgaaggggtcctagggagccatttgaagaatctgaatgaatgaattatccatcatgcagtctttttgaaaaagctaatttgtagaggaaggtgcactgggtgggttttttcaatggaattaacaatggaagataatggatttcaaagcaaaattggcacatgaaaaatataaacaagcaaggaaaactttaagacttctgaaacagaagagaaaggctaaaactaagcctgcattaaattcaanaaagcgcga

SEQ ID NO: 4755 - DNA, 404 bp, Homo sapiens
  misc_feature (1)...(404): n = A,T,C or G
tactgggtaaaaaagggcagttccctggcaaagcctcaccctcaagcctggatacctgctgtcttaaacgaaaacgaaaacaggcatttctgtgttcatgctccaaaagttatcttttggcctgccacaccccctatcgttgcacaccatatgaatcccgaaccccagactccagaagcagaccagcaagcccgcagaccancagagggatggcagaacgatgtggcagagaaagggagaagaggaggaacatctgaatgccaaaatgagttcagctggngcgcagtcagagaggagtccagccactgggcagccagaatccaggggaggatcacctttccanttcatccccttccttgtgcctccccatccatcgtgctgaaagccacctccaccactcaata

SEQ ID NO: 4756 - DNA, 723 bp, Homo sapiens
  misc_feature (1)...(723): n = A,T,C or G
ttttacctttaaaaatgattttttattgtgataaaataacacaattggtacatttatgtaccattgttacataaaataacaaaattggtacatgtattcaatagtatacatgacagtaaaaaagaatgaattactactacatgcaacaacatggatgggtttcacaaacataatgtgtagtgaaagcaggaaatccagaggcaaagtatccatatggcacgactccatttatataaagacaaaacaggcaaactggatggggatttgcaccaatctgaccaaccgtgggacatgacaagattgtgcttttcaataaaatgcaaagtttgtgcacttatataaaatggaggatgggattctggatcctgatcagttcctactgaggatgtaggatacacagccagacttctcctggccacagctcctgtctctccctgagcttgtttcaaaattcagccattgtttcacctgtctctcctttagaaactgtccaatgttgtcttacaaaagaactattctgtaaattactttaaaatgaatgaaaaaaaaatgggtttcttggattttctttcatctttcactattgtcacangaggtcataggtaactctgtntancctttccaagaaatggcttcttttgganaaatatgagcagtttataataattggattgcatttctctttcttctttttagttttcagtctcctttccaggacacagt

SEQ ID NO: 4757 - DNA, 564 bp, Homo sapiens
cggccagcatcggtttttattttatctattttatttctattttattttttttttttgagacagagtctcacttttacccaggctagagttccgtggcacgatcttggctcattgcaaccttcacttccaggttcaagtgattctcctgcctcagcctcccaagtagctgggaataaaggcacctgccaccatgcccggctaatttttgtatttttagtaaagacagggtttcaccatgttggccaaactggtctcaaattcctgacctcaggtgatcttcccacctcagcctcccaaattgttgggattacaggtgtcagccaccacacccggcccaaaacaagatgtaaaaagtgatccgcaggaggagcactcggtgaacagatgattgtgcggtgagcaaatgattgtgcgttggggcagttcttgacctgtgtccaggcccaaagtgagggcggggtgggggcagggtgaggcggcaggagcaccctctcggtgggcactgcccctgcttctgagcaaaaactctgtaattttctccttggcatttgcctttgattaatg

SEQ ID NO: 4758 - DNA, 282 bp, Homo sapiens
cgcgcgatcggggtttattgtttcatctctgagtggatgtaaggtatcttaatatcataaattaagtcaatcccaaatgcatcacctggaccagatggaacatagaggccaatgaacctagaggaaagcttaatcaagcaccaagtgctcagaaaccttgaatcaagttgagtttcttttatgtctgtcccttttagccatctctgtggagtccaagctctctgccttgaagcattcttctccacttctctccactggcaggcaaagccatgttggtttcct

SEQ ID NO: 4759 - DNA, 262 bp, Homo sapiens
tttttttttttttcagttgatgtcacttgtgagttttattttctcctaatgaaaaatggatttgcattagtgcaactttggggacaggaaacccctggatggaggcctgagctggtgatctgcccctgccctgaggaaagctaattaccggccggccagcgtggaagattgatgctgcggtcaggaggggactttggggaacagaggggaggagtgttgataatggtctgtcttctttgcagtgagagtccccacggtgctt

SEQ ID NO: 4760 - DNA, 277 bp, Homo sapiens
tcccgtttttatttacaagtagataaatttatttagaagagagaaatttggatacagtgagattttggtggggtccattaatggaccttttaaatgagcacccacgttattcccatgcagattgtctggcttcaatcatctgggcatggtggcgggtgcctgtagtcccagctgctcgggaggctgaggcaggagaatggcgtgaacccgggaggtggagcttgcagtgagcagagatcgagccaccgtactccagcctgggcgacagagtgagaca

SEQ ID NO: 4761 - DNA, 387 bp, Homo sapiens
  misc_feature (1)...(387): n = A,T,C or G
acgccaaaacaaaatgaaacaacaacgctgtagctgatgttatcagtgccatgccatattgcctaaacctttctgtgtgttcctgacaacattcagctaacttggggatcatccgtgcttaggattctttcctcaagaacttaagaaagaggatggaggtactgagaacttatcacccagagcaacttcattcaaagacttgtctactcctccaccacttgggaatgaccattctaaggcatatgttttccatcatttctcagagtttctcantgggattgagcctctgtggctcactctggtagtgtttttcatccatctttcatggattgcctcacctctccactactttgccagtgttcatggcccttcccaaataaacccaga

SEQ ID NO: 4762 - DNA, 267 bp, Homo sapiens
ttccatgtttccaactgaacccatgttcctccactaatacttggattttcttccaccacggccgttcctgagacagcaagaccagttcctcctccttctgctcctcctcagcccacttgacgtgaagacgacgaggatggagaccttgatcgtgccccactcccacctaatgaatagtcagtagattttctcttccttaggactttcttcataacattttcctttctctatcttactttattataaaaatacagtaataaacacaga

SEQ ID NO: 4763 - DNA, 515 bp, Homo sapiens
gttgacgcctttcttatttcatttgtttgttttatttgttgttttaaagagaaaagggagtatacttgttgcttcagggcaaaacaaagaccagtgggaagaaagttatcaaaggttgatttcagctcctcacaaagagctttctaaggacaggctatttgtgaagggactaaatgtgtttaagtagagctgggcggtcacatgagaccattgtcctgaggaagctcacccaaaaaccccgatggccaggatgttgactgatggctcaccctggagagttgacatctggagcctccgctgacaagcagcatggtccgctggcaggtgaataggggccatggttctgcgggctctctccaggggtggctgaggctggcactccacagtgctgctaagcacatgggtcacagctgcaagaatgctggggtatgctgactaggcaggtgtgcggaggtcacgatgcagctccatcttcaaaacaggaagcatttctcggagctgtagtctcacagact

SEQ ID NO: 4764 - DNA, 354 bp, Homo sapiens
ggccgcatcgtgttttatttctggtgatttattgtccttacatgaccacagggggcacaacggtgttctccttatctattgctgtgcaacaaatcaccccaaaacctagtggcccagaacaacaatcactccgttattatctctcatgttttggggatggactgtgctcagccaggcagctcttgcccaagatctcttatgtgttgcagtcagatgatggctggggtgagagttatcttcactcacttgtctggcagttgatgctggctgtcagctgagaccttagcagggtctgtcgtttggaacacttactcgtggcctcttaatgtgatctgggtttcctcacaacatggc

SEQ ID NO: 4765 - DNA, 761 bp, Homo sapiens
  misc_feature (1)...(761): n = A,T,C or G
tttcatttatttatttgttttgagacagagtctcactctgttgcccatgttagagtgtagtgacacgatcttggctcactgcaacctctacctcccaggttcaagtgattcttatgcctcagccatccaagtagctgggattacaggcatgagccaccactcccagttagtttttgtatttttagcagagacggggtttctccatgttgaccaggctggtctcgaactcccgacctcaggtgatctgcccacctcagcctcccaaagtgctgggattacaggcgtgagccaccacacccagccaggatttgttttcagaatttagaaagacccatctgctgatggacatttgggctgtttcgactttgagctattacaaatacaaggacaggcagatgctattgtttgctcctgggtaaatacttaagagtggaaaggctggtcgacttcttaacgttggttaccggtgatgaatttctgagtggttcagccacacccataatcaatgggaagaaggagaatagggacttaaaccctttttaagtcccttttgaaggatancaacagggaagaatggnnaatctggcaactnnaaaaanaagggnccttcccanggcccccaccaagcctggncacttttgatcttnggcttccnncctcaaaaactgnancnggggggtaaattnaanaaaaatccttgnncttaantttcaaantgttggggtnnaaaancnnnnatnggnntnnncnanttantttgg

SEQ ID NO: 4766 - DNA, 175 bp, Homo sapiens
cctctctgttgggatgggggagtggacagtttgggatgaagcccatattcaagaatctcctgccttcttcaagaagtgaagttgtcagaaaggagggttgcaaatcccattatgttcccttcccttgaaataaatcagaaacaaacagaagaaacaaataaacaataaatcccga

SEQ ID NO: 4767 - DNA, 917 bp, Homo sapiens
  misc_feature (1)...(917): n = A,T,C or G
acggtcgctccgcatttatttaattctctgaagggccattgcccagatcttttcccaaagaccacccaagtggcacagggatggcggaaatgctctatgtctccagcaccgtgctgctgcctctacttaggcatcttctctgcatcccaggcaggaggctgagaaactcaggactgattgggatgtatggagaaaagagctcagaggctcaggcaacctgtacaggagatcctgggctacagagaaaaaagacagaagcagcaggagatgaaataggtcagacaatctgactacatggtctgtctgaagagggctggcatggataggaagctgaagacacagttatcagctcaggagatctgagcatcttgtggcctgaatatgaggatccgtgctgggcagcgggcaagaggagagggattctggaaaaaggagaagcgtgggaggtgctcctgggaacactggaattagggaatgggatcctggccccagggggagcctagccacaggcgtcttccacaagggctgtccagaaagacaccatacatggcacacaactccccccaccccacacgtcatgttgtgttgtcatccatcttctcctctggaccgagagttctccaaggagcagggatgtgtccgattcatttttgtttctgctgcacacacagcagtgcctggtatacagcagagactcaataattggagttgctgttgttttacttctttgttcttttctctctctctcttttttgtttttttgttttgttttgtttttattttcctgcgctcctttctgcacgctgaagtttgaaacatctccctcagtaaggttntgcaggttttacaggaagcatagcaccagcatctgntcagcttctggtggagcctcaggaagcttttactcatggtggaag

SEQ ID NO: 4768 - DNA, 358 bp, Homo sapiens
caaatgagctgacagtggggactctggggagattcagctgcaggacttagatgaaaggtgctctggtgaccagaggagctggccaatgagagagagaagcaactggatcaacacaaaacattctgggcacactagaaattgaagcattattttttaagacaaataatactgtagactacctaaggcaggttgaactacatcacgtttgcttatgcaggctttccaagttacatcaaagcatcctgcactgctctttatacacggactcctggagactccccttttatcagtacagagcccagcacagaatcctaagtgatttaataaacaggactctcaaattctaaaaaaaaaaaaa

SEQ ID NO: 4769 - DNA, 550 bp, Homo sapiens
attctttgacaaggatatcacacaaaagggcttttggttctattggtttttgagtcttaaattgccaaagaaatcttttatagaagatggggacatgaggatgtgcttcaaggaaagtgcttcctttttttcctgtggcacttgggattcagataactgtaaccttatggagaagactaccctgtaaatgaaaacgaccaaccagaaggcaacgtgagattggcttaaaagacactgatagttaatgaagaaatgaaaaacacctccaaaccgaatccagctaccgcaatgtggaccgccctagaaactacatcaatccgtgtggtttattctcatcctcaatccaattcttacccttaaagaaactactcatcactaaagaatcttagtttccattttggaggctaatcttatatgtcaaaccactaactttctcctgtattctatgctattcttagcccaagattgcttgacattcaataaatattaaatgtagcaataataatcatgatgatgaccatgtaaataaataaaaattgatcggcccgag

SEQ ID NO: 4770 - DNA, 531 bp, Homo sapiens
aaatggcaaagcagatgaccgcaaaaggccacactgccctcccagtttcttccagaagactggtcttcatcctgcctcatgactcccatagactccagggtgcctccctctttttttttttgagacagagtctggctctgtcatccaggctggagtgcagtggcgcaatctcagctcactgcaacctctgcctcctgggttcaagcgattctcctgcctcagcctccgcagtagctgggactacaggcatgcaccaccatgcctagctaatttttttttttttgtatttttagtagagacgaggtttcaccatgttggccaggctagtttcaaactcctgaccttaggtgatctgcccacttcggcctcccaaagtgctgggattacaggcatgagccaccgcgcctggccaatgcctccctcttttaccttcgtctgcaaaatcccaggcccccttccttttctttgagatgtccctcattaatgagcattctcttcatggcactagcttgaataaaaccggatcggccg

SEQ ID NO: 4771 - DNA, 341 bp, Homo sapiens
  misc_feature (1)...(341): n = A,T,C or G
aaaattaaggcctgcaaagattgagtgaaaatttcagtgtcccactgctcatatgcctgaagttcattcgaatacaagcaatctggatccagagcccttgctgttaagcatgacatagactttttccagaaacttttgatgttttctcctacatagctcctttctgcattctggtcagtgtttcactttttagtcagttgccttacaagactcatgccatggacacaatctccacttgaggacattaactttactcctttatcatcacttggccaggcaagtgtacttaggaaaaagcatctaggcttgagaataaaatttgangcgaccgtcccaaaaag

SEQ ID NO: 4772 - DNA, 374 bp, Homo sapiens
ctctccttctgcctccgcatgcccaacgatccggagaaaaacacggaccatgacatcaaaaggccttggccaaggaatcgtgattattgtgatacaagattctgcacctcaaaggggatccctgtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaatgtaga

SEQ ID NO: 4773 - DNA, 454 bp, Homo sapiens
actggaccagacagaagactacagttcaataagaaggaaacacattcattttcagtattgttaataaagaagcttacctaaaagaaggaaatcaaaacaaggtctgtaagctgtaaattttaattcctattctcctttccaaattatgttgagaaaacagagaaacaaaaacaactgccctacagaaaggacagcatatatttcaatgtacaattcagaagcacctgcattagttagaaatgccatagcagtaacctgacctattgttagaaatttagcaagtacatttttcattgctccccagtgggactttatgccaaccagtattgattgtgagagtttcaaacttctattagattctactgtcacttagttggtaattatttcagcccaacaataagatgatttagagttgtgaaaataaatggcgatgcggcctgaggttcttcctctc

SEQ ID NO: 4774 - DNA, 404 bp, Homo sapiens
  misc_feature (1)...(404): n = A,T,C or G
cggcggcatctgtgatttattgtccttgaaaataaaaacataccagttgatcagagaagcagttttcctggtattgggcttgagataaaattacttaatggctctccatcgtcctctagtgtagattatcggggcacagagggcaggtgtgtgtataggtgctgtgttgaatccatgcagtcattcagggatccaggcttcttctatatgtggttctgccctcctctagaatgtcaaagtctagatatttgctgtggttgggccatggaatcaatgttgagcttccagatatttgtgctttcctgccaaaggacgtttcaggttttcanctgtagtccctgtggcgagtcctttcttctggcaggctctcatctggctgcccccaggggtggattggagcatat

SEQ ID NO: 4775 - DNA, 277 bp, Homo sapiens
catagctgcaacggctctcttaactcacttggcaaactaatgaactttggaaaatgcagttctttaacttttaaacaattgcaataaagaactcgatccaaattgacatattgatcaatctattccagaactgatgcttcaggaagatgccctgaatgtcagtggtgtgaatcacaatgaggtatttaaagcgcagcagttcattgggatttattttacaaaaataactagtattatgagtaagaattactgtttcaatttgaaaaataaaacccga

SEQ ID NO: 4776 - DNA, 147 bp, Homo sapiens
cctaccttggacaaagaaattctcaagttttctgtgagattaaaagatcttctttatacatacatcatttgatagttctcagcacttttcatgtaatctgagattttctgacatctgtatcccacaccccaccctaaataaatctgg

SEQ ID NO: 4777 - DNA, 211 bp, Homo sapiens
cgtctccctgtcagctgttactatcagcaatgattttccatagagcaaacacatgtgattcatcaagaactgatagactcattgtggatatcaaccttcctcagtctcacgatcagattaggtaggaagccaggacaacctcatacagagatctatatagctgagtttacgtaatttatttattgtcctatattcatggtataaatgtaga

SEQ ID NO: 4778 - DNA, 276 bp, Homo sapiens
  misc_feature (1)...(276): n = A,T,C or G
tgggaagaactggatttgcaggtattgctggagccagagcgaagcccggccactgtcaccatgggctccagcctcgcctctctgggcctggtggtgagcggcttcagcaacaggtttccggtccccgcagagggtcccactctgaactcccgatttacagactgttctcgggccgtgatgaggattaagacaatgcaactaagagcactctgactacagaagcatgatttaaagctccacaaccctgcagtaaccacgaagaaaaananatagcga

SEQ ID NO: 4779 - DNA, 857 bp, Homo sapiens
ggtaggaattaattgattattattattttatttttttgagacagggtctcactttgtcacccaggctgaagtgcagtggtgtgatctcagctcaccgcagcctcagcctcctgggttcaagctatcctcctgcctcagccccccaggtagctgggactacaggtgcacactaccgcacccagctaattttttttgtttgttggtttgtttgtagagacagggtttcaccgtgttgctcaggctggtcttgaactcctgagctcaagcgatctgagcgatctgcctgccttggccccccaaagtactgagcttacagacatgagccaccaaggcaggcccataaagttttctatcttgctttattttttttacataatagaaaacatttaaaaaattaatcacaaaattcatggtcacattcctacaaagttaacgaaatatctgggttggcttatgcaggtggtcagccagaatttctgcaatgtccagatccaaccaggtcctggctccagtttgaggcccctggtggcatttatctccaccacctatcagtggaggtgattctgggttcggggttgacaggacctccaggaccgcagtggcaaggcttgtaatctcttggagctaggagaaccctggggcagaactccttgcttccttgctttctagaagggatttctgttttccccgactcgccttgtcctctttctgcattccccacatcctgaaggatgtagaatcaagtcactgcagtcaggctgcaaagcagacagagatgcagtattttccaggagagtcagaacgcgtttccaggtcctgaaatcttcactgggcagatgataaaatctggatccgaa

SEQ ID NO: 4780 - DNA, 582 bp, Homo sapiens
  misc_feature (1)...(582): n = A,T,C or G
tctccatttcaagatgatagaaacttntnccngagtaatttcttcaagcacttgcataaattattaagcatttgactttattggtaccagtcccctccacccaagtccaatgaggggagactcagaaatgggttaaaggtcacggcagtcagctgtacttactgtttgataatgaaaacttttttcaaaaagtgtttccttgtcagcagggatgattttatataaccacatcaaaacatttagtaaaatattctgctgagatttaaagtaaaaagtcagagatacagcaggggtagtagggacattgttctaattctttgtgggaaggatggggtgggggtgaggagagactccctggtgaaactttgctaagaattagatctctttaggcctgacctcgtgatcggcccgcctctgcctcctaaagngctgggattacaggtgtgagccaccacgccaggccaattagttgtaactctttagtaaaatcaactaatggtttgtctatatgttatacataaattataaataaatacagaccggccgtnccaataagcnccnnaccgtccnaannnnnncccc

SEQ ID NO: 4781 - DNA, 244 bp, Homo sapiens
agatgaacccactgaggtagggaggccagaccatcctgacctcagggaattgaggaaaacgtgcagcttcaaggaccacttctgggctagcggccagagcactggacagagacatagagaacaagccctgtttattcattaaattgcctggatttttgtcccagtaggatttggaggcagatacactgtaaaatatgaatggttccagcacattgttctcactgtttctgtaaataaaaaatga

SEQ ID NO: 4782 - DNA, 215 bp, Homo sapiens
agaagtataagaagtacctttcacctcctgccatgactctgaggcctccccagccacatggaactcacaaaagtggaagtgcatgatatagaagaaaaatcagtgcacgcttaattggctttcaatagaaaagcaggcagctgctcttcttgatatatacatttgtggcacttttttatcttgtaaatatctcaagctaaataaataaaaagaga

SEQ ID NO: 4783 - DNA, 260 bp, Homo sapiens
agtgagcgcgtaaggtcccagtggccagcagggggcagcacgtccacacagagagtccggctgggacgccaccagctgattgaacatgctgcagctactggacctaggacctcatcagtcagaaatgcaaactcactttggtaccttcactgccttctcatgattggcggtgaagaacaaagctccactgaaagacccggataaatggaaatattccatttatgccaaccaagtgcagggtggcacagaataaagaggga

SEQ ID NO: 4784 - DNA, 435 bp, Homo sapiens
ggcgcatccagctttattagtcgtcttttaaaatagacttttctatttcaaacacctccacttaccacttgctgctcatctttcagcacatccactgtgtttccctgtcatcggaatatgctacacggaatatcccagacatgctgactgtttgtgaaagagcagcctcttgaggaagagttttcttttcctcttttaattatgtcattttccagctggcctttttctttttgaaaggtgagcttctgattactgactgttcaaccactaatttcaacatcttgatcacacttactggattgaggcaggaagcatcttcagctgatcatgcacgtctaccttcttactttgcagatgaagcagctatatctcagagatggagcttggcttgtctgagatcacacagccaactagggctgagctggggctggatcc

SEQ ID NO: 4785 - DNA, 428 bp, Homo sapiens
cggatccacagtggttctcaaactttaacgtggatcagaagaattacctggagtgttgtgacaacctagattgctgggccccgcactcaatgcttgaagttctactgcagtaggtctagggtgagtcccgagcttctacaagtttctgatgctgcttgtccaggagccacacttcaaaaaccactgccttaaagtagctagtacagatctgagactcaggaaaaatcctaaaaattattaactaagccgggaaggatggtgttgatgagtgaagccagttcacccattttatagctaaggaaactcagacgcagaaagctgaaatgactggtctccttttacatgttgtgttagtgacaaagccagaatctaggattcttgatactcagttcagtgttctttctggcaccacaataatcttgatcgcc

SEQ ID NO: 4786 - DNA, 260 bp, Homo sapiens
acagtgtgtggaacagagatgacaaatacaggttcaatttgtgccacctgaaagagtgccatctagaagcagttgcttcaaactgcacttcaacgggacccacacgccctgctaagcaactcaaactcatcatgaaataaatctgcagaagaaatgtgtactctctattcaaactctgaagtaaataaaatgtgtatgattgacacaatcacaaaatggcatttaagtggaagtctgcttcctgaagaaataaaagcagg

SEQ ID NO: 4787 - DNA, 440 bp, Homo sapiens
ggatccaggtaactttaaatacttgtgaaatgtgatatacaaaatggtatcactctgcttcagagctctaaaatggagtcagaaagccattctaaaaaggactacctgcacagcttgcaaccttgcaaaaaacaaaaacaaaacagaaacttgccttgaacttttgaactgggccaaactgcaatgaccacagcatcttggaaaacagccaaatttcaacagcactacaactcctgaacagcaacaaccaatgaactatggactcacgtaccaagccagccacctgcaccaatgataattctttcaaaacaacttgcacaatcagcattcttttaaaaatctctactctccttttccttttcctctttggaacacaatttcacttctagcccaatctgtgtctcctgaattgcagttcctaagaccccaataaacacaga

SEQ ID NO: 4788 - DNA, 1018 bp, Homo sapiens
  misc_feature (1)...(1018): n = A,T,C or G
cggatccagggccatgggtctggatttccaggaaagcggagacctcgaggtgcaggactgtcggggcgaggtggccgaggcaggtcaaagctgaaaagtggaatcggagctgttgtattacctggggtgatgcttgcttcatgtatattttctctaatctaaatgtcagttaatgatgaaaatctcatagcaagttattttgaacttaaaaatcatataaataggtcaaaatgtttattttactgtcctactttgctttttttttttttttttgagcctctggttacgttttcttgtatatttactttctcatcctttctcttttcttaccttcctctttgactccttatctttctatgccaaccctctctaaaaagtcagtatgtaatataagttgctcttttatttaaaaaatttaagattgatatttgcttactatcatgttatgaggctttatttatatgtgtattacaaatatatttgttaactactagcaaatattttatgtaataacttcgctattttattaaaatcctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtatagttgatataagctatctttgacatgtacaattccataagctttgatatatacatatacacccttgaaaatgataccacaatcatgatagtgaatatattcatctcccaacatttcttcatgtccctctgtaattttctgcattcaccctgccatccgtccttgtccccaagattagtttgcattttctagagttgtatataagtggaatcatacagaactgtgtgctttttggactgatttatttcagcacaattatttggagattaatctatgctgttgtacttgttaacagtgtacttccttttcttgctgaatattaaaaaagggnnaggccgtc

SEQ ID NO: 4789 - DNA, 225 bp, Homo sapiens
cagtatgcaaacaaaagaaagtcatgcgaagacacagtaagaaggtggccttctgcagaagaggaagagagcccttaccagtaaatgaatttgcctgcatattaatcatggacttctaacctccagaactgtgagcaaataagtgtctgttgttaaagttacccagtccatgctattttcgatggaagccctagctgactagtacagcattataataaagacaga

SEQ ID NO: 4790 - DNA, 298 bp, Homo sapiens
attaaatcagattatgtctgacaaccctctcaaaatgataaaaactaatctgcagagaaaactggctgcagaggaaccggctgcagaggaaccagctgcttcctcctcggaacatgaagaggtgaacagagagatgaagcctctttctcctccctcacgtttctgaatgatcaaaatcaagggcaactgggagaaagaataacaaaaccaacaaactggaggtcaaggagagtttttttcttttttttacctttctgccttttccatttttaataaacagttggcctcgttggcctca

SEQ ID NO: 4791 - DNA, 350 bp, Homo sapiens
taagccatcataacccctgtgacctgcatgtatacatccagacggcctggagcaatggaagaacaacaaaagatgacattccatcatttgatttgttcctgccccaccccaactaatcaatcgaccttgtgacattcctcccctggacaatgagtcccatgatctcctcaccctgcaccatgtgacccctacccctgcccgcaagagataaccaactttaactgtaattttccattacctacccaaatcctataaaactgccccactcctatctccctttgctgaatcctttctcggactcagcccacttgcacccaagtgaataaacagccttgttgctcacacgaaaa

SEQ ID NO: 4792 - DNA, 455 bp, Homo sapiens
cagaatgattcctataagaaactaaagacatctgtattcggggagagaatgtggaggagtgcctttgattgactgattgattagattgattcaactcatcaacatatatcctaacgactgtattttccccgttgaagttggcattattttttaaggatacagtgagaaggtggccatccgtaagccaggaggagggtcttcaccagtagccaaaataggcagcatcttgatcttggacttcccagtatacagagctgtgagaaataaatgtatattgtttaaatcacccaagctatgatattgtgtaatagcagcttgagcagacaagtaaaagggacaaccagaacattaatttatgggcttaacattttaaatactctcactagttatggagaaagttcttcaatataatttcttaactgtgcaccaataaaagactggcctcgttgggccta

SEQ ID NO: 4793 - DNA, 794 bp, Homo sapiens
  misc_feature (1)...(794): n = A,T,C or G
cttcagggccccgcctctggtgaatttggaattccaatatgacttgcccgtaagcagccaacgatggaatgtactcaaggatgaagagaaaattcaatgaagggcttctccgcagatttcataccttaattcatttaagaatgatcagtaactgaaattatatcggaaacttttataaaggaagaaaggagaaagtaagtcatagcataaaaatgcactcaaaataatagcagaggtttttaataaaaagtcaatataaattaatgtactatttgatggaaaacttcaaaaatttcatatggtttgtgggaaaatgtatacagatttgtaaagacttttatttaaattaatatcaattgatatactttaaaaccagggatccacaagatgctaagtatttacaatagagaattaaaatgataatctgtatcacaataattactcagattataagtntgcattatatgntgntgaattntaaactaaactgattaaacaggaactgtgtcaagtttggacagaagtcatatcagacagaagcaggacatttttctttttcttttttttaaagcacagccatgtttacacaatttttccttccactcccctaccaagatgctaagtatttacaatagagaattaaagtgataatctacatcaccataattactcaggttataggtctgcattatatgttgctgaattctaaactgaactgattaaactgttttatttttatcctataagtttgtaataaacagctggcctcgttggcctcagcgggnagtctcgac

SEQ ID NO: 4794 - DNA, 516 bp, Homo sapiens
  misc_feature (1)...(516): n = A,T,C or G
taggatgattcaggactctactcatgcaaacactcacaggctgtggccacacagagaaaaagatcatgtggggacacagagaaaaggcagccatcataagccacagagagaggactcagaagaaaccaactctgctgacaccttcatcttgaacttctagcctctagaactgtgaaaaaacaaatttctgttggttaagacacccggtctgtggtattttgttaagacagcccctagccaaactaacacaattttgtacactaaataaagtccaattcaattttaattttatagaaactgaaacaaataatttaaagatttactttaggtaaattactttcagattgggatcaaatgtgtacatgaattatgaaaatgtaagaaatggatatttaaataagtataccagaacataaaaattccagtgcctggtttttttttttttttttgaaagccacttatcccaacaataacactgatggcctcgttggcctcagcggtngagctctgcgacgg

SEQ ID NO: 4795 - DNA, 569 bp, Homo sapiens
ttgaaaccttcgcagactccccgctgaggccaacgaggccaggcgtttatttctctcacatgtaaccatttggaagctggcattccaggaaagatacgatgactttgttccatgaagtcatccagggatcccgattccttcattgtcatttggtcctcgtatagtattgccctcatttgcagtctgagatggccaacagtcaagttcactgtccaagcagcaggcaggcagagaatgccctcttctttttaaacgcatgacccccctggcattcttaaattttagcaaagttgatttattttttcttattgttttgagtccacagatttggcctctttgattcctttttctgtgttgtcactgctgtcgacttttcttcagtaagagaattaggatacactcttgcaaagcctgtatgccttgtttgcttgccagcctgtggaaataaggagccttagagtgtggctttgatctccactttgaagtaggtaaatctgctactctgaatgtgggcagggatcctcgggaaattgttgttgttgtagttgttgtttttctcttttcctgaa

SEQ ID NO: 4796 - DNA, 694 bp, Homo sapiens
  misc_feature (1)...(694): n = A,T,C or G
gcagaccaaccagaccagattaatgtcagattaatgacatctctgacaaattaagttttgagatggagtgaaggtaggggaaaagctcatccaactatgctccatttgaagtctacttgtgtccaaatgggctttctggaacctgaggtcggatgataaggaaactgaggctcagaaatgacctgcccaagatttctcagcctccaaattggagcaagtaatgaagcccatatctatctgatatagcaggattctctgaaatcatactcctgatagtgtggcagaggggcaaaaacacctcacaagtgtaagattttacatttagcaatttaacgtccaatctcatttaaaaaatgaaagtgtaaaaaatatgatttctatacttccatacacatatgttcagaaaataaaaaggaatggaagtatattctgtggtggctattgttaggtgagaataaaggtgattttattttcttctttttgttttatgataaattttttctgtaataaatgttttatattttctgtaataaatgttttatatttctgtaataaatatgtttctgtaataaatatgtagataaatttttaaataatatatttgcctgaataaaaaaatggcctcgttggcctcagcggggagtctgcgnncgtctcaagcntcgtggcncaccgggggngctnttcgaaaggt

SEQ ID NO: 4797 - DNA, 333 bp, Homo sapiens
ctggaagtcaagaagtccaatatttcaaaggagcacacgaagcgggatggctgagttacagttattttttacaacagagctgctccgatgtcatgggaagtctcctcaaagccccagctctggtaattaaatgaaacacaaccatcctacaccacaatggctgggcactctcccacggaatatccaaagaagacaggaatgagaagaatcagccatcaattgcgttttaaaatttaaaattaaaagaagtatttatatttcatatttcccttaatgcaaatttttgacattttctaaatttctacttattttgtataaaaatgagcttatgat

SEQ ID NO: 4798 - DNA, 710 bp, Homo sapiens
cggccgcagagctccccgctgaggccaacgaggccatatgtttattcataaaatagttgctgccctttatgatatttttaaattaatggaaattaataataacccacaaactaaacaggaactattgatcagtgaaatctttttagtaaatggaatagtttttaaaatctcacagatgaaaagttagccatagcatttatgaaagttgttctgactctagacctgttaaaggatggagtagggaatagttacatgtgaatttagtgtcagtttgcttaactgccgctttaaatatcagggcaaattttattttctggtaaagacaaagtgtgctgctttttgtactcctttatttttatttcgctgtctcttcatcttataattctttcttgtgtttttcctttctgatgcttctcactgtccagcgatctttgccataagtgaaatcaattgatgcttttatttattccttttattctacaacatttgctcaaggttgttttgaggaataaatgagttcatatgtttaagcagcatggcagccccattaagtgtttatgacattttttagataatatggcaaacacagatgtactcatcacttatccagcccttggaagaggcacgcttaagggcatgtttgagtctgttacagcatggccttttaaagcctataaactctaccttataattcccccgttttttacact

SEQ ID NO: 4799 - DNA, 669 bp, Homo sapiens
attctccaattacggctcatttttcttatattcccagctagttttcagccattattctagcaacaaacataaatgaaacaaagcaaattaattcatttattcaaaaaaagtattggtggtctactatgtgcaagtccctatgccatgtgctgacagaattcaaagatgaataaaacatatctccaatcctcatagaacttacagtcttatgcaactggaaaaattacttcaacatttattaaatcatcagtttatgtagattgacattcaatacacattggttaaaaaaagatataaaggggaaaggcaggaaatatatgagaaatagcccaaaaaaatgtgagcaaagaaaatatataaagaagaaatcagaatagctcatatttcttggccaggcaccatggctcacacttgtaatctcagcactttgggaggctgaggccgctggactgcttgagaccaggagttcaagacgagcctggccaacacggcaaaaccccatctctactaaaaatacaagaattagctaggcgtgatggtgcgcgcctgtagtcccagctacttgggaggctgaggcaggagaatcacttgaacctggaaggtggaggttgcagtgagccgaaatcgtgccactgcactccagcataggtagagagtgagaccccatct

SEQ ID NO: 4800 - DNA, 219 bp, Homo sapiens
ccctttagcagtgtccagtgtgtgctggagccagctcctgcaggcttgcaagccgacggtgcacccagctggtcccaactctgagctcagtgatgtggagccgtaggttgaaagtggccacgatgggagaatttacaccacagcaatggacaaatgctacaaaccaaagctccctgcacccagtctgaccccaataaacggctggcctcgttggcctca

SEQ ID NO: 4801 - DNA, 117 bp, Homo sapiens
ggaagcttgactgtgatgaataagtcattaacagctgcgtatcatgagagaaacagatcttacagctgggctccaagcaagttaccaaaacaactaacaagcaatacaatggcaaca

SEQ ID NO: 4802 - DNA, 416 bp, Homo sapiens
caagaaaacgagagctcaagcagtgatgaatttcaagatggcaatggcagaactcaaaattgcatttgtcagtgtccaaaaccactgttcttccacaagtcttttttatatagaattctttttctgtaatctattttgtttatgatagctaaacattcagtttcatttatattatgtattttatcttattgtttttatagtattttctttctctccatacattctaatcagtttattcacatggtcaaacattaacagcagatatttatgacaatttctatttaaaaaccttaaacattgattacattttcaattattttctccatacaggcatacctcagaaatattgtgcgttcagttccaaaccacaacaataaagtgaatattgcaataaacaactggcctcgttggcctca

SEQ ID NO: 4803 - DNA, 315 bp, Homo sapiens
cgcgcagcatctgactttattcattcatcaagtatttatgaaatgcctattttatatgtaacaggtactttcgctgaatgtgggtgatatagcaatgaataagacaagcaaagtgaattctatgaacaccacagtagtaattatgtaataaccagtttttctggtttctagagttcgctggtttccgtactttaaatactcccactgtggccaatttcaagtcactgacatggcatcactgggaagctgggaaatgatgcaacacagttggccttcatgagccggtaggaaccaacctcagcactcctctggaac

SEQ ID NO: 4804 - DNA, 602 bp, Homo sapiens
ttttttttattttgtttcattattatttattagtggtgtgaattcggccgcattcttttttatttcatctaaagtttcttttttggtgtagtcaaaggcatattctacatttctataggagctgccgttcagattcagagaagcgattgtccaagttgaggtaagattcagcaattccaggagaaagcaggtcagggaagagggacatagtccataggtttctgagcactgttgctgcacatgttggtttaacaacatgcaacctccaaagtctcattcatggtcatctgggtcaatagttgctgcaatgaaaatcttccatctctattatttccagatttttctccatttacctgtgatttctgcttcctgtaagcacttaattggattcttctcagaaagatgtccagaaattgctggcaaaaatctatgtctgctctctctcaataccaatgcacctacatgtggctgtctccaggtaataacaatgcatctttgccttctactctccgaataatttgcaaatatccctctttgtcaaaatacaactgaggttccactggcaaggggatttagaaattgcagttttcaggttttgtgcc

SEQ ID NO: 4805 - DNA, 617 bp, Homo sapiens
accacagatagaagccttgagaagcttactttggtcagaaattttgcctttgtctgcaggcttctaccagttcgattccatctgtgggtcttaggtttcagttacctgaagtcaaatgtggtccaatacacagactggaataagagacattggagactccaaaagaatattttctggtagactgatatatttctcctaaaaaatttggaaaaattttgtgatgaagaagctacctgggcctgaagatatcttttctggacaaagtaaatgaatgattgaagacctgcaaactgtgtttgtaacgactttctaagattgatagcctccgtgtttcaatgctcatggagcagatggatatgactgacactgcccttaatactacagcatgatccaaagcatcaccaaagtcttcaaagagaaagtaaaaaaaaaaatgcctctccattttcacttctacttcaaatcctgcaatttgacataaaaagacaatatatctgtctccttcactagactaagggcgtcttaaggtagggctcatggcttttttctatgttctccatacctagcatacactatacacatccatttttttaaaaaataaatagcgatcggccagg

SEQ ID NO: 4806 - DNA, 756 bp, Homo sapiens
cggccgatcgctgtttatttcacctgggtgcaggcgggctgagtctgaaaagagagtcagcgaagggagataagggtggggccgttttataggatttgggtaggtaaaggaaaattacagtcaaagggggtttgttctctggcgggcaggagtgggggtcgcaaggtgctcagtgggggtgctttttgagccaggatgagccaggaaaaggactttcacaaggtaatgtcatcacttaaggcagggaccggccatttacacttcttctgtggtggaatgtcatcagttaaggcggggcagggcacattcacttcttttgtgattcttcagttacttcaggccatctgggcatatacgtgcaagtcacaggggatgcgatggcttggcttgggctcagaggcctgacattcctgccttcttccactgtgagagttaccggaagctcagcgtttgtgatggtctgggggcttctgaggcaatcgggcagtgtcagtcttcagccgctaagccgagaagatttgggaaggagtcagtcagagagccttgggccagagttccagggtctttgggaggggctgccaggtgatttgaacaatctgattttcagtgggggtccacaccaaagggacccgggtttaggaggaatccttgggctgcggccatttccttgggccagtggccagaattccgggcccttgtacaagctcctgatttaaaatgggggaaatgttccttggggcttgggggtcttaagag

SEQ ID NO: 4807 - DNA, 190 bp, Homo sapiens
aatattctcctactataaaagcatttgaatgtccacaaaaagaatactaaagaagactcaataggattgggcacctgctcacagaaaacccaatgtcctgtatattaaaagatgaagatgtgcatcaaatttggctcacacaatatgcacccacttaaacatatttaaaagcttatccaataaaagaaga

SEQ ID NO: 4808 - DNA, 536 bp, Homo sapiens
atttcctaaggaaaatgggcacaccagaatcctggagaatctgctccaagaactgataccaagaattggatctgagaggtagaaggaatgaatcgtagtggatgctgcattgtctacatctccttaggactcaaagacttagtcttccaggtgccagctgattacctccagctgtcaggcctcctggaaactgggctcagctagagagaactggcttatccaagatcacactcccttcctggggaagtctacatcaatggacagaggccaacaatcaaagaaatgagacttaccagatcaccacatctggacaatgagacaccagacaccttacctgtcatgattgcctaaccgaccacttgtttcctgttgaccaagtcctcttccttacccctctctaatctgtgttttcccacacatagttacatttcttccctgctatataaactcctaattttaattggttgaggagatggatttgaaactgatttcccatctcctcactgaagcacctgaataaagccagatgctggccg

SEQ ID NO: 4809 - DNA, 652 bp, Homo sapiens
ttctgtaaggtgccaatgccaaatgttgatgagattgtgtaaactagaactctcatatattactgatgggagtgcaaaatgatacaaccgcttctgaaaaatgtttcacagttccttacaaagttaaaccgaggcagaatgttgagctcatttctttgcatttcccttctctctgggatcgcctcagcctcttacaagagcagtgattcccaggctttctcagcaatgtaccccatttcctgacatttacagctgaaggtgaagtttcccttttgcaaggagaaaattttggtggagaattatccaacaagaaaaagacctgtggctattaagatagtgacgtttaacaaagtcatggccatggaggaaagtaaacttacaaagaatgtccataatgaggctgtgagtgctgatgtttcagttgaagagacaccatttagcattctggagatggctacatgcaaacatttaaaacttgtaagagaatacagtgcaccagggggactactattatgactgtctggaggataataccacgagtttggagtatgcttcttagccagggtccccttgaactaaaccaactaaaataaaaagagatgcggccgatgcctttcttattatatattctctatacttatctactcccaaa

SEQ ID NO: 4810 - DNA, 634 bp, Homo sapiens
ttctagaagctgagaagtccaacatcaaggcacaggcaggtggcaggtttgattgtctggtgaaggctgccctctgcttccaagatggacccttgttgttgcattttctggaaaaaaggaacactgtgttctcagatggctgaaagcagaaggaacctcaggccaagtgttcttgacagctcatccacagactcccactgatctggaggctgggagatccaagatcaaggcacttacggatgtgccaagtgtctggtgagggcccactttctggttcatagatggcacctactcatggcatcctcacatagcgggagggtgcagctagctctctggagtctctgtcccgataggctaatcacttcccgaaggccctaccttctatactggcacattgggcatcaggtttcaataaatgaatgaattctgaggagacacaaatactcagactattcataacaccagcctttgctgatttttagtttacctcacccaagtttcttttattatttccctaaacataagtttttccataattatcatgttaaaagtcacttctgtgccacataaaagtttgaagtcaatgaagcatcaaaattgtatattttcctttttatcactaattaataaaggc

SEQ ID NO: 4811 - DNA, 904 bp, Homo sapiens
attttcccccactatgcagaaatgcgaggaaatgggactctagagatgcaagttgtgataaaggaaaaaggccaagatgaaagaaatacagcacagtttctaaaaaaagaaactgtggttaccttatgtggcccagggaagcaagttggaccttggtatctgatggcaggaaagtaccaataacaaaagaaagaagaagcacagaagagttcccaggagaaagagttctgcttctcaattttgctcactctgcctctctgttattcttgtaaaagggtggcatttgttgtaagggggacctgtgaagggattacggatggctaaagaagacgatcccacgagtggaaaaatactgaaaagtgtcatagtgtaggtgaagaaactcaagtgaaattactcagagcagatcacaaatattttagaccatataatgcactcagcattggtcctagagcatcataaacaattcaatgtaaggttcagttcacattcctctccaattcatcctctgtattgtgcccattccgtcttgtaatatttcctatcatcatcctcttgtcctccttttccttattaatgctgttgttgatacttattttcattatttctccttcctttacttcccatcctgacaatagagatcctacccaaccattcagttaacttcactagtatttgagttctacctccttcattaagctttctccggctaatcctaacctgcattgacctcccatttggggattaatatctggtttcacactgtcttaaattgttccttgttactccgaattattatttaatcttgtcagatgaataaagtgacaaatactttgaaggctgaaaccatagccttgtttctctgtattcaccataataattagaataatgtgaaataatgtgg

SEQ ID NO: 4812 - DNA, 337 bp, Homo sapiens
cagaaaaatcaaacgcccagagaggtcaagatgtctgcaaagagacacagagtgatgcaatggaaatcctgtgtggaggtctccagaaggctaatttctgaagcagtgttctatccacatgaccgtgctgctgctcattaagatgaacaatggaaagtagaaagaaatctcctccaaggtattagaatcatgtacagtttcatatttgactaaaaaattatttccccagcctgttttctcaacactaaggatatgcagaaaagtatcacttgcattcatcatgaaaattacagaaaaatgactgaaactactgagaacattattaaataaaactcga

SEQ ID NO: 4813 - DNA, 504 bp, Homo sapiens
aacttggcgcgattccaggagacaagcagacgctgcagtcgtgtttacccggcatgcttcagcaaactttcaatctatttacaggcagctggtgaggagtagagtttgatacatgcaagtcagaagcttatttctcagagttctggaggctgaaaaatccaagactgaggttccagccagcatggttccagtctcgcccagagatgcgcacagccggtgcgccgtggctctcggacgctaggtggcgctgtctgcagctcagcgtcctcgccccgccgggcttgaggtgcagccgcgcctgcagggggtttcagaaggggcatcagcagtgatgcgtgccgtccttccccaggcctggctaacaaggaggaaggaagaacacattcccaagggaaaagagacactgcgagaatcacagaccacccgccgcgggaaaactggggggagaaagaaatttacttgcaaaaaaaatgtgaagggcaaataaagtatgatcggccggag

SEQ ID NO: 4814 - DNA, 272 bp, Homo sapiens
cacagaaaagttaagactcttcagtgggacctgctctggccagtgaaatggaaaagaaagtgacatgtatcacctctagtggaaactctaagagccagtgcaccatttaccgaattttatttcctgccttggcaattgtggatgaatttccatcagcctaagtacctgagcaagcccttctacagacctctactagacatgtagcataaaggagaagcaaacttttgttatattgagtgagatgtatcatccattctaataaaaaaatcata

SEQ ID NO: 4815 - DNA, 239 bp, Homo sapiens
ggccgatcgccttttattttttaaagtttatttttctgggaaagaaaaatcttaggatagtctaaagctctcattaaatatgggaaattttatagaaaaactttacattaacaatggttattaaaatgaaactaagttttatatcaccaaaaggtttcaattcatacaatttatagctttggaaatgtaaattttcacaatcttttaaagtaaaatttcaataacacttcaaggtagca

SEQ ID NO: 4816 - DNA, 229 bp, Homo sapiens
aatatggactcagtgccttgtccataaatttctgaactttggatggaagagtatgagtcattgaaatgcttcaagatacaacactgtttctcaactttcttcaaaagacctcagagtggaggaattgtcatttttctcttacccagcacaggatcaatgaacctctctcttttcatttgctttgggcctcaataaaaaaattaaaaataaaaaccgatgctggcctgaa

SEQ ID NO: 4817 - DNA, 324 bp, Homo sapiens
  misc_feature (1)...(324): n = A,T,C or G
aagttcttttagaaaatatggtgtcagatgccacacagtatctttcctcttgttcaagatcttcagcagaggctgaggctgaagacagaacatgctgagcaccagccacaagcccactgagagggatgttccctaggaactggccccacccacacccccaccccantgaacaaccactccacatatgaggagagctcacgggtcgtctttgggcctttgtgtttggttcatgaaaacagcttatttcttcctcactctaccggggtgaggggagatccccaagagaattattccaaaactttgagtgccatcaataaagaggga

SEQ ID NO: 4818 - DNA, 341 bp, Homo sapiens
tgtggttacaaaacatttctgaaattactgcctgcttcactcattacatcaaccaaaccacaggtgggctcaacctaatcacatgaattcttaaaagtggataacctttcctgagtgtggtctgagggagacgtgaccacagaagaacagtcagagaaatgcaatgttgctggcttcgaagatggagcaagggaacctttagaagctggaaaaggcaaagaaacatcctctcccctagagcctccagaagaaggaatgcagcgctgccaacatatcaattttatcccagtgagataacttctgacctccggaactgtaagataataaataaggatcggccg

SEQ ID NO: 4819 - DNA, 540 bp, Homo sapiens
agagatatctgaaattgtgatagtgaattggccaaggtaagacagaggtcctggatgcagaaaggctgtgaaacttgcccattgtgtttaggaagacaaggccaaaatgtaacctggaccacaagattgtatgtgatgtcaccatcctgaagacctataactcagagatatccatatatctatatctccagctacaatcctcacactatctctctgcctcaaagatacgatggattgtgtcagaccactgcaataaacataatgtagaagcctctcctggagactctttgaatctacttcttgagatccatgacactgtctgctatgtcgttgcagagcttcttgcatggaatgatgatgctgtcatatctgtgtgagaaccacagaattgcagcaaccactctagtatcaggaagagaattaaagagccatgctcaagatggcaaagaggaaaaaggagcaatcattgttcaataacccaatgatattgccaattcactgaattaataaaacctggagccacacctaaaaaaaaaaaaa

SEQ ID NO: 4820 - DNA, 143 bp, Homo sapiens
ggatcttcaatggagaatcactgatgtcaagcccaccaaccgaatagctcagaaactgtcaaagatctatggaccataatataaatcactgccctcaaactttcttgccgaaaaatgtgcattaataaagcacgatgcgcgcg

SEQ ID NO: 4821 - DNA, 709 bp, Homo sapiens
  misc_feature (1)...(709): n = A,T,C or G
catcccatcttttaaggaaccctccttcttctacttctatatgacccacggggggctgtgagtcatggtgccccacctccacctccacagagcagcacagaagatgcagcccctggcctcagagatggctgcagggatgggcatgctacctccatacacagagaannanctcttttcctgagaccagaggctgaaaggatgatgtaaggtggggttgcttggggccatctctctgggctacacggaagaaggcatctaacataggagagaatganacccacctcaaaagaggcagagatggaaagaacaatggctgatatgttggggtgcggattttgtatcagaccctgctccaagcacactgtgtggacgatctaatttactcctcacaaaaatcctaagaggtaatattattatatcaattttagagacaaggaaacaggggcactgagaagttaagcagctcatctgaaatcatccagctagttaggtggtggagtcctggattggaacccaggctgtgggactccaaaacagtcatgctatgctctgcgtgctatgctgccttatggatgagccaagatgaacataaatgggagtgagatggatttactcatttatgagcaagtgcaagagataactgacagcatcttctagctcctggatctagctgtgcctggagccagctgactcatgtgtttttagttaa

SEQ ID NO: 4822 - DNA, 504 bp, Homo sapiens
ccaccttgaactgatcaaaagagagacaccaggaaccaaggctatgctgtgtttcctcatgaaaagggatgtcatgttccctaactttgcgttattctgtgcaacatacatcccaaagtatatggctgtgtatcaactgcaaaagggtacttactggttcacaggaaggatggaagagagacgtggaaggcaaggagcttcctttgaagaatatgaccaggaagttgaacatgtcactgctgctcacatctcattgatcagaatctagtcacgtgaccacacttaactatgatggggctgaaaattgtattctccatctgagtacccatgtgcccttccaaaactgtagagcgggtggggttcaatactaaaaggaagagtgcaatagaagagcaataattggaagcaaatagtaaaagcatgctgcaatagttttacagatttttgctgattaatatcatgaaagttcacatatcttacattaaaataaatacagatcggccg

SEQ ID NO: 4823 - DNA, 240 bp, Homo sapiens
ccctgcactggatggatcagctgacaccacccagaccgtggtaatctggctcaaccagttctgccaccccacccaggaacagaagacagcaagcaaacctcacttcaatccctatgattccatctccaacctgatcaatcagtactccccacttcccgagaccctacctgccaaattatccttaaaaactccaatccccgaatgcttggggagactgatttgagtaataataaaacttga

SEQ ID NO: 4824 - DNA, 211 bp, Homo sapiens
ccttgtttatttagaggtagatatattggtcaggtcaggcaagctaagcttcagtaacacatcaacccttacatttcagtggcttcacccagtgaagatttgtttctcacttaggctccaagggtatcttaggctggcaggagatcagctgcacatcatcttcactgactctcaagggcattgtggtgtcctctcacaggtcctctgtatt

SEQ ID NO: 4825 - DNA, 308 bp, Homo sapiens
tgtgactaccaaaaaggaagaaaggcaatggtatcaggagcactttcacagggagtaacagcagcacttcttaaagataccattgtgttcccttgctctcaggaatagatatggatccttctgatgcttttccatcacagaaagtaaattcacgagtgtgcttgccaatctgaacattgaactacttccaaatgatcgcttcatccaagctaatggataactgtagtctgatagtcaagagctcattgatgtatttcctgctccattactcaataaacattaaataacaataaaagtagatgcggccg

SEQ ID NO: 4826 - DNA, 191 bp, Homo sapiens
aactctcaagagtacagacttgacaagagaagtggctcctcaggatgggagccagtagctattctcagcactgtcctgttggccagattgacttggcaagactgtcccttcacccctgccttcctgtgctgggtcaagagtgaaggacactgcctttgggatgctcttttaagatcctcaataaaccatga

SEQ ID NO: 4827 - DNA, 466 bp, Homo sapiens
cagccgagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaagatatttaaataaagagaga

SEQ ID NO: 4828 - DNA, 153 bp, Homo sapiens
agaagtgtagtcattttattgaaattgtgtgcataaagataaagccagcttaaaagaacagcaaggagttgaacattacttcaattcatctgaaatgagttgttgatcaactaaaaagaagctgtgaggaaagaaatgctaaataaagccaga

SEQ ID NO: 4829 - DNA, 140 bp, Homo sapiens
cactaaggaaaaggctgcagctggtgagtgtcgcggtcaacaacgttcagtgatcattacacaagatagagcctgccaagagaaaaagagatctcgaaaatgcctggtggttgtcattgctttgtatgtgtgaataaagc

SEQ ID NO: 4830 - DNA, 322 bp, Homo sapiens
ctccctccttttaagcggcatagtgctgtgccttcttctgagaaaaacacttcccaaacaggtatttcccccatgtgacccatcatcaaacagactatggatcttggtcaataatacagattctgccaaccatccgtgagttattcatacaaggaagatttttaagtggaagtctggagacttttatttgtttgggggggttcccatggcagtattaagggaaacattcaaatcacactcctcaccctacttgctgagatctgtggattctgaaatctgctattgaagcctcatatcctcaaataaaggacgatccgccgaa

SEQ ID NO: 4831 - DNA, 253 bp, Homo sapiens
tggaatttcccagacactttgaaatatatgtatctaaggtgggggaagatatatgaatatgcttccttgactgatgcttcaaaataacgtccatacctaaatctgatgaagcttctagatccagctatcaatttataagagagaaaagaagaaagtgttaaactattacacggagatacaattgcaacatccaaactgtggaaaaatctacagggcatattacctggctacttcaataaaatgcgatccgccg

SEQ ID NO: 4832 - DNA, 695 bp, Homo sapiens
  misc_feature (1)...(695): n = A,T,C or G
ctcttatgttggagaagactttatatgatcacttggaccagtaattgccaattctggatggtcaccagagggttctttaaaaacagttgttcggaggtggtgcccttgaggatgccccactggggacctttgctctcgtcccctatgcagcatcacctctcaacctgggctcttggctcanatcaaatgtgtcctatgtccctgtagttagttccttctacttctctgaggaccaagacaattccaggaagacacaggctccccgggactgtgactttctattctctcctttgacttgtcttcctgtgtagtgatcaaagtcctcccatttctggggggaacgtcacagtttacacagcactttcttcacgccaatagcatgaagaaaataacacctgccctttatctccacatgagacacagacaggtcaaggacgtgtgcaagttcaaagagcaagagtggaatccagccccccccagcaccccatgatggaaggggaatgcccgtggctggcccagtcacttacagctctttgcccaggggcagctcacgaaaagctcaggttcttcacctgctaaaagatggcagtgatagtggttactgcacagggctccctagacataaaatagatttctaaaagtgctcagcaaaatgactagcatgtaataaacgtgcaataaatgccgatgggccg

SEQ ID NO: 4833 - DNA, 165 bp, Homo sapiens
ctgtcttggcctttaccacccacaacgatggccccagccagacacaacggcaaccgtatcaacccaaattgtaatctgaccgccttgggccatttactcacagcttcttgggctcgtgctttctcagggccatggtcactcatactggcttggaataaacctcga

SEQ ID NO: 4834 - DNA, 448 bp, Homo sapiens
acacttgtgatgacactgggcccatctggatgatccgggatcctctctccatctcaagatcctaaacttcatcgcatctgcagagttccctttcccagagtgaagctgttgctacattgcccaggctggtctcgaactcctggcctccagcaatcctcccacctcagtctcccaaagtgcaggtgtgatccactgtgcctggccaagcagagaattttgtaaaaaattcatttgtaccattagaacagcctattccaactaaatgagataatatgtattctttcatgctataaatatttgttaagcacatgctatgtgccagacactgtgctgggagctaggcactttgtgacaagcagaagtagacaagctttccctcagatggagcttttaggctggcagagaggacaggcattacataagccgtcaaataaataaagatcggccg

SEQ ID NO: 4835 - DNA, 385 bp, Homo sapiens
atcttcaacaggaaagggatcgggcaccactcctggaccaggaagcttggatcaggtgctgccgccactcctgaggcagatgccactcggaatccacaaagccagctaatggataccaaaatatggcagtggaaaaactccatgtcttcaccgccatatctgtggtggaaaaaatcgccaaatgtcatgtcaaatcacctgagtagtgaaatctaatttgcatccagaaccctcgctgcaaggaagtcaaataacgtgttcttcagcttcctaatctctgcagttcaggaaaacacaccagaaagggatggaaatggattctgagagtcaaagacccatattcaccccaagcagtgtataaacgtttgcaactaataaatgccga

SEQ ID NO: 4836 - DNA, 513 bp, Homo sapiens
aagcatacttctctccccattgatgttggccaatgagcattaacagacttcacccaagcaggggcttgaaatgctcatgaaatgcctgtcccttgtgcttctgccattgccccaaggagagcacatgctaagcagcacggcacgggaacagctacatgaagctgacttgaaacccacctgcagcctggagccaagccaagccctgacttaatcagcttaactccaagcaacctgctgatgtgcgagcaagaaatcaatggttgttgccataagccattgagtttgggggtggtttgttatgcagcatatttgtgagaatagctaactaatagaatagctaatagagctctgttctcgagataaaatggatagacaactgattagagctttagaaattgtatcgttttccaatcctggcaaacaggaattcaaaccttattgtaactatatttgctgagccagaaacatttctctgccaaaaaaataagtttaaaaataaatgcagatcgcgcg

SEQ ID NO: 4837 - DNA, 847 bp, Homo sapiens
ttactgcaaaaatcaagatgtatcttcaaatgggatttgcctgcatatatttattgatcaaactgagagcttctattcagttgctcctacagcagggagaagtgagttacagagactacctgactttgactatgtggacttcagaagttaatctctgctggcatcttttccaaaaaaagattaccaccatcaattccaatgtgatatatatttgtataaagaagatagttccaactgcaaggaagaacaccaaaacactgagtatggagaagagtgggagaatcattgtcccctgttcagagcatgaaagactgcccacggtctgacaggagaccgtgttggtcttaaaacgtaattaaagattctttgaatatgttttctcctgctcaagtaataacttgtgattttagtgctgaattgccttaaggaatatattgtttccaaactttccaaattcatgaatgttaattagactaacactctaaggccattttaaatcaagcctctcttgaaataagattaaagtcttagatatttcagtagttatataaatcagggtatatttaaaattttatttgatcatctgaaatttaataaaaataaatgttttgtgagatagttgatgaatggggagaaatctgaccattcaagtcagctacaaaatatcttcatattctttcagatgaaaaaagaagtcccagaagcctaattattgacatgatatcaattcattaaggtatatattgacaggtcttctctagagaaaaagacttagcaggattgatgaagcatgttgacactgaagagagagatttggaaataaataaatccagagtccgcgctgagg

SEQ ID NO: 4838 - DNA, 966 bp, Homo sapiens
tgcctattgaggaagaagaacagatgcacaccaataccgactgacataattctccaagctcttcttccaacttctcaaaggcaaaacagtcttctgttcgcaaaaacctccgaggctttataattttaggacataataaagtgaatagagaaaaaaagatatctggaagataagagcatcacaactacttgaggactttgtaacacttggagttttgttactctctgtggttgttgtttgcaattggatgaaaaactcttaatagcttccaggtagaaagatttaaagaacggaattctgaagtcttcaatcaagagcatgaaggctcataaacagtttgattttatgacctttacccaaacggattttgtttttaaagcattttggcaaggcatgttccaccatatgaaggcagaaagaacatttagataagtgcatgccgggggcttggtttccattaagagggaattcagcactcttccaaacagaaaggcatcctggacacgatgcaagaatgacattgtgagaagagatccagatttagcaatgaggatgcaaacatgaaagcaattccttgatggaaagacgttttaaaattctgggatctgcaggccagagcctgccattagaattggcaaagaaagaagaaaatactgattttcattttggcttttgccacaagtactattgctttgtgatgctttcccaaagtctctaaatgagatacttggtgtgtttttcaaagttcctgcatgccgatgctagcatggaagacacaacacactctttttcctttctatccagtggaaacagctttagacactaagccgttatgaacgtatgttgaaaataaagtttattttccaacataggtggtgacctgatcattcctgttttgtaaaatcatagggacatataaagacaaagtatgaggtacaaaaaaaacaaataaagagcgatcggccg

SEQ ID NO: 4839 - DNA, 743 bp, Homo sapiens
cttcccagttcggcttggctgagggtacactgtgtgccagagaagcataagggccgctgccaccattaagtagagaaaagaatgcggaacagcagggcatggtggctcacacctgttatcccagcaccatgggaggcccagggtccacggccaagctggacagattcttctcatggtgatggcagatgcatgagaggaaaagtagaaatatgtaaggtctcttaccatcagctctcagacttggtatcaagactcatctgccccattccattgatcaaagggcagccctggctgtgcgtgctcacacatggcaatgcacgggagatctgcagcccggacaggagctggagcacgtgggaaggacatgaggcaaatgctcaaggactcgagaacagcaggccccaatggtgggaggggcaccctttgagcactgttacatgggaaggccatggcacggcgccaggctcatggcagggactttattctcttccaaactccaaccatgaatccacccaggtgtaaaccttctacagtaagccaattgtgcctactgaagctctgtagacaagtgctgctcaaaatgtcacctgcagacctgtgctgctctgcaaacgcttggttagatgtccatgaaggggaataagaagctcgcactggaatgtacgttactgtcactcagcgggctatttagtcccgctgactttttccacagcaagactttctcaataaaggatgatcgcgcg

SEQ ID NO: 4840 - DNA, 216 bp, Homo sapiens
ggtggagtcattcctgctacacttgtgtcaagtactgtataatttatgatgtgaagccatggagtttgagtcaacccagatctgagtttgaattccagctgtgtgacccaagcagcaaagtggggcaccaaggccctgtgctaagcactcataatcctctgggggtgctacccctacaaacagcacccccaccatgtttaacctaataaagaaaga

SEQ ID NO: 4841 - DNA, 687 bp, Homo sapiens
agatatactatttgttaaaaaaaaataagaaggaagaaggaagaagaagaaggaggaggaggagaaggaggaagaggaggaggagaaacagaagaagaagaagaaagagaagaaacagaagaagaagaaacagaagaagaagaaacagaagagtcaatagcagcagctactaattgattgaaatctaagccacctactcagaatatggctacattttatgtttttcccagcagacttacctattctaactatgcaggcatgaaaaagaacgagatcgtgtccttcgcaggaacgtggatggagctggaggccattatccttatgcaaccaacacagcaacagaaaaccaaatactgcatgttctcacttaaaaggttaagctaaatgatgagaacgcatgaacacacaaagaagatcgacagacacgggggcctatttaaggctggagggtgggaaaagggaaaggatcgggaaaaataactaatggatactaagcttaatacctcggtgacaatataatctgtacaacaaacctccatgacacaagtttacccatataataaatctgcacgtgtacccctgaatttaaaggttaaaaaaaaagacttaacctattctagatacttaatataaatgtaacatgcgaaataaatagcgtttcgcgccgaagctttttttttcttttct

SEQ ID NO: 4842 - DNA, 462 bp, Homo sapiens
tgagaaaaatttagtctcagaaaacaaagcagcaaaataatccggatgttcttcagttggtaaatggataaaatatgttacatccagacaatgaatattattcagtgataaaaagaaattaggtatcaagccatgaaaagacatggaagaaccttaaatgcacattgctgagtgaaagaagccaacctgaaaaggctacatattgtatgattccaaccgtatgaaattccggaaaagactcagccagcagagaggagaagcagctggatgtcagactacacctggatgttggagagaagctgtttgacttcagaggtacagcttgttggtttaactttggagaagaatccaaccagagatggtcgtacttcaggggaagattaccttcctgcctcatccccttttcagctccccttcctgctgagagccacctctgtcagcaataaacccagatgctggccg

SEQ ID NO: 4843 - DNA, 421 bp, Homo sapiens
agaccgggtttcgccatgtagttcagttgctctcaaactcttgtgctcaagtgatctgcccgccttggcctcccaaagtgttgggattataggtagttttggaatatatcattgggtgaatataccatggtgtgaatcctgggctctgtctgctatccatctgcagccccaccaccagtcttgaaaacagaatgtgatgagaagtcaactcaaaaatcaggactcataacatcaatccatgcctttgggttcctagaagagaagtaacgtagcattgaagatcgaagaaggtcaccataaggaaaaattcccaaagcaaaaaacaagctttgtgtaccaccattccatcctgtgcatccgaggtacactgggtctggcataaattacctcctcaattaataaataaatctcgatgcggccg

SEQ ID NO: 4844 - DNA, 507 bp, Homo sapiens
accagactatgagttacccagaaccctatctcccttccaccaatgggagctggcaggaggaggagatggacaggaaacttggaaaactcattcattcattcattcattcattcaacaagaaagtatgactccaccccaggcactattccagtcactggcagtacagaagagagcaaagacaggggccatttgacagcatcttcagaaacccccacatcatctagaccctgggcttcccacccgccaggccaggctcttcctgctagtccatgctgcctcctggggctgccagttcttcaaccaggcccacggggcacccacttgctggctgaatttctccccctgcatcccagttctcctccaagttggaagaagtctttgtggtttggatgaaggaagggatgaggaggagggggacagagcaaagtgtgtttgctggcaccagaatcacagcagaagccagtgctggaaaccttcccaagtatttagaaattaaaataaaaaaga

SEQ ID NO: 4845 - DNA, 284 bp, Homo sapiens
cgaagaaggctcctgttgcatcagagaaatctcgaggaaagaaaacagaaagatgcatacttgagataaggtgctgtagcctatgaagagtctgaactcacaaaaaactatcttctacaattgtggctgaaattagatatggaccgaagagctgtgacaaaggacgtcagagtagtttgccacagtcctgttatctagatattctaaaaactagatattctttaaaaagcttttaaacattaaaacatactttcttaaaaaataaaccccgatgctggccggat

SEQ ID NO: 4846 - DNA, 308 bp, Homo sapiens
gaggaaaccggaagccatgttgtgaggacactcaagccaccctgagaagaggcccgtgtaatgaggaaataaggcctcctgccaaacaccaatatggacgagaagcctcctgcccatagccatgtgagtgtgccaacttggaagtagattcttcagccctggtccagccttccaacaatggcagccccagctgacaatgtgactataacatcatgagacacccagaaccacagccagccagcaaagccagtccaaaattcctgacccacagaaactataagataataaatgactatcgtgtccggaag

SEQ ID NO: 4847 - DNA, 148 bp, Homo sapiens
ctccggccgatcaggttgttatttttttctgttttcttttccttgacttcacaaggggtgtggttatctctgtgctcctaaattagaatttcaatgttttgtaggaatgaaaatgtcctcaaccatcataagggtcatagctgacact

SEQ ID NO: 4848 - DNA, 240 bp, Homo sapiens
acaatatttagatcatggattcactgaaaagattccgcagtgccatctttaccctattttgctgtatcctgatataccccagttttgtattccttgtcagctccataataccacacccgtgagtacataataatttgtggaatgattaattttaaatattagtttttattaataattttttagaaatatttagaatgtaaaatgaaatttcagttgcaacaaaaaagtagtaaaacacga

SEQ ID NO: 4849 - DNA, 319 bp, Homo sapiens
catctagtgctgttctgtttggggtttatatttggggtgcaccggccgcatcaggattttagtgtttttaataataaaatgaggtccaaggttgaagttaaagaacgtgttaagttgtatcacaaccaaagcagacacaccggttttgacctgcgctagttcagtccctgcttcgctgaaagggtcggcctcctcttttgaagacaggcgttgcttcggatttgcaaagattcagaaacagtcaaggacagcgccttctgctgattagcactggaggcgcgcttttccgaagtcctttttgccaccagatcttctttat

SEQ ID NO: 4850 - DNA, 230 bp, Homo sapiens
gatcaggccggcatctgtttttattctatcatttttatttcgttgtatttctttttccttccttaattggttgggtaaattttcattagtttatttaaagaactagctttcagattttgtttattccacattttcccctagtttattaatttccacttttatctttattttcttctttttgcttttataggtattttttttcatcttttacattttcagttggatatgtc

SEQ ID NO: 4851 - DNA, 542 bp, Homo sapiens
acattctgcaaaaaatctgaccagcttactgtaaattagagggagcaaattggaggagaaatgacaaaagaaacagaaaaaatgtttaatcagacaaaggaactaaaaaacctcagtcttaattagaagatggtcaaacaaatctcttaactgatgttcacaaagatggtttcaagtcatctaaggaatgggagaaaatacaactggtgaattgcaaagatattaagaaatttttttcatgacctccaaagaataaaattataaaacttattcttacctttttgtttcctgtaaacgtgtggtatattccccttgtccctcacgacaaacttctctatgatttcctcaatggttaaggccccaaatgatacattaaaaaatatacatttgttttatattttcaaagtattcttaatctttaattaggaactacactgaaactctgttgtcaatgcccctacgaagactgaaagagatgtgatggttttaagactggtgcctatggtcaaaagaatatactgactgcttccaaatgtctataa

SEQ ID NO: 4852 - DNA, 565 bp, Homo sapiens
tcaggacgcattcgcgatttattttatctattttattttattttattttttttttttgaaacaaagtctcacttttacccaggctaaagttccggggcacaatcttggctcattgcaaccttcacttccaggttcaagtgattctcctgcctcaccctcccaagtagctgggaataaaggcacctgccaccatgcccggctaatttttgtatttttagtaaaaacagggtttcaccatgttggccaaactggtctcaaattcctgacctcaggggatcttcccacctcagcctcccaaattgttgggattacaggtgtcagccaccacacccggcccaaaacaaaatgtaaaaagtgatccgcaggaggagcactcggtgaacaaatgattgtgcggtgaacaaatgattgtgcgttggggcatttcttgacctgtgtccaggcccaaattgagggcggggtgggggcagggtaaggcggcaggaccaccctctcggtgggcactgcccctgcttctgaccaaaaactctgaaattttctccttggcatttgcctttgattaatg

SEQ ID NO: 4853 - DNA, 599 bp, Homo sapiens
  misc_feature (1)...(599): n = A,T,C or G
ctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagcccccccgcatggagatgccttttccctagaagattacaccaaatgtgacttgactgtctatgcaattgacccccaaaccaacagagccatcgatagaaatgagctttttaagtggagagcaggtgggataattattttnatttaccccantgcctatgtgaaatttcatcctagcaggaacttaaaaatttgagttataaatcctaaaaataaattcagatgccgcgcg

SEQ ID NO: 4854 - DNA, 258 bp, Homo sapiens
tgttgcactctccagctgagactgatgctcagtgaaagcaagatgaaaagattccttgtggcaaggacactttacttattaagaagataaaggtcagcactttcttctgccttgccttcctaggttagctgagagtcctctgagagcagagattcagaagaggaaatgaacagatgtaatgaaccaattcatatttttcctgtgtgctggcagctttttcaggttctcaatttttaataataaagagtgatgcggccg

SEQ ID NO: 4855 - DNA, 364 bp, Homo sapiens
caaaggcacctatgttattctccctttcgagcaaaagtcatgatccagttttcctgctgacgacgctttttccactgctgtgtcaatcacaccctctgtgttgagcagtacagtaaatcacaagagaaggtggtggcgaatccctgctcacactggaagttgctctgtggaccattcgaagaagctctggactgatcacaagggaaaccgagcagaactgtgaagcagacggacaggaacaaaaggctattttggtgtgaggagaaattagtcacttcagctccacaggcagatgttgctactggactgacaagtggaacctactcctgctggagaaagataaataaaggcagaatgcgcgcgg

SEQ ID NO: 4856 - DNA, 315 bp, Homo sapiens
aacaagatggtcaatgggacacttgtgagttctccagattccaccctctttctcctgtgaccctggtgaactgaaaagtgtaactgcttcacctcaccatcgtgcaggtcaggcattggatccaggtgtagctcatctaatacgctagggatgctgcaaaaatgaatgctgctcacattctgagcagctgaggctctccacagaaggttgctggacaccacccagagcatcttcctcaccccaagagccccgacctgatggaaaatgttcacctgtgcccactgttctttactcaaataaaaggagatgcgcgcg

SEQ ID NO: 4857 - DNA, 956 bp, Homo sapiens
ttagctgcactggctctcttaacttaacagtagctggggttgggcccagctacttctgttttaacaagccttcctggggattctgaagcatgctcaagttttgataaaccactgctaatgcttttgtgctttgtgactttttttgtagaatgactttagaaagttaaactttgttattttaaggtttcaagtgaatattttcttcaatgttgacatcttccaagtatccttcaaataatatctttggtttggcttatgtcagtcaagtatgtgttggtttaaaaagatgaccgagaatagaaagttgtatcttctaaaaactcattttaaagtgagattcgtatataacagcagacgcaattttatcctctttctgcctttcttatccactacactcatggtatccactcacagcctcactaaggaagtcagtccacttcatgctcagcttttaacttaggggttttttaaatgtatgcataggatgtatcatgcacagaatgccatagaatccttctctgacccctccttctgttttataagccattctgtgcataaggccacagtgacttcacactggactctggttctgcctcctactaaatggcagagtccaggagggtcccacaacctgtgtactccaggcctacagactataagctctaagtaatggatgctcagcaaatattttttctttgctctagggtctcaactctcagcaggattaatagctgtttaacctacggtgatccttttattagtttgttacagtaagaaatgcatgttttaattggattggaagccttgaaccttttcttaaataataaacatttttatgttgaggtaaaacttaaaaacagtaagtacacagatgttaagtgtacaacttggtgggttttttttcacatggtaaatacccatgcaactgagaaaggaataaacgcggatgcgccagg

SEQ ID NO: 4858 - DNA, 160 bp, Homo sapiens
agctcttggagaccttgcatttcagattgtgcagttacaagatagtgtgatctttgtcagcttggatccctgagggactacgtgaagtaaaaccccctctgatgactgatgttgatattgtaaaataaaccttcatgttattaagctaaaaaaaaaaaaa

SEQ ID NO: 4859 - DNA, 173 bp, Homo sapiens
ttagtagcgtaacggagaccttgcgttcagagtgaaacgttacaagatagtgtgatctttgtcagcttggatccctgagagactacgtgaagtaaaaccccctctgatgactgatgttgatattgtaaaataaaccttcatgttattaagctgaaaaaagaaaaaaaaaaaaa

SEQ ID NO: 4860 - DNA, 655 bp, Homo sapiens
  misc_feature (1)...(655): n = A,T,C or G
aacctgagccctcctcggaagcaagactagcaaacctcttgcacgcacaggctctcccacttatcacggacctggttagtggaggtgacctcccaacatagagacacattgggcctgggagggccaagctgagggcccttggacaagtggcttcaacatgccaagtttccatttcctcaaacctgaagggattaaatacaattctgtttgaagagcctctcctgtgatataccaggccataccatgtgatagccaattttatgtgttaacttggctgggccacagggcactctgacaggtagttagacattattctgggtctctctataaggctgttttcggatgagactgacattgaaatcagtggactttgagtaaagcaggttgccctacctaatgtgggaggggggcctcatccaatttgttgaaggtccgaacagaacaaagagactgacttccctcaagcaagaaggaattctgcagcagacaaccctcagccttgagctgcagcctcggctttctcctgggtctccagcctgacggcccttcctgcagagtctggatttgccagctccatcatcatgtgagccaatcaagaataagccgtagcgtccacctttttttntctcttaatgaggacatactgcaaagtgag

SEQ ID NO: 4861 - DNA, 1200 bp, Homo sapiens
  misc_feature (1)...(1200): n = A,T,C or G
aaacttctggaagatatgaagaattgtgatcacatggcaggacaagccaagcagtgccaaccatccatagtctgtttcaggttgggagggagctatctgtgaagtgggcaaatcaaaagacccaaatgatggggccagagagaagctggccagtgcctccaccaaagtggggctgtcatagcaaactggaagaagatacactggcatcttagtccacttgtgttgttgtaaaggaatgtctgaagctgggcaatttatacagaaaagaggtttatttggcttctggttctgcaggctgtgcaagaagcatggcgccggcacctgcatctggtgattcaggctgattctggggttcaggctgcttccgctcatggtggaaggtgaagggaagctgacatgtgcaaagagcacatggtgagaatggaagcaaggggtgggagtggtgccaggctcttttacaaaatcagttctcatggaactaacagagcgagaacttcactccttgcttcaaggaatgcacccagatgctcatgagggatcctcacccatgaccccacccaggacgttcatgagggatccttaccccttaacccaaacaccttccctttgtcccttaccttcaacattgggcgatgaaatattcaacacgaggtttgaaggggacaaatgtccaagctttatcagtgggttgttgatatgtttaggtgcaattcagtaagtcttcatcgtgctgtgcactgcagggagtggacagtctccgcgtggtgcccatcccttctgacagtgcagctcctgatctactgcaacacctgggagaaggcggctcttcacctttaactgaagtgcttggagatccagatatgaaaatgaatcctgttaagacataagcctcactaagtaaaggactgacatctctaatcaaatcaaataagatgatgtaaagtccatgcagtaggttgcttgcattgttaacatagggatatttttgctcttcctataagcataaagcaatgatttcaaatcttgttgctatatgtaagatgtttactctttgttttaaagttagtctttctctaaatagaaaaataatccacaatcctactaaattatcaagaagcaaataaaggcgatgcggccgaattttcatttttgtacaannnnnnnnttttntctttnnnnnnnnnnnttnnnttttccccc

SEQ ID NO: 4862 - DNA, 688 bp, Homo sapiens
  misc_feature (1)...(688): n = A,T,C or G
aaaaataatttcaactgtaccagaagagcccagtgcccagaaaccaatatcagttctatacagatacaaggtgatgctgattatttcatcaaccatcttggagttcccatcgtgcagtttgcttacgaggacatcaaaacattagaggctgaataggccggacgcggtggctcatgcctgtcatctctgccctttgtgaggctgaggcgggaggatcaccggaggtcaggagatcgagaccaacctgaagaacatggtgaaaccccatctctactaaaaatacaaaaattagctgggcgtggtggcgagtgcctgtaatcccagctgctcaggaggctgagatagaagaatcacttgaatcctgcaggcgaaggttgcagtgagccgagatggcgccactgcactccagcctgggggacagcgtgagactctgtctctaaataaataaataaataaagactgaatacaagacaattggattttcatacctgttcctgcattatcttttgtaatatgttgttttattgtaaaagtatgaagaaaaatctgctccaatattttattcatataatgacaagtatttttctttggagctacattgaaacttaatgagtattagtttcctaaaggttaatatcaatgtggaatcttaatccatcttaataaactntttgtactccacacaaaa

SEQ ID NO: 4863 - DNA, 784 bp, Homo sapiens
attaaaaacttcaatgaacaatatctcccttctgttttggctttagaaatcaggttgttattggtggaactgtacccctcccacacccccaattcacatggtgatgttctaacccgcagtacctcacaatgtgaccttatttggagataggcattttttagaggtaatcaagtaaaaatgaggtcattaggaaggcctaacccaagatgacagtgtcctctatgagaaggaggaatttggacatagacacacacaaggcgaacatcatgtgaagatgaagccagagaccaggatgctgcttcaacatgccgaagaacaccagagacttccagaaaaccactaggaattcagtgaaagggatgaaacagctgctccctcacaagcccctcaaaggaaccatccctgccaacatgtagatctcagacttccagcttccagagccgttggatgataaatgtgcgttacttaagccactcagtttgtggtactttgttacggcagcctaagaaactaatactcaggtttttataatgtcaggttgagccatcctccacatctactttctctggcagtgaccatttctgatcagggactgaatagaagattctagttatttaattacaaacaaaataattgagagaagaatgcagtcaagataattccaagaacagcccatgacctggagcccagtgcccagcttccacagcagtgatgtgttcacatcaggccagattcttccataaaaagttcacatttaatataataaaaagtgtatgccgccagg

SEQ ID NO: 4864 - DNA, 575 bp, Homo sapiens
agttaaaaatcattcagagaagtcatcctgagggaatttagcttgaagttcccgaattaactttctttcagccaagtgctaaggagttgtccatatgctgatgttaagcctgaaagatcttggattaccttttgtttgtagttgtgcagctgtaatataattctgatctattccatagctgctaatgactcaacacctgagaccttgaagtataacaggcaaggttattattgcactgtgaggcagtaaaataaggtaggatcggtcatatgtgacaaagtcctgtgaaataccaagactgatatagggaatgtgctaccatcgagggcttataacagaagtgattgatgggtttagagcccgtcccccctacaggatgtggcaacccgcttgacaaactagacgatgcagccgctcgagcgtatgttctagacggataagaagtcactgaaaaggcccaccttgcatatgccgccgaaaatccaaaaggtcacaacaataatcagtgcggggggttatacccggtcccttagaccattatcaaaatatctcatttacagacacacaccgtacgc

SEQ ID NO: 4865 - DNA, 498 bp, Homo sapiens
attctcaagaaagttgtgttcagtcaaaatccttcctacagtacagtatgtttcgagcttaaaggaaactcttctagaaattacacagatcataggaccctaaatatataaatgttttatgactgacttttttccgagacagtaagtgtctgatgcagaaagaaaacagaagaaaaaggagaatgataattagaagaggatactctctgcttcgtagcaaattcagcttttaataagaacaatattgataggtttttccttatgtaccagtaacatcaccaaaccttttgacacttgtgtgcgagctccctaaagagtctgaaatctcagtttaaaataaattgtaattgttcattgtttggcaaggttcaactcaattaggcttttgcacagatttctacatctacattttcctaacttatctgttattgtgcctattttaaaatacagagtatttaagccaaaatttatatgtaaaccattttaaataaagatcga

SEQ ID NO: 4866 - DNA, 780 bp, Homo sapiens
  misc_feature (1)...(780): n = A,T,C or G
cttttggaaagaactgaaattcaatatggattttgagtgtctccacttttgctgccttaaaggttatgagataagatgctggctacgagtatggatcaatagagcttacagcccggaggacaggaaataaataatgggaaacaagtgaacattgacttctctaagaatgtatttactcatattttatgcatcttctgctgtgctttcaaggagatgaacaaaaagataaagaccaaggatgttgataagtacatcaactggacagtactatgctaactgtgctctgagaatatgatctgagaagtgtctaatttttagacacaacatcctcattgaagtgcctccttcaatcaatgtcacagcatggtatgagggctgtccacagcaagcttacctgaaaaacctacttataaaatcacaggaaagcagtgcgttgataaaactgtcttttcaaaacgatacattctagagtaaaaagaatgtaaaaaaattggtttctagatggctaaatatatctgagttaattggaaatctctgtgaattattttgcctcatacctgggtactcacaggagaaaatggctagtgtacaagttagttagttattaatctcataatatcttagatagcaaactatgtaaaaaaactgttctgtatagctatatgtataaaatatgacaacgtttnaacgtataaggcaataacctgtgtctccccacagcaccnnnttttttttttttttttttttttttttctttttnttttntttttntttttcccc

SEQ ID NO: 4867 - DNA, 388 bp, Homo sapiens
cacctgtcctaacactgaaggatcataaaaaatttgctttcaccaagaagttcagaaactttaacatggctgatgtgataaagtgttgggtctttctctgaagacttctgcatttggccaagagtttcggaaaatcaacaaaatgcacctgtcctttcaaggaacaaaactgacagcatttgtttccagtaatagagttcaagctttcatgtgaaaattagaattatggaaaatttgtatctgtcccatgagtttgacagcttcgcaattttaaaaggcttttttgatgagatttgtggtaatattagcaaatgttatttttttgcattgaataatgaaatatgtcaattattaggaaaatacttaataaaccaataggttccaaatg

SEQ ID NO: 4868 - DNA, 799 bp, Homo sapiens
  misc_feature (1)...(799): n = A,T,C or G
tatctttttcagacaaagactggatgcatggctgaacccttaggatgcggaccccactaacggaatgcaacactctatgcacaataccggcatcaatcctaccacaactagcgcctatgcagtgacaacgagctctaccacacgcgatgcggccctgagacacattcgctgaacgagagtgtgaaggacactgttctaagagtcacacatctactacatcctacacagagcgagctgccctgtgtgctcgatataacgccgttgctcttattggagagctagtcgtgaaaagatctggaccactgctcacaatgccatgtgtgatgatcacactgtcggcacagaagctctgcacttgcctggacacctactagactgttgaaccctgctactcgctacatggacgcactcgtgctggaggaggactacagtgtgaagaccgtgagcaagagctgtaaatgatatggaccatgtcacaggtcctgtatctgggacttcctatatgattacctgacatactcatggtaacagtccagacatgtaccatacatcgtctganaaacagacactatcccgcatgtatctactaaagagggtttccatgacaggaatatccattcggatacattgaagacacatttgctgactcctagaggagcgctcacaaaggctaatttttcgtattccattattataaaaatctatggaaccttatcctttaaactagggttactcttcggaaaagccaatgatcacctagaaggaaaatggtcaagggtgggtcctcttaggagctgca

SEQ ID NO: 4869 - DNA, 404 bp, Homo sapiens
  misc_feature (1)...(404): n = A,T,C or G
tgactggcttacagttgtgcttctggccaatgagattaaagaagaaatcttccagggtttctggaaaagattttcctctacgataaaaagctggggttctacaaggatttcatttactggttttagatgctgttttgtgagtctcatcatgcctagagtttgtgatgcttggaactgctgccaccttcttgaaattatggaattaaaagcagccaatacaatggaggcacaaagaagaaaaattaaatgagctatggttcttgtggatatcttttggcttattaaccagcgctgcttctgcttatctctgaacactttatgaggatagatcacatatgttttcattgttcaagtcactgttaaaaaggtattattttattgcacctacnnnaaaaaaaaaaaaa

SEQ ID NO: 4870 - DNA, 556 bp, Homo sapiens
cacgctcaggaccgatgctgctttcaagtgcatacatggtggttcttttgctcagccatcagaagaaatcctggtaccttcacagcacctgcctctccccaagaccttccccagagcagagtgccactcagaccatcctgctgctaattctgagaactcgatagactggattaagaaaatgtggcacatatacaccatggaatactatgcagccacaaaaaaagatgagttcatgtcctttgcagggacatggatgaagctggaaaccatcaagctcagcaaactattacaagggcagaaaaccaaacaccgcatgttctcactcataggtgggaattgaacaatgagatcacttggacacagggcagggaatattacacaccagggcctgtcacggggggaggggctgggggagggataacattaggagaaatacctaatgtaaatgataagttgatgggtgcagcaaactaacatggcacatatatacctatgtatcaaacctgcatgttgtgcacatgtaccctagaacttaaagtataataaaaatagatct

SEQ ID NO: 4871 - DNA, 1391 bp, Homo sapiens
  misc_feature (1)...(1391): n = A,T,C or G
ttaaaaatactactaagtgtggcaatacaaaagtgtgtattcattaagtttacttgagaagaaatagcagaggtcaaataatatataatatcacaactatgaagcagagattcttctcactttagaggtagaaatggggtttcactgtgttagccaggatggtctccatctcctgatcccgtgatctgcccgcctcggcctcccaaagtgctgggattacaggcgtgagccaccatgcccggccggatctttctctgccatccaggttggagtactgcagtggcacaatgatagctcactgcagcctggaacccctgagatcaatcagtcctccatctcagcctcccaagcagctggaacctcaggtgcacaccaccatgactggcttatgtttgttaaatgtgtttgtagagatgggattttgcttcgtttgccaggctggtctcangtgcctgggctcnngngnncctccccccttggccttcccatgtgcttggattactattatanatagcacaaatatatatttatctnnnggggngggcnggncnnnncnnccggggccnctnnggtggggggggacttcctccgataatggctatcttttcattcacattagataaatgttaaagataattcattttaaaaatgtgtgaatttaaagattntgagatgagtaaatctgtttaacttgcaataacactcttttgnaaccatttaaatatgaaactaccaagatatacatatttttgtaacaatacaactgaaccaaaatacctgaggtttatgttgattatcctcagaattttaatacttaaatggtataaaatatanaaagaaattgcaattacaaactcctataaatgaacttatgaatgcttatagtcaataaaacaaataatttattcgtacaaaagcatactatttcttcaagtttttcaatcaactaagtagatgcaatcaaaatgtgaataaaagcctgttcacatttccaatcactccaactaagcattgccttcattgtttgaaattctacttaaatgtaaaactaagtttactctatgatactaacatgtctaatattaattttaaaaagatcaatagtctttaagcttaaatttgcaactatgttttctaatctaacagtaaccctaaatttaactaaaatgataaatttactgtaatcattatactatatcaaaatctaatatgtgatttagtttccaataaaattaatttatgtttacaattacctattttgcatcataatgcaaaataaataataatataataggtgagaacctctgaaactcagaaatgaagttataattattaaatgtatacaataaataataaaaaaatgcaagaatagaataaagcgcgatcggcca

SEQ ID NO: 4872 - DNA, 265 bp, Homo sapiens
agccttcttagactgaaagcaaggaagctcagaagtgtggaaaattgcaaccaatccaaggtgggatccacggatcaatgttccagctccccctacttcactgaataagtctagggatggggtataacaatgtgtccttttgattattttgctgaaacatgacaacacacacttactttggctttcccttttttctctttcttactctccctgcttcctcactccttctttctggaatacctctcaaataaacactgatgtggcg

SEQ ID NO: 4873 - DNA, 302 bp, Homo sapiens
agaacactaagaagatgggcagaaatcaaagcttcctggtgtgaggttgtggtagaagattcctggttgatcaatgtatagaagatggaaatggattccagttgtgggaaggaagaaatcattgctgcagtctcagtctgctctgcaggaatagaccatctgaggacacagcacgaaggtggccatctgcaattcaaggagagaagcctcgggagaaaataaacctgccggcaccttgatcttggacttttagtttccagagctgtgagaaaataaatgtttgttgtttaaaaaaaaaaaaa

SEQ ID NO: 4874 - DNA, 492 bp, Homo sapiens
  misc_feature (1)...(492): n = A,T,C or G
agtatactccttctacttaaaaaaaaggtaactgtaagacaacctcaggcaagtccttcaggaggtattccaggagaaggcattgttatcaaggatgaaaactcctcgggtgttactacctctgaaaaccctccactgggacaagacatggagatggaagatagttctattgatgatcctgaccatatagatgtgattgatgtgaccaaccacagaagacctcctgatactagacgggattgaatgaccataccggatgtcagtagtggatagagagtgtgtacaagcgcttataggcataagggacttgtcttttctcagatgagactttggactgtggacttttgagttaacccatacttttagcccctggttgtcaatacatcccactagatgtatttttttttctcccccgtacaaattttnagagcaacacacacaatgctctgacaagatacacatttatatatacaaataaaggaagatccgccg

SEQ ID NO: 4875 - DNA, 685 bp, Homo sapiens
  misc_feature (1)...(685): n = A,T,C or G
aacaagaagataaaaattctggaaaatgggtgagaaaactgatgttatataaagaacaaagaatttggaggcacatgaaatgggccttagaatacatcccaggcttgtttccagttggcctttgataaagtgcatatttgaaatcctgaaaaatgtcatcacagactggacatgaagaaactagagaagaaccacactgtggtctttctttggcaggcacgatgatgtgaataatgaggactttcctttgtgaatactaatgggaaagaatggtcagcatgggctgaagacacatgtggaactggttctgacatgttcctggagaaagcagaagttcaaaaagaatcgggaagaaagagctaaaagaagggagaagaaaatatataaatacacagaaactaaaaagagagggcttattgtgccctttcccataggagctcatagcagttggctgcccccccctatgaagtcaggaaaagggaatcaaagatctatgtgcgtgtgaaggttcagtgaaggaagcccttgctgagtaaggtcaagtaaaatttacttagttcctaggtatgttganttgttagatgagtatttgaatgactgaccccaatcgacagtaaattttgtgaacacaatttccaccctcctttatatcaatttactgtataataaatccccgatgcggcgg

SEQ ID NO: 4876 - DNA, 444 bp, Homo sapiens
  misc_feature (1)...(444): n = A,T,C or G
aattctacacccgtgacctttgccatgtgactttgcagtggctctcactagaatgagtgcagtgtttttcctcaccccatggaagcttggctcagccacaggctttgccttgaataacagacgctagtggaaatgatgtaaaagaggctttaaatgtgcttggatgatttgacttggcctgttgtatttctcccatccccgtaagaagantacgccccccctggtgccagttccagaacaaaatatataaagcaggcccaaagtagccctggagcctggagccatgcccagtggagcccagccaagatcagctgagtccctgccaatccacagccctgtgaataaattaatgaacgtctccccgctcccgnaagtgagacttggggcattatttgttatacattactgcggtagttgatgactaataaatccagatcgcggcgg

SEQ ID NO: 4877 - DNA, 706 bp, Homo sapiens
  misc_feature (1)...(706): n = A,T,C or G
cataaaagacattgacacttccaccttgctttcttggattggctgctttggatgaggtcagctatcatgtcctgaggacattcaagcagccacgttggaagaaactgaagcctctcaccaatactcggcagcaaccttgaaaacagattctcccacctccatcaggccttcacatgagtttaagtctggccaacatcttcactggcacctcaagaggaacactgaggcagaaatgcctagcttagccactcttggatccttacccacagaaattgtgaagatgacaaatggtttgttattggtttaacctactaccatttggggaaatttgttatacagcaatagatacccaatcaagattttagccagacaaatggtactatgctgtaataaaaacctgaagtgtgggagaagtttcagaatcaagaantgagaggaagctgaaaggattttgaggagagtgtaagcagaatccccccccccctctgaggaggctattggtggggacttaaagaaaaataagaaaaaacattattggaaactggagaagaggggctcctcattatgttgaggcagaaagtttagtgacaatattacctgcagttgcatggtaagtataccacgccctactgaattatttaattctcttttctttgtatgtagggtgaacttagtgacttctaatcaataaacccagagtgggggg

SEQ ID NO: 4878 - DNA, 707 bp, Homo sapiens
  misc_feature (1)...(707): n = A,T,C or G
ccataactcctacggtgcataagagtaagacactccctttcaacttttcctctccatggcaaaagtatggaaaaacctcaaaagtttcataagctctggaaaagaaactataactccaaaggtgagaaaaagtagaagacatgccagtgctaaaaggtacaaatggaaccgggacccgggggataaaatgaaaatactttaggttcatatacttccattgagcagcattgcattttatacacttcttctttaatggttcagacatatagttcttagcatcacatgcagactcataaccttcagaatacagcatgaatcagctggttgcactgcaaagagaatacaaaataccatcaagaatgtcctaactggaacagtaaacttttaaagtacaaacaactcatctgttagcagcctggcattttgctttctggaaagtaaatacattagagagatatctttaaagagagtctattacctgtgtaagtcagcaattttcaatcatgactgtagcagatccaggtgagagacactgcgacctggccttatagcaggaccaataagcataagcaatcccttggtcctaagatgaagacttactaatcattagttcttgaatctataacttccttaggttaggtcagatttgtcctcgcttactcagcttatggggcgtggattcttatatangcagttccatagagaga

SEQ ID NO: 4879 - DNA, 537 bp, Homo sapiens
cggaccgactctggatttatttattcatttcatatgtattaagttatatttatgtcaaacttatgtgaatttcttgctcacacatctgttggttcactggggtttcgctgatccaggctgggttgggttcatgtatgctgcactgtctcccctttttgggggatgggttggactcctggagcatttccatcctcagagcatttgcagatgcttctccttctacctggaatgtgttcctgttaccggtggagggtcttgactatgagttgtccaagtccttggcgttttgaacaaaatattgaacaaaatcctgcttaataaacattccccaaccagggcagcactactcaaagttgctccaggaactggtgccagtccataatccacagcaaagtgcacagattgagagtaagcatttataaattttttagtgatttcaacagagtaattttatgcctcgccaagcctggaaaaatgccagccctggatgaatccagtcattgcctcccacaatattacctaactggaagctctatt

SEQ ID NO: 4880 - DNA, 963 bp, Homo sapiens
acgaccagacgacagaggctgggcgcatctggttttattgaatggtggaggtggctttcagcaggatggacggggagccagaatgggtggatggagtgggaaggtgaccctctcctggagttgggctgcccagcggccggattcctctctgaccacccctagctgaaatcctctcagtcgtcagatgttcctcctcttctccctttctctgcctgattgctctgctgtccatctgctggacggctggcttgctggtctgcttctggagcttaacgtttggggtccatatggatgcaggatagggggcatggtggaccaaaaggcatcttttaggcatgacaacaagaatgccactcctcatttacggccaaaggtctttaggcttgatggtggagcctttaccgggaactgccctctgctccccagaattcgcctctccctgtctgaatcaataccatcggagctctttcactagtgagaacacaaagatttacccatgcggtctcacctgcatcatcatctgggtggcgcgcattctccgcatattcaaggtccagtgtgcacatagggatgaaggggctcgctggctcaagggaaacatcaagcacgatgggtcgttcgcgcctttgacctcaccgagtacgacttgttttggtggctacacggcgtgtcctctcctcagtcatttaccagttcgtgagcgacgatacctcgaagacgccgtgacgctcagcgccagctcgatgaaggcgaaggatagctccatcctaattggaccgttacatggcagagcggcgatagacagataactaccgcgaccatgaggagcggccgggccagtcagcttagaaagttgctgtcaggctgttcccaacactcgacaagtgcgaatacggtcatgatcgtagtttgagacgacataaccgcccgcgcgacacggatagtttagcacctcgtgcgagc

SEQ ID NO: 4881 - DNA, 306 bp, Homo sapiens
gacagcaatgagcctgactctcctgcatctcctttgtctgaggcatagaccactgactgcttatggaaaagaacagataatgatatccgtctcctgcttccacccaccactcaatgtaactttctgccatgaacataaccagccacacataaactgtctgcagaaaaggaagttccatcctataagcttggcaggagggtatgtaaggtcaacaaagaaatctctgctactcgtttgcagtcatttccatgaggctaattgtcacctccagaaatcagcccagaaggaataaattaggatccgccg

SEQ ID NO: 4882 - DNA, 312 bp, Homo sapiens
gttcggccgatcgtcctttatttggatcattgagggggaggggggagattatggaactttgctccttgtaaggactagttatttttgcatattacttcattagcttcgatgatttttctttaatattcattatgttaataagttctggatgagtgtgctctcattggattttttatccgtcttgttctgccgcaggatgagactatacatcgtcgagatcgcaatgatgatatgagttgttcctcctgcgacggctctaatcaaaaaagagcaggagtgcttttccatctattgcgatgatggctttattat

SEQ ID NO: 4883 - DNA, 409 bp, Homo sapiens
tcaggccgatccttgtttattctcatccccagtcccattctcatagtggggaaaggctgcagggtccattcctgctctcccagctggtgaccaatggcaggtgctggtgaacagcgttggattcaggagcccagagcttctgaaattctacatctgttggagttggtgctgtcatctggctctgggatccagagctcttgggactcatgggtttcctgggaggtgagctctggcaaacgtggatggttgttctccctgggtgaatccatactagggagtttgggtagaaggccttgggaagccctggttttgttgggtgaggtgtcggaaggcagagcagaactcatggatgggacatgcgggttgtagatttcagctcaaacgagtaagaacattcttaaggccagca

SEQ ID NO: 4884 - DNA, 382 bp, Homo sapiens
aaaactgctgcagagtgagagtcttctaaatggattaagaagcctatctcaatccctctggagagtcctcttcaattcacaatgaagatgttgaagagcagggacagacatcaacactcctctccccaccttccccactggcagaggcattcaggtcactactagtgtctctctttctcttttccccttctcttaatctctcactgcccttctctccatgtcatattctctttttctccttccctctcttccttcttacctactaaactccatatgaccaaaatcagtcaaagctctactatctagctctctttatctagactaaaggagttgtccacctcttggtctagataacacttgcaaataaagaccgatcggccga

SEQ ID NO: 4885 - DNA, 346 bp, Homo sapiens
caatcacttgatgcggcctgttactggcaacatcagcagtggattttgtgtgcttagggaccatgatgaacaaaacaacatgagactaaatcaagcacaagagaaaacgacaccatcaagagacatggcaaaacggacccagaaattgaatgtaacctgacagcctggagactgaactgggattaggactttggtcttttgagtccccattcttgccaaaaccctctgctttgccttcattgtttctttctctccctgcgagtaggtcatagtaggcccctggccatctgtcagatggttgtgttatttggaaataagaaagaaaataacccctgatgcgcgctga

SEQ ID NO: 4886 - DNA, 402 bp, Homo sapiens
ccctgggcttcagatgatactctgatgtcgaagctggcagtgggattgggacaagaattgctactgtcttgattatcagagccctggagaatgaaaaagccctatgtggacctcctgtaagaggacgcttatcttgaaggcagttatcagccaagtgaagaattagatggcgtgtgtggacactggaaacactggagatgagagatgtatcaatgatagaagggtggaaagttgccagtgaagtgaagctacgaggagagggaataagatgggctgtctctttccaaaatttaaaattataaaccagactgtgatctacagagtgtatctaatacccttatcttacagatgagtttaaaaatcatctcgtgttcatggcaataaagttagatgcgtcctgac

SEQ ID NO: 4887 - DNA, 344 bp, Homo sapiens
ctgcacagtctgaattctgcagtcagcaagctgaaaatgtaggagacatggtgatataaattccagcctgagtaaaaaagcttcccagatgatgctgaggctgatgttgctggtccatggacccccattttgagagaggtctcaccatgaacctggcgatggatgagaagatatttctttccccccataccagccctcaccaccaaatgagtgaaaaacttgagagaccgagtgagaattgcccagctcagcccccttagctcctagaaccatgagagataaaaataaaataatggcctcgttggcctcagcggtggagtcgtgtggcggacctccctcccgcc

SEQ ID NO: 4888 - DNA, 475 bp, Homo sapiens
tttttttttttttcaaagatgctaggatgctcctagtgtgcataaggcagatctttattttgaagtttttgtctatctaaacaagtcattaaaaatcagtgtatcagcaccattcatgagcaatcacatgctatgccacaaaagtgatatcatatagtgaacaatctgaaaatgaaactaagaaaacaatttcacttacaatagtgtcaaaagaaatactttggaatacatttaacaaaagaagtgcaagatttatattctaaaaactacaaaacattgttgaaggcaattaaagatctaaatacatggaaaaatataatatgttcatggatgagaagacttaatactgttaagatgcaaatgctctccaaattgatctacagattcaatgcaattccaatcaaaagctcagctggcttctttgcagaaatggacaagctgatcctaaaattcacgtagaaattcaaggaacctg

SEQ ID NO: 4889 - DNA, 375 bp, Homo sapiens
attgaaattaaaaagaacaagcccagcagtatgttgcctgcccttctggaaactgaagaatataattaataaacttagagaaaattaaagactcaagtgacacaggctttgttgaattaggatgagaactttaaacgggaagtttggcactgagtaagcatcattgggagacggctgaatacaggcgaacctctgcactctgtcagtatcagaatttttgaaaaggaaacagattgctttgtctttatttgcaataatatcatgttaaccttcaagtaaaccttctttagtaaaaaccttctttaataaaaaatattatttttgcccaataaactagtggcctcgttggcctcagcggtggagctctgctgccgg

SEQ ID NO: 4890 - DNA, 827 bp, Homo sapiens
atgtgatttctcttctctggaacagtgatcaaggggagaatcaacatcggggagccactgtattcaacgtgagcatcattatcactggatctgcaaccagtcacatcaaacctgaagaagaatgttcagagcatgacagtaccaagcctttatttaacaccctttgaatactaagaataaccattccatcagccagcatggaaagagaatttgaacaaattctttttcccttctcaattggctcctttagagaccaccaggacaaactgactaacaaccaatatgaaaaactaccagatcattctactctctgggataattattctcagtatatgaattatagaccacaaggggcagaaagagtatgctaaattatttcaaattataaatgttaacttttaaacaaaaacctataattggaaagtatgttacaggtttgcaaaaccctcatacttattcctgacaatattgaataacaaatacattttagcattaagtttagaatataattttaattaaagtcaacacattctattagtattataaagtattatggtatcatgcaggaacctagagatatgataatcatgatcattaagtctgaataaaaaagtaataggatccttgtgagactaattgagacaatgtgtatgaaatatatttttctgtgtttgatacaaggtacatacttaataaatgggaattgtctttaccgttaatattaacaagctatactctctgcctgtatcttctaggtgttcacagtgtactctaaataacaataaaagtttggcctcgttggcctcagcggtggagctctgcggccg

SEQ ID NO: 4891 - DNA, 488 bp, Homo sapiens
agaaatggagtcttgctatgttgctcaggccggtcttgaactcctggtctcaagacagtccttcctgggattatagacatgagccaccacacctggccaagattttcttttctctagcttatgttaagaatatataatacatatgacatacaaaatatatgttaattgattgttttatgttttcagtaaggcttccagtcaacagtaggctattagtagctaagtttttggggagttatatgcaaaagttatatgcagattttcgactgagagaaagatccatgtacacattgttcaagggttaattgtgctgtatatagaataaaaaaaaatttgtaacctcacaggacaaaataatgaaaataaaaataaagattaaaataggtagaattttttaaaattaagaaactcacctttataataaacaacaataatgttgaacaataaactactggcctcgttggcctcagcggtggagctctcggccg

SEQ ID NO: 4892 - DNA, 307 bp, Homo sapiens
gagtctctgcctcaaaaagaaaaaaaatttaaaaaggccgggtgtgagccatcacacctggactgttgttgagtttttttaatatattctggatatcagactcttatcaaaaaaatattttgtaaatattttctcctattctgggggttgtcttttacttccttgataatatacttccatgaacaaaagtttttaattttgaagtccaatttatatttttatttggttccctgtgcttactttgactgcttagacacatttactaagcgtttattaaatgaataaccaagtggcctctttggcctca

SEQ ID NO: 4893 - DNA, 877 bp, Homo sapiens
cagacctgctgagagtgtcaagtttcagtaaaataaaaagagttattttatagcagaggattatgtatgtcacgatgatgtttaacgaaatctgcgacactgaaggagaacgtttaggagcgagtcgatacatcgaatatgacttccctagaagttcacaagaatgacaaagcgctgttgcaaatgtcaagatgttcagtggtctaagtgatatcctctttcctttgcaccatgtattttcagaagtttatgtgttatgctaagatttgtcatatatgaatgatgtttttcaatgctttattttgtaaaagtatttcatatgcaagccattttgattttatagtagctatcctaatcaaagagacatatctgctttaataatacatattactgttctgtgtcacaggaatgcagcttaatttatttaatcacctgtgtaaaatagcatccataagagaattgttgtggggacagtcttccaaagcaccatatgtgatattttccactggtttagattgcctgtgttaatattattcatcaatataaatgatcaagagttgcagtattgattggtattgatgtcaaggaagcaaaatgagaggtaaactaaattagcatgaataaaaaaggatttatggcaaacatttccgcctaggagtaaatgtgaaacccatttcaaaggaagcaaattagcaaatggtttaattgacagaaagctctgtgtaaataatggctgcattttttttcactgttcatttgaataagaaagccactgacattggtaatcagtggttcccctctagatttttacaagtaagagagttgttgaaataaaactgtggcctcgtcggcctcagcggtggagctctgcaggtgg

SEQ ID NO: 4894 - DNA, 611 bp, Homo sapiens
agatgcttaagagaagagttgctggaaaaaacacatcaagtgtagaagacgtgttcaaaaatagaaaatactgcccttgatctacgaactctcttcaaaggaagttttaacattttaagtcttcagagtctttaaatgtgaactggaaaatgtggaaactggaaaataattactttgtgtgctttttgtatgagattaaggtctctaccatagcagagttctttacaaggaatatgtaggacaaggctaaagactgaagcaagaggtaagaacttcacttaacacaaacttgataactgaaaactttagttatcacagtatttcattctgatgatagtttacaagtcaattaatgaaaattgattggtatgtctacatgaaaaaaaattacctgatttaaagcaagtcttaaagtacctgaatgcaaactgattacttttaaaggtctacttgactctgtcttacaggaaagtgaaaaagattaaattcatgaatatagctttaaaaactgtgactgctttaattgtgatactcgcagaaacatgtaaactacattgataacgtaataaaattgtggcctcgtcggcctcagcggtggagctctgcggccg

SEQ ID NO: 4895 - DNA, 493 bp, Homo sapiens
ttccggccgcctccatatttattttattttaagttctaggatacatgtgcaggacattacactccatttttgagaaatctttagattcatgcacactagccagtttacagtatgcatgacttcacagatttgttggctaagcagtttaagcaccctggaggtggagacctctctgaaagcagctgctcatcagatctggcagcaaaagaattagaaatgtcatgagccttccctggtcctctctggcccaaagaatgacttccaaggcatcatgctggcctgccttgattccaggacgagtgtgaatcaaaaaccttttctcattattagaatgctgaaatcatcctgggaaatccacctgaagaagctggcaggacacctcatctgcattcttaggaaatgatatcagtctttttctaaaaaatctctaattgaggaaaaaccaacacactctggtatctctcagccttctctgggggaagttcctcccatg

SEQ ID NO: 4896 - DNA, 932 bp, Homo sapiens
tccgggcgcctctacatttatttctacataagaattcagcataagtggtaataataatgattttgttacatgatattccggctaagattaatatttggtttaacttagttgctctatggtaaagcaataccctgcatgaaggtttgttcactaaatatttgttttggcaagtattacataataataatttgcatctatccagaattatttttattttatcataagcgggagcatactagctcagtttttttttctttttttttttgcagttcgcaaaatttaatagggggaaaacagagctcccatacaaaggggggggatccaaaaagggtacccgttgatgggccaaatgcctgggtttatattctgatcatttcccctctccctgggctgccaggggataaataattggctatttctttacctcctggttttgcctaattagcattagacggagctggctttactacctggattggggggcgggctctaaggggcacgccccgggtttaaagggggatgcggccaccttccccacctaggttaagggttctaatgtggggctaggagaaccagctagtcctggctctaaaaccctttctaaagagagaacccaagggcttggggggaatccactgagttcgcgctacctgttcctgggaattggggcaaatagggggggggcattcgaagtccctggggggggggccttcatggcattacacaaagctgggccacaggtgggccagggggggcggaaatttaaaaatgggcgcgtgggggcgctttagaaacaagtgggggtaaccgtgatattccgtgggggggccccctaagggactgacttccttttgtttgatccgggcgggggaaaaaaagaggggctaaaagaatggggtggaaggcgttgtgcgcaaaacgggggtgtggga

SEQ ID NO: 4897 - DNA, 991 bp, Homo sapiens
cgacaagattgtttgaagacacccctcatcagcccctgtctctcttaaagtcccaggagggcccccaggggttagccccacacgcttttcgctcctattctccgacttccccttaaaagaatttttggcctgcctctagcacagaggggagcccccctgttataaggtaagggactctactgtttggttacacaggaaggattattttcatcctgaacaacacaaatgccattcttctgtgtccctaaaaagagtctcacaggtccagagaagcacatcgcattcttcttcccctccaaaagaaccccacataattttcccaaggctgttttattcagattcatctaattaatttgaaagatcctctgctttttctttgcgaaagacctcactgtgaatttttctgtgaagcttgtctgacaactttccatgccccaaagtggacagaaaatactcttctccaccctgtttcaccagattactttgtgagcatatgttacttgttaggacattttatttagctttttgacttcacatgctaatctctatgtgggattttgagttgccatatggcaagatccatactttataatccaatccatacaatctgaaagtttaggtgtcaaatcaattattggaaaatgaatgagtttaaaaccagaaaatattgatctgtggggatttgatttttagcaactgtgtcgccttttcgaattgtaattttaaagcactttcattcaagtgtatttacatactttacccctcacacctttaaagtgcacaattcagtgctttttattgtatagatagaggtatgctaccattctcactagctaattttaaaacattttaacccttttaagaaaccccattccttttagcagtcactcctgtctcctgtcccctccccccacccaataataaaccttaatctgcattctatttgtctattctgcatattaatataaataaatctatgatccggccggaa

SEQ ID NO: 4898 - DNA, 816 bp, Homo sapiens
gttttatggtaaccaagccctaagagcttacttgatcacactctggggatccaaacgagggggcgtatccagtgatttttctaggattataagcctaccccaactaaatggatgccgccgcctgggcttttgacacatatagtctcacactaaaggttgtgctaataaatgcgcccttctaaatcctaacgagagggactggatagagacgctctgaggtacatgcataggtgcttatatgactacagggtgctattagacaccagctcaattgggaccttgttggggcgtaggatgatctgttaacgtggctcaagaccactagcggagaccgtttctaatacataatgatgcggacgccgccctgaagagtctgcgtctctctggcccataacacgtggataaactaggagataaggcccgccgtttcccttcgagggatggatccttgaggtggatcaaaccgtgacctgtcactggcatcttgtgttaactggaataccatttgttgtacttttaccctgctcccagtagttcaataattactctcttcctacaccaagagaaaatggcaggcttgtcctctgaaagatggtagaagagactctcggtccgggggtggcggaaacaactgtgggcgcatgggaatccatttaaaccttactgcactgaactggaccagctttattgagtgaatggcccttcccctgaggggacggcgcggctctctacttttttaccagagaaatgcgcgccggaagggctgacccctattggaagcatctggtaatactttatggaaagttttcccatggg

SEQ ID NO: 4899 - DNA, 865 bp, Homo sapiens
  misc_feature (1)...(865): n = A,T,C or G
tcaggccgatcgttctttgtttctatttttgcacatcagaggttttcctaaaaaatctgccaattcgtattttaaagtgaggcactagattggaagctctgagtacatgaatggggcttatcaactggtgggtttcattgtaggttgatcaagtgggaccttgatggtttgttggatgatcttaaaggtgaccacgtccactggggagaacttttccaaaacagagggggtccagactcctgactgaggggtctgggccttcctgccagcattcttgtggctgaaaaggggagaaggcctggggagtcaccacagggtatgtagcctttcactcaatccagctgtgtcctgtccagtgcctcaaggtctcacttgatcaccatgtgcccttagttgtttctgccatacctgaattcagagtctctagaataattttttagggaatcaaacctcccatttcctgctggtgttgggagagtgtaattactggacttctgggagtggggtagaagttcaaggaatggaattccttttaataaaaactctcaattaattttcctgtttttatccccctccttatccttccttcgaaggcaaatggtgtctctaacttctgagtttctcaggtaaaatgggccatgagtcagtttgattctcattggcaaccacctccgcagaactataagcttcagtttttgttattctgtgaatccagttatcacttatcctctgcccttaactttccgaaattttgttggtgtctctaagccactgttgtcatctctcagttatgcttgtcctttgttgtctcttcactgtcattttggtaaggttctaggaggnagcatagatggttcccgactta

SEQ ID NO: 4900 - DNA, 481 bp, Homo sapiens
agaggcagctcctcgagggaatgacttctgacctcaccactccccagtacccactttttcttggtttgaggggagcctggatcgggatacatgacagataacttaatgagcctggaagtttgaagagactcctttcacctacaattctctcttgggaacaggcctgaccaaagagagcaagtgctctccattgccaccagccaccaagcagtgggacaagctgacacctgagtgacatcctgccaatatagacactgcccatgtccagatgggcatgtgcctcccatgcagatgcaaaccatggtcaacggcagcttcttcaacaaattaaggtgatgtttgacttaccctatgccttactgctgttcttgtttctcacttggtacagaagcacagaacgcaacagggttgttatataatgggctcgacctacgtacttcccacagaggatactgtaacaaataaatgcgagtcggccgaa

SEQ ID NO: 4901 - DNA, 364 bp, Homo sapiens
cggccgcatcggcatttatttggggccttgctgagctgcaagttttttaatgagttaaaataatattttgggtctggagtggaaggtgtgaactatcaaaaacaccacatttgactttaaagtttaggacaaaaacaactccacatgcaaagtcagtttgagcaacagacccactgaacttggagatagaatcccctgggtgatggtctccataactgttttctctgggttgtacaacagtgaagccaatctgatgaggctgaagttcttaagagaagactgttctatcaccaccatgcatgcttgaacactgtccttagcttatgtctgaatagctatgccaagacgattatttccttctctt

SEQ ID NO: 4902 - DNA, 648 bp, Homo sapiens
gttttccaaagaaacaaaactcgaacatgaagaccagaagcaagtattgaaggccacctcttcattaaatgtgtctgcatggagagcatcattcttagtggctaacttgcattgctaaagcaggtgcgtgaacacctatctcagctcttcggaagacatttgcgcgtctttttctaaccacataagactcccaaactggggaggaatggatgcactcatcatttgtgaataagccaggtgaatggactttgtcttctagaaaaggatcaattgcttgagatcgcagatgacagcgacctcaaaagtatatttgagattttaaatctccatacatcctggattaaagtcaaggagaaatactctgtgattgccacagaagcactgaaaagtctgcttctatttccaacttcctgtctttgtgaaggaggggtttctgcggtgacagcaaccaaaacaagattatggagcagactggacatagcaacacaatttgggtgtcactatttcccgttgccctcagatgggaccttctagttgctggaaaacaagctcagggctcccactcattctacatatgatgagttgtataattatttcattatgtgttacaatgtaataataataaaaataaactgcgatcggccgaag

SEQ ID NO: 4903 - DNA, 926 bp, Homo sapiens
cggccagcatcggggtttattaacaagggtgaaattatacagaagaataaattagtttagctgaaaaaagaaaaaatggtagggaatggagggaaaaaattgaaaatgcaataaaaccagaagatgttcaggaattcaaagttgttgatacatagaaatactactggtttttgtacattggttttgtgtcctagaactttacttgcttatccatttcaggaggctggggaagttttctccaaaaggagttttggaaagactttagcattgtctacgtagtgactcataatgcaaatggagaaagagaattcaattttttttttctatttggatgcctttttcttttctattggctgattgctggggataggacttttaaatctaattaaattggatttggtaaatttttgtatatttaaatatggccccaattaattttatatctggataagggccccttataaaggaatatgtagctggtttatttaattattttattactggtgcgcatttgagtttttttcagtttggaaaagcccaaaaatgctggttaaaacatttgtctgattggaaatatgtggcattttattgggggatatccaaagacaaaagggcggggtctaaaggggcgtattgcctggggttggaggagttctactaaaaggggtggaggcggttaccagggggccccaaagtgttaaaaagtgccggggttgaaactcccaggcctaatttggcatttaaaaattgaagagcctaggggttcactgattaacatacgggtcgaggaaaagggtgggttgttctctcttgtggctcggggtggtggaagactttaacttttttccctggggggccaaagcgcttgaaggaaatcccggccgccccagccggggtaaaaaatccggcttaccaaggttgcaagc

SEQ ID NO: 4904 - DNA, 956 bp, Homo sapiens
tgaatagaaaaacatatctattgtcgctgctcataactatgataaatcatggaactgactgggctggcatttcaaagactttatagccgagcgccctctttattcttaaatagctctctcataccgtctgataagagtgccctcgctatgtggctgacctcacctgatattcatacacatactctctctaggagcctggatctctagggggggagcgatcttctcatcaaaggtcactgctcaagcagatcattcttccttccatcatgggcattgtactattactacaacaacattcacatcgttcatatgagatggcttttcttgacaggagaaattcagagagtgaactctccattcatctcgccactgggaccatgacaccactcattgcatagatccactggatcactctagacttgcagatgtcagataacgggggggatggagcgtactgcatgatctggggctattctctgctccgtatgggtgggcggcaggttggtgagctgctggtaaggcccttgacctggggtgttcattcttttgcgaatctgggccgggcggggacgctcccaaccgaagttgtctactcagggagagtacagaattggcccggcgcttactggaaaaatttcctcactcgaagaacgggaggggggtgccaaaacaggggccggggtaacatagaaaggtggctgggccttagggccataatgtgtgggggaacccccgcgtgggtgttcaccttgccggggatggggccttttggcagataatccctgtggggccagcgggcattagccgacggcattggtaaaaggtgttgaggctttaggccgtagttaaggtcgctgggggaggcgggttggtggggtggtggtgccgggagtggagcggatggcggagggtgggtggacgtggggcggaagggctggaataaagggatgaatcgg

SEQ ID NO: 4905 - DNA, 612 bp, Homo sapiens
  misc_feature (1)...(612): n = A,T,C or G
tccggacggcatgccggatttattaagcactaactatatgacaagcattgttccagatccaggggatacatnatagaaaaggctggggaatccttgtccacattcacatcctaagagagggaaaaaaacagtaaaacagacacatatataaaatggcaagtggggaagagtaccaaaaagagaaacagagcagggtaaaggggccaggtgcggtggctcacacctatggggggggcaccttngaaggctgaggtgggtggatcgcttgagccgaaaagtttgagaccagcctgggcaatgtggcaaaatgtcatctctacaaaaaattaggcccagcacagtggctcacgcctgtaatcccagcactttggggaggcctaagcaggcagatctcttgagctccgtagtttgagaccagcctgggcaacatggcgataccctggctctacaaaagatacaaaatantagctcggcatgggtgggtgtgcatgtantcccanttacttggggggctgaggcaggcagattgcttgagcagagccgggtcatggaaagactcattttttcagtgggtactctgacttctgggtggagaacagactggagtgggag

SEQ ID NO: 4906 - DNA, 1165 bp, Homo sapiens
cggccgatcgcattttattgcaatgacttttggtcaactaaagtttaatctgtacccacgtattttcctcattgactttttattctatacagtgtctgatgaatctagccctttgctctacagattatgttggaactggcacgattatacctggcacaagatgaccctgattcctgcctgcggcagtgtgctctactgcttcagagtgaccaggataacgaagctgctaccatggtcagtccaaggaacttcagtacaataaaagcacttgtgttttataagttttaaattttaccccatggaactactactagatgatgaggcatggctcacgttggcttttggaagaaataacatttttctaacattactacattttaccaataaagacccagaatcattaggattttatttataagaaagataaacctaggtcaggcttttacatgcccttttgggtctagttattttttatttatgcctaaggggatgcttggtcaggtggaaggtcattgggtaacactataatttgttaagaactactttttaagtactaaggaatgctgggccaaatttaaaagttttgggtggaaatttttgggagttaccgggggaaaaaaaaacaaactttcatattattcagtctaagacagtctgttttgaatagagttttttattttttcttatttttacgtgggctaaaatatttgttagctttgtagacagctacacagatgacattttgtgaggtttatttaaggttattgtggttaaaaagaaatatatgaaatctgcatttttaaacacataataagaaaaatgtcagtaggtcttgctcatttttaatttttcaaaatagttatgatttaaattttgtttcatttttgaatcgtctcattattattttagtcaggtccagtgagtatcttttctacaacagcacatagagtgtgcaattcctttcaaatttctgtttttaaaacaattgctagaaacatattttttgctaaaaatacaattttgcaagcagagcaatctgtttcacatccttgattatcttctgttacactgatctgcaagttattctgcacaaggtgggcttgaatcttaaatgcctcctttttataaaatgctgccccctcctcatgtttatcatctatatttt

SEQ ID NO: 4907 - DNA, 655 bp, Homo sapiens
tctctgtttattcatgcttagggacttattttctttggagatttgaggctagaagttggaacatcacgggcacaactatcttctggataaattgaacgaaacaattagagattgatagtgcttatccccaaatgccaaatcaccctgaatgagataggcttctaaatttatcttaaatccacagtgctaacatgaactggatcgataccctaatttatgggaggatgttagcgtgaggaagtctcacaacagacacacacatacatatgacaactttcctgtaaaggtacagctgtgtgtgtatgatatcttgtcttttcaacatcagtgtagggacagtaatctaattgtgtggtgtggctttgcaaaagtccacttgtggtcaaacattgcccttttgagagaacattggctctgaaacataagaaatttgaaatggtattcgcaggatgaaagcaaccaacagatcagcatttgtgaggtgcaggcaagatgacttcaagctgcaaagctgggccttgacagacgggtttagcaccattagcagtggcctgtgtaagatcccattcaatgctcaggtatacggatacgatttggatatttgtccccaccaaatctcatgttgaaatgtagtctccaactgttggaggtggag

SEQ ID NO: 4908 - DNA, 779 bp, Homo sapiens
caactctaccaccccatatttgaggagttaagaacaagccaacatccccagagaagatggcagagcagaaagaagaaaggaacctggatctttaacaaatttaccaaccctggtatctctcatcttcacatttcttgtaacatgatattgtaaatgttattgttgcttaagactctttcaattgggtttccagttatttgcagcaactggcacctgtagtagctgatacaagtcatcatgcctaagtcttcttttcttaaggtggaacaacttcagctactctaggtatttcatacagggtatcatgtgaactcaaattctctcaaattttttttgtctcaattatgatagtgtgctatgaactgaggagtatgattaattcaaacctctgccctaagactgtgtgtgagtgagagagagagaaagaaagacaaagagaaggtgggggtagggaagtagatacatattgtggtctctaattatagcaaattcacccagacaatgaaatcacacaaagttttacttggaaaactccaaaacaagaggtcatctaattcaaggttctcatcctagggttcattgacatcccaggatgggcttgggtgaagttggacataacacatttgaatgtgaattttgctaaacagaagttcagtacctttcaaatgtttttgtatggatatatgcccccatccttaagagtcacaaagcaccaatgctgaccaaactttttactttctagacaaagaaagattatcccaataaactaagatcggccg

SEQ ID NO: 4909 - DNA, 650 bp, Homo sapiens
acgaagtctttgtcgtccaggctagagtgcagatgtgtgatctcagctcattgtaacctccacctactgatacaagcaattcttctgcctcagcctcctgagtaggtgggactacaggatgatgcaacagaaaagcgcgcaccagataccagcaccttaatgttggacttctcagactccagaactactttacaccaggaagagttccttttaaaattggcctgggtggcagaggtcagaacatacacaattcaacaacaacttgcgccacccacctccaattccctgctctacaggaccatcctgacttccacagtgacccgagcactggcattccaaggactcaaatgaccaccttcctcgcccttcaataaggctgcctggaattcttctaatatctctcagtgaagaaagtatttggatgaatgacagaaagcatcctgaactgtgcacctgcaaaagatatttcacacattcctttttggacattttgttattttcctctaagccgatagcctttccatcttgtgcaggaaagatcattaagtatttcataggcataaacatttcatgttcaaaacttttggtacttcagttgtaatattgttattgtactacataaatctaaaataaaaccggatcggcagaac

SEQ ID NO: 4910 - DNA, 960 bp, Homo sapiens
agggatgaggggaggattcggccgcatacttctcctcattctttttgcttgttcccatctcttcctgagttgtgccttgtctttgtgcttctgtttctgcttctgcttggtcactccaagctctgtgatgccttttggcttcaggggtcccttctggacctgcttgtaggcccccaggtcactagcctgcagttcggtaggtagcataattttttctggagaaaagatcaagcaacatatgtggagatttacgtccaaggatgtgcatcatagaattcccggctcaaggagacctgcaggcggggcagacgggtgcctgcaccccaggctgggaggccaggggacttgtctgcaaaagaaacccttgtctggaccatgcacagagcggcaaaaaatttgagtcaaccgacaagcacatttctagcaaaggctgaacaaaggcgaccctctgacttccatgggcaactgacattggaggaaaaaatagcttttgacgaccatttagtggcagggagtggatagtgaggggcctttgatttggagaggggccggggaaaaatggcgccgcattccacgcgtagaatgctggttagaaatccgaagtgatgaaaaaatgggttagacttgtcggggagggtaggaaaaagaggcgggggagtaaggggcaacttggtggggaaaccctcacttggtggggaaggagcgtgacgcggctctggggcagagagtagggctataacccggttggatagcgggcggctcactaagagtgtggagagtagcaggggtggtaaattggcgtaatagtacggggagtggtaatggcagcggtgggagacgaggacagagttgtgaggattgggggtgatgcgtcgagcacgagggtgggttgcacctaagggtaggagaaagaccgcatagtaaattgggatgtacgaggtcggagtcgcgaacgtagtt

SEQ ID NO: 4911 - DNA, 274 bp, Homo sapiens
tggccgatctgtgttatatactgtattcttataataaagtaagatagagaaagggaaatgttatgaagaaagtcctaaggaagagaaaatctacagactattcattaggtgggagtggggcacgatcaaggtctccatcctcgtcgtcttcacgtcaagtgggctgaggaggagcagaaggaggaggaactggtcttgctgtctcaggaacggccgtggtggaagaaaatccaagtattagtggaggaacatgggttcagttggaaacatggaa

SEQ ID NO: 4912 - DNA, 411 bp, Homo sapiens
  misc_feature (1)...(411): n = A,T,C or G
gcatggaagtcatccaacagctgctggagggactgtgcagagttacgacggagacagtgactcctccaaaggggtctcgaggggatgcattgtgctggagtctcaatcaagtgcctggaagctgaacgtgaaaaacagtgctgcctggattacagagatactggccataaatgcattcgtgggctctcaagaagcattagggatgccatgaaggaggggcatttttactttgtgtcctaccaaattcacttaattatacatagcaatgaggaaagtgtgggaaacagcaaatctgaccttagtgtgcctttgactaatccaagcttatcctttgtgagttaatatgtaaatgatcccctggcatataagcagtcatctcaaaaaaatcgatcggccggnnnnncccccagt

SEQ ID NO: 4913 - DNA, 605 bp, Homo sapiens
atcgatcatgcagaaggatgaagtgctatttcctcagtggcaccttcagtgctactgacactttcaagaatatgcgtgtctatgcagcagaaacagacaccctgagatgctggatttgagataattcactgggttttatcaacatatgtgaacacacagattttcagctaatattagaagttgagatgagactgattaacgtgactcctaggcaggcctcatcatatctcctaaaagaagtgcaagcatcctatttgaatacataccctggccctcctcctttttcccttgagttccctcttgaggttaataaaacttgatgtatgagatgacgttgagtgtcccaggcccaaagaagttcaggatgagtacaaacatgtgcataccgtggttagaagataagattgcttggagttctttgcttcattctgaccacgtgcagatcagcatagatggtgagtgaggaaaagctcttcctgtggacacttctgaataagttctaataacttgactaaaatttattccaccaataaaatattcagagtgctcaattagaaataaaacaatggcctcgttggcctcagcggtggagctctgcggccgga

SEQ ID NO: 4914 - DNA, 788 bp, Homo sapiens
aagatttttagcgatctacaggcaagagatttgctctctaaactcctccttctcccagaagagctctcctacccagagtccctcatgctcagcatgcagtgcagacagaaatagcagccatctacatgaattgtggatccacgcactcattccaagatcttctttcagcgagcaatggattcttcatgcatgtgatcctcaccacgtaccctacaaagaccttgctaatgcttagagatcaaattatttgtgtatcttttcagtggaggaaatgatccatccacctgatagtgtgtgagcttgtatcccctccttctttttccccctcatgggaaaacaaatcaactgtttttccttttacttgtcacagactgcaagttatgctatctttcaccaaggaggaagagttgcatctgagttattgctgtgaagaagtagtttgcaggcacgggcagctggcatttttttgtctctatgtgaagaggatcaatgcaattcatgttttcttgttcgcacaaagctagatttgaaaattcctggaaaatcaaggaaatgtttagagaaattgttaaaattttgggaaacaggaaatctgagaggaaggtcaggttttcgtagtctggatatgctatcggagaagtgagaaggggtgagaagatgggtagggtgagcttctttcttttctaggcgctcatcccctgattggccaatgtgttggtttcctagggctgctgtaacaaataaagcactggcctcgttggcctcagcggtggagctctgccgccgga

SEQ ID NO: 4915 - DNA, 1011 bp, Homo sapiens
  misc_feature (1)...(1011): n = A,T,C or G
agagacaaggtcttctatgtttcccagtctcatctcaaactcctgggctcaagcaatcctcccatctgtgcctcctgagtagcaggcgaacacagagtctaacttggagattcaataacagagcacggagacaaaagacagctggaagtatgatccaggcgctacagcttcttagatcttccaaataaaaaccaatattcctttggattacatgaattaaatggaaagacaaagcttggaaattctgacataggttctgacaatattttctttcttaaatgaaataaccattttagagacaagatcaatatgacccattttaatatggggtctgaatccactctttaagcaatggataactatggctacatagtaaataaagggtgatataattttccaagagctttgattcataactgttttagaatcttagaagcattgaaaaaattaatgaaatcatcagcctttaccccatggaaaaataataatcattttacaattttgtacattctgcggaggttaataatcctctgaaatcttagactctcatatagaatctagtctagaatatggttcttaagaacaataccagtttttaaccattgttttatgtttatataaaattttaattgttctttaattcatacctatacagactggtgggctgggctgccagaagtaccgattttctacctgaatgcaggttattctttcctctccttgaagttcatatcctgggtcacattgaaaaacaacagtgtccccaggttctcttccatccccatttcgagtcccattcatggggacccctgggtcacgacacgcagtggcaacagaacctatcaaaagacagagacaaaattttagttttgataactaccaaaatcaatttcatatatccctgtgttttagaaaattagtttttaccattctggggacaatttttaaatgctatacaataaacacgtggcgtcgttcccctcaagcggtggagctnggttgcgatacaaa

SEQ ID NO: 4916 - DNA, 493 bp, Homo sapiens
tagatccatgatgcatagttacaggatatgagaattcactgtgaatcccccaaccactgaggatggtatcacgatgagcaacgaccatgcagtcccatgaaatgtccctcagcatcacaaccagcagctcatcctgtcctttccctgctccagctatggaatctaccatatctccaaagaatcctggaagagcctctcctgagacaaaatcatatatcagaaaactaataagacaggaaatttaagtacacgttgaaagaaaaagatactttgttacacgaagctgaagtcagtgaaacttgtaacaaggcaggctcaaacagaggtaccaactacagggtataatttgaatctaggaaaaagcaccctgaatgcataggaagagctgatgttctaaaatgcttcatatctaagaactatacttaagaacgagattactgtaaggacttaaacttgttgacatgttcttttccaataaatatagatgcggccg

SEQ ID NO: 4917 - DNA, 396 bp, Homo sapiens
atctttccctttgggaatttttgtttttgttttcggtatggatcagatgggctcaaccctgccacctcacccctcatccacaggtatgagttcagtatccagattcattcaacaagaatagcatgtctccttgcttattggttcagtgatggattcataatccaaacaaggccaatcagaaccttccctgttaatgtgtgtgatacagggacattgggagaaagtatgactctgttcttctcaaatcaatagctaccataaactagaactgctgacagccatcttctacggctacatggaagtgactatctaaaggaagataaaattaagccaaaacacaggaaaaagagaggtgagagccagagagataaaaataaaccccgatgctggcctgag

SEQ ID NO: 4918 - DNA, 196 bp, Homo sapiens
atctaccatcagaaggcgagtgagcgctgtgtagaaggttgttcgacacctgaagtcgctgagactatgattgtcactgatgccaagaaaagggaagtgttcactctaatgaaagcaaaagagtaatccaagttactaacactttacctcaactatttgtaaaatgttattcattaattaaagaaataagacatga

SEQ ID NO: 4919 - DNA, 203 bp, Homo sapiens
aacaatgccaacattgaagtcctcggttggagtctgcacagttggagatctttggtgccattttagacatctttggatttcatcaatcaaactgactgcaattttccataaaaaccctgaatttgggtcagaaagtgggcaaagtagataaagatcattcgagctgtcttataagatgataaatagatattgatcggccggaa

SEQ ID NO: 4920 - DNA, 370 bp, Homo sapiens
ctgggaagcaatttggcaatgaagactttaaatatctcaagaataccatgaaacagggccagttgcaggttgagtcctgtgtctgggccctaatttccttgtgactgggctcctggtgatcatgcagttgtcttctggatgaaaggagctgtctgcggagagatctcagtggccacctgaagataaagggaagagagtcttcagggccccaacccaacttcaaccagagtttctgataactttggagattgtgacattggaatagaggaaaaacactttccgaactttcatggagtgctgcaatgttcacgaatgtcaagtagaacaggagttaactgcatggactaaactaataaacacggatgtgcct

SEQ ID NO: 4921 - DNA, 440 bp, Homo sapiens
agtttcgctgttgttgcccaggctggagtgcagtgagctgagatcatgccaccgcactccagcctgagcgacagagcaagattatgtcaaaaaaaaaaaggtcaaaaaccaacatatgttggcagggttgtggaaaattaggaccccttttacattgttggtgggaatgtaaattagttcaaccattgtggaagacagtgtggcattggtggttgccaggggatgggagaggggcaaataggaagtgactattaatggggttggaacttactattggagtgataaaaagatattctagaattagataatggtgactagcatacaacctgtgcacattctgaaagctctgaactgttctctttaaaaggatgaattttatggtatgtgaattgtatctgcataaaggtcgtataaaagtatctaccatggccaagcaaaaa

SEQ ID NO: 4922 - DNA, 262 bp, Homo sapiens
tttgtgaactcaattttagaaacaaaactgtgccagcagtgaggaagatcttggattaagaagactcaagacaccattttggagtcttaatattctaagcaagaaatgcagtgtacacaaatggaacagacttaaagctgttttagaggtggaaaccaataggatttttacatccaagaagaggaggaaacttcaaaaatggcactaagtttctagcttaggagctgagaggatacgctattaattaagaaataaaatccga

SEQ ID NO: 4923 - DNA, 391 bp, Homo sapiens
aacatggagaaagcgctgccattaggatgggaggtcaacatggctctgctggatgccagtggctttggatctgatctgacagagctgtaatcaatactcagcatttcctccatgcagttactccgatcatttacatattgccttactcctcatggcaaacctacacattcttgtgattttacagatgaaaagactgaggcatggaagggatgaagagcctgtccaggaccagcagttaatcacaggagaactgggagctgagcccaggctgcctggcttgcagctgccctgggcctgcctctctgtgctgcagggctgtcagatccaatgcccttggcatctgtagagaaaagcaatccacacaattcttatacataaaataaaaaccgat

SEQ ID NO: 4924 - DNA, 975 bp, Homo sapiens
  misc_feature (1)...(975): n = A,T,C or G
cggcccatcgagctttattaaaaagatcagaaaattggcacaatgacatagactaacactgggcatttttgcggggcccggggagctcaacctttgtttcataattattcctgcacctctgtcatgcatcgagtcctttttgctcatccctctgcagcccatgttaacttgaatcatggccagactcaaggacagagtcccagtgatctggggactgagctggggggtcctctccctcacttggtttttgaacagtcgtctaagttgacatgagttagatgtccagagcaagaaaagactggatggaggggtgaggcacattccttggtctctaaagtccagttcccaaatgaacaaaaccctcaccatcttacattcatatctttctcaatttttctaacatgagtccattccatctcacacaacacaggagtcctccttttgggctgaaaccagtatggttctggctctgctgaggagagctcatcttgaaacatcttttcacatgggtattgggggaagagagccttggaaagtgaaggggcttcccttaaacacccttcccatatgatacgggaganaaaaaatcatggggatgaggcatggtccggcctccatnccagacagacgtaaccctccatcgatgaacagataaacctttgccccgggggcctggcctggaatatttacggattctggggcgggggggcgttaatggccccagcataagattttagggcggggggggaaaatgtgaggatatgtttgttctgaagaaacggatcttgacaattgtgtctttgtattagacgactttggaaagcccgggggtcaaagattcctgtggggcggtgggcgtggaaaatctgtttagagactgggagtggacgtggcgccttaggagatgttaccgcgcggggtgtgtgtccagatctgggagcctgaaataacgggtcgaatagaggagaaaggggg

SEQ ID NO: 4925 - DNA, 427 bp, Homo sapiens
aggactcgatgaagaagaaaatgtcatgggtcatggggatcgaacaagtatatgacgacttactcaagagttttaaaagaagaaattgacgaattaactaaaaatctatgagaacttagaatatatttgtctacataagacaaaagtgaaggcaaaaatagaaaatagccgataaattggaaacctcagtaatttttaaaaatagttcaagaaatagaacacttgaagaatttaatttcaacacagcatttctccatggaattatatcctctacatgactgtattcattgtacaggtaaacctacatgtaactgtgtggaactctataaagaaaacaatattctatgtattttatgatcactcccccgaccccttgaaggaataaactattttctgttttctcatctgctagccacccattaaagca

SEQ ID NO: 4926 - DNA, 791 bp, Homo sapiens
  misc_feature (1)...(791): n = A,T,C or G
taacatttgcatacaggaatgtctggtcatacatctggaacaatgtaacgctggtggggaagatttttggaaaaacgctacaggctttacgtggcagaaatacccttcatttttttcttgttacaggatttgtcattagaaataagagtacaataacttgcagccaaaccatgatgatatctgtttattcagccatgaatacagaatgaattgtgtataaatattagagacacacacacataatttgcatgtatcactacatatggttacatatatttagtaagttcagaaggtatttttctctgtgttgctgaataatagaagatgcgtcagatttttaaaccaatgcattaatccatctctctttaaaatgaaaagattggcttatgtatctggttagaactgaaagttctgtgagagtcaaaagaaaaaaatacatccaaattacataaaataatataatgatatcagagaagactgtattcagtcattttactaagtttgtcagattttgaaatgcaatttttgtgaagaagcagggaatagcactttttacaatccccccacaggtgtcccaatgccaagattgttgtctctaatacaattcacccaattaaaagggcctgagatttggcttaggaaaatggctggttctgtatttgatgcaggaaatgtacaagatgaatttcatgcatgctgtagcgccccgaacggataagctaccaggaaataacagagacttgtaagagaactcaagagtcagctttaataaatcncgatggcgccccgaa

SEQ ID NO: 4927 - DNA, 548 bp, Homo sapiens
ccaaagaagaacatgaggcacttctttaaaaaattgtcagaacaattacaaattatttttcatcagcttttgagatgaatcctcttctttggcacctttttatctgtgaaactcatcaatattcaaagaactctaggaagaagattcacaatgtctaatatacgaagatcttgaaggattttgttatgttatgaaaataatcttttctgtgtcaaaggctggagtgcagtaacgccatctctgctcactgcaagcttcgcctcctcggttcacgccattctcctgcctcagcctcccgagtagctgggactacatgcgccgccaccacgcccggctaattttttgtatttttaatatagctggggtttcaccgtgttagccaggatggtctcgatctcctgacctcgtgatccgcctgcctcgggccccccaaagtgctggcattacaagcgtgagccaccacgcccagcctaaaggacagtttttaagtctggtagctagacttatacaaatttgatataagaaaaattattaaagtttaggtaaaa

SEQ ID NO: 4928 - DNA, 263 bp, Homo sapiens
agaacaccatatgaagataaagacacagatgggccgatgctgcttctataagcaaagaagtgccaaagattgccagcaaaacaccaaatgttgggatggaggtatggagcagattattccttcctcctggccttgagaaggaatcaaacctgacaatgtcttgattttaggcttttagcctccagaattggagacgatatatttctagtgtcagatccattcaatttgtatgactttgttatggcagccctaataaactgaga

SEQ ID NO: 4929 - DNA, 845 bp, Homo sapiens
cggccgatcatcttttatttcatgcaggtagtggctgaagactgttgagagcaagggaagatcaataagtgtctccacaatgtcaaaagaggttgaagaatgaaagattcacttagtctctcagttgtttatgttggtggtgaaaacaaatatttgactctttgtgagctgaattggtccctttgaaaattgcaaagtgtaacttggaggaatgatgagcacacaattacttaaaatggcaaaaaggagtgtaaacatatgggtaagaataatggagaactctggagtggaggctgcagaatgtggtggaaaacgcagtttcacatgcttaccaaccagctgagagcaatttctaagagcaccacccaaagaaccatgaggctctagcggcagatgtttgcttcaggagccagagctcatgattggcagctcacttcaggaggctgtgtgaaatgcatccacatttggtccagagcaagcctgtggagctttaaatctttaatccattttgaactgatctttgggtatggtgtaagataaggattcaatttcattctattgcacttgaatatccagttttcccaaaaccatttggtaaagagacgaccctctcctactgtgtatccttgatacccttggtgaagatcagttgatcataaacaagtgactttatttattggctctctattcaattccaatggtttagatgtatgtctttatgtcagtatcatattgttttaattactttagctccccccatatattttgaaatcagaaatgtgatgtctccaaatttgttcttctttctcgagactgcttttgctgttcagggtcttttgaaactt

SEQ ID NO: 4930 - DNA, 184 bp, Homo sapiens
cttataactcatgcaaaacaacatgctgcaatgttctgatgaaatgttcctttacagtcgaggctcccagaaggcagagagcatattcattagagtcattgtgctcggcacgtaggtcatgtccatggagagatgttgaatatgagctcctattaaaaagagggaatacaacaaacaaattcga

SEQ ID NO: 4931 - DNA, 339 bp, Homo sapiens
gggatctgagactgccttggccaatagaatgcagccaatgtggtgctatgcgtctgcctggcctcggccttgagagacctgggagcttccatttatgtcatcttggagtgctgagttaccttaaagaagtctaaaactcagagagaccatgtggaaagagaggagccagcggccctgcagtccttccagcctcccagctgaggcaacagacatggtcagaagccatctaggaccttcagcggcagtgaagtctccccagtcgatgccacacagaactgagatgagctgttctcaccaagctctgcccaagttccagagctaggaacaaataaacccgga

SEQ ID NO: 4932 - DNA, 529 bp, Homo sapiens
ctgccgatcgggctttattgcaattccagaatctagaaacacttcattccctaaaatagaataagtattccaatgagctggccagaagaagttagctttttgttttgttttgttttgtttttgtttttttttgttttgagatggagtctcgctctgtcgcccaggctggagtgcagtggcacgatctcggctcactgcaacctctgcctcctgggttcacgccattctcctgcctcagcctcctgagtagctgggactacaggcgcctgccaccacatccagctaattttttgtatttttagtagagacggggtttcaccgtgttagccaggatggtctcgatctcctgacctcgtgatccacctgcctcagcctcccagaagttagctttatagacagagaagtctccaggaacgtggccaggttctcacagtgaatatcagagaaaaatcttctcatgcttctgtcaggcggagcggaaatgtagccattttgaaaagcaccagaatattctgctccattaaaaagt

SEQ ID NO: 4933 - DNA, 634 bp, Homo sapiens
cggccagcatccggttttattatacacattggcttgtttaatggaatttgcttctggaggacactggaaaaaactttcatttaagtattttaaaatcacataatgtgtgttgcaggaattcctgacatgggctcatggacactgcagactcagagataggcctcagaggtcctcccctcaaggactgcatgcagacattcagtgtgcaatacatgcatttttgtggaaagaagttctatagcttttatcaattcttgaaggagtctgtagccttgaaaatatttaataaccgctcttctacaagctctaagaatgtaatgcagtggatgaggccagaggttgtctctccaaagagacagatagcttttgtctgatttgatggctctcctttagttctctttcttccattccatcattgctttagatgaaatttgtccttcactcttccacagctgaagaaaccatggagcgccaccattaagataatattctgcttgtgcgttggggttgtggtgggccaagatggtgggcttcttggaggagcagcttggttagaagctggtgatgagcagcagcaaggatgaccagtggcagtggtaggacttcatgtgggacatgacttggctggcgctgc

SEQ ID NO: 4934 - DNA, 119 bp, Homo sapiens
gcagtttattattttctcccatactcctcttttcttccaagtccaccttctgggtagcaagagggagggaaattcataaattttgaatccaagttgtgataataatccattgcggcgat

SEQ ID NO: 4935 - DNA, 792 bp, Homo sapiens
atttcactgcgcatctacagacaaacgcccaacttgcctggaacatcaagaagagtgaaagcgaacccatcatggtgaacagagatcaggaggaaaagcctgggatcatcaatcaatctccagttcatcccaaacctactcaagacgcagcaatcatgtgaaggaaaggattcctgactctagcaatgtgccttcagaagcctgatcacacaatcaagtggctctaattccccagggcaaacatacctgttctgtttatctaaatgagcagaagtgttgaaaaagatacaaacgagagaaaaaacactgtgctcagaatattttgtatttgtcaatgtgcagttggcattggagtgacctgctgtattgaaatgggactggcttgagggagggggttgctgaaaagagaggagaatgtggaggatggaagtgagacagacaactcagaatttttcccttttgaatttcaacctgttggataaaaacaatagcaaatgaggcactgaatatgcatgaggcagggaaggtattttaagtttttcaggagacagctcgctgaacagaattgctaattatgtctcacattgctctgtccaattcagttagcttgattatggctgagttgtcaactcccctgcacttgaggttccacagttgcagcccattctaaggcttaatactaaattacaattatatttttcccccaaaaaaaatgttttcccttgctgaagtgctagctttatccattgtgacaacataactttctcaacaaaaataaaacttatcgggccg

SEQ ID NO: 4936 - DNA, 450 bp, Homo sapiens
cggccgcatcgtggtttattttatttaaatatatgttaaatcacagaatcatgaaacgttaggaaagatgacaacctggggatcaatccaatttcaatcattttacaggtaaggaggctcagatccagggagaagacgtgatttgcctacggttgcacaactagctggaattagaaaccagcttgtggtttatatctgaagttgttaaacatgactctttggatggtaagaaatggaaaacagttcaagctaacttttggaaaatttggggtcacaccattaagaagtcagtgaattgcagtcatggcttgatctaggggtatcaatgtttgtagtttcattcacttctctctctctccatcttcagaattgacttctttctctagtggccttatttactcctactggggacaggcttcactcaaaacaacaaaaacaatggtttcaaag

SEQ ID NO: 4937 - DNA, 179 bp, Homo sapiens
ataagaagactaataacgctcagagatgtcagataaccactcactgtccctcagtcatggtgattcagaagggtgttcaaaactgggtatatgtggcttcaacatactcttctaactatgccaaattgcctctcagttccacgtaactacctcagtatgcttacttcaataaacaacga

SEQ ID NO: 4938 - DNA, 519 bp, Homo sapiens
tgtaaacaaagtaaaaaaagctcagtcgtgtctacacatgtatgtatgaaactgaatatggactaccttttatatcttctttacattatagctaagcaagacactctacagagtaaaggcagcatgtgctaaacaatcaatggactctagacggttgtgtggtagccgaggaagagccaccatgagaggttccctgccatcagcctggcaagccgcaaggcaggccaaaggaagaacaatttggtttccatagcaaatattccaacttcataaggaagtacaaagtgttttgagaagaaatgccctccatggacagagaaatacttttgaagtgcaaaaaagaacttacattatcactaggtagcttgaattatcgaagagaagttaccacctaacgtcagcatgaagttacagtgtttaccgccattaccctcccataaatgttttcgtgctctgcacagcagatataagctcagatatgcttattttgagtaatctaaaataaaccgagatcggccg

SEQ ID NO: 4939 - DNA, 268 bp, Homo sapiens
attcgggggtacatgtgaaggtttattacacagatgaactcatgtcacaggggcttgtggtacggattatttcatcacccaggttctcagcagcacccagctccagccccaaggcctctcctggatgcgcctctaggaccttgagctcagtgtctgttcaacccctcactgaactcagttctccacctcggccatttgagatgcttagtgaaatccaaggatgactttaatagttattcacacaatatttcctttaaataaacctaga

SEQ ID NO: 4940 - DNA, 347 bp, Homo sapiens
tcaggccagcatcggtttttatttttttttttctataagaaacatattttatatggtttgagaggctttgacattgaggtctgtgtgttatctgttaagttgcttccaagtcttcgtgccatttaaatgacatatgaaatatttctgtactaacgtacacttaaagccaaggaattcagtcaaaatacaatgtggttgaaaaaaatcagagacgcatttttttcttcactaaggaaaaagctgaatgtcaggatccatttttgtcaccataaattcttctacttccaacaggacagcgcatacaactccagattttgttagcttggtagcaataacttaattttttt

SEQ ID NO: 4941 - DNA, 407 bp, Homo sapiens
ctccaaagtctgttgcctggtgactggacagaagctggaatgtcctggcagatctattgtggcaagaatgtgcaaatcccctctacatggcattttgcacaagatttgatgagaaaatatggggaattgctcactggggatgctatgttttgtttgtctgttccatgcaagctccatttagaggcctttaagaactctaagactagggtccaaagcaaataattatagcactaaacaatccacccctcaaaacatatattttcctctaatgtttttgtttatttatgatgtttcacataagatgatcacatcacatcaattatgatgaaaacctttgattggggggctttggaggaattcctcagaagatcaatcttttaaataaaaataaacgaagatcggcctga

SEQ ID NO: 4942 - DNA, 309 bp, Homo sapiens
aagctctggctgactggtgggagttgcccaggaggatcttacagctgaattgatcccaaatacttattttaaaagatgctccatgggtgacatcatcatgagaccaagcagtcttcaccttccagccgccagaaacttctcagactgccatgaggtcttggagacctcctttcctaattcttctcttgactctcatcccatgattcggatgttatggaaactaacatctttgcattatcttagcatccaaaatttcgcctgtgagagttaacttgtgattttaataaaaataaaggacgatgggccgga

SEQ ID NO: 4943 - DNA, 460 bp, Homo sapiens
aaagttgctatatttaaatcatacatttatgtccctagaaatttttattagtttagtaaacctcatacatttattatactgtcttattatcaaggcaaattgcagtagaaaatgacactatttggaactagaaaactgttttgagtccttattccattaggtgctagttctgtaccctaaggaaaggattcttcaactctcaggttccttatttgaacaatggaacctaaaataaatgagataatgtatgtaaagagcttagtgcagtatctggttcaaagggcaatcaataataatactacctgcctcagaaagctattactttgatgagggtattaaacaatttcacagatctttgcaaagtgctagataagcatcagctattatgacaagattgctatttgtttgccttgccaaaaataaaacattgcctttaaataaaactcgatgcgggccggaa

SEQ ID NO: 4944 - DNA, 195 bp, Homo sapiens
ctcggagtagtttgatcgtctgaagcctgcttctctcaactcgtcaaagtcattctccatccacatttgctccattgctgcggcagttggctgaactgagggtttatggagtactacaacatccctgacatcgttgagacaggatggcaatgctgaagcaggagatataatctaataaagcaggatcggcctgag

SEQ ID NO: 4945 - DNA, 296 bp, Homo sapiens
agatgggatttcaccctgttggtcaggctggtctcgaactgctggcttcaagtgatccacctgcctcggcctcccaaagtgctgggattacaggggtgagccactgcgcctggacagcatgttgacttttcatcttcagcttgttgcctcatgatcacaaagtagctcccagagtgccaggcatcataactgcattcatggcaggaaaaaagatgggtctttttttttttcagtggtattctgttcttttttatccagaataaaattgttcccaaaataaaaaccgatgctggccg

SEQ ID NO: 4946 - DNA, 448 bp, Homo sapiens
cttggattctgtccttaccctacatcttcaggaggtgatcaggtagcaaacctgaatagctgacagcaaccacatccacctcagctatatttctatgcataaacattgaatgagttaattcctattcctaagaaactttctaaacacctgcctaattcaactcaattctaccaccatatctacaacctgagacaatcccacaataataacacctcgccccacccgaatgaatccgtagcctcagcgctcttggagattctttgctttgagcaagactgaaagtccgaacgtgcagcaccaagtgtactccctgtgggtgactgcccagaccgctgcccacctgatcgctgatttggaatcacagaggtgccacagaaacctgggcagggtaggacctggggaaggaacagagttgacacctgaagaaataaaagccgatcggccggat

SEQ ID NO: 4947 - DNA, 327 bp, Homo sapiens
ccccaggcagagctgaagtaaggctgtcatccaaggccctacttaagaagcagatcacaaggtacacgactgtggacaaaacaactgtgaaaacctacaggacatgcagcagtcaaatggaaaagatatgtccccagcaaccagagggcagaacaagcgcacccagggattccaagaacttggtttccccaacgccatgaggttgccacataagcaaccactcatccctatagagaagcagaggaggaagagagaagctacctgaaagaatatgacctttagaaggagagattaaacacttcctaaataaactaagatcggccggac

SEQ ID NO: 4948 - DNA, 789 bp, Homo sapiens
cactgataatgaaagtcaaggctcaaaggacagaggatttccacgccagagcaatgcaccagaaagagactctggattggagagaggacaactgtgcctttggaagtgggagaaaggttacggtgaaagaagaggtggagctgagaatcagcatgacatctcaaaccacagaacagttttaggaaaaagtacaaataaaagtttaggatttgaaatcaatttccccagaacaatgcccttgaaatgttgccatggattcccaggatagtcataccctattttgaagccggccgtccttaccctacatctttccaatcagattaggtggcttaactcttcccatttataatagagctacaggtattaatcttccaaaaataacatttcaccaagccactttagcattcaattaactcccaatgcctctccagtgtgtaaggtatgagcacaaaaaaccacgaatccatctgaatgtgaccagtggcccttcctaatctgccttcccaccttgacctcattcccgggaatctaaaagaagcagtctttgcttcagtcatactggtccccttcccatttaatctgtttattttgctcaactgcagatcatatctttgctcatgtggctttcttaggctggaatgcttcatctgctatcatcaccctattgtgataatcttcttaggttccttcccactggaaatttccccttcccacttgcggacgcaactaatctctgcattctcattaacttacacatgcaacatggctattaatatctggactactttt

SEQ ID NO: 4949 - DNA, 218 bp, Homo sapiens
ttttctgtgcaaagggggaaatccatcacacagattcatgcaccgagaccctgacacatgagagtaatcttgccaagctctgtcctccccactttttccatcccctgtgggacttagggaataagtcggcttctcttgacctaagattactgacctatacatgaaggagtggccagactaacgaaaaaagggagaagacccaagtaaataaaagcaga

SEQ ID NO: 4950 - DNA, 149 bp, Homo sapiens
tgttaggacacctgtttcccactcgttgtgtgaaaacggaagtcagcatgaggccccgatctggagcctagtgggtgctggtgccaagcttctgggaccctccaggccttcagaattgtgaacaaaataaaccccgatgctggcctgaa

SEQ ID NO: 4951 - DNA, 407 bp, Homo sapiens
aaaatcctagaacttcctttgatgttgaccgaggttgtcttgcctccagaaataagagattctgctccatgctggcgggggaaagaatgttcaggcaaagaatggcacaaataagataggcatcgcagaaatgctgatttcacagtccagtgggatatggtggcccaagaagcagcaagcaaggtcaacatgcaattattggtttctttctctggccaaagacaaacagattctaggttttggaagagaggatgcaattatgagcaacggggaactgttagtgaaaaattcaccaagaagtcagagagtgcctttaaacttctttctacccagtgttgtcctattaagaaaataatgtcagtttcagagagtgatgttttaaataaataaaggctgatcgcgctgac

SEQ ID NO: 4952 - DNA, 190 bp, Homo sapiens
caaggtttgcatttgtgttctccaccagtgatgtacaatgacaacccttgaaagagtcactgcaaacaagtagtcatgatggtccaatggatcttgatgcatcatcatatgagtaatgatacaaccagcaagaaataaactacagagataagaaaatctatttcatttcaataaaagcagatcggccgaa

SEQ ID NO: 4953 - DNA, 332 bp, Homo sapiens
tagactgtgtgaccaatttggggttcagaaagcatggtcaccacagactcagccattccagatgaacgcttgcattccatcaactctcagacagtttgatcatcgagtgcttgctgcagcaccccctccggcttggaccccgtgcacgttgttaccaagcaaaagaaacaagcagaaaaaggagggcattgctctcctacaatattataggaatactattctgtataatttttaaaaggtagacaaatagttttttaaactacacaatgcatattgtagaaaagttagaaaatataacaaagcaaataaaataaaacgcgagtccgcctgac

SEQ ID NO: 4954 - DNA, 174 bp, Homo sapiens
ttgcagaagagctgcatttggtttgagcaggatcttaaacctgaatccaaagtatgagagaaatcctgtgcagaacattgctttttgtttccatgattatgaagacacttgccttttaaacctgaatatattatgttaacataaaaatacaagaaaataattaaaaaaccctga

SEQ ID NO: 4955 - DNA, 217 bp, Homo sapiens
ccgcgcgatcgagctttatttcttatagttctggaggctgagaagtctaagacctggggacctgcatttggcaggggccttcttgcttcgttgtcatccttgcggcggcccaagacactgcgattctggaggcagcccaaatatcctcggaagaacgcccccaggagaaacaagctggaccactctgctgtcatcaggtttctgctgaccactgagt

SEQ ID NO: 4956 - DNA, 355 bp, Homo sapiens
ctctacttaccagccgaggctaccaccacacagagtgtactgcagtttcaggcttggagaggaagggaggaagcctaaccctcgggagaccccgtcatgttttgatgtcattgcatgtcccatttggccagcccggaaaaaataaaatgaggaaggtgaatataaatctgttggatacaatattgtgtgcatggtaggtgggccgtcagtggtgagccggggccgccattcaggctccacctactcagaagtcctcgggcagcatttaaggacacgaatcacctgacttcactgcggggaaatcctctcacggcatgacttcctgtcacagtagaataaaacccgatgctggccg

SEQ ID NO: 4957 - DNA, 479 bp, Homo sapiens
tctggctttatttcataagagctaagataccaccatcttccaacatttattggggactacaagaaatcattgagaattcctggaggacatagttctcaaaagccatccaactttgccatttgtgaactctgatttgtgtggtgctggtgatgtacgcctcggtttcttcctccagactttcctgaatttcctgaaactgatcctcttcagagaacatctcatcagcatgcataccttcatccctccccacccaaatctagaggccaccaaaaacatcctctctgtggaacatatttgcaacatttttgacttggtgttcctatttcagccatttcaataccaggaactctttgacatcgtcacatgggctattttaatcctccacattttgacataacaaagaaaagtgcagtctcagatgtcttcatgaatgaattccactgaacatctaaagatttaatacccattcttcacgaact

SEQ ID NO: 4958 - DNA, 472 bp, Homo sapiens
gcttttcaaagaaaagaaacttgaacatgaagaacagaagcaagtattgaaggccaccacttcattaaatgtgtctgcatggagagcatcattcttagtggctaactgcattgctaaaggctggagtgcaatgacaggatttcggctcactgcaacctctgcttccagtttcaagcaattctcctgcctcagcctcccgaggtagctgggattacaggcacctgccactgcacccaggttcaacaccatgtggaagctccaaaggcttggtgcttacaccctctgccaaggttggggcttgcaccttttcttttgtaaattgcccagcctcaggatctctagatgaaagaactagaatcaacagatgtgtgtgcagggagaaatggtaaacaagagctttcattaaatcagagatgtcccacagctgtcaaaaggaaaaacaaatttctttgcaataaatctggatcggccg

SEQ ID NO: 4959 - DNA, 197 bp, Homo sapiens
gttggtgggggttttctgccgcatcccactttatttaaattgtttaagatgtaagtaaaattaagcactccttccaattcttctgctcccatcaccttcccctgatgacagatgatgaattagatgaagtaaaatctgacagaacttgagcaagtggaatttattctttggtgttaggcaaatatttcttagattat

SEQ ID NO: 4960 - DNA, 289 bp, Homo sapiens
ttgttaatgtgttgcctctggtttgggaatttggaactaattaaacagcggccgtgttgtaagctgtcctatgaagaggtttttcatgacaagaaactgatgcagccaacagccattgaggacctgaggcttgtcagcagccatgtaagtgagcttggaagtagattaaaatgactgtaggcctgacctccatcttatttgcagcactatgagagaccctgatgaaaggacttgcctaagctgtacctgaactcctgacacttagaaactgtgagataataaatggtga

SEQ ID NO: 4961 - DNA, 539 bp, Homo sapiens
ctagcttggacttgttctgatggaaatagcaggagtcccaactacaagagttgcaatgtcaaggcctcatcttataactggcacataggtcacttccaccatattctttttgctaacgaaagtcacaaagtcagtccatgttcaagtagaggggaaactgactccaccacttgatgtgaagagttggaatatcatagttattgtttcttgtgacttgccatagcgtattttctcacactaacaactctgtatttcttcccaaattctgaaaaattcttttgttggctcttcctgtacttgattcattacattaagttttccatttaaatgttatttccttggaaagactttatcatttgtcaagtaggtgtattctcttcatcagttactctattttctcattacaatatgaactttgtaaaaatgggaactttactttgtttatgccagtagtttatatacattttctgttacgtgaaaagtacaaaatgtttttttcatggttaaagaaataaaagaataaatatgtaatcactgca

SEQ ID NO: 4962 - DNA, 194 bp, Homo sapiens
aatctgatggcagtgtagacgcctctgacttcctgggctctgggctcaccccgagactggttggaggaacaactttaaattgttcactgcattcctactatgatacatcctttgcactggaggattttttgtttgtttttttcacaaggactccaagaggctatccttttcttaccatgtgtaataaaatttga

SEQ ID NO: 4963 - DNA, 936 bp, Homo sapiens
  misc_feature (1)...(936): n = A,T,C or G
aaaaaagggcgacgacgtacagaacgatggcattagtaacatgcggtgtgaactagaagaaaaactatgaaggtggtaaggcgattcctgggggtaggagtacaaaggtgggcaaaaaaacaggataagtagggggaggtggtagagaaggtaaattgaggtagggacaatgggaccgatcgaagcacccgggaacagaaacaaaaatgagggggaaaacaaacaatcgcgggcgaaaaaagtcggaaattggaaatggaaaagaatgaaaagcgtaaacgggaaaagggtggggtaaggtcggaaaactaaggaaaatacggactggcgggagaggcgggatagggctgaagtaccacgctagaaaggtggagggacagacgagaggaggaggatagagaggcgggagacaatgaaaacggtagaaacggttcgaaggttgatggtactacaagcattggggatacaaaggaatagagcgatcggtacatcgtcaggcgagcatgtaagagttgggtagtacaggcttcaaagtgaccaacgccaagcgagggtatatttttatttattgtagcaatggggcctcattatgtggcccaaactggtcttgaactcttggcctcaagcaatccttgtgtctcagcttcctcaagtgctgggatgacaggcatttgagccaccatgtccagcctttacctaacttttgagttaaacactctgggagaacacaaacatggaaatggatgagaaaagagaacatggtgggagaaatcagagctgagctcgggccttggaaagtgcacgagtgattttgtcacagaacgtgccacgcaattttcatctgacttaaacatgtctcattctgtaagaataaaagcggaaggcgccaaggcaacaccnnnnnnacaacnnannttgcgggtggaaaagaggaag

SEQ ID NO: 4964 - DNA, 378 bp, Homo sapiens
atttattggttctggtatttggaagtgcaggcagtatcttagcctcaggaatggctggatcatggtggctctctccacttctcagctctgttttcctctaggctgactttatttagattcaggtttacgtcactgatgcttcaggaatctccagtcaaccaaaaagagtccaggaccagatggattcacagccgaattctaccagaagtacaaggaggaactggtaccattccttctgaaactattccaatcaacagaaaaagagggaatcctccctaactcattttatgaggccagcatcattctgataccaaagccaggcagagacacaacaaaaaaaagagaattttagaccaatattaattttagatcaattaa

SEQ ID NO: 4965 - DNA, 516 bp, Homo sapiens
  misc_feature (1)...(516): n = A,T,C or G
cgccatattatcggtgatggtgactacggttgggcaacgggggcgtacgtccacgagcgggtgtgtagtggtcatgccctactctcggctcgcggcagggggtcattacagaactggggggtacatatgtcagccgcggtctgatcgtgcacaatcgtgagttctggcgctacttgcgtgggatgggcgatgtatggtcttgtgatttacaatttttacgatacttcaggcctatcaggtcacctactactattgtttgctctgggtgctctttcgtcctttactgctcgcgggtgcgggctgattacacagtgatcacgtgcggcggcggtgatcgttattctgatctgtgcctgaggctgccgttgctctgtgggttttgcgttatgggcgcctcaaggtctttgcgcaccataggacctacgtcagtgtgcattctcagctctcctaatggtgcatgtgtgctatgtgcccccactntaattccttatttcccttacctcagcgttccatcat

SEQ ID NO: 4966 - DNA, 342 bp, Homo sapiens
caaccaatgatttcggcacccgctattcgtttgtgtgcagaggactgtttctttgtctgtgttgtgttcggtgttgtcttttatacaagtgtggcgggagggcttgtgacaggcttgtgggcttttcatcacgtggggggcgcgctagtgtatccacgcgctcattaccgctatatcccgctcgcacatacccgcttctagcctctttctctcttttcttaccgtatcttgggggtacgcgtggcttctattttcgtactgcttagatcgcctttgacacgtctcgtggcgggtgatgcggtctatttaacttccttatcttaaaacgggggcagtaacgcg

SEQ ID NO: 4967 - DNA, 584 bp, Homo sapiens
gctctatataacttgaccagccagaactgacgggcgcatcggcaaattaatcatcggctgggcatgagaatggcagttacaacaaatcctatcgtaggcgcggagcatcgtacaccaaccgccgctcacaaaaacaaacgcaggaccacgacactcaaaatccacgcgagcacgtcgcaactcccgacgagatggctgttgtctgcggggtacgatatcgagcccaccagcaattctggcgcacatagggcactctatatttatagccgcaccctgttcgccatcgatcatagcattgctgtgtgcgtcccgctcgcacatcattacactacgcatcgtggcatcacgtgcttcgtgacacgacggggcaacatcctacacgccgggcctcctaatactacactacaccggcacgagacacaacacacgagtccctcacgaacctgtgcattggttgtcaacggcgtcacgaatgcccttgtcttaggaagtagcacaacacggccgaactacatggatctacacacttcggccacaccaccacgagtgtaggcgagatgcgagacgatctcgtctgactaatc

SEQ ID NO: 4968 - DNA, 165 bp, Homo sapiens
ttattcacttgtggggatcacttcacgtatttcaccacatagacagcattcccttgtgccatatttctgattactttgtgcccagtgaggatccttcattcatttattgcttctttccttcccagttacttgtgtttcttttgtctggacagaagaaagcggtaa

SEQ ID NO: 4969 - DNA, 263 bp, Homo sapiens
cctgggccgggtggaccaggtctctgagtttgagtatgatctgttcattaggccggacacctgtaatccacgcttccgagtctggttcaactttactgttgaaaatgtgaaagaatcacagtaaatctttctgctgctcattctttgggtccgtgctgcctttaagagctttaacactcaccgtgaaggtctgcagcttcactcctgaggccagcgagaccacgaacccaccagaaggaacgaataaagccagatcggccgaa

SEQ ID NO: 4970 - DNA, 152 bp, Homo sapiens
ctgcctggagaaaactctgagggctaaggggtggacagagctacaagaccgagaatcttgaatccctaaaggatgacatcaaaggccacttgtcagctagacacacccaactggactctatttaaatgagaaataaaacaggatcggccgga

SEQ ID NO: 4971 - DNA, 223 bp, Homo sapiens
atgtattatatttttcaattcagaaagatgaaaaaaaggggagagggagaacctaaaccaagaacattatcccctcaactaagactgttcatgacacaagcattactagaacaagcccatcttcaaggggaagataattatgcttcacctcctggagggagaaatatcaaaaactggtaaacatatgtttcaaaaaaccaccatggtaattaataaatcaaga

SEQ ID NO: 4972 - DNA, 278 bp, Homo sapiens
aggtggcaagcagaataaagaacttgggatatctagagcgtgcctgcaaagcaagaacttccttctatggctgttctacaccacaccctccgaccaggcattcatctgctgtgttcactgatggaggagactctaggaagttctgttaatatttccccctatttgccccttgaagggaccgagttgtactcattgagcttgtcactctccccagggataagctcaatgcctggcttacagcaaacttcacatgaatgtttgttgaatgaataaaagca

SEQ ID NO: 4973 - DNA, 332 bp, Homo sapiens
atatcataactaggggggcggcaaccatcctgcaaccacgaggacagaagccgaaagccaccaagagacagaacccttatctgagatgatgtcaccagtggctgcattcaccttggactactacccccttccactgcactgcgtgagacaaacccgtgcgctgggaagttttctgtcatttgcagctggtcggttacagaagcagcccatccagctggcgtatctctgtgagggttgtagcggaaatcatataggtttctacccatcccatgtttttggtctttattcttggtcttttattaatatacgatcggccggatgcccggccctca

SEQ ID NO: 4974 - DNA, 451 bp, Homo sapiens
cttcaacctgggcgacagagcgagaccttgtcttaaacaaaaaactaaatattgtttctcttgattcaagtaggcgcacttgctcctcccttatgcccttatgcatggagtcccccttgcattcacatctctggcttcactgctgatgcctgaaattcctttaaacaaggggagaaaacatttcattccacaaagaaaaaaatgacaaaaatgcaaaaggctggctaccattatattgagtttaactgaatttcagttaatcaccctgccaagtggggcctggtgatgcatctttaggagatgcaagagagactcaacagtttattgagacctaatgtgtctttcacatcacggtcagcagaggtgaatttaaatcaatttgtataatttccaatgtcttaataaatatttactgaatggtctaagaaataaacccagagtgcgtccggaa

SEQ ID NO: 4975 - DNA, 295 bp, Homo sapiens
ttttcctcatagcgttttgcactgaagcaagagctactttacactggaagatcaaagaggacctctggaggaggtgaaatccgaaaactgaataacacaaaggggcccaccatgccaagttctgggaaagagcattccaggcatagcaaacagctggtgcaaaggtgtgaaggcaggaacaagcttggtacatctggggaagaaatcttgatatatctgggcaatgcggctggagcacagtaaatgagggagagaagaacaaaagattaggacacaataaatgaggatgccgccg

SEQ ID NO: 4976 - DNA, 365 bp, Homo sapiens
cccccacatgcggtaccagagtgacacttatttaagacatttaaataagatcaggttcctccctcaccctccaaggtgcggtcaccaggtccttgtccacagtttagtacttctctctcctgcctttttcccagacttcctgcccttgggaaaaacacactccggatggcccactggtccaaggaggatgaaaaacagtgacattgatccagatcatctgcagcctggagtcaagtctggccaagtctagcccagcccagcccagactagaatacacaatcccccacccagatgacctgcaataacatgagcaagaataaatgtctgttgtttcaagcaaaaataaaccccgagtccggcctgag

SEQ ID NO: 4977 - DNA, 660 bp, Homo sapiens
gtctcagctgattcgaagctacctttgtgtctttttgagtcagtccagtacattcctagaagggtcttaaacatctccttccctgattcactggcactgctgatgaagttttcttcggtctgtacaagaaaatttgggtggatgaaagcatgaagaacggatttgagagatgttgtgatggtggacttaggacttggataaagacagaacatggtaaattagaaatgtcttcaaattctttgttactctttcctttaagagactccttcttcctgtcttgaatctcagctaagtgacttgcttgatcaatatggcaaaggtggcattctgagaattgaagctgagtcgaagttttgcagcttcctgctggacgtcttgaaacacatttccttgttactcagcctccattctttgaagaagcccaaaaaactctgtggaggggtccacatggagaggaacagaggtccccaaatgacaagccagctaagctcccagcctacagccagcactatattgctacatgtgattgacccatcttgagccacaccagcttctccacacaccatgtggagaagggaaagcgctatccctattgacccaacccaaattgcagatttgtaagcaattaataaaaaattaataaatgatgatgcggccgga

SEQ ID NO: 4978 - DNA, 265 bp, Homo sapiens
  misc_feature (1)...(265): n = A,T,C or G
acttataggagatggggaggtttgtgctgcagggatantgacctttggtcgctttccctcttccctaccttgaatgtggatgtcctggctgggaacccagctgccagctcatgaccaggaggtaacaagcaggaataaaaggccaccagagtcacagagacgaagctgcggcgttaccgaggtgcgaatcactctgattcctaggtgcgaatcatcaccagcaatcacttctctcaggactacttgtaagaaaaataaaactcga

SEQ ID NO: 4979 - DNA, 399 bp, Homo sapiens
ttccggccgcatccatctttattatcccattttatagatgaagaagctgaagaacagggatgttcaataacttgattaaggatcacgaaaccagtaaggaataaagccagaagtttttctcagcagtctaagtccagggcgtattctctcaaccaatccacaacattttctttcattgtattctacatcattggatgatacactgttgccatgtcaggaacttctttttgatagtttctcatctctctcaagctactcgctggctttctcccaactgcaggtgattgaattctgactggttttcaaaatttttcttctccaaaatatagggattctgaccagtgattctctttattgggaatttgcatgataattccatatgcattttcatctctataa

SEQ ID NO: 4980 - DNA, 484 bp, Homo sapiens
agaaggagcatcaccctgagaagaggaggagaaacttgattcattcttgctgctgctgctgtcactgttgacctgccaaccagaacattgctatcaagatttcacagcatattttctctctgaaccacgacgattttcccagaaatctctcattttggaaataccctgtctgctgatgttgggagtgacctcagggaggcagctaatgaataatgaattggtatctaagactaatagactaatattactgctagtggctaatacctaaatcaggatattctagagtcttctatcctgccaaccctctaaatggtcaagctacaaaaagcgattaatagctctttcaccacttaacccagcaattagccattttacaatttttttctcctctcaagcatgcacctttcaaatttttacatttttttaatgacctccagatttcacctgaataaaaaccatgaaaataaaaaaagatgggccgaaa

SEQ ID NO: 4981 - DNA, 244 bp, Homo sapiens
acattcttattcaaaagaaagaacaccgaaattgaccttaccctgacaatatgatggctgaaggatttatgatcacttataacatttgaaattgaggcggaacctgaagaataagactctggtgaaaggtcctatttatgcttttgatgtctttcacttggacatttaccacatgcctattggtagctttgttacataggtcagttaaggtgatacaagaataaataaaacacgatgctggccg

SEQ ID NO: 4982 - DNA, 1089 bp, Homo sapiens
ctcctgttacagcatctgggctttccttcaggctagactataaaacctgaaaatgggcttcctaggttcaacttttcatgtccttcaaagaagtaaaaacattaataaaaaaaggatgtcaatgtacttctgttctaatgaaaacaagcatacaaaccccttagatggtgacagaagtctggaatgctttatagaagaaagagaaaatgagcatcactggcagtctctagtttgtttccgccaacttccctcatatgtttcccaggaaaagagagcaacaattctgcagctcttcctagaagtactcatataaagaatacagaataaagcagtacaaagcatgaactattatataatgcaagtcatggcctattattcaggtcccttcctgaagacttaggcactacttcctctggctgctgggagtattggcagctgagggctcaactgagataatgttgaggaattacctttggctaaagagagtctcctcattcaagtttaccttatcttcttggaaccgtccacattcagagactggatactttttcctccaggcagggccattttgaggggccatctcaattccagagctctcccggggactgactgatgaagcttctgttgtgggactgactgaagaagcctccgtgggcactggactacagtccaaatccactctttgagcaatcctacatctttcactctccaatgaactgcctgagtacaaacctgcctcccagagtctgtttctagggacactgacctaagacaacaaattgtatataagattaagtttgttctattatttagctttaattctgaagtatacttgtttatactcattgcagttagttgcccccgtagtattttcttcctctaagtgtttttatgaggaaaaagtatcagacattttatcctttgtgtttcaaggctgatgctaaattatctgtcatttattctgtatttctacttacataattaatgaataagttgccttttgggacttagccgattttttctcaatttttgttcaactgtacagtgtaaacttaagttgaaatctcaaataaaagatgatcggccgga

SEQ ID NO: 4983 - DNA, 864 bp, Homo sapiens
cttcagatccaaatggtatgctagcattctcttcctagcagtccactgtcaagacttcactgttagaagaagaatcacaccagaattaaggtcaaatggattatcttattcttaattgctgaaaatcacacctcattgaaatttgcttcataactgaaccatgaatttttcatcaaacatacttttgtgtttctcctcctggcattctttatgaggaacttctttttggagctcactgacttcctgttctaatttggtccagttattttctagaattgctacatgactgtcatcctgggacatccttctgttggaatctgggagagcttacaacttttcatatcctctcttcttctttgtgtttttcaccctgaagtgtacaaagtcaaatgaatttcctagaaaaactagtgagttaatattttgagtccttgcgatatgggaggggggcagggaagtgctgggtagagaagggtggggtccctggtgagggctccactctcaggcctgtgctcatggacctaaatgaggacaggcatttctgttttcatgccccaaatgttgccttttggcccaccatgcgccccatcctgtacccataaaaacccaagacttgagaaggcacagacacaagtggccccacgtcaagagagctgaagaacacagcaacagacaccagcagacaacatcaggccatcgatggctgcatgatgtggaatttggctgggggcagttggaggagagtctggctattgggcgacctgactccaggggaagactaccttcccactccatcccccttggggctcctcatgcatctcacgagagctacctccaccactcaataaaaccggatcggcctga

SEQ ID NO: 4984 - DNA, 705 bp, Homo sapiens
gtcagcccaagaagcaggaagcagcagtgcagggagaaaagagtactggatttagagtcagacacccaggttcaagttctagtttgcagttcatagaagcagtcttcccagcttgattttattcacagaagaaaaaaggcacccctgggaagtgcctgacaaaagcttgaagagagaagaggctctgctgtggtttgaatgcgtcccccaaagttcatgtgttggaaacttgatccccgatgcagcagtactgggaggatgccctttgccatgttatgatcctgcaggaagaccctcaccagatatggccccttgatcttggacttcccagcctccagaattgactggagtgtcatatctcagcttctcgccccttgatctccatatgcctgggaggaaatggcatgaatgagacttgaagctaaaaatgcacttgctgatttgaagaacattaactgtggctgtttgtgacctggctggaaaggacaacccatcatcacatctactggtaaacttatggtatccagaaaaagccaaaggactctattgcaagacagcatcacctggctgcagagacttactaaataaatgctactactttcaaatacaccaaggaataaaagaatttatatttaaagtgtttggagagtaaacattttacagtatttataacattcccctaagtaaataaagcaagatcggccg

SEQ ID NO: 4985 - DNA, 535 bp, Homo sapiens
ggaaacggatggaataaatgagctgagactaggatatgagctacactaagggctccatgtgccttctcaaaagagtaaaagaatcaagatacagtctcactatgtgggaggtgttgaaggagatgcatacagctggcaaggccaagggaagatgctgcgctatctcctaccagtccactccaaccaggagccaggctggagctgaaaaccgcaaagggcaaggtcaccatagctgcaaaggtcacagatgtcagcccaaactgatacagaaggcagtcatcacaacttctaccaccgctctgaccaaacaagcctcccaggtgctgggatctaccagaggaaaggagaagagagcctgagatggaattttgaactggactccagtgagttaattatcttgaacccactgatcaatctcaagagtgggctgaatattctgagaatgtctgcctgaagatgtctgccagagggtggctagagggtcggagacagaaattcagggctattttagaaataaacaccgagtccccctgag

SEQ ID NO: 4986 - DNA, 464 bp, Homo sapiens
actgctgctttctggggtaagaaaggtgctgccatgcttgaactgtgccactggaaaccacacctattcttccctggagaaaggactcgtcacagtgctgcagagaagtgtcactggatcaaggctacactatgccatttcataacccttcatgataaagaaagtcaccgattggagctcatcaattagatatgagagcccgacaggagccacagagctggctgtggggccacgcagagtcaagaagccacatggaacctgctgggcttcactcttgtgatgatgttcacagtatacttgaatggtaatgtgaagcctggaactgcagcaatcatcttgtattcacgagggagagaccaagagaatctcagagatgttcagaagtcatgatccaatgctaagcaaatgtccagctccaaacttctttgtatgtggcaaaaaataaacccccagatgctgcccgg

SEQ ID NO: 4987 - DNA, 482 bp, Homo sapiens
ccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcccccatatgctgtataaatgtataaaatataaggattacttttgtatgttccaacagtattatacttgttttggcatcagcattacctctttctttatctttttcctggttaattgttttctgagttttttgggttttattttttgctgatccctattgattgaccatttgtatggtatttttatgaaaaagaactgcactacagtacaataaacccagatgctggcctgaa

SEQ ID NO: 4988 - DNA, 452 bp, Homo sapiens
cctagaaagtatgaccaagaaatacaatgagcctcttatccccagatgtggttgtgatataccatttcccattgaaagaaggcagggcatcttggagaaatggctgatcccaggtctgggcagaagatgtacaatataagcctggaataggtcatgtaaaaggacttagaagccaacgtaagaggattcccactagccgaagatgacaacttgagctttaataaggatagtcgttgcaatggattggaaccgatgtttagacatggtctagtatatttatactcatgagttcataatgccattttaaaaattatctaattggttatctcctgaggatggccgggaaccactttatcttgaaaactgagtacacccacgaaatgagcacttttcttgtcactactatttgaatgtattatttgaataaccaaataataaagtgagatcggccg

SEQ ID NO: 4989 - DNA, 568 bp, Homo sapiens
cagcattgccagccatcactccatggatcctctcatctggaagtgctccacttcagaaatcttagattccaagatccactctcagaaaacaacctccagacatttctgccgtccacacagttgcttcttctccctctggtgcacggccacctgcagtgagccaagattgaacaccactgctctccagcctgggcaacatagcaagactctgtctcaagaaaaaaaaaaaagataccttttttgaccactccctttattcttccctttcccataacactaagtcatatgcgcccaaaacaatttgtgcacatctccatcagtgagtggttttccatgagcccctcctccccgactaggctggtgtattctagtgtgctcacctttgggggtctctactactgattatttgcaagacctaaggcaacttatttcactttgtaagcttctgtttcctcaactacaaaaccaggttattaatagaaactcctatctaaggaacctagcacaatgcttgatatacagtaagtgcaaagtatgttaaatgtttaataaatcaagatgctggccg

SEQ ID NO: 4990 - DNA, 810 bp, Homo sapiens
attagaagagcaaagctcagttgagatgccaagaaagaagaggatatccgactcagaagtattaggacagattcagatgaacttctgtagggtctcccttgctatccatctatctggacgctacactttttccatcataaagaccttcacaaagccctcatgtaccctgaggtctctcagctcaggacatcacatcagcatggccaccccatcctagtgtccagacccaaactacatactaagaagtgtaataaagccagaaatgtaattatgacacatcaggggatgagttttgtgccagtctcaactctccccaaagtgatacacagctgtcatttttgacaggttgaaagacagtaagaagttctccagcctagcaggctgttccatgcatctggagcaaggggcttcgggtcagctgctgtgattgcatgagagaaggactgaagtaattgctagttctcgaaagaaaaccatttggatgaccgtggaaggggagctaaccactctcacaggcaggagagaccctcatctaacatgatacaatataaaaggcacagatgcgatttaggggtaggaagacatgcgtaatggtcctgccaccccttctcatcactgtgctgccactgtaccctccgtttcctttaatagagcctttggtgcctgattgtttcttgggttcttcaatatggcgaggacctcaagctttccttatagtcattcatttattcatccaacaaatatgttttgagtgtccacattctgtgtgccaggttctatgtcagataaaataaaccccgaatgcgtccg

SEQ ID NO: 4991 - DNA, 738 bp, Homo sapiens
cacagaaacaagagagggaagctgaatcccaaggcattgtgaagggtgagggtgggtaacaacagataactcaccaccaacctcttcctaaccgcacagagcttcagcatgacacacgatccttgagccatgacacaactctatttagaaaaactccaataatggaaattagatttccagggccatgggagaaattggtttcagagtcagaaattgaactgaattatagaaataggatacttattttactgtgaatgagctaaaatttatatttgctacaaatatacatcgatttattttttctttctagtttgtttgctcaaggattgattgattggatctcaagtgtatacatacatatgtatatgtatattctgtatcatctagatttttgcacaataaattcccttatggagaaatactgggtcaaaatatataagcatttttagatctcatttcatagttgcagagtgctttctccaagaattaatttaatttcccttgatccccccccctgattggatggcctggtttacccatatgtttattaactttagttactagtatttcaaagaaaatattgctaattgagtagtggcaaatgttacttcatttcaacaaagttactagaaagtttgaatcttatcccaccccccccccccccagtgcatttcttatgtgtattgagttttagttggccacaattcaactttgaaaaaataaattgcgatcgcgcgg

SEQ ID NO: 4992 - DNA, 323 bp, Homo sapiens
ttctggaggctggaagtccaagatcaaggtgctatcagggttggtttcggctgtggcctctcttcctggcttgtagacagctatcttctcgcagtgtcctcacgtggcctctttgtgtgaagaagaaaaatgagagaggtgattcaagctgaggtaggctaggcatttccaattgacagctgtaaccttgtataactaaatccatcagaataattgcctgaagacgtactcacccatcactgtggttcactctgaggcattctaccttggggtctcataaatcatggatcttcagaaataaaggctagatgtctgcccggaaa

SEQ ID NO: 4993 - DNA, 285 bp, Homo sapiens
acaaggtttcaccatgttggccaagctggtctcgagctcctgacatccagcgatccacctgtcgcggtctcccaaagtgctgagattacaggcgtgagccaccacacccggcctctcaagggctcttgatgggactttggattcacttattttatgactccttcagggaatcagcacgctaaaccctcacctacagcttctgggaaagagaatgagaaatcttccctgtgcttcctttcaaatcattttcctcgaaaacgcctggcctgaagatataaagctgga

SEQ ID NO: 4994 - DNA, 326 bp, Homo sapiens
cagtgccagagcctaaactataaacatggagatatttggaactttggaacctctgagagtctaatgcatcagaactagcacagaagaggagtcttagaaaccggattctcaatctgagcttcaaccctaccagctagagatcctgagtaaggcacttagcttctctgagcctcagtttccttttctgttaaatagaaataatcccttaccagttcaaatgtatatcatagtatttataaagtgatatgctaatgctagttgttgctctcatttaaaaggaaaggcagagactataaccaaacaaacaaataaaagtagatcggcca

SEQ ID NO: 4995 - DNA, 605 bp, Homo sapiens
tcacatcaccagatgatgctggatatggctccactccaaggaaaacaaccttttcttggtctttcaatggctgtttatgagtatacaacaagtgctttctatatactgcaaactcgttagacagacaagtccctctgtcaatcccactctacagtgcatatgcttctgtgtggtacacatccccaccttctcccataactgacgccgcccctacttttaaacctcagagattcaactgcccccccctacttttaaatctcagagattctcttacaagatattaattttcttttcccctatggatctgcttaaaaatgcatcctacaaaagggaagaacaggtcgcctcattctccttgactcttatttgacttcagatagttatcgtcattcattgagagcttagaatatccccttattctgtggagtcctcttctgagatagatgtgggagatacttggaagctaaaaagatgctactcagttccctaatgccctaacgtgtcgatcctcctccctcttttctcttcagtttgctgatgagagctgtttagttcatttactaagtttttatttttcacacaatacaatccctgatgcggccagg

SEQ ID NO: 4996 - DNA, 676 bp, Homo sapiens
agatgcttaaaatcatgatcataaggccttttggaaaatagcatttggatccaagatcacaggaaattgtcaacagattttccaaggaacccactgagctctgggagtgtattcaagggggcctaggattttctacctgaacccagacgttgcaccaactcatagagaaggcgcaggcggaagttttagaagtgtggtgggagagacaactgtgaaatgggaaagatgctgagaaggaagcctcagatcggtggacagccccaagaaagacacggaggagttaccagacataaacagccaccctcaggcctacagccattcccctttttgttgaaagaggaagcagtcacagaaggcacccttcacccactctctgtggtctcaagaagaggaacctggatctgatttggatttttttgaagaaatcttgctttgatgtggtctaatccaacttcttcatttgctggtctgagtgggacagtgggtgctgtacctctgtggggaccgaccaaggggattctctcagccagggatccccccaagggcggagtttcccagccccggtacccatgactcctcgggtacctccaatgatctccaggctattggaaccttctctagacaaaatttaaatattgaaataaatattctatgaaaataaaccccgatcggccag

SEQ ID NO: 4997 - DNA, 719 bp, Homo sapiens
tgcgcgagagctccaccgctgaggccaacgaggccatgtttttattttttattaatctatcagatgaccactgttgtcaggggaataatagcaaaaatgtttttagtaattatagctaatgaatacatgaaataaatgacaagaattcggagaaaaaataaactatacaaaataattaaattagagaatgcagaaaaaagtggaagaccaaaatagaacaaggggggggaatagaaaacagtaacaaatatgggacatatcagtcctaatttataaaaatggggtaaatacaccaattacagagactttcaagagttgtttaaaaaaagacctaactatatgctggtcacaagaaacttatggtatatatatgaatatctctaaagtaaataaagatataccatgctaacactaatcaaaagaatgctggagcagatttatactattagacaaagcagatgtattagtttgggttctccagagaaacagaaccaataggacatacatagatgataaatggatagacagatacataaggagataggtttattataacaaattggccaacatgattatggggtctgacggtttccaagaactgcagttggcaagctggaaaatagaagagctaatgctgtagttcagtctgagtcccaaggcctaagaagcaggagagtcaaaggtgtactttcagtccaattgctggcagggttaaacct

SEQ ID NO: 4998 - DNA, 196 bp, Homo sapiens
agtggttatgaaagagacagaagacagggaaattctgggcagaagagggtgggtctgcagcaagggccccaccctcaggcctggaacctcggcccaaagtgagaacatacattcctattttcccattcaaatgttgccttttccaaaaccacccatggcctaccctgaaccccaaacctgtgcccataaaaaccga

SEQ ID NO: 4999 - DNA, 929 bp, Homo sapiens
atgtggagagtgcagctcaaagaagaaaccaagatctcatgtgactgtatgtaaaaatgagttcagcctttgaagaaaagctgtggaccactagaagatgatgaagagtttaacactggacttcctggaagaaagaacagggatcttatcagaataccaagaagaaacatggacataggaaacattttacaagagaagaaacacccacaccatctaaaatctgcatcgctgtgtgtgtaagacacaagctaggaatttttaagaacatgaaatttgcctatgctttagacagtctagaatttttaaaagagcgagttggcatttcaaaattctccatctgctaaagagaagaatgcttaagtccctgttcctttacttcccttcactcagagtgctctggcttctagggacgagtgtggtctagaatcacagatatggttaaattgcagaatattgcactagtgggtaactggagtttatctagtgaagccccccttgttccatggaggagaatgctgaagctcagagaagtgaatacaattgcctcaaagccaaacaggaatttggtggtgaacatgggacctcaaaccacattgtctttctcctaagactagtatattttccatcaatggtctttctcctaagaccagctctttcccattatcactttcctggtaaagagagaggcacatgcaatttaggaacaaatgtgtctgtagcatcccttgggttttcatgctaaccaatgaatagagagtcctcaaatatgctcattttccaaactgcctggaaatcgtaaatactaacagacatatggcaaattatttataaaatgtgttgaaattaagtgacactgtctggctaattagaaccctaaaaacagagagcggcgactcctctcccctttcatccccacgtatcgcacatcc

SEQ ID NO: 5000 - DNA, 511 bp, Homo sapiens
  misc_feature (1)...(511): n = A,T,C or G
ctggagtgcaatggcgcaatctcggctcaccgcaacctccgcctcccaggttccagtgattttcctgccgtggagtttctgagtgggcagccaaggaaagaaagaaggaaaaaatatgagcaaaggcctagaagcaggaatgcatttagttactggagaggaagtcatcaaagtcttcattttccatctaattctgggatttcacagaaatgtcatctttgtattgtaaaatcgacttacatgacatattttgagaaataaaattttgttcattgaaggattatattttaagtcctttcccattacttttggaacattaaacactctcataagtgaatgtaaaatgtaaactataagtaacccagggataaaaagtgtacatgcaaatgtagcagtatagtggtatcaggaatatactgtcctttattgtcaatagacattcccatattaacaaagcccgatgcggccgaannccctccttattccaaccccccgaaaatcgaaaaatcct

SEQ ID NO: 5001 - DNA, 200 bp, Homo sapiens
  misc_feature (1)...(200): n = A,T,C or G
agctgattcttcttaaaatgcattgccacgttatctctaacgttggctttctgacttccccgcggggctcggaggaagtaacccagtttcttaaggaaaaatgagagataaacgtttccacagcaaggtaatccccccnggttgtctaccaaggccccccccccctcctccctcccctcgtcaaaaccagctcacaaccc

SEQ ID NO: 5002 - DNA, 322 bp, Homo sapiens
aacagtttcgagcaaatacactcagagacagagagcataaatggagaataaaacacacgtagagacggggtttcaccgtgttagccaggatggtctcgatctcctgacctcatgatctgcccgcctcggcctcccaaagtgctgggattacagacgtgagccaccgctccttgtggaataaagcatcagttttgatacgccaaagctatctttgaatcctgtcctcacttcttaacagcactgtgacatggggattttgaattggcacctttcttatccagtgttttaacaacaaaagacaataaaattcaataaagcttga

SEQ ID NO: 5003 - DNA, 431 bp, Homo sapiens
cctggactcaaataatccacccacctcagcctcccaaagtgtcagaattacaggcatgagccactgcacacggctgataacttttctttttcatagctatttcgttctctattttgtggatgcaccataattgatttaagaagtcccctgttgatggatatttgttattgtttttctctctttttttcttttcaatttgtatgggttcatagtaggtttatatatttatgggttatgtgagatattttgatacaggcatacaaagccaaataatcacttcaggataaatggagtgttcatcacctcaagcgtttctttgtgttagaaatattccaattatactcttttagttatttttaaatgtacaataaaatttgatgcgcgccagctccttttttttcttcccatcccggatgatatcgttacgtcct

SEQ ID NO: 5004 - DNA, 492 bp, Homo sapiens
ttcctggcacacagctcctagaatccttggaatctcccaagtggtgattgtcttgaatgctagtgatatgactagtagctggaggctcctagatagcttcggcatgaaggctggtaaccagaaagaccaaggtcggattagaggaatggggctttcagcaccacctcctgacctctggaaagggacaagaaactggagatttagttgatcaccatgaaccatgatttaattaatcatgcttgcataatgaaacctccattaaaaccagtaaatgacaaggttctcagagcttccagactgatgaaaacattgaggtgctgggtaagtggtgcccacagagaaggcataaaagctctgcaccacccccagcccataccttcctttatgcatttttttttcatttggctgttcttgagttgaatccattataataaaccccgtagcgtccaggcgtcatctttcactgcctccatggtgcggggcgggtgacaa

SEQ ID NO: 5005 - DNA, 404 bp, Homo sapiens
aaagaaaatgcctgagataaaaagttctctctcctgaccaaaatggctaagactggtgggatccaagatgacagcccacttgatctctgaagaacctctaacttcattatagtctgatctctctgctatgtaacactgcaaccagcaccatgacaggtgacaaacaccatgagaatgactggaagcaaccataaaaagacaaaaaggcaggcagcactccagtttctaggagttctctaccaactctcagaaaagacatgaagattcctcccctttcttttaatgctcaaccccttcattaaagatgccctgtatttccagcttcctggctttcatgggctgagaatttgatttttgaaccaagcttctgcttctcaatcctatggccatcaaataaagcctga

SEQ ID NO: 5006 - DNA, 333 bp, Homo sapiens
atgagaaaatggaagaacaaaaagggaagatacatgctcacagttgcaaatatactaaaagatgaaatccaaaactcaagagttttccaataagcattctggaacaagctgaattttcagactctgtcctcaatgacaatatactctgctctgtcttcttaggactttttctttccagaacctttaagttcttagctaaattctaccaccaagaacaaaaatatgagggttatgtataagaatagtaaatgacataaaaatatgtttttgccatggtgcatactcttctcccaataaaaactttaacaatccaataaaaagcgatcggccagc

SEQ ID NO: 5007 - DNA, 269 bp, Homo sapiens
aagtatgcacgacccttctcttcttggaggcaggtctgctcgtcatgtgaagagccactgccctcaacaggcccacgcaaacatttgccagcgtcctgagcaagaacatggggagaggcctgctttagatctaattgttcaaaagctacaaatctcattagcaagttgtttaaaaagtgtaggcactttgcctattgtgacccatctggcttccagaatatcctggaaggccaggcagatttgaccttagaattctcaaactctaccaa

SEQ ID NO: 5008 - DNA, 480 bp, Homo sapiens
tcctccctttctggcatcagcttctatcaatgtacggcaccacacaggctgctcgctttgagatgtcacagctctccatcactggtgcagacataattctgaagaaaaggtcatgaagtcatcgtcatgctttccatgaaggtctagttcccggctcctcacctggtgtgcaacatggcacctgaagaaacgtcacggctcctttttgtttctggtctcatgatgagaccagagtccagagaacagaaaggaaagagattgaactttctatactatgagagatcaatctatcgtttgttaaagtgatcagcatatgtatcctacagttggaaatacatcctaggttataacttgtgtgtatttccacacaaaaaattatatgggctttttttctttgtactaaattggaggacatacccattagaagtggcaatatgttccaatttcttttctcatacaaataaatgtagatgccgccag

SEQ ID NO: 5009 - DNA, 214 bp, Homo sapiens
gtttacaagacattaagggctccttacccaacccccttcctcaaggagttaacctgtgtaagcagatcagcatttcaaaggagcccaattgactgatgaggtactgaaacaaacaatgtaagaagttcccaggattttactcaaagaggtaacaacataaagccttgagactgtgtccggcatagcatctatatctaactctaataaagggtga

SEQ ID NO: 5010 - DNA, 868 bp, Homo sapiens
aaatacagatctatggggtgaagcactccagcatccatctcatgctgactgtcaggggaaaaacaagactatcagcctgacatccctgagacactggactgcttacttgggaatttttggctgtgaaggagaaacacagcacctatcttgcttaaaccactgttgctagcattatctgttctcattcaactgaataactttgatgttctgtagcaagtccaaggtcccatggctataaactaatgtaactttttctgattccacattctatagagaatgctaagagcagatatcttcaacattaattcagctagccagagtaatatgttagggctaacttccaggactagaatgatctcataggccccatctgtatcctgagccccaagaatagcttgcttacgtgcatatttcactgtttgtttttatgcattcatcaagtattattgacagcctactattaacagatattgccttggctacagaccaatggacagaaatggcacttgttcccaagccgtttatagtctattttcgtgggtatttccaataaatagttaggcaaagaatttctattattgggataattgccacaaaatctgttactatgacagcagaaaatgggagggcgtatttcagtgttcgggtgagagaaagctttagagagaacatgtcacatgtgctgacttctgaaagatgagtatggactagccaggcaactgggcatgagaaaacggaagattttaagcttcatgaagaagagaactttgtgttattcactgctatatccaaggaagaaagagcagatcccagcattttgtaaacaccgaataagtaatctgtgaatgaataaatatcgatgcggcaa

SEQ ID NO: 5011 - DNA, 795 bp, Homo sapiens
aaattcttactatagtactttagggagcaaaatccacatcagaaatttatataataccaaaatggatgacttccagcagtaagacaatactctatttccagggaacaacatcatctatgaatgtcattttcttcaatgtgaccttaacaagcccaccttagagatctggggtcagtgtttcatcttgtgtgtatgggtagatttgtgactacagtggaagtgaagttctgtgactttcaaagctattttataagagacaatacatcttcttcttaattctcttgaaatgtttggctttggaaaccagccatcatcctttgaagaaactcaggcatcctatagacaagcacgtggagaggaagcaaaacccccagtttccagtcccagcggaagtgcctggtgaccttcagccctatttgacagccatatgattgagccatctcaaaagtagatgttctggccctcagttgaatgacagcagctgatgccacctgcatcaggaattttctgtcctaccaagctctctacaattgcatttttgtgagcaaaataactcatttttacgagtttaaactgccaaatttccaggtgcattgttatgtagtgatagataacaagatcattatcccagtatcctaaaatactcaataaaaaagagaggagcctttcgaggaagacttctcaaatatctggatttgatttttctcctttcttactagctttatttggtacttaaccttactccttttcttaccttccttacttttttcctttgctactttccttatcttgaag

SEQ ID NO: 5012 - DNA, 1192 bp, Homo sapiens
ccctccctgatcatctggaaggacttggttctttacctctgggaagaagactgaggggcatcgcagggggctctgtattggatagatgggaacgaaaagagtggcagtcgtgatggggcaagagaaagagacaaggttgtatctgtctaccactgagggagagctggggctttgcatgtgccatcccaatgttttctttcaaccatcccgtgaaagagaggatgctgcatcatgtagagagagaacggagagaaaagggcctgccgtagttggcctgcatgctgacattgggacctgctgcacctgcgcgggtcacttgagagtgaggctctacccgctcccgtatttcagtctgtactccttctcagacagctcacaatgctagtgcctgggacccaggcccactgaccctctccaggcccgcctgacgccctcaccctgtgcctgggctcactcctccttcccattcttggcttccatgcttttgcagctgtcaaaggagttggaactacaaagcatggtgaacttccccatagaaagagaagaacagtcgactttggcagtctcttggtagcgtatcatttattaactcactgcatggctgttaacacagtaatcatagctagcacttgttgaccatacagtctgggcttcgtaatcctcattgtgtccttgttattgggctgacacccttatcattctcctcttataaatgaaaaaatgcaggcttataaaaatcaattaatctccacaatcagaaggagctcagcctcattagtgctcaggaaatgcaaattcaaacttcaataagatcccttttacatggatcagaatggcaaaattagtaaattggacaatatgtgctattgatgagaatgtggggcaacagaaactcgtacactctcttaatgagggcataactctccactttggaggacaatttgccagtatttaagtgaggcgagaaagggcccaccttaggattcaccagtcccactcccctgtactgaaggcatgtgccctggaggagctgtcacatgtgtccacgaggaaaccggcacagaaatgcctatgacagtgttgtttgtgatagcaaaagaatggaaacaatctaaatgtttattaaacaagagaataccaacatagattgtggtatggttattaccatggaatcgtacaagcaataaagata

SEQ ID NO: 5013 - DNA, 309 bp, Homo sapiens
ccccgtggagtggcacctcagaggccacaggtttgagaacacatcacttactacactgaccagttggacacatggcctcacctccagagcttggctcctcaaatgcagggcagggctgggttgtgccaaagtgaaaggctctccactcaaagacctcctggccccaatctctgctccatcacttcctgtgtgaccctgggcaagtcacttaaactctctgtgcctaactactcaaaacagttcctggaacagtaagtgctcagtaaatactagctggctaaaagttcatagaataaaggcagatcggcc

SEQ ID NO: 5014 - DNA, 299 bp, Homo sapiens
agaaagataacaaatggttcttcacatcagcctgcagacttgcagccatgcaaacacctaagccaaatggaactctgtggacaaaggatgctggatgcgccctgcattttaattgttggggaagaattacagcctcaggaattatagacatggtcgcttactacgatttgaactttaaaaagaatcacctcaattttatttttcttttatgtcaaagttgtcattttccagtagtaaaagtaaagtgtatatcctcctttgctttctgtgagtaaaattaaataaacatagatcggcaa

SEQ ID NO: 5015 - DNA, 801 bp, Homo sapiens
actatagaagccaaattccaatgtgaaaatgcacctttcaattgcacagactaggtcataatggaggtgacagtcataaaagattttctagctctcagcagagctgtaaaccgggacccctcatccaggcagacagcacagaatctgaaaatctgcctatcaaaagcatcattcaagccacaaggctcttctgttcctggtaaaaggcaggcaggaaaagaggagacaaagaaaaacgtttatgatctgaagatatggcccaaatcaccaaccacgcaatttgttttctgaggaaaggaaagacctggtgcaactttatacaaagagcccatcattcatccttgatcagggatattttctcctcccagccactaatctgctctctgctcttacatttgtacatttttagaacgatattaaacatctgaagagtcattcagggagctaaagttcactgtggtttgaagtcttataactacaaaataatgttgttctaactgatctttcacatcaatgcagacaaaagcactttggtatatatgtttaaggcttaaccctatcaaagtcaggaggttctgattagagtatattaggcttgacacgctcaaatggaattaaatcaaagatggagttgcagtttctatgttttaagtatcataacctatacttgtatataataatattataaaataatgttattttaattttgttgattaatagaaagaatattgtcttatgattggaattttcctcctctttgtcagcatggaaaaccttacaataataaataccgatcggccg

SEQ ID NO: 5016 - DNA, 602 bp, Homo sapiens
cgacacccctctgctggagtgtctggccccagggcaggcagaaggagcttcgcttcctgagcatcctgaacaaagagttcagttggagatgggaccgccaatgtcaccttaccaaggagaacagagagctgcagctgcctccatggcagcgatacctccaggtcactgtggcagcaggagtgactggggctggagagaaatgactgcccctgggctgcgggacatttgcacatttgcagtaggaagtgcagagggcttcatgcccgagagctgctgagggagccaggggcaattcctggggcaagtggggattccaggagccgtggacctgtgttgtccctgagctcagcacatccagtgctttgctcaaggcagcaggcctccgagcccatgctgcagttgcttctctaattacttccatccactttccacctcctccccttaggtaggaagtcctgccagagtcacagctgtgagaaaagtggcaccttcctgaaacagctgagtcaagtcagtcttctcatgacttcatgtctaatccctcatgtttctaataggaatgaaggagggtaaaccatttagaaataaaacaagatcggcag

SEQ ID NO: 5017 - DNA, 515 bp, Homo sapiens
atctatccacccagtgtaactaccgggctcttggcttttactggggagtgtctttaaagagtactgtgatgtgatccatcttcagatctctcagctgtggacactggaacctactcttgtggaggaagcagggatttggacttggactgaactacaccgtcagctttcctggccctccagcttgcagatggcataccacgggacttctcagcctccataaccatgaaagaagaaagaggaaagaccaagtgaaaaaaaactatatgcatctggccggatgggtttatcggaaatgaaaatgaactcagaagccaaagtaacatttgttaagtgttttcaccggaagccaagaactgaaccaaatatagataaccagagacatgggtaggttgagctggtatgtagaggaaagaatataggccagatttttaaagatttttatgaatatttaacatagcatttaaatgtattgaagtgaagtgaatttaagctcaaaataaagctcgatgcggcag

SEQ ID NO: 5018 - DNA, 691 bp, Homo sapiens
ttcacccacctcggcctcccaaagtgctgggattacaggcgtgagccaccatgcctggcctcctcttctactcctgccagagacatgaagggatctttcttggctcttcaccatgagaacctggtggggtttctggaggtgaaacccatgaaaacataggtccccacctcaagactgcaggccttgggagtttgtcactttcatgctagttcactgcagcaatttgccaaaatcatcatggacatgtttctaggagttgatgccctcattggcttctgctccaggtgagcaggtgtccttgtgactctctggacttgcccatctctccagatttgggggtggcagtttgctctgcaaacttagttctctgatgtgtccaagaaaggtcatgaattgacggcttgtttagctttttcttgttctaagaatgggagtaatgacttccaagcccttcacttgtcagagctgaaattataagttaattatcttgtatgtaatatcttatttttctcacagttttcaagattttctctatcattggcattctgtggtgtgaatgaatgttctgtaccagggtgtgattttctttgaaggtctccaatgtggggtttttggggctttacaagatatactcatatttaccagatatcgggagtgttctgtctttttttcataaataaaggatcggcca

SEQ ID NO: 5019 - DNA, 943 bp, Homo sapiens
agatgccctgcccagagaggaagaatctagagaggcagtctggctacagcagctttgcagagctgtggtgggcatcacccaatccaaacttccctgtggctttatttacactgcgaggggaaaaccgcctactcaagcctcagtaatggctgacgcacctcccccaccaacctccaacatcccaggtcgacttcatactgctgtgttggcagcgagaatttcaagccagtggatcttaacttgctgggctccctgggggtgggatccgctgagctagaccacttggctccctggctttagccctctttccaggggagtgaacagttctgtcttggtggcattccacgtgccactggggtatgagaaaaactcctgcagctagctcagtgtgtgcccaaatggccgcccagttttgtgcttgaaacccagggccctggtggcataggccactcaagagaatttcctggtctgtgggttgcaaagaccatgggaaaagcatagtttctgggctggatagcaccatcccttacagcatggtccttcatggcttcccttggctaggggagggagtctcccaaccccttgcacttcctgggtgaggcaccccaccctgctttggctggccctccttgtgctgcacccactggctaaccagtcccagtgagatgagccaggtacctcagttggaaatgcagaaatcacccaccttctgcgctgatcacactgtgagctgcagaccagagcttttcctattcggccatcatgccagccactttctcggccattttaaattacatgggctatctcccttgttccatgccctgtccacttgctctttttaaaaacattcctattttaatataaaaatacttcatgacgtaatattttatatgtgcaaaagaaattatataacttgtgctagcttaaaagtaaaataaataaa

SEQ ID NO: 5020 - DNA, 589 bp, Homo sapiens
gatttggggtgcccttctgtctaatctagtccaaagcatcaccctcctattgccccaccccatccccattcgcctcccaggtcagtgtgtggccaaagatatgacagcttccagaatcacagaaaatttgagatcagatttctccactgacttttacttttatgtgttcattcatttatttatttattagaggcaaagtgtcactctgttaccaaggctggagtgcagtggcataatcatagctcactgcagtctcaaacttcctgggataaagtgatcctgccacctgaaccttcacagtagctgggactacatgctcatgtcactgggcccaaatcgtgtttaaacttctatattaacaaatgggttttgcatgtccccaggctttgtttgaaccccgggccgaatggatcatgcaactcgcctcccaaatctgggattcgtggcgagcagcatgcctggcctgcgcgtcggcgagcggggatgcgtagatgacgataccaacatcaaccccgtgcgggttttttagtggcgcgcaaagcttatctttttcagccatcgatcggcatcgcgtcgggtctggatagat

SEQ ID NO: 5021 - DNA, 720 bp, Homo sapiens
  misc_feature (1)...(720): n = A,T,C or G
cctactcaaacaccagctccaagatggcagatatttttgtcttataatttgccacatccccagtgtctgacacagggaggggttcgataagcatttatggaatgtgatgtgaagatacactctgagcttcagcgagacagtacagcagtgttgactacaggcagtcagagagattgatgaaaacttcctggtaggtcctttntggtagacaagaagagtgggcaaagaagaaagatgagagatcatggctactatcaggttgatgttcccagaggaataattagtagtaggctgggccacaagacccacccccacactgtggggggatgtggagactgagagacaagttatgaatcataggtatgtcgcaccatagttgggaagcactattccaagttacagtgcaagcaagaataagaagcaaacaagagatgcctaagaaaggagaggggaaagatctgggcagattccaggaggtaaaggacaaaagacaatctgtgatgacgaacacagagagtgcttgttcagattatgtcacaagtcccacaaaagtccttgcccatttggaggggagcagtgccggtgaacaacgctattctctgtgtgcccacttatgcggccagagtatcacataatggtttccagttatactgtagttaagctcagtgaaaagatgagatttttaacagtaaatctagatgaataaactgcgatcggcag

SEQ ID NO: 5022 - DNA, 190 bp, Homo sapiens
agtaaaaattataagcaactataatgaaaagtcttcagaagtattctctgggagactcaggattgaagaggccagaagcagagagccagcaggtcctaggaggtggtctactacaagatctgggggctcaccgcctacttgaaaagatacagaactcctgccctcaataaataaaagaggatgcggcagg

SEQ ID NO: 5023 - DNA, 820 bp, Homo sapiens
tcacggctctccctttctttgaagaaagaggaagaaaaggaagaagaaggagaagagggagaaaagaagaagaagatgaagaagaagaggaagaagaagaagaggaagaaaggaggaggaggaggaaaaggaggagaaagaagaagaggaagaaaaaaatagattaaaaaaagaaactgctgcaggaatatactaggaaagctgagagaatccacagaccctctgaaggaagtggattgcttctgcaggacccaagaaacagcgccaaatactttgctggtatccgtggccgagagacctgaagatgattcacatcacaggactctgcagacaactcccagtaccagcccagagcctggtagccctgctgggtggctagatgcagaaaagaaatcgccattactacagttcagctctcagggagtcacatcctaggaaaagggggagagtactacatcgagggagcgccccatggtgaccagcagaacaaaagaatgtaaacagcaggcttgagccccagatctcccctcagacatagcttaccccaataagaaggaaccagaaaaacaattctggtaacataacaaaacaaggctctttagcaccccccaccatcaaaatcacactagctcaccagcaatggatccaaaccaagaagaaatccttgatttaacctgaaaaagaattcagaaagtcaattattaagctaatcaaggaggtaccagagaaaggagaagtacaatttaaggaaataaaaaaaaatgatagaagatatgagggtagaaatcttcagtgaaatagatggcataatgaaaaacag

SEQ ID NO: 5024 - DNA, 442 bp, Homo sapiens
agcaactatatttctcagcaccaccacccttgctgcaaaatataggcatatgctcaaattatctgcactagaaagtgagaagaaatgatgtgaaccatgattttttttttctcctgcaaccatcaacacaactagaataacaacgacctaagtatccttggaagcaaatatgttgaggattgctgaacccagcttcagtctgatttccagtatcactctgaatgtggagcaaagctgcccatgaggaacaaatatactcctgttctttaagccagtttttaaaagtttatcctaatatattcgtagataattatgtatatcaaatatcaaagtatattgaaagttgttaccaattttatttcctgaagcgtatgtaatgctcactaaatatttgtggaatgagaaattaaagagtacttgccttaattttaataaaaactga

SEQ ID NO: 5025 - DNA, 741 bp, Homo sapiens
tcttctgctctttttcattctttaaagaaatggaaacaaagaggccaatcctgacaagaaggagatgctggccaagagccccagatcttcctcctggtctcagaacaaaatgtgaagacggtctgagttttcagtgaagaaggggaaaaaatgtttgagttctggagtctgacgtcatggtcctctgttgctttttaccctaccaaacaacggtgcaataacttgatgttggagaaagtcacttttcaatgtgtattgggttccgttatttttcaagacttcagtagatgtgcgcgacagggcagagtcacacccacttctgctcgctccagacatacctcatcccacaggaacggggacaaggggtggcttccttggccacctttcaagaatgtgcaagattttcaaactagaagtggaaaagctacctgaacatcttacaaggacataatgtctaatttgacctccccactgccttagctttggcaaatgaaagaaaagctgatgtgatttgtgtccttattggatggaaagatttcccctgcccttctcctgtttcagtgattgcagaagcactcaagctgaagcctccctcgccctgtgtctatgagtcactctcatgagccatacttgccaccctgcaccagacatatggcataagtgaggaatgaaactcctgaatcctgcgcaggctattcctcctgatctgggcggaagatgaaagacagactgaaaatgaaa

SEQ ID NO: 5026 - DNA, 308 bp, Homo sapiens
ctatgggcagccaagtgatccctgagggtgtaaaatctatcctgccaactagggagaataagcatgagaatgaaagctgtaaaagatgaaaaaggtgggatgaaagttcagtggcagtggtggtggtcagaaataaaaagaacctgcatccttcctggtacattgagcttctttaccagctcgaggctgctcctctcaagattttatggtacgtataacaaaactcaaatttcaaagttgctgtaggttatgtttttgtttatctgaagccaaatgcattattaaataataaagccagaatgcgtcag

SEQ ID NO: 5027 - DNA, 976 bp, Homo sapiens
gcatagcgggaacgactctcttaatctccaccgctacacgaagtagactctcaattagaattctcacacagaatggattcatttcagcaatgaattactgatgactctgatacaaaatctggcatggatgcttcaaagtggaggaacctatatcatatgcctgtgccacagctgcaagataggttggaaataaggtagggaattccctaatgccatgaatgctgtgacctctctttcatgaccttggcttatgcaatgatttcttagatatgacaccaaaaccatcagcaagcaaaatgaaaaacagataaactgacctttatcaaaattaaaacttatttgcttcaaagacatcatcaagaagtgaaaagacaacccagacaatgggaggacatatttgcagataacatttctaagggacttatatatccagaacacaaaaaggacacctacaactcaaatttttagaaaaacctagtttaaaaatgggtaaaatatttgaatatatttttcaaaagaagatacataaatggctgaaatgtatatgaaaagatactcaatatcattagtcattagggaaatgtaaatcaaaactatgagataccatttcacacccactaggatggctatatttaaaaagacaataacaaggacgtagaaaaatgggaatcttcttcacacactgctaatgaaaatgtaaagtgaaacaggtgctttggaaaaatttgccagtttcttgcaagtttagtacagaattaccatacaacttggcaattccattcctagaaatgtaccctgaagaagacatctgttcatataaaaatttgtacatgagtagttgtggcagtattattaacagccaaaagcagaaacaactcaaatgtctatcaacaaaatgaaatgtcctatacaatggaatactactgtatacatacagtgtactattatcaaacaataaaaagtgttgcgccaaaag

SEQ ID NO: 5028 - DNA, 718 bp, Homo sapiens
cgcatgagcacatgatttggttttgttagtttaaaagaggattgactttgaagttcaggctcgatgctcctgaaaattgatgaattaggtctcggatttcaccatgtccaacaagccttccctgacctttcttccaaactgattttctgctgtatggcagtagccccatctttccgttttttaagactatgcatagacatcatcgcccttgctactctgaactataattggctcctcactgtttctcatgcaattgggaacacattcctcgtgggtatgtaccaggtttcaagacctgtggtgtatcctgaacctagcacatggagctgcttgatcagtacagttgaatgaaatgaaggaatgaatataagaaaaagtttttctaaataagatgatagggcaggattcatttttgtctttgtagttctcagctttctcctatgttcagtcaagtgttccatcttgaaatagctgaatttaattaaactaacaactccatgtaagatcttagcaggataacaaaaatcatggtttgagggcaaaaccttaaattcaaaggtgaatgaagctttgatgatggttaggatacatctgcctttaaaagctgggttacctgctctgtctggtaaatttgaggcagacataactgtcttcttctgtcccaacaaacccgtagcggcaattttttttttttttctctcgcttgttttccgttatc

SEQ ID NO: 5029 - DNA, 807 bp, Homo sapiens
  misc_feature (1)...(807): n = A,T,C or G
cagcattgccagccatcactccatggatcctctcatctggaagtgctccacttcagaaatcttagattccaagatccactctcagaaaacaacctccagacatttctgccgtccacacagttgcttcttctccctctggtgcacggccacctgtgctatctgcagcctcaccggcattccctggcctcgccctctgcacttcatcctgacaggcatggagtctcctcctgtcaccccagagctatgtggtatcttgattaggtgactttgcccatgttgtcattcaacttaatatttattgatctatctctgtgagaatcacttggctggccctttcgtctggagtgtcagcctcctctcacctgcccccaggaggcttcctccttcttcttttaactgcttgcacatctttaagactcagccttggagacacgtcttttaaaaagccttgaatgggcctgggaagtggctcacacctgtaatcccagcaccttcagaggccaaggtgggaggatcacttgaggccaggagttcaagactagcctggacaacatggtgaaagcccgtctctactaaaaacacaaaaattaaccgggtatgatggcacacacctgtatcccagctactcaggagcctgaggcatgaaaatcacttgaacctggggaggctgcagtgagccaaaaatggacaccactgctctccagcctgggcaacatagcaagactctgtctcaagaaaaaaaaaaangatccttttttgaccactcctttttnttcctttccctaaactaagnntatgccccaaaaa

SEQ ID NO: 5030 - DNA, 910 bp, Homo sapiens
  misc_feature (1)...(910): n = A,T,C or G
atcttgctctgttgcccaggctggagtacagtggcacaatcacagctcactataacctcaaactctcaggctcaagggatcctcttgcctcagcctcccaagtagctgggaccacagaggagaatgtgctggctctgacgttcagtgacaagggaacagagagaggtaggaaggcctgaaccagccaagagactttacctgaggtaaaagttcctcttccttcaatgcctcaaatcaggatcttgaagttggaaaataataaaagcttgtacagattccactttgattgtttttggcaaggctatttcataactacctgtggtgatctagagggtttctcagaagaaatgacatttgtggagggagtccggaagctgagtgataatgaaagctataattcaaaaccacactaagcacccttcatgtcatcctctgtggtagcccagccaagatggcccccagtgatcctcaagtcctgtgttcatgcctttgtatagcctccctcaatactgaatcatgcctggcctgtgaccaatagagtatggcacacatggtgacttccaaggctggatcatgaaagacatatgcaactttccttttgctttctcttgcataatctggtctaaacaaagcagctgccgttttatgaagacactcaagcagctctatggagaggcccacgtggtgagaaactgaggcctcctggccaaaaccagcgtcaacttgtcagtcatgtgactgaaccatcctggaagcagatcttcccactccagtgaaccctgcagttgatcacagccccagtggatactttggctgcagagagaccatgatctagaaccaatacgctacgctgctcntgaattcctgactcacagaaactgtttgattaagataagttatatccttcacg

SEQ ID NO: 5031 - DNA, 536 bp, Homo sapiens
agtgtactcctacttattcgtttctaagtgaacaataagagagcctcaggcagatccttcaagagatgttgcagatgaaggcaattgttatcagaggagatgacagctccatgagtgttattgcccctgaagaccttccggtgggacaagatgtggagatcctacgtggtgtattggaatccagagatgaacacagcagtccctgccttccaggaaataacaatctagtcagaaggagaaactatcttggggaagaaagatgagtatttactcataagttaatagatccaaacccccccttaaatgtcacatagagtactactcaccctaccccacctgaaacaaactttaaagatgagaaaatgaagtccaaagacagtaagtggttaccaaaattcacacctccagttattgtcagtccagaaggtgagcccagaattcttgatgtcccagcacaccaccatctatgtttgacacttgatcatgtattgtctgtgacagcattcatagagaacaaataaaggcgtatcgccacg

SEQ ID NO: 5032 - DNA, 801 bp, Homo sapiens
agttcaatatactctactggtgggaaaaacaaaaacaaaatagaaacgaaacgaaatttttgcaagcttgttgttgtaaaaatacttcactcaggcagccgggcgtggtggctcatgcctgtaatcccagcactttgggaggccgaggcacgcagatcatgaggtcaggagttcgagactagcctggccaacatattgaaaccccatctctactaaaaagaaaagaaaatgcttcactctagaattttgatgagaagaaaagcgccatgaagactcacgtgcagcttcctgaggaatctgtgtttcaccctagaagcaatgggaggccactaagaagctagagtcatcctaacaagagtgatagtctttccccaagtgagaccaggctgtgctgtctggggaaaagcattgctggccttgtcgagatgcaccgacgactcagctcagctaaggacttaaccagtacaggacttgcttgcagcggagcctgagctggatatggaagcaaaagaagcaagatctccctatgttgccaaggatgctctgaaattggaactgaatattacttaaacccttgaagtctgggaacagggacatagtgcttttccaaaactgccagaaaggtgtctcttaatgctctatggatagaagtggccacctgtcttacaggctgacgctggagcccagcaaaagttattttggtagaccccccctgcccagcaatgcaaaaagagaacctacttactttctttgtattaactcgggatactgataaactaaataaaaaaagtatccgccacg

SEQ ID NO: 5033 - DNA, 510 bp, Homo sapiens
tgctcaaagttgaacaggcaaggaagactttattcaaggccgttgcaatggtgagatcccagaactaaatctaaactcatcttctctggaacaaaaggcaggaatggctttttaagcactgggtgcctggccaaaacatactggaggataccaggggagaatcctagggcttttgtatttgtttgctaattggctttacccgatggaaaactaaacttctcacatctttgtgatagagaatggttttgcaacttggcttcaggaaggtaggagccaagttgcaaaactaccatctgtcataaactgtcataaactctatcatagaaactgtcggtgctatcttccttgacatttatttagacttcaaaaagatggctttttggtccttgaggaaaatatgccgggtttctaaatttggcaagaggatttaaaaaatatttacatctgaaatgggcaaatagcaattttataattatgttgtctaaggtggtatactcaaaaaaagccaaa

SEQ ID NO: 5034 - DNA, 871 bp, Homo sapiens
tatccaatgctgagcatcaatctaaagaccagaccgaccctttggaaagagatgtacaaaaaaacagagagccaggggcactggaactttacccatttttggcagaaatgaaactgagtaatactacacttaagaagagagaatcccagggcctggaaaaaaagctgtacatgctgggacctagacttctttttctctggaagctcctagaacagtcctccaatgattctcagactcctaacaggtttttgaaagaagtgcaatgaaatatcccactgagaacaaaaatgttcacagtctgtcaagtgtggtttcaaactttaaaccttttacctttaaaaagctaaatctacttttcccttttaagattggtagatctaaatattatactataattcataaaatgcatgtgtataaaaatacatttaatattatatcttgtataaggtaaatataattatattacatatatgcatacacacacacacacacacatatgccatgttgggaaccattaggttctaggcacctaatattttatctaattctaactatactctaagaaataattattgctttttccaagcttactatgaactatctgcaactcagaaaaataaacaacttaccaaagctacatccaggttaaatgatatgtcactggcagtctataaaatcttttaaatagaggccagcttcatcaaaaaaacagctttaagttcaaaatctctttctacatttgaaagcagcatgttcctaaactttatttcacacttcccagaataattctggcagtattggtagctttgaatgtgctgctgtgtagtcctaagatatattgggtttctcaatgtctcaattttataaacaa

SEQ ID NO: 5035 - DNA, 817 bp, Homo sapiens
  misc_feature (1)...(817): n = A,T,C or G
cttcagccagtccctccatttggggttcctgacttcctgcaacagtatctggtggaagaaatttctaaatagcaaaacattcaagaggtgacctggttgattctgaaagccttcagttttatgccttcacaaataaatggtttgaaattgaaacttacgtataaaatgaaagcagagcataaaggtttggaaaatttgcagcctgactatgtagtagaaagaaaaaactcatttcctggggaggaattcaagctggatatgaaatttgcataagtaacaaggagccaaatgttattataatagccaagacaatggggaaaatgtctccagggcatgtcagagatctttgcagcagcccctcccatcacaggccaggcctaggagggaaaaatggttttgtgggctgggtccaggaccccacaactctgggcagtctcaagacttggtgccctgcatcccaactggtctagctcttggctgggggctaacagggggcaaggtacagcttgggccattgctttagagggttcaagctgcaagccttggcagctttcattgtgggggntgggccctgcnnttagttgcanaaaaaaaaanaatngngccttggaaaacctcttaccttaaatttcnggngggacgtatnggaaatgcccggatggcccaggcctaagtctggtggggggggggggcccccatggaaacctntgntnnggnannnnngaagggaaatggggggtngnnccncctcccaaaattccactggggtctgcctatggagtgggggggggggccccctcccccnncnncnaaaagt

SEQ ID NO: 5036 - DNA, 598 bp, Homo sapiens
  misc_feature (1)...(598): n = A,T,C or G
atgaggaaatacccacaggcggttgagcaaattcctgaagagcatacaacttgtaagatgatgacttcaaagctctttgagtgctatcagaatttgtgagtaacagaggcttcagcctatggatggggatggaggctacacaatttgagggaaggctaacttctgtaacaacaaactcaaattcccagtgacttaacagaataagagcttgcctcttgctcacaccatagtccattccagtatggagagcancttttcctaaagggatgccaagacccaggctatattccatctgtgcctctgccttggagtcatccactggatcgtcagcattttttccaggagttgagaaaagataggcatgggnaaaatacttgggttgttggtctaaaaatacacacattatttttgggcctattccattgggctaaaaactagtcacatatcttgaccaacaaaagcttggaaatgaacctttttctaagccgaaaagataaaaggggaaaacatcctgtaacctaaccttggtctggtgaatgataatgggatgggatattttcttttttcttttaaaactaaagggcggcagtttgcaaat

SEQ ID NO: 5037 - DNA, 869 bp, Homo sapiens
cacgcgccgagagaaagaggaaagaggaaaaaaattgccgctacgtgctattcgtgggccataaaacaagagtggataaacaagttgtagaatattcattgaatgtactactactcataacaacaaggaacaactattaacacctgcaacaacttgggtggaaatcaagataattttccagagcataaaaagctagacaaaatagatgatgtacctatatgatttcattcccataaaattatagaaatgcgttaatcaatattaatggggggggtggccttacttcctgggtccaaaaaaaaaaagaagatattaattgtacgagtggcgtgggggaccttttaagagcgagtgaaaccttcattatctttgattggggcactaagttgcgcgcggtgcagatggtggcaaaactcatcagagcggatattttaaatctcgggggtgcggctatacaaaaaatatatgtagcaagcggcatctaccccttcagttataaggggaagcccctgccccggggggtaggggcaacagaggaatggaacgtgtctgagcaacccccgccggcctttatggtgtcaaaagggggagaagaagaaaccgccctgtgcaagagcgcggtcggacgacaaccgatgcgattggcgatcagagcgcgcgccgcccctctgtcccctctgccggctcagaagaaggctcaccttgacgcctgccggtgcggcgaagagggtgcgcgcgttcgggacacgggaaatgcgacgcagctggcggtggggtgtggcgacaccgaacccggatttgtcgcgagggtatgcgtctgcactaccagaggcgcggcgcggatacggggtgcctgcggccgggcgcct

SEQ ID NO: 5038 - DNA, 813 bp, Homo sapiens
caatgagccacaataacaaacttgaaggaggctgtgtcctacaagcattaagagcttcagcagctcccactttcctctcaatctgcttcaacaagccttttaaaaaagtagcactggagcacaaagtgggaaataccggacatcctcaaggtcaacaaggaaatggagaggcaatagatgaagactacagggtcaatccagaagttcctcagaaaagcacaataattcaatccgctggaggagaggatgacaacaggggcctctgcaaagagcaagtgatcctttgaagaaaacaaagcttcagtttcctcaagaagttcttcagagaaaagcaaaacaataacaacaaactttcctttagctcttcccaggcagcgggaatttcagacagaagatcagcatatttgccctcaaaaagccacagcttgggtggtgcccatgtgaccagctccactgggcatctgttggcaggaagtccaatgctgcctttctgataaggcttgatgggcagcccttctatattccttacccacccttccttggggccattcctggatgcccattaccactcttggcttttaaccctaaaagcccaatggctactgtggtctaatttatttgccaataaatgctttaaaaggaccgtgaaaatttccaggcgtgcccggaagcttaacctttagaactttgagcatttcttggaataaatcctaatacatatgggtaaataaggtatttgaaacataaaataacaggtgattatttaattaaactgggatttattttcgttcctacagctggcattgttatttg

SEQ ID NO: 5039 - DNA, 804 bp, Homo sapiens
aatagtgagatatccttgccttgttgtggatctcagcagaaaaaaacctagtttctcaccattaagtatgatgctagaggttatcaaatttaattcttttatcagtaaataaaaggatcacaaaaacagacacacagaccaatagaacagaacagagaacccagaaataaatctacacatctacagtgaattcattttcaataaaaatgccaagaacatacactggggaaaggacagtatcttcaataaatggtgctgggataactggatacccatatgcagaagaatgaaactagatccctttctccatatagagaaatcaaacaaaaatggattaaagacttaaatctaagatctcaaactatgacattattgaaagaaaactttggggaaactctccaggacaatgaagcaggcaaagacttcttaaataatatccccaggcaaccaaagcaaaaatggacaaatgagatgacatcatgttaaaaaccttctgcacagcaaagtaaatcatcaacaaagtaaagagatgacccacagaatgggaaaaaatatttgcaaagtatccatctgacaagggattaataactagaatccccaggggctcaacaactctacaagaaaaaaattataatccattaaaaatggacaaaagatcgatagacatttctcaagagacgacttacaaatgacaaacaggtgtgcgaaaaggggctctacattactgataatcagagaaatgcaatcaaaactacatgggaaagccaccccaggtaaatggcttatccaaagacggcattacaa

SEQ ID NO: 5040 - DNA, 843 bp, Homo sapiens
  misc_feature (1)...(843): n = A,T,C or G
ctagccgcatctgagctgtatttttcttaacataatgacctcatgtcagggatctcattcttttttatggggtcaataatacttcgttacggggggtataacacatatcctttatctnttcattggttnatggacacttaggtancttccatatcttngctattgtgaatantgtgggcaataaacatggggagggcagatatctcttagataaactgagttcctttctttttggtgtatacgggggggtggggattctngattggtanctctaaaatagttttttaagaaatctcccaactggtctccatagggggggggctaacttacattcttaccaacaggatggggaggggtcccttttcttcacatcctcggcagcatttgttattgcctttgcttttgggataaagccatttagctggggggggctatctcattggacgtgtaatttgcatttctttaatgatgcaggaggggaaaggcccttgtcggataccggggggggcatggggatgggggcgcttaaggaatggacatcgaatgttttggccagtttgaagggggttcagtatttttttccctggaaagggggtcgcagcctccttcgggatggcagggggaacgcccttggacaagggatacttggacacgagtgtgggtgccctggtcggggggcgcgtttggacgtggtcggaggggttgacttgggcgggcgaaaaggggggggaaggaggggacggtaatcggaccattcgtgctggagggtgagtcgggggacgatggggaggggacgtgagcgcggcggacgccggaagggcgcacaggggggtgggtaaatag

SEQ ID NO: 5041 - DNA, 660 bp, Homo sapiens
  misc_feature (1)...(660): n = A,T,C or G
atggagtctcagtctgtcactcaggctggagtacggtggtgtgagcttggctcactgcggcctccgcctcctggattcaagccattcacctgcctcagcctcccaagtagctgggattacagatgccactgcgagaacgggaacaatggaacaggccctcaccaaatgccaaatgtgctatcaccttgattttggttttcccaggctgcggaactgtgaggaataaatttttttacttataaaaaaaaaaaacaaaagtaatagagcggatatatttttaaaaagtcaaacagaaaattaaggtagtgggtgccggttgcgggccgttccttttggggggggttaatttatgaccctcgttaattatatcgcttggcttgggggagttccgtgtgcggaaaccgggttcaaattgctccaaggggggtgtatcccgggtttccccatgaatcgggggatacccccaggaaaaaactttgggcgcccaaaggcgcgagtaaggggcccggaaccggtaaaagggggggggtttgggtggtgtttttccatagggccccccaccccctgaaaaaattaaaaaatattcgaccctagaattgtgggggggagataacccttcaagggattttnaangnccnccgnntntaccncttngnagag

SEQ ID NO: 5042 - DNA, 422 bp, Homo sapiens
  misc_feature (1)...(422): n = A,T,C or G
ctacatatttgtgtgcagcaagatcttcatcaaaataatttacaggggattgaaggcagagaagatatgaaaaatgaaaatccaaccatctgaagacattgaaagaatttgtaaaaaattgaagcttttgttcagagacgtatacactgaaatcgagatgttcaccagggctgcaacttcatctggagcttggcatcgtcttccaagactatacagtcatgtaagatgtgcctccttcctcttcaccatctgccatgattgtaaatgtcctgaggcctcctcagccatacagcctgtggaactgtgagccaattaagcctcttttctttataaattgcccagtctcaggtagttctttatagcaatgtaacaacggacgaatacagctcctgttttaaatgttcaaaanaaaaaaaaaaaaa

SEQ ID NO: 5043 - DNA, 985 bp, Homo sapiens
gagacaggaatcgcataccgtcacccaagctgaagtacaatggtgcgaacatggctcactgcagcctagaccgactgagctatgcagtcttcccacctcaaccacccgaataggcgggactatagttagcttcttcctggaatcctgaagcttcctgctacaggatttagagtgctttgaacacgcagtgatatgctgtagaagccaagaagaaaatgcaaatgccttccaggttatgacaccagtttgatctgagggagtgatctttgccttaccactcctgctccgtaagaataaagggacatcagaagtttccttctgcaatgactgcataacctacccctgtccccataaagggtataaactcagatgaccttagttattattcccatggtgattttagaaagagtttatgtgttcatatgcaagtgtgcatacacattggaacagcaaagataaaacatgatacattgttgttaaccttcaagtctctttatatcctttagtaattgcacaagagggccagagtcacatgtgaaactaattgcagaagatcatattgagtagcatacccactaaaatgctgttatgagtttacattatttgctaaaagattgaatatgagaaaaaattctgatttttacacattatttccaaaaggagtcaactccattttaaaaatgctactgtttggggaggggggtctccctatttcaatgaaatgactatctgaaaagtacacatattgttttgtttataaaaatctctggtgtgttttgtttgtccttttctaaccacttcacttagcaaattggtttttgcccagatgttttatacatgctgtattatttgactatctgttgtctttgacacattgtttttctgagttttatttatttttaaaaagttgtctctcagtgagttgctcattttactacttatacagatactcatgctgtatgtaaataaagaccgatgcggccag

SEQ ID NO: 5044 - DNA, 242 bp, Homo sapiens
ctgccgcatcccagtttattataaaggatattgcaaaggatgcagagaaagagatgtgtagggtgaggtttgggagaaggggcacgcagtttccaagccctctctgggtgtgccagccctccaggagcctccatgtgtacagctgtcaggaagctctcctaacccagtctgcttgggtttttaccgaagccttccttccctcagggtatgaggcaggaccctttgcaaaggagggtcttaag

SEQ ID NO: 5045 - DNA, 260 bp, Homo sapiens
cggccgcctccctggctttatttgaaaactaatcataatggtaatatagtctataaagcacaacttggtagttaattgtttttggctaccaaaaaattgagtcatccggcaatacaacgtcattccccaaccccacccagattatattggtggagtatttatacaggctatgaatcaggagaaatccaatatcctttctgtggagatctcagttcctcacaggggctttctctcagcgtcagccattggatataccagat

SEQ ID NO: 5046 - DNA, 884 bp, Homo sapiens
ttgccgatccacatttattagttaaatccttcatggctcttgaaatattgacagctgctaagacttctgatgcttcccctcatggtcctgaaataaggaaggccagaggacaagaagagattgagcgggcgtcattccatctatcacaggtgtaaagggtgattgacagcgccacataataattttgaattttctattaagaagaaaccctttccaaacataattttcacccagccccattgtcctctccattgaattgggggctgtgagctgctgtgtatggacaggtaccctctgtgacctcattcatatcttcctgaatgaggactcaggggatttaggctggagcagggtggatctggagtggacatggaggttgtcaaggcttgtcctccttagcccttgcaagtgaacacctcatctgtactcaggacatcacacagctgaccccggcttaagatggcatattcttcaacatattacataactggatttgttttttttgggcatccctccagataataaaggaatggctcatttcccgggagatagaattcctcaaatcttctccttttttcccacgaaaaataattacgcattgaaaacaaaatttatttcattcggaattcgccctggatacgcatcctatcgcccaatgaaaaaagcggccctttagaaaatggaaaccggtttttaaatttttcagtattttctattttatccattgagagtattatgtactacactcgctttttttccacaatattttttttattgcacacaaaatagttttgggctttatgggacaagcagcccatgtcttaatgcctcccaatacaagctgtcatcttttccctctttacgaccctaatatttaagctaat

SEQ ID NO: 5047 - DNA, 246 bp, Homo sapiens
cttagcagagaaggcctcgtcctgaccagggaatccctggtttccagtgctgtctgtcacagagtggtgagttgaattcagagaagaacctcttcgctaccagacctaaggcaaccttctcccacccaacctgaataaagattcaaacacatgatctagaagttgagaagtttccagagagtcagatatcccgcctaagatcttttcacttcttcttaccacgtataaataaataacgatcggcca

SEQ ID NO: 5048 - DNA, 357 bp, Homo sapiens
cggccgatcgttctttatttctttcattatttttataatgtgcatcatttaattacatacttctgtgaaaagtcatcattacaggcaacatttggttataaaatatatgtagatgaatttcttaactgaaagaaaagggaatgcctcattttaaacactcttccagcagaatctaatgctttttttcccctctccctttctctaggcaatacactctgagatccttaacaatatcattccttgggtggttgaataaaaaatgatgctgacttgattgttctggcttcctgctttcccatttctgtgtaatcttttaaaaactaacttcttctgacagctctgctcacaggcataaaa

SEQ ID NO: 5049 - DNA, 1215 bp, Homo sapiens
cctgaccgagactgatccacccgtcttggccttcgaaggtgctcccaaggccaccctgtgagccaccacacctggcccatcccttttcttttttacagaagtccgtaatgctcaattaatttaccctgaaatggcagacaaccacagctgcagacctcaatctacaatacgtattaagcaattcaactttttcttataatgtcatgacatttctctgctttttgggagtacttctagcatcactagtggtacttcatatgggtctcatggtgttattcaaggtttagagtatagtgctacatacaatgataaaatactcaaaaaccacaagagatcactgtttactgttatacgcagtttactggagggacaaactgctcacttggagatgattagcgtcttggcattttaagtggatactagcaacacttgagctcaccacactagccataggaggtagctacaaaagtactgcagtagtatagtatgtactacagttaatttcatgcagttatgatttaatactgcatctttgctttttttttacattttttctggattgagaatggcaccagatatggtctgctagtgtttatgtgcccacattgggatgaacttttataacagatttgggtcattttattggagtaaatgaaaaaatggactagtatctcctatattttatgcattcatgccatatctttatcgtaatgttttggatattttaggctacataggtcatatgcaagtgttttcaaattgctgcaaatttccagaaaagtttccgatatattacctgaaaaacatcaacgtataagtggacctatgcagtcacaacctgtgtcttttgagcagacattatattttgaatcacaattcctgcatcacagtgccatatctgcaactgatttcagacagttatagaaacaaaccagttagttttcccccttcctgtcatatgataatggcaacatcttcttctactacataactattttcagactgaattatattaatatatgcaaggtacttagttctaggtctagaaaattcttaaagccttcaaattgaaacttccatttgttatactatttacgttggtaagggtcccttcaaataaaactacatatatttttatgtatttttctcacatctttcaataaagaagatgcgtccgcttcgttttttatggtaattttgcggagaacataaaga

SEQ ID NO: 5050 - DNA, 706 bp, Homo sapiens
aggaagtgcccacagaaccatgaaacagatgttttctgaacctatgcgaagttttcttcctgatggaagaggcaatcctaaatcccaggactcctactgctgcattttgtcctcctgacacagaggaagatctcctctgtgagatttatattatcctgcctgccttggtaacgtaacattttcatggtggcatttttctttaagagtcagatagcatctggaatgtagagattatggaatatatcatttgaaattgccaaatcagcacttctactttgttttctgagaatttttctccaaaggaatatttagtgattgaaatcattaaatatagttgatttgtcatgtttcttggatacaaaatttggacagaaattaaggcataggaaatttaatgctgtatctgaaaactaaaatgccacttatgaactaattgagaaagtaacaatgcatgcattggacattgtattatagacagatattttagaatgatctttaattgtatgatcattttctgtaaacctcatttaaattcttagaaaaccaagtaaaagccaaaatattagtgttttttttctttaaacttcctgaaaggttacataagcaatttctagtgtttttctaagtaatttgaaatacagttatctgaaagagtatcaagacactcaaatagctgaaatcaggaaaataaaattagatgcggccg

SEQ ID NO: 5051 - DNA, 820 bp, Homo sapiens
agtttcagaagagacccagaggtcaagacaatcggtgtgaaatattctacatattatggggaagcatgaccatcattgaaaaactaggaaagaggtgaaccaaatggtttttcagcatcaatctatcaccagcctctcagcttaacaaaaatgagaaaaacttatcaaagtctagaattggagggcaaagtaatcagtctaacctctcctaaaaatacaactagaaaagcaagaaaaagtatgaaaaagtaaaatctgtttgcaagtatcatagagtaacaaaatgctgaagactcaccagcctaggttctagggaagacaaaagcttagagaagtgagttactcaggacaacactaccaatttgggatcactcttgggatctgtactaaatccagagcgtgactctaaatggctaaaatactgagccctagtttttatggcttccatgggctagaataaaaaaaaaattgatgttcaactgccagcaggaaggtagtgctggtgattcagaagtaatagggtaagctgcaagtagaaagattattacaggtactgcagctcagctttgagttatctccattgctaaacttgaactatggtgagtccatactgatagggtcaccagttgcctgacataaacaaacaagactcctctatgtaggaaagcataggttagcgcaaaagtaattgtggtttttgccatttaaagtaatggctttacattatttctacaaacaactctgcaaacataaggtctagcacattaaataaataaacaaacagatacaaagagccaactcaacacaaataaagccagag

SEQ ID NO: 5052 - DNA, 389 bp, Homo sapiens
aatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcattcaagtacttagaattcactagtcaaaccaacaacagcttgataaatactgggaagcattcctacctggagccaagcccttgccaacattagattgttgccgtaagaagaccctggattttgttccaggtttgcctgatgccacgtgaaatcatgtaaaaccctcgtaaaaaccccttttatgttatgaattgcacgtgggctcattcccacccc

SEQ ID NO: 5053 - DNA, 854 bp, Homo sapiens
aacctctacctaccaagtcatgaaatgccttcctgaatcacctccccaatctcctagtgatggaatagcaactatttctttgctgggaacacaacagttcatataccagattctttcagaaatgaaattgccaaacagctttccacaatggctgaactaatttacattcccaccaacagtgtgtatgagaagactgagtctcaaggatggcaaatgaataaagttcctgtggtttgtaaatggtagactaggatttgaaaccagagataattgtctcaaaattcctggctcttcgccataatatgtgccacctctagacctcagtgcttcatttttctccactaagaagatttagtattcatgcagaggaaaaaaaaatcacattacttcgaaggacaagattgatgggacctcgggaaaaaaaataatgattgaaattctcagctgctctccaagacatctgccatctgccagtgctgaataaaacaaatgcttttcctgtcttctgggagcttataattgaggagtaaagaaaaattctgaaaaagtaattgtaagtaagagtcagaagactgatttgattcttgtaaacaatatgagcaattgagagagaagcacattattgtttttcaacagatgtcatttgagtttggagaagggcaaaggaaagaagataatcactggaagacaacctgagaaaataaaaaacaaaacaaaacagattttgttaaatgctcaaacttaactgaacactttgactccattttttatgtatgtactatgacaagctatcaagagacaccacctctattatattccatattccaaacataataaaacttgatgcggcaagg

SEQ ID NO: 5054 - DNA, 1117 bp, Homo sapiens
gtaattctgaggctttgtgtctgcagcaactgtccaacctgaaacgcccccaccgtgttgcaggcctgcttgatctgcacaggaaatccagagaactccgttgtttccgaagagaggggagatggaaagaggtgtcagagggcactggtcaggggcgaggagcgctggaaggacgacatcacctacagagccctatgaaaagaagtcagcaaatactctgacctccgggtgctgggggagaagacagcagacagagagaggaagatctgggcccagaattccttgttcgtgtccagaaaactataaacacagtgaattccttcaaacgtatctgcaaagcccgctgggtagtttatgtcacagaacgtctcagagattagagcattttgcacgcaccaagactcctgatcaaagatgtatctaaacatgccctgtgggtgggcaattcctcaggagccagttcgggaggctgtttgtcacctgtcctctccctagtaaggaaaggcccccctggaccagtcagaagacttgagttctggtctcttactgttgacctcagtgagcttggatgaatcccctctgcatttgtcttgattggttcttgattggttcagcccaagctctgcatttaaatcggctgtgtcacttaccaccagagatctgatttaattggtttgcggtggggagcatagatgatagagcttagaaagcttcccaagtgaattgtatgtaccatccggacaagttcactgctctagcatacgttagtgttcgtctctcaatcactttgcagtgcttgttaaagctcagctgctcgaccactcacccacagtttctgcttcaacccttctgggacggagccttagaatccaccttccttgtaagttctcaggcgctgctgaggctgtcaggctgggatcagtttttaagcagccctgctctaatccagaggttctcaatggtagagcggtttttcctccaaagggacgtctggaggatgtctgtcttcacaagcgggaaagggatgctgctggcatctagtgggtagaggccagggaggctgctaaacactcaacaatgcacaggacatcccctcaaaataaagactaatcggcca

SEQ ID NO: 5055 - DNA, 650 bp, Homo sapiens
cacttattgagctagcagctctgtaggcggctctgcggatatggagacgaatgatacaagactcctgcctttgagaagctcacaggctaatctagagaacaacgagataaacacgtagacacagctcatcatgataaggagacagttcacttaaaaatgaagaacttggatttcttgtcccacctctgacactacgaggaggcttcagacaattaatttcacgcccaagcctcagtttcctcttctggaaaattagatgatggaaaggaatgaattctgacattttttccagcattgaaattgtagggttatataatatattcatagaataggcttcaaatagtctacaaaaggaaattattaatatctgtagtgggcaggcccaactcagtgaaatctgtgtttcgaatcttccttctcattgcctcaggaaatgtatattttgtctgccatattattttcttatgactcagagttaaaatatatatacccaatgaaaatatcaagtggatgaagttaaccttgttagtagcatataatattttatgacaaagaaaaaaatgccagaccatctgcaaatgactgttttatggatttaatagaaaccaccacttatggaaaaagcaccaggaataaaaaccgatcggccg

SEQ ID NO: 5056 - DNA, 750 bp, Homo sapiens
gcatgctgcagacactctcttaatcttccaccgctacagcggagaagaaacagcaactgactttgccggctgttcactcacatcatctcatttaatctgcacagctgccaaatcagctggactccaaagccagattgtgcacatcttaaagcttctcatcagatcctgaagcccagcatattaaagcatgcaaaactaaagaaggaaggtatcaggttcagaaacggaccatgttgtggatctgttggcttcagaagctgagtaaggaggggaaggcagccctttaaccctgaggcaggaaactgcccccaggcactgaaggagcctgtgagaacaaggcactgccaggtgacctgatctaccaatcccatcgaaggaactaccttggagcatccccactgagacagcagattcattaactgggcaggttaatgccaaagtgttagtacagaatatcaaagagctacaaaaggccatgaggagacctcaggcaaatgcactctgtgcacacacagttatttcacaaaccataaggcacatttcttctaaagacaaggtgatctgtcttccagcttcagggaaggatataagcagaagtatttgctaattcattagcttaatttaagtgttcagaacaaaagacagtaaaaacaaaggaatgttactgtttgaaatagaaactttttgagtttctactaagttcttataataaaatttttgtttaaaatgaaaataaacctcgatcggcca

SEQ ID NO: 5057 - DNA, 406 bp, Homo sapiens
agtccagctccacctggggaaatgatagcagaggaagagaagaacaaggcaggggaactagagaagccagcaacatgcccttcaccccgtaggttggcctgtagcagccctaaattaggaatgttacagctgaccggattcctgcaaagtggcgtctacttcacaggcagtttatatgaagcctccaaatcagacatgcttttactgtcatgaagtagaaagaaaagacttttattccctaagactctcagaatatgaactccagataagaccaaagatagctcgttgggtgagaattggaaatacaagactggcatcttcagtattatgttgttaatactctaggagcaatgaaaacccacatgtaaaaacaaacactctcattaaataaaagacgatgcggcaa

SEQ ID NO: 5058 - DNA, 850 bp, Homo sapiens
agttcacccgtgtatgcgacgactgccccgattatatcatctcgtgcttacctcgtcgccatgccaaaacggttctgtttatagccccattaggcaaatcgctaattgccctcccaatgttctcataatgccattgggaattacaagtcgtgggaaacccagggaattttgttgccagagaggcctaacaccagttaaatgcttaacgcattcagtgcttcttaacacccagtttttcacattagccggcaggacctattttaataaccccccggctcgaggtacttttagcctataaagaaaacgaagggctacccttgatatttccaaggtttttggacagacctgtgatagaaatctttatggcatggaaaactatgcattagtcgtaatgcccaaccctgtcaaaattcaacaagcatgaattaatttcaggctcttttcctccttcaggcaaatatgaattctgcacctgcatttgaggcccgcatgactcaataatttcatggtggcaaaaactaaataacagtgtccttgttaatatcacctagactcataatagttctagcaatatctgttagcactcatgtttgtatcagacagtcttatgaataccaacatctttttttgccatgttttaaattttctttaaacctctattgttcttattatcctctacaattacagtctgaaagagtattttctgggtctaagaaaacttatgttctccctccattcacgactgtataaaaccaccatcaatctttcattaatcttccttgcacagtattcgccattcagtgtcaaccttcactaacatctcagtgagggtaatggtgactatgataaa

SEQ ID NO: 5059 - DNA, 533 bp, Homo sapiens
actacatgacaattctaaaattccagttctatgattcataatggccaaaaggtggaaacaacccgaatgttcatcagctgaagaatggatacatgaaatgtggtcaattcatgcaatggaatagtattcagcagcgaaaaggaatgaagcactggtacatgctacaacatgaatgactcataaaaacactatgctgagtgaaagaagccaatcagaaaagaccacgtgctgtatgactccattcatattatgttcataacaaggaaatctattgagaaagtaaattagtggttacttagagctgggaaggatgtgggaatagaaaggtgatagtgaaagggcatggggttttataggtgatgaaatagttctaaaattgtggctatggtcgcacagatctgtgaacatactaaacaccattgaaatgtacaatttcaatggatgaattgtatggtatgtgaattatatataaataaagcacgatgcggccgatcccccctcggtcacgcacccctgactcgatttattttttt

SEQ ID NO: 5060 - DNA, 1079 bp, Homo sapiens
catgctgcagacgacaccttgcttcaattggttagctactatcaggaaagacattttggcacaagtcattgtctctaagcctttaaaccttgtagtacttattccaaaggaattcatgggttgaaaagactttctgttggcctgcattgcttggtcggaagaatggctgttgctcagaaatccaagagtgagaataaacgcaagagaattccttctgctagttttacgattgagcaccgtacttgaacccctcagtgcaatctaggtagaaagagtcaggagataagtaaaaatagagaacattgtagtttaaaggaaaggaacctggaaatgagtgataataccaggaaagttgctaattttttgttccctcaagattgtatcagtacaagagaacgatcgaagtttgtttgtgttccctggggaagatcagcgatcttgtttctttttgagaaatgtcagttagactgaagatgatgtaggaaccttaccaaaaattaattctggttattctggatgaaaaaaacaaaaacaaaaacaaaaaaatccatgtcatgtagcactgtccaatggccttactgaatttcggtcactggaaccttcttttggttaaatgtttatagattatgttcactaatccatttttcatgcttaaatctgaagacattaatatttgaattgcacagatttatgattatacaataattgatctcatgtacacatgtgatctgtgcaccagcgtgacacattgttgaagcagttgcctatatatgagggattttgtattgctgcagcttgcctgatatgccagagcctgctttgctgtttcaaatgtaataaatgtgaatgtgcatgaacttaataacatgatttgaaacataatgaggaagataatgggttgatcataatgacagggactaatatagggataatacagagtacaccctcactgctgttctcttttagaactccaaaaaaactctaattatgcagttcttatggcacacatagactgagtagattttaggagtggaatgtgcaaattaatgatttattaataaataaaaagggatcggcca

SEQ ID NO: 5061 - DNA, 1287 bp, Homo sapiens
attcacaggtacatgtggacgtttgttacctgggcatactgcatgacgccaaggcttgggatatgaatcatctcatctcccagacccaacgggaaccaaaccaaatgtccatcagttggtaaatggataaacaatgttatatatacttggaatggagtaataacgagcaatgaaaagaaacaaaccattgataaaccctaaagcatggatgaacttcagaaacatgagaagtgaaagaagtcagacacaaacaaaatactacacattgtatgactcagtttatatgaactttacagaaaggacaaacctacggagacagaaaacagatctgaggttgtctgggaccaggttgagaatgggaactgactgaaaacaggaacttttggggtggtgggaatgctacaaagcctgattgtggtaatagatacaaaaaacattgaattgtacacttataatggttagattgtatggtatgtgaattatacccctataaagctattaaaattagagaaaaggttttactaaaaataaaggacatggattaattcaggaaatgtataattttttaaaaatatattcattgtttagttaaaataaatgggaattaagggggggagctaaattatctgagtggaacttttggcttggtgaattcttgaaaaccctggtaaagttgccacagctaaccttcaggttcctaaatggtagaaacagaggtgtaaatccctatgtccccatttgaagtcactgttgtacagctcaaatgagatatgaaactgctttgtgaggcataaaaaactacacaaatgttaattataatgatgatgattcttcccattaatctattttgaaaagtcttttaggttcttaagcttaacgatttatgaatttataccccgccattttgagaagttcaataatatcacctttgtaattctcttttcttctcttcaacataaataccacagaattttctttaaaaaaaaactttatgaacatgacttgaacattacctggcacatgtagtaaactttaccttgtgtgtgtttgcaataattggcaatgggataaaaaagaaaataccatgtatttcataaatatttgaaaggtaaaatgtgagtattccttgttgtaagacaaaacgtgagtattccttgcctttggagttactatttttagaatccgcctttgtaagacatattactgaagacatctccctgttggatattcacaaacatatcaaaggtaaaaacctacataaaaaaataaataaagaccgatcgcaag

SEQ ID NO: 5062 - DNA, 783 bp, Homo sapiens
tccctcagccgaaggccgagcccagggagtcatgagcgaggatcatatattacccctcactaagggaacggcccgcatctgggtttattcatgcaccttcatcttcagttcagaatgtttttaatcttgtaaatcagtaaccaaccaaggtgattgctgtgattttaaatacttcatgttatttttaatgcgttttacagagctgggatctgatgagtatagatgtaataaaaacacatcctcctatctttttttttcttaaacattttccttgtacgatttcgcaaaaagacagataacttatagagtaagttcctttgctgtttatatttctcctggcagattgccaaacagcgtttagcagcgtattaatcagctagaatgtgagctccacagaccactgcattttccttctgcacctgagaactccagtggaagtctcagaaactcttgttgagccagaaatctattttcagtggatattgaattcatggattgtatattttcaccttccacatccaggtgaaggctgagatcactagtaggacctcccaaccctggaaatgtggcaagcagaaagccattgtgactctctggacacattagtggagaaatgttgaattctctcttactcatattacatcttagaagcatccaccagcacagcctgtagatttgtaagatgagcagagtaatgaaaacgacacggtgtgattcgttatcttctcattggtggtgacttctcacagaggtggcagagcaagccaggcaaatgaagttaag

SEQ ID NO: 5063 - DNA, 476 bp, Homo sapiens
tgtgatggcatttgggacacacgctcaaatagttcaggatcgtctcccggtctcaagattcttaatcacacctgcaaacatttacgatgaaaggacctcagaatgtgaccttatttggaaatagtctcctgtggatacaattagttaaggatctcaaaaggaaatcatctgtgtttctgggtggaacctcaatctaatgactgaccttcttataagaggaggaaaggacaagcaggaaaagagagaaaaaggccatgagaagatggaggcagatattggagtgatgctgccacaagccaaggaattctaggagccatcagaagccagaagagacaaggaaggattctcccttggaatgttcagatgaagtgtgcctcttgacacctagattttgggtcccttgcctccagaactgtgagagaataaaggagatgcggccgacctcgacacatgaatatgcgccaacacaccacccc

SEQ ID NO: 5064 - DNA, 561 bp, Homo sapiens
caggacacacactcttggaacccaacaactatgctataagaaagcccaaattagcttacagggagagaaacagagaagtccaagtagagaaaagttgacagcccagatgaaagccaccaacaaccaccaggtggaagtcggattcagatgattttagcaccctagcaaataagatatgaatgtacaatcttgagacttattggttgtggtagatatctcactatttagaagtagccaacctagtaaaatggtagaatgtcttataaaatctgagttaatttgccagactggaaacaagaccctgtgtgtttggatgttttcctctaagatgcagtatatgaactaaaatatagtgctgtgtcccaaactactagaatttgtgacttcaggagtaatattgcccctgctcttcgtatgtccctatggctcacctgtagaatttttgcttaaatcctcacaacttctggctctgcaaatttgagatcctgattttgaattaggaatatgagtgcatatctaataaacagagttgtaagaatttcaataaactcggatgggccg

SEQ ID NO: 5065 - DNA, 575 bp, Homo sapiens
aagagtaaacagagacagagacacagagggaagacgaggtgaggacagacaaggaggagaaggccttgtgaagatggaggcagaaactggaatgatgcagctacaagccaaggaagaccacggataaaatgccagctgctgccaaatgatagaagagcaaggaaggaccttcccctagagccttcagagggaaccatggtctgctgacaccccgatgtcagacttcaggtctccacaaccgtgagagaataaagccccaagtttgtggcacgttgtcacagtagccctagggacctaatacaccctctatttcctgtctcaccgaatcagaattcctggggatggagctgggcacctatctatgctttacaagttctccgcttgagcctgatgctcaactataacctccatgacacaatttttgttcatccccaattgtgtacacaatttttgttcatcctgtaggcagtggctagcacagtgcgtagcatgcagttggctgctaaaaacagtgtgttaaagcaggaaaaatcagagcgccgtatgtaaataaaataaaatacaataaatactac

SEQ ID NO: 5066 - DNA, 497 bp, Homo sapiens
acaagacaattcctggaactggcactgatgaagaagatggcagcaaatggaagattggaaccaaagaggagccttgagaagtcagaagttctgttccagtgagttgaatcaagactcagtttagaactgagaagaaagagctcttctcttgttatgctcttgggatgcccaatggttcaactactaataacaactggcctgaatcatcctgtcagctcggcattgtctgaatagctgttggtgtggtggaggaagaagttgttctctgcttaaacatcattgagagatgtatgcttatctaccagcttccaagctacagtttaagttggaagaacataggcaaaagacaataccacctttcagctgtagttgcaagagttatgattactaatcaccacctatcaagaaggcagctaattttgatactatacaacaaagcaggatgcggcaagtatgtttaatttataaaagcgactcgttaactacaataacgctaa

SEQ ID NO: 5067 - DNA, 249 bp, Homo sapiens
aattttaaaaagaacagattcatttttccgaaactgtgcattcgatgtaccggcaggcgcaatccagattaatcaacaagctcgtctggtattggggcccctcatccagaaactgactcaggtcaagaggccagctttaactccctaagatttcatctccaacctgaccagtcagaactcccgtcaaactatcttcaaaaattccagtccctgaattctcagggagactgatttgagtaaaataaaacg

SEQ ID NO: 5068 - DNA, 194 bp, Homo sapiens
tttggtaccaggatgatgcgggcctcataaaatgacatgaagctatacaattggaaacagaaaatatgattttaaagaagaaaataaaagttactgaaaaccatgtgaagcagatcataggaaagatcagtgaataaaggctgatgcggcgagcttgatcaattaataaacatactaataatctctatgctgta

SEQ ID NO: 5069 - DNA, 176 bp, Homo sapiens
caggttcaaaagaaatgcacaaatattaagtcaaaaataagatcacgggatccttttcaagatggccgaccagacgcaccagggaagtgccactcccatggaaagaaacagggattttgactaagtcagcataattggagcagatcttcagagagaaaatgcagaatgtgaataga

SEQ ID NO: 5070 - DNA, 238 bp, Homo sapiens
ctgctagcagtcacctagaggacgctgcatcccagtcctggccatctcctctgggtcgctggcctgtgcgcccaaccacagaaggccgagggctgctgcttcctggggaaggattctgggaatgatgagtacctcttgcttcatgacaataagacaaagaagaattttgggaaactgtgtctggggaaacaaagaaaaaataaaattatcctttagtagaaaaaaaaaaaaaaaaaaa

SEQ ID NO: 5071 - DNA, 324 bp, Homo sapiens
catgcaggagaccctgtgaaagccggtgtgctgtttagtcgtggggcacagcaggccctctgtgctgtacacgctgacattcattgagcacttaccatgagccagacgtgggcctcccgtcgtcttcctgtggccctgtctcctggcctctatcactcccatttcacagatgaggagaccgaggttcataaagcccaactggctctctagctgggagtctcacagcctgtaagaggcagagctgagatataaagtcaggttttctgttctcaaagctgtgttctttaccattacaacttgagaaaaatgtagaaaggcaataac

SEQ ID NO: 5072 - DNA, 561 bp, Homo sapiens
  misc_feature (1)...(561): n = A,T,C or G
cggcggcggaggaactgttccaacaaaagacaacccaagcagcggtatagaggagcggaacaaataatctatgacgaagtacggagagtccaatacctaaccgcgatgtaaagaacccaactaatataaacatcattaaagcccgcgtattcatatgtgcacagagcggcacgcagaggcaaatcatacnaactactactctaacctcacctgttaatcactagattgtgtcagacggtaataacaaagaacaatctcggtggcactcaanatatactcgtgagcataacattgtgagagatagaaggatattattatgactcaagaggaaaattcggttactttgtgtgttactcgtggggagttaagagatgaagatttacactcttgagaaacgacctatccgaaaccgtaaaatcaccgcggactatagcactgactatcagcagcaaggagaacacaagatcatcacaacagagcaggggctaaaatacaaaaacaataacagaacataataactttataaaggacaataaattaaccgncggccagtgaacgcgc

SEQ ID NO: 5073 - DNA, 192 bp, Homo sapiens
atgaagcattagtcccaacatggaaatggatctcggagagaaacgcatctatcagatttttactgataccgaggaagaagtatctccctcttcgaattgtattgtacatttgcattgatgtggttattttcatctaaataaagccagatgcggcagccctattattcgaatcgaacaaaacgaaatgaagaa

SEQ ID NO: 5074 - DNA, 243 bp, Homo sapiens
ccccccagctagagatacttgctcttggagcccacctgccctgctgggaggtgctgggaacacctggagagccatgtgcagctgtgtggccagcaatcccagctttgttcccagccagctgccagacctgggagtgaggaagccttccagaagaccccagcctagtccccatctgacagcgacctcatgagatatcctgagtgagatctacccagccgagcccaataaaacccgatcggccag

SEQ ID NO: 5075 - DNA, 339 bp, Homo sapiens
tgcctgaatttccagtgctatgccaaaaagaatggagagacaggataaccataccttgttcctgattttcaagaaatgtattcagtctttcaccattaaattcctctccattccagtataatgaaaatttttaatcataaatgagtcccgaactttgtgaaatgccttttctgcttcagttgatatgatcatgtgacttttccgccctcccctgttgtaatggtggattgcaatgattgatttttgaatatagaaccagctttgagtaccgggaataaataccgatgcggccagccgcctctttcttctaaaattctcaacccccaaccaacacccacc

SEQ ID NO: 5076 - DNA, 550 bp, Homo sapiens
tgtgtccaaaacatgaaaataatgacgaaccgaacaaggaaatatttggaacataatttcccttgactgagggaagaaaagtgcttctgaggctctttttgaataagtaacagttttcagattcacttttgcaaagattgccaatatccttcgcagacaccaacaaaccagactgaacagaaagatccctgtagtaggatgccgagcaaatcattgacttctccaatctctaagagacaatatctaaatgtcagtctcatggcattgtattttctgcttcaccataagattagcaaacacaagacataaaattatgtttatttactaaccaatacagaatatactaggccctttgcctggaagccagattccacttctgagattttctgaagtccattctagaagaggtggtttttactgatacccagggaaggcaattcttaaattgattacgtggggatggaagtttttgtggactttacgcccctaagaccaaaagccatgaggcatttatgaataggtgatgtaagaaattttataaaagttgcaa

SEQ ID NO: 5077 - DNA, 179 bp, Homo sapiens
  misc_feature (1)...(179): n = A,T,C or G
gtgctgcctgacaaaggtcactgaggaccaaggcactaggccactcattctcactgctgtgagagctgaactagagacgaangtggcccgcaacaggaaaccctcaccccagacactcagaagatctttccaggcaccaggactgtgagtcactgacaggagcaagtaataaacacgga

SEQ ID NO: 5078 - DNA, 220 bp, Homo sapiens
cactggtgaacccagacagtatcctttccttcaaagaatttaaattttaatgggatccatattttttaaagtaaacatataatacataaaacactgtactatgtaatttataataataactaacatttattgaacgcttactatatacccgcactctgttccaagggtcatcaatctattgcctgtggcaatagtaagcattctgttttctacatagaca

SEQ ID NO: 5079 - DNA, 799 bp, Homo sapiens
cctcaattgcagccacctgtaacgatccaggcatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaaggtattgcgattgcctgaatttgagtgggaattaatttgtatcaggactgtttttattgtaggcattgctttgtaacatcttgcttgtctgtttaatacataaatgctgatatgtgtctcctctgtctgggaagatacatgtctcctccctctccagtgaagatattcctgaggtgcatttctactttaactggaggaagaaagagaggggaaaaaaactgtcccagttcatggccatataaaaataaattgtggtttgtaaaataaaaaatgatccgccg

SEQ ID NO: 5080 - DNA, 490 bp, Homo sapiens
tctaagcacagagggtacacttggagaagcatttggatgaaatctggtaagaaaccagttgaagtatatcgagcagcccaaccccaggacacccatataaatctagaatgtaacctttggaaaacgctgaccttgtaaattaaccagaaacatcaaagaaggagattatactgtgtacattcagaatgcaaaagaaagagccatctttacttgtgaaacaatgacctttgttctgcatctgtgttatgatgaattctcgagtctgatgaggtatcagatgcttggttaatctctcctagatccaggaaaggcctgcaaagggaaggcctgtctgcattaatggagattctctacagatgcaaatttcccccacaaagacagctttgtggggcaatttcataatatgtcaaataaatatatttgggttaaaataaaaaccgatgcggccgatccatcggacttattacaaaaaatgcaataatatatggaa

SEQ ID NO: 5081 - DNA, 433 bp, Homo sapiens
taccaatagctaatacaaacaatatctgtggaaatgatggataacataaacaatttttctcattcagttaactaaacttttcatgctaaattagggcaatcagcctttatgttaagtttatagaaaaattcataagcactgcagtgatttcaagtataatatgtttacacagaaaatatttcagatttctttgctggaagtcagcaagaaaaaaataagagatggtgcactctccaaatttcgctgctgaacaacagctctggaagaacttcttctacataggcttttaaatgtttcttccttctgattcagacttaggtaagaactctagatgtttcctaccaaacaccgttaatttctcctcaataaacggggatgcgggcccgccccctatacatttattttgtaaatatgtaggaatataaactcgtat

SEQ ID NO: 5082 - DNA, 236 bp, Homo sapiens
cttcagcggcagcaagggcagaagaccaaatgaggaaggggctgccacaatggtggatagtctactgctcacaaaagcacctgctgagcttctcccaattctggattcctgccatgcagcaaagggaaaggagaaggaaatggaagcgtcagcatgtgttaaaaaaatgactagaaaatgggaaaggaaatacccagtacagcaaaatcaaccatcaaataaactgcgatccgccg

SEQ ID NO: 5083 - DNA, 625 bp, Homo sapiens
aataactgcaagaaaaaatctacatcctgaaagggttgaacccatcttgaaaatggcaaaatctccatcctggtgatcactggcaccatcactcccagtatagccatcactctatgggatcctgggcactgcttagcactaggaaggcgaatggctttaaattatgattcctgtcctcaagaaataagtcacattgttaaaaacctgacatcaacgtacaaagattcataatcataaaaggtaactcttgtggccatgggtgcagtgtctgccatgcagaggagaagccgctggttgtagcagcaacactccagcttacctggagcaaagtgcataaaggaaaggccatgtgaggacacagcaagaaggcggccctctgcaacctgaccagcaagatctcaccagaaaccacccctgcttgcactgtgatcttggaattctagcctctagaactgtgaaacaataaactgttgtttaagccacttggcctgtggtattttgttacagcagcctgaactgactaatacaatcactaaattatcaaaaagtggaattaaaagtgttatatctgtttcactcaagatatgagtaggaaacagagaagagttagacaaaaaaaaaaaaa

SEQ ID NO: 5084 - DNA, 179 bp, Homo sapiens
catctcctcacgccattgcccgacccgctaatcagcttgaggagaaaggagagaggaaatgccgtcctttgacaagatgtgggaaaccacctcggtttgtacttggtgtggctgtgaccggcaaacaaagaaccctccccggctctggggccaagtttccaataaaccctgatcggccg

SEQ ID NO: 5085 - DNA, 332 bp, Homo sapiens
ccttgcctcctgtgtgccctggctctggaatagcctacagatcctggagccctccgtcaactcgcattcccagccaggagatgtgggacgccccccagaaatggactgtggagatcagaatccttgaatctgcaaaatttcactaaatctctaaacaagaggcagagcctgtcaaaaacacccaactgtgaggagacggtagtggagccagtgtgcaaatgagaaccattgcacgtggtccctaccaggagtctttcctaccagacatggggaaggcaggctgggggaagtccgaaatgtcggcggtgcaaaaaataaacattgatcggccg

SEQ ID NO: 5086 - DNA, 196 bp, Homo sapiens
accttcagtacggattagaataaaatgatattttcagcaaacagacatctttaagcatcttcatctgcttttatcaaaccttcaactggctcctgctgctgttgacaatcacagcagcctgttgggggtaaagtatggggagagaagaaaataatgtattcctcaaaattcagaaataataaacctagatccgccg

SEQ ID NO: 5087 - DNA, 486 bp, Homo sapiens
ctcactttcaaaacggggagtcagcccatttggtcactggatgaagcaggatgcaggctgaatggagaggtggtggagttcgcagtctgtcccaggcactccctcacccagctatctgccaatacaccactttgatttatctattgtaaagctttttaaaagtgtcccttaaagtagcttaaggacaaatgtgaataaaacttcacagcaagtggagatgcagcctgaagaggcacgtcataagctcaacagtgatgtgtccagctttattttcaaagtcgtgaaaatttcacattttagaccctaacagctttctgtacttcttttcaatatgaaaagattgcatgattaaggcgtcaggaaagtgaaatgtttatctcatgatttgggtaaccctgtttgagagaaaagaggttcacaggaacatatctaccttctaaacaggagttaggaaaacacatggaaataaatactttaacgtggaaa

SEQ ID NO: 5088 - DNA, 205 bp, Homo sapiens
aagcgattctgggtcagtcagtgcgttcatgtcctggcccctgtcatcaaacgctgaagatcttgctgcagctgaaaatgattagcttctgctggaaagagacagaggccagcttcaggaatccgctgcactttcttctctgacagccgtgctggaaaacagggaggtgtttggaaattgcaatacatactctaacaaaggggga

SEQ ID NO: 5089 - DNA, 266 bp, Homo sapiens
aatagaggcacagaccagagaaaagagctttggcaaccagaaacccggctttcacttagagccccttgactcactgcggccatgtgaccctggacaagtgaattcatttctgagtctcatttcttcatctgtaaatagcacaggatgtttgcaaagatgagatgaaatcatgaatgttaacacctggcacatactaggtgattaataaatggcgatgcggccacgccccccttcttcttctctttccaccctcaagcaataactcg

SEQ ID NO: 5090 - DNA, 206 bp, Homo sapiens
  misc_feature (1)...(206): n = A,T,C or G
atgcaaggatagcagagctcacgtggacatctcacaggactgcaagtgcactggtggagtaagcagcccaggagagggaggaaatgaacagagatcaggcagatgaatgtatttataaaggcaaggctaactgctataattaataaatcgagatngcgcccgggccccacaatctcagcgacgttcccttcttcacccaccaacca

SEQ ID NO: 5091 - DNA, 372 bp, Homo sapiens
aagtcccacaacgcaatcacggatacaaaagcgacaacgcaggggacacaacgagcacagtcgataagaatataacagggacgaggctacggcgactgaacatccaacgcgtgaaaggctcggcgaggatctaggcggtacggtacaacggaaaagggacgacaacccacacaaacagtcgacggaccgcggcattgctcatacatcaaaaagattctctctcacatgcgcatgtacaaaggccgggtagactacgtatcgcccggtcaagtaagcagttctagagcaaacaactatcgcacggggatggaagataaacgcagtgaatgcgtatgattgcgtgagaatgatatggagctgggctcgcgccgc

SEQ ID NO: 5092 - DNA, 292 bp, Homo sapiens
aaagtgactggatctccagtagccatttttgatgatcagggaaacataaagatggaagatgtgctaatgatggagaaatggcaagatggaagaggcccgggtctctgatgaccatggagcagccaaacttttgtctatgctgatcatgtctgaatccccaggatatacaacagtgtcagttacataataggtgctcatgaatttttgaatggatctaataaatcaaggcatgcgtgccgggccttcgcttcggtggtcgatctcttcgctgctatattaacggcagcaccgt

SEQ ID NO: 5093 - DNA, 360 bp, Homo sapiens
aaaatctagcagaggacatcccgccccagaggatgggggagcccccagatggaacaagcatagctccctgaagggctgcatggcaacaggctcccctcatcccttctctgacccacgttagactggaacatgagtgacacctaaacctctgaagcaattttaaccagcccaagtttcaagctttaaagggccgcaattttgcatacacaaatgatggggacctcagaagctgtgcctacaaggacttccattctaccgttccattcatgccatgattgcatcctgtagcctttctgaaaaccaaataaagcaggatgcggccgatgtcattctccgaaagatgaccgattaaatagcaca

SEQ ID NO: 5094 - DNA, 344 bp, Homo sapiens
atggaccgaaaatgctgacgccaatgccaaggaaaaaagtgtcttgaaaaagcagccgtggacgtggagttaccaaatcatccgaagtggctcctggaccgggtggaggagccaggctgcagaaatgcagttcatcgcaggagttttcctgaacagagaaaagtctccacagaatagcaaaaatagcaaaaactcgaagtcaagggtcttgaggtctaaattttctgtgtgaccccagggaaatcgtttcatctttctaggtcttcacatcctcacctgaaaaataaagtgcgatgcggccgtgctgatttgcggcaacacatctgtttacgtccgtcgcaaca

SEQ ID NO: 5095 - DNA, 431 bp, Homo sapiens
cagtgcacagaaatgctctccataccacacactgctgctgggggatgggggaaagatggcttcggtaattcaagactggctttcttcagtgcctctttcagcaaaatgatgttaaaaccaggaaagaccatgaaaggcgatgaagaaaaatggaaatgtacccccaatattcccgactggagagagaagaaacacttcccacatcctgtttatctgtaaggcctgccatttctatcttcaaaatataccacaaatctatcccccatctctacctctgtcatctgcaccttaggccaaaatcctttcctttctcatttggattattgtaattcaggcctcagctgcctaaaattcagagaagagggtatatgaaggcttatgtagacttcaagtagattagaagcccaatataatacaagagcgatcggcca

SEQ ID NO: 5096 - DNA, 794 bp, Homo sapiens
gatgctgcagcgcctctcttaaggttcctcatttctcaacaagaagacaaaaagcactacattaccatccagaggcacagcagagagaattctggcaccgtcttcacctaacactcacaccctcttctactgttacagagctgagactctgtgtcttattcctacacatgacagctccctgtcctcctgcatcccagcggcatctccatctgaagagaccactgtcttccttccagactgtgtcatccaatacaatgaaagtgctagactgcttcacccacccccacaaaatctttgcttaacacagcaattgcctgccatcaagaataacccctgtaaattcacaatgccaaaccaaggtcccaaaggcgtggggggacaacctctcctggaaatgccataaggatttctcttaccttgcatagtagtcattgggtggaactgcctcttgaaagaattggaactggtataaataaagtccaatcaaatgtccagcagtgaaaatagccagcagaacacagagacagctgaacagcaatgggtcgaacgtccggcaccaggaccaccaggtgcacagacccaaaaatacaaaaaaattacacatatgatggctaagacggcaacatcattgcctaaaggaagaaaaactttatcacaacgtccgggcgaactggaaattcacttatcattcagtgaatggactatttcgaattctgggaaccttcctcaagcgtatttaagaccataaaaaaaaagaagtttaaaaattgcgcgtgaaaaatacaaataaaaag

SEQ ID NO: 5097 - DNA, 695 bp, Homo sapiens
taaagaacgttctccagaaaatatacattaagatatttcaactctgctaagcacttcacagagccacccgggtgtgagaaaagacatttgacgaggatgatgaatgaaaatgatactttaccagttctttctgcaaaaaagcctgaaatactctaagatcatttgatggaggtttccctgtgagaaagcaatcataactgacttacaagggatcctccatcaatacagtatacagattaaaaaaaaacacggtaaaaaaactcatcatagaaccataaggcttcagaaatgcactatggttttatatttttcttaattaggtgctcgaaatgtgagtaaaagcgactacgacttctgttcagactgaacttccaaatgctggaagcacggtaaactcggcacaagaagtacttgtgaaggaatgggcttctaaagagcctgccatggaccctttccacatctcctaccaagttaaggcattataccataggccctctgaatgtagccagaaacaaacaaacaaacaaaaagccagcatcatcggcacctgggggattgtcagaaaagcaccctcagacccaactccatcctatgaatcagagtctacagttcagcagggtcccaaggggatgatcaaaaacaataacatctgaaatgcaccgctatgcatccctttttccttaggaataaatagc

SEQ ID NO: 5098 - DNA, 829 bp, Homo sapiens
  misc_feature (1)...(829): n = A,T,C or G
acaggttctcgcgggctggagtgaagtggcacaatcatatctcactacagcctcaaactcctgggctcagttgatcttcctgagttgcctcccgagttgctggtactactggtgcatgccaccacacctggataatttattttttaatcttttgtggaggctatatcttactctgttgcccaggctggagtgcagtggcacaatcatggcctactgcaaacttgaacttctgggctccagtgatcctcctgcctcagcctcctgaatagttgggactataggcaagcatcaccatacccagttgatttcctcttactttttgcgaatacaggctctcactattctggacaggccagtctcaaactcctgggctcaagcaatcctcccactttggcctctcagattggtgggattacaagcataagcctctgcacctagcctgcattctcactttttaaaaaacaagagagtatctacttccacattaaattacatagtggagattataaatctttttgatcttcatactgacaaatgaagaaataaaatctcaaaattttgatatgcatgtttataaattatgctctgcatccttctatctgagaactacttgaatttacttttctctgcactgtggaaccatatcctttctatgtttttaagtagcttgttgttatttttataatatcgcagtcccttaactctggtaaattttacaaatacccctaatattcctcatgtttttacttaaatttcagctttatttataaaataaaacgcgatgcggccagantttttttttcgtacattattaatatgaccggacctt

SEQ ID NO: 5099 - DNA, 542 bp, Homo sapiens
agtggagagaaccacacaatgtctttaacttttgggggaagaatcaagagctctaagacaaatcactttatgcacctatctctacagtctttgcatacatggaaagaagcacctgagatttcctcatataaaccatgagagcaactgccctttgatgcctctatggcttccaagatcacatcattctgttgctgtgacaaaggctggtgagaaaagaaaatttgggtatctgaatgctggttttcatgtgtcttatgtattaaccacctccttcaagttgtataccctgcctttcttactggtttgctccctgtggttttgagaaacctctgtctattcttcttctgatgctactgtgaatgtgtagcattttgatttgctgatcacattcttcctcgtcacagtggccagtatttggttgtctctatgattctggttttgctctgcctgcactgagaggtacagatgagtgccataaatgaggttcttttcctcccttcagaactttttgatttggaacaataaagaccgaatgcgtccag

SEQ ID NO: 5100 - DNA, 727 bp, Homo sapiens
ttctggaggctggagtccaagatcaaggtgctggcaggttgtgtgtctgctgaggacttgtttcctgatttctagatgggtctccttgctgtgtcctcacccgatggaagagacaagtcgtgaccaagatcctctaagagacagctgtggtaggcaggcttctcagatggcccatgatgaacaccactgcctggtttgatggccatgtgctattctctccccttgaacatgggttaagcctagtgacctgcttgtaaccaaccaactccagctaagctgaagggatgccacagttttcaagcttcaaggattagcttacaaaagactgtgacttcctttttgctgatggactctctttattgccttcttggcttgaagactttgaggaagcaagctgccatgatgaagaagccaacatgacaaggaacttctgagggtggctgccagccaacagcagcaaggaactgagactataagttcaactgtctgagaggaactgaatcctgaaaacagtctcatgagcttggaagcaagtcttccccagttgagccataagatggctacagcccagctcacaccttgattgcagcctgcggagagaccccgcagtggaagatgcagttacacccttcccagctccctgacttacagaagctatgagataataaacagcgatgcggccagatcttttacattaccccacctctcaccacacggcctgcacatt

SEQ ID NO: 5101 - DNA, 740 bp, Homo sapiens
agcctagactacaagagaatgctgacgcatggctctctaggtatatcctctgtgtgtcctaggagtatacaaaggcctaccaagtggtttggaggatgctgttcaaattattaatggctacacaggctcatggaaatgcctacccttctgacccagccactagagggattgttgtaccatggagaagcagtcctcccccagtgctttgggagtagttctgctcagagcattgtctggaaagtattcatcttcttttatgaagaagtgatggaggcaggtaagagagctcactttcccagcacgtctcctgttgactgtgggctctgaggacgtctctggagtgtgtgtattcagctttctcattctctttgaaatctagctatttgcactccaaagaagttaggattctcaagactgtctaggctgaatgtagtttttaaaccaagtgttttctttactgttcagaagctttgtctttgagagcatatttgccaataaactgcctaggagaacttgtaatgataacctaaaatatcaccaactctgtacttaaattgccctgcttttaaaatgtgtttgttttggctgtattttgaagttgaaataatttaatatggcaagttgacactttgaagtgaaacatattttgagcaattggtttttttaaaaaacatgcaaatgtttcggtatctctagaattaattataagccttaatcaattgataataaatgatcggcca

SEQ ID NO: 5102 - DNA, 260 bp, Homo sapiens
ataatctaagaaatatttgcctaacaccaaagccatatgatgatatcttgaataccaagtcttgaaatcaataataaattccacttgctcaagacatatccaggatcaatactttattcttcaattcaatcaagttgacactgagtattaaccatcacagctgtattgcttgccagtttctgtcagattttacttcatctaattcatcatctgtcatcaggggaaggtgatgggagcagaagaattgaaggagtgcctat

SEQ ID NO: 5103 - DNA, 319 bp, Homo sapiens
tttcggccgcatcgaactttattttttggctgatctccttttgcagaagaggccaagttcctggtggtgtttgctagatgggggggagggaacttagttcacaatagcataactatgaacccatggtaattttttttaacctatagattggttttcgtataccaaaaggggataatcagtgcagatcgaaataaacattcatttcttatcactgtacatgtaataccacacttccacatgttgtcttccttaatctccttcatctttgatggaaaacctcttccttttaactactctccatcaagttttctgttgactc

SEQ ID NO: 5104 - DNA, 204 bp, Homo sapiens
agacggggtttcaccgtgttagccaggatggtgttgatctcctgacctcgtgatccacccgcctcagcctcccaaagtgttggcattacaggcatgagccaccgcgccgagccctatgtgccacattttctttatccagtctatcattgatggccatttgggttggttccaagtctttgctattgtgagtactgctacaataaa

SEQ ID NO: 5105 - DNA, 294 bp, Homo sapiens
  misc_feature (1)...(294): n = A,T,C or G
ttaccatctaagaacagcaagggggaaatctgccctcatgagctaattacctcccaccaggtcattccccctacattgggaattacgattcaacatgagatttgggtggggacacagagtcaaaccataccaaatcagcatctggatgatgggatcattcataccccaaaactcagcattatgagatatatccatgtaacaaactggcacatttacccctgtaaatgtaaaatacaagttaaaattattttcaaaataaataaatgaataaataaatctcgagtcnggccggag

SEQ ID NO: 5106 - DNA, 429 bp, Homo sapiens
  misc_feature (1)...(429): n = A,T,C or G
aagccctctctgccaacccatggctggtcacggaccaatcggctatcaccaggctttggggcgtctgccagggcctctgtgttttgatatactctgacctggcagtgaagctgctgatgaatgcacgacaaagaccagtttgctccgtaaccccaggctcccagcgtcttttccatgagccaaaggcctggtcctggaggggggtgccctgcagctctgctggccttcttccaggggagttcatcgctgggggtggccctgcangtgacctcctactgtgctggggaggggaagaagaaggatgcaacagggtgaggggagaatttgagaaaataggatgcaaattctccacttgtaaaagaaagctcgggtcgcccgaaacccctctccctcctctctcctcactctccgctcctctctctctaattc

SEQ ID NO: 5107 - DNA, 201 bp, Homo sapiens
tttggcaagttccaggttcctgtcttgtgaccaagaggaataagaaattactttgagcttcttgaaagaagaaaaaataacttgcaagcattcagttgcctgactcagtcatggattcacaattttgttaaattaaatgatttgattgtcaaattccacaaatttttaataaattaatattactggccaaaaaaaaaaaaa

SEQ ID NO: 5108 - DNA, 145 bp, Homo sapiens
caagaaaacgagagctcaagcaggatgaatttcaagatggcaatggcagaactcaaaattgcatttgcatacctcagaaatattgtggttcagttccaaaccacaacaataaagtgaatattgcaataaaacctgatcggcctga

SEQ ID NO: 5109 - DNA, 217 bp, Homo sapiens
aggaaaaatgggcaaagcgactctgcgaataaaacaacagagattccatggaataccggagctgagattctgcattctctcttcaagaactgctaagaatcatgaaaatcactccccctctgcaaaacctcctgagaaacctttccttagggagctatcctgatggttctcatgatatatcaatactgtgatcaggaataaaaaccgatgcgggccg

SEQ ID NO: 5110 - DNA, 171 bp, Homo sapiens
ctctacacacctggtttatcagccctgtggttcaaagagcatccgtttaaagccagtagacaagactgatgtcaagttattgctactgggaattctgtctttacatttactgttaaattcaaggataacatctaaggatacagatgaaaaataaaaatcgatcggccgaag

SEQ ID NO: 5111 - DNA, 266 bp, Homo sapiens
aatagaaaatgtgctgggctacagtgatggtgagaaggaagagtggaggcctcgtgtcattttgccattatggttcaggagaaaaatactgctgttgcatcaataagaagaccacaccagcacagacactttgtgggtggaggaaacaggttggaagagggcacatacacacacttgtggagaaactcttcattccaggcgtgtttgttttgaaaatgtcgcagtaccaggtcacagaattcatgaataaaccccgatgctggccg

SEQ ID NO: 5112 - DNA, 312 bp, Homo sapiens
aaacaaatgaaagcacagagacactcagagaaaagctgccatcagcaatacatatttcaagcggagagcaatggctaacctgcttctttcgggggcccaaaggaatgctgccattggaaggcacttgacgagatgatatgtgtcccagcattagtatcatcattcccaggtgaaagacgggagagagctgctctgtgtcacaaccctgttcttaatgctactcaataaatttctatctggctgaggtcaaagaacttgatacaatttacttagaatccaaactggaaataataaacagcgtatgcgtcctga

SEQ ID NO: 5113 - DNA, 522 bp, Homo sapiens
tcccacttgatggatcagctggcgccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaaacagtgctgactgctcactggggccatgcatatgaccgtgagataacgcagtgattttcaaccccagttgtgcaccagaatcacctgtggtttgtttttggttttgatttaattcagatttcctggccccactcttcatgtattctgattaaatggatctgggatgaggcccctaaaaaaaaaaaaaaaaaaa

SEQ ID NO: 5114 - DNA, 551 bp, Homo sapiens
tttcttgaatgcagatgaagtctcactcttgtcccgcaggctggagtgcaatggcgtgatctcagctcaccgcaacctccacctcctggctttaagcaatcctcctgcctcagcctcctgagtaactgggattacaggcacctgccaccatggctggctaattttttttggtttttttttttttgtatttttagtagagatggggtttcaccatgttggccaggctgatctcaaactcctgacctcaggtgatccacccgcttggcctcccaaagtgctgggattacagctgtgagccactgcacccggtgtccactgatgatattcttatggagagcctcggatgtgaactatcagcagttcacaacctgcttttgaagaaatgtgttctgaaagaggatctgggtgatccactctaagcatcctaaaacaatgaagaactacccagatgtgtctcccacttgtgtgtttgggggggtgttatgcaaacatctaatagtatcaattaatcctattacacaaaaacaaacatgaaaaaaaaaaaaaaaaaa

SEQ ID NO: 5115 - DNA, 262 bp, Homo sapiens
ctactcgggaggctgaggcaggagaatggcgtgaacccgggaggcggagcttgcagtgagcccagcttgctcactgcaagcttgcagattgcgccactgcacctccagtctgggcgacagaacgagactcagtctcaaaaaaaaatgttgttaccttttataatttagtcttttgaatctttgtcctttggaagccagtggtattagctgcactctacccataaatgttttggatatgaagcagaaaaaaaaaaaaaaaaaa

SEQ ID NO: 5116 - DNA, 777 bp, Homo sapiens
accgatgttatggtaacagtcagccaagcgtcccgggagcagccaaggccatgcctggagtaaacggctcacaataggccgccggaaatctttcctggccctaaaagaaagacacaaaggcggggccggggggttcatgcctggaatcccagccctttggagggccaaggagggtggttcagaagtcgggagttcaagcccagcgagcttttgtttcaaagaaaaaaaaaaaggaaaattctttttattcccaagactatgaggacaacatcttgtgggcaggaaaggcgcattccatcattgttttctacgtgggtgttaagatttctgtaatgaatacaactcaacatccagacactgtgactccctgtttaccagagtgggaaaacacttctcaaagatgcttcaagaaatttgaaaatgtttccattttatccagatgcagagagaataagaagcataagaccttccagtttaatatcattgcaagcaaatgtatgaatttttatggattgcataattgtctctcttgttcattgaatttcctatataggaaggagaaaggagcattcaaccaacacaatatgccatgatgcactatagataatgaagcctctattgtacaaaaaaccagaaacataagattctgaaaattttattttggataaaaatgttactaaagaaagatactgcctgagagtgtaagatgtcttgacacagcagatttgcaaataaaatattgtgtagtcatgctacattctaaaaaaaaaaaaaaaa

SEQ ID NO: 5117 - DNA, 837 bp, Homo sapiens
tcgcaccggaccgtcggccagagtctaggcacagatcacgagacggaacttggggataacactctgtcacccagactggagtgcagtggcaccatcatcatagctcactgcagccttgaactcctggactcaagtgattctcccgcctcagcctcctgaatagctgggactacaggcatgagacaccatacctggctaatgtttttattttttatagagacacgttctcactttgtttcacaggccagtctggaactcctggaaccaggagatcttactgccttagcctaccaaagtgctaggattccaggtgtgagcaactgtgctgatccagtataatccctttgagtgctgtacccctcttggtgagattttggatgacccaaggcaaaatcattaagggctcaagagttggttggctcatgatagggtcatctctattatcatctataatccattactctcggggacctcaatgaatcctatagcagtaaagataatggcccaagtgtgggcttggtttgccatgtagtaaaatggatatggtgcaccgtaaccacggcacgcgcacacgacgttttatagcgccaccggtttatgtttatttattttacactatagtcctctcagttattacccagaatagtatgcgaggtgggaatgggaccggctacacggcggccatccacaccgaggctgctgggattttcctgctcaaagctctcgtattctcagtctctctgcggcgttcctgcgggaccaatatacttttattcagcattgatcaaggcttatgtcatctcactcggacagagcgtgctgcccgccccaccgagc

SEQ ID NO: 5118 - DNA, 760 bp, Homo sapiens
gcagttttgtctacgagatttgaagcaatgaagcataggaaagacagatctgcaaagagccaaagatggcagaaagacttctggaacctggaaaaaataaactaaagtgttacaagtgattaacctaggaaggaaagaaatggagataaacttgtttttgatttactgtaattttctttattctccatattttccgtaacctgtattagttttataacctaaaaaagtaaattaaattttggttactgcataactttatacttataatactgtacacttaaaacaaaatttccatttttagggaatatagtgactatgaacaatcatgccagggaacattgtgcagtcattaaaaataatgtctatgaagtgtttgggtatgacactgaaaaatgtcataagataatatcaaataacaaagccagggttcaaaactttatctactatttgatatccactgtatcaaaatgtatagaaaatacaaaaaggaattattacactgttataactgtcatttaattttcactagattgtgaggtgatgaaattttcttgttatttatatcttatgtacattctgtactgcatttttgcaatcaggcaaaggtaaacttaatacaatgggaaggcaaacacttaggtactcttaggtctgaaatgcctacatcccgaggttgtacttattacaggcctaggaataattaggtctatctaaaaattaggactaattcaccgatttaaatagatcacttttttatatg

SEQ ID NO: 5119 - DNA, 791 bp, Homo sapiens
ctgaacccaaatcctagtacattctttgtgatgtggagaggctgctgccctgggattgcctgggcaccatctttcctggcacccaccctctataccagcctttcttctcctcctcagtcaccaggaaactgacttcttttgcaaagcagcagtgatgaaaactttccaagtttcagcgggtagaagatatccagctttgaccctcaaagtaaacagagcctcagaaattccatggagtaggcagggaccaggagcagagctcttcaaactttttgaattcacaacactcttactttaagttttctggttaactaaatatatagtagtacagcaaaaattaatattggtacagaaccaataagccagatattcagaaagagtctgaaaaagcagtaattaaacattgagaataggagttgtgggacacatagtaaaatcttcctctctacttattatggtcctcgtgtaggccaaaacgtgataaactgagtggatatttcatctgtcagtgcaatttgctttctggagtggttcttggttatacttgagtataaatatactcgccacaggatgaagatgaccattataatttggaaaacagaagaagagaaaggaattgcttccgaaataccttcatagaatcttaaaatcaagagagccacaaaggcaccctaagctaatatttctttccaaagggcccgtggaactaacatatggttacaaagacctcttcagcctcctgaaaatatatttagaaggactctaattttggccttaatatggggactgtt

SEQ ID NO: 5120 - DNA, 832 bp, Homo sapiens
caaccaaagattgaactactcacccttggggccggcgtcgcctcagagcaacgatcaattacagtagactgacataaaaagagaggcaaattgacatcatggaaagatactaactttggagtctgtcatattcactttcaaatctgtgaaaggaaaataccttgggcccccaaaatcactcaggaaaactcaagctggaaactgcttagggcaaacttgcctcccattctattcaaagtcactcttctgctcaataagatagatgcatatctgatttgcttcctttggaaaggctactcagaaactcaaaagtatgtaaccctttgtgtttcacctgtttgtgacctgaaagctccctccccacttcctgtcttcttgcttttgcttcatgttgtcccacctttccagactgaaccactgtacttcttacatacattgattgatatctcatgtctccctaaaatgtatgagaccacactgtgccctgaccacctttggcacatgttgtcaggacctcctgaggctgtgtaatgggcgtgtcctcgggcttggcaaaataaccttcctaaattaactgcagcccgtctcacattttcatgggttacattttgggaacccacggggaagggggaattttgaatggagatgcccctgacctttgacacatctcctatccgtggcttggtaccagcatgaacccacttttttggctccaaataaataggacaatttgctgaaggctcgagacaacccccctccagagagtgcccgatctccaaaacttttgttgagaatctaaattatatttttgctgaccactattttttttttt

SEQ ID NO: 5121 - DNA, 593 bp, Homo sapiens
acagcacagattccaatcgggaacgcgaaaaaaaaagagcttagaggtgaccctactcctcattatgcaagcatcactctttccaggaatacatctatacgtctgcacgagcatagaaaacatctgctgtgaagacacacttgaactgtaaacagtggttaccctttgaggctgggaatgacaaggagaagaaagcactgacggcaacgtttgaaagtggaatttccttagaatgtggaagcataatgataaacataagcgacttgttttactgggtcatctcatgaacaaatcgctctctgtaagtgcttgctgggaagatgagcaaataagaggaaggatggacacgggtggaactttctgattaattcctagccgtttgcctgcatgcagggcatgagctgccacttgagttctaaaactggttttgaattctgatttgaacctgattctgacttgagatttgatgatgaacctatggtagggtgtaagtttgaaggtgtttttttttttttttttttactataagggtaaaaaaaatcatcagagtgcttcatcaataaattaaacttgttccctcaaaaaaaaaaaaa

SEQ ID NO: 5122 - DNA, 338 bp, Homo sapiens
gtcacatgcagacgagcagcactacctaggagaaacacgaagccgggtttcacagcagccatcctaaccaactaattctgtgatgattgagagactgtgagtgacccgattggccagacccttactgaacccaactgacaactgtgtcctgattaaaggggaatgaaatttgttctcacaatcccatatagacctataaacttgtcctgacctgtcaagagtgccagttttcaaactgccattagcaaaccgctgtgaaaccacccacaaaagccttacattttaggcttttcattttatgtttactatgaaacattaaacaatgcatgaatataaaa

SEQ ID NO: 5123 - DNA, 883 bp, Homo sapiens
taatgaccaatcaacacctcatcgacccactacctccaacacatctcgaaaaagttcagggtagtgcgtgcaaatggatatggcagctacaaagatgtcaaagaaaatgcaactatcgtcattcatggaattgtatctccccttgaaggatacacatattctattttgctaatcaccatcaaagaaactgaaacaactgaatgcttgactctgatatctcagcatcctttacagcaatagtgcaagggggtgagggagggaggcagtgaagtcccatgaaaaaaaccaatttccatagagtattcaatttgccaaaacgatggctcagagaaagctaaataagttgattactgtatctggtatggacttatggagtgtttcttgattttggaatgccatgcctagatttgaaaatgagctcggagattctagcccccgaaaggaaaataggtagggaccttccttcccattacctcagtggccacagtcactgtgccctgggaagcccctggttctgcttacctcaagcataaaccaggaaccccttcttgaattcaagatttcaagggcattactcaccaacccatcacaattgggcatgcaatattgaataatatttctcccccccaaaggggagacccaactcccccaccttcttacggaagaaaacccctttttacctcccactctttaaaattcttaaaaaaccccctcctgcccaataatttgcaacccggcttttctggagaaaatatgggttttggggaacaacatttctatccttccgagttgtcactcgatggcagcacctcccccaacattctttgcaaacccacaccccaaaaggaataaacaacgaaacggccccccacttttgcctcgg

SEQ ID NO: 5124 - DNA, 204 bp, Homo sapiens
ctggaaaacgaccttcaacaaacagccagtatgcctttgacagagtgatacacagagtcttacttcacctaccagcagaagagatcaatgctctagtgcgtgcagacagaacacaattggcttatccgacttgttaagtattgaaatcctccatgaattttcaaggaaattaagaactgaattctgtcctcaaaaaaaaaaaaa

SEQ ID NO: 5125 - DNA, 298 bp, Homo sapiens
aggagctgcaagactcgctgagcacgtctgcaaactgggaaacctgctttgatgaacgcgatgcttcttacctgggaggacaggcagatactttgcaaggcaccagccccgtgacaggtcgtgtcttgggattgcagaaggacatatttacttgaaacttcaggtctctgtagcagccctctctcacggtcatctgtcctgtaggcaaggatgaaatgtagaataaagactcacatgcatgccccacagtaaaaggcagatgatgagctaataaaatctctttcaaagaatcttaaaa

SEQ ID NO: 5126 - DNA, 785 bp, Homo sapiens
  misc_feature (1)...(785): n = A,T,C or G
ctggatcttgctcttttaactcatgctgcagtgccgtggcaatgatcatgactcaccacagccctgacctcctgggctgaagcgaacctcctgccttagcctctggagtacctgggaccaaggttggttgtgatttatgaataccattcaagaggtcactatcgatcttcaagatacatcaattctaagtagacaaccttccacctttgaagaacaaaacttttactgtttcataaacacattagacaagaatgtggttcgatcaacagggcataggattcatgaaatcaacatttattcatatggtatcacctggggcagcaggaatgcttctggttctgattaaaaccaccgcaacaacttgtggatctaaggactttgttcttaaattaacttaaatatatcatggaattacaaaatgtattgaacttccctacacaaggcttcaatggcatggcattcgaataagaagatgagttgatcttaataaaatggataatccaaggagtgcccaaacccagccttttggcatctcaaatcgcaattttaaccctgtaattataagtgtacaatgagatcttaatgttccttgatttggaataaggttntaggtagttntggttggttggtttttggtgtttgagacggagtcttactctgtcgcccagcctggagtgcaatggcatgatctcagcccaccggaacctccaccttccaggntcaaggcaatnttcctgcctcaccactctcccgaatagccgggatttactgatgtgtgccccacc

SEQ ID NO: 5127 - DNA, 778 bp, Homo sapiens
  misc_feature (1)...(778): n = A,T,C or G
cctggagactctcctctcccaccttctcacttttaaagaggaggcccaggaccgagttgtaactgagcactggaacctaacatgtaactgtaacatacaactgtacctggaccctaacatgaatacacagcacttgtttagatgctgtgtgatgaagaattaactataaggaggatggtaatttggaattctgtatttgagctcagcttgaattcgaacaagtcacatggaagtcatagatactctctggcataaaattttatataaaataacctatcttctaaaagatttcatccattaaaaattttgaataaaaatttaaaaaaaaaaaatagaaggaaaattaggactaaaagccatgaaaaaacaatctctcatattggatcgaactataaggttaatgcagaattatccgtgcgttccttcttctcagcgcggggcttccctcttattgnttgattgtttgtgggtgcggctctattcagcccctctccatccctgagcttgtttttcttattagcctctcgtccaggtattatatttagtaccgggcctcaggccgccgacgcctgtcagtctgcggtgaactaggtggcttttatcctttaactagggcccccaggtgggaggtaggagtggaggccacacaattaaactggttcgtcgtgattctattttcgtggcaaagagggaggttttgggtagagttttcggagacattgatctgaatcttcattttatctattggatcctgctaggtgtgaatttggggtgtagt

SEQ ID NO: 5128 - DNA, 594 bp, Homo sapiens
tggtgatgagtctatgaagcaaggtgttctctttatacaactatctggacccccggtacatttgaaggctgaatgcctttgttgtggggaagagctgctccgacagagaaatggctttccttgagaaaatggctcactgctgaagaagtctccattatgaagaggcttcttcctaaattaatgatttgcttcagtgcaggctgatcacagaaaataatataaggtacagatcaaagactccaaatattagaacatgggctatggaagatccatctccaagcttcccaactttcttttccagagattaaggaacaagataggagaccatgcctatgactcgtcccactgattgtcaagtagaaacagtggaggaattggaagttagtttagctgaaaagaaaactaaaaggaaaattaaaaaatttacaaagtatcacttatgaaaatgctctttaagagaagattgaaaattagaccatttccactcaatatcaccaaaactagacaagaccccttcatgaagtcctagagtcatctctataaattatgatgcataataaatatagttaacaaggaaaaaaaaaaaaaacggcc

SEQ ID NO: 5129 - DNA, 675 bp, Homo sapiens
gtagacagagtcccatttttgtcacccaggatggagttcaataacatgatctcagctcactacaacctccacctccgaggctcaaccgattcttgtgcctcaccctcccgagtagctgggattacaggcctgcactatcacactcagataacttttgtatttttagtagagacagggtttcaccatgttgcccaggctggtctcaaactcctgacctcaagtgatcagcccacctcaacctccctatatgttgggattacaggcgtgaaccaccatgcctggcctctaattctaccttattgcaaattgttactaatatgttctagagcaatttattaaagtctatattttccaattgatgtgagatgctacttttatcaaatacatttctgtatgtagtttgatctacttctggacattatattctctctcattggtctatttgtctattaatatgccacactgttttagttataaaaatttcataagttttaatgtctgttaaggctagcttcaccacttaattttcttcaatgatttcctacctattttgcatgtttgcttttgtgcatgaattctattgaggttgaataactccataaaacagcttgttccttatccaagaatataaaagttttgtcatttaaaaaaaaaaaatcggcctccgtggcctca

SEQ ID NO: 5130 - DNA, 342 bp, Homo sapiens
ctgaaaagaagctttcctgccgctggcatgtggcctgtgatgaagactactaggcccattgtcgtttgtgcctatgcacagcctgagtccaaggcacccttccaaggagagcctcctggtggacgacaagaccttgagccttccagcaaatgaaagaatggctgccattgtccaggtgatgcacggggcactgctgacctgggtttctcataaggagaactctggtctctgatattgtgagccggtaaaaaagatttcagtgttctgtgtgcaaaaatggttatcacttctgttggtgttaaaataagtaaataaataaataaaataaaaaaaagaacaaaa

SEQ ID NO: 5131 - DNA, 792 bp, Homo sapiens
cagatctgatattccccagtcacttcctatcccaggactcttctagtgatgaagattatgaaaattcagactctccctgccataagtaaaactggctggtattttatcttcaaagagaaagccttaagagaggcattcaagaaaatcctctttaggaaaaggagatggggatgtttttggtgaaagcaaggtacttctccagcagcaaaaatgggagctgcccgaccaccttattctgctgttgagatgacagcatcatctctgttatctgccagcaccactcatccaggttacgggcagagtggactgcacctgagaacaatgcacacctaaagaggcggggcctgccttctgcttacaatggctccctgggcaggtagttgggattgtggccaccctcatccctttcccgctagaacacagaaagcatggataaaaaaagacaatcaagacacgtcccagaaaacacagagtagctagcaggctgctggaggctcagctcagggaggcggtcagagaaaacagtggaagcccaagtgaaaccaggatttccatgcaaggctgcctgttaaaaaccacctggccagcatcaaaaccaaaccaaacaagaacaaaactaacgtgaagcctgggctccactccagaccaattaaaagagaattttccggaagtaggacatgggcctaaggagctttttgcaaataaattccataagtgattcttaatgtggggctggaactgcttgggtgagtggcatataaatggcctagagccagaatacttgggtttggt

SEQ ID NO: 5132 - DNA, 801 bp, Homo sapiens
  misc_feature (1)...(801): n = A,T,C or G
cagaaacattcaaaaatgaaaaacatcaaaaataacaagatgtgacagaagccacttaggcagcaaacataaatgttgcagtgatataagaagctagccttctagctgaaaaacgagtattccccaatggactccagaagaaacttgattcatcgctgcaaaggaaagaacaaccttaaaacttttaacagataaaacttacagaaaactatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgagttccaacagccaaagccattgagagtataggagttttccataaccttctcttctatgacccancaacaagctcatgactgaaattcaccaaatttctgagacaatggcttaatattctatgtgctatgtcccagaaaatctttagatgaatgtttcttaggattggaggaaattttctggtaattt

SEQ ID NO: 5133 - DNA, 853 bp, Homo sapiens
agggctgcagtcagataacaattggtggatggcaaccaaagacatggtgactttctttcagcaaatgcattctcccaaaaggtcgaaaagctaatatgtttgagaaccatctatttaaagaacagcaagtttggaccaacaataaagaccaacggtgaaagcaggcagccccagaataactagaaaatgccaaaaggaggaccttttactcacaaatatcaaaccatttgacagacactttcaacactagatttgcgttttttaaataactttttttaggccttaagacttatccataacaactcaaggatttcctacagaaggacataaccagggctgtcattcaaccacgactcacaggctagtgacatcagctggcaatacatctttcagctttgctggggacattataattgccagaagttcatgaaatagcagttgttaaatattttgaatatctctcctaagcctataaatcctggagaaataggtataccttatcaaaaagatattgttaatccaaagtgatacatggtataaaaaagtattcacatttggctttgaagtgtatttttgtactaacatttgaatgtgtgtctgatgttctgagaaattacttcaaagagattaatgaagccatacagtgaagacctgactcaggaaagctgggaaattgtccagctttttcttcattctgttaccctgccgaactcctctttgacacccactctctgacaccaacaagggatagctaaaatatcttttagaaataatgtcaatccttccttatagaatggaagatggcagtttgaatactacagaccttttttgttacagcaggccatgcagattt

SEQ ID NO: 5134 - DNA, 508 bp, Homo sapiens
agagatggcgtctctctgtctccaggctggaatgcagtggcaccatcacagctcactgcatctttcaactcctgagcttcaagggatcctcctgcctcagcctcccaagtaactggagtcacaggcatgggccaccacaccgcgcccagcctgtcttttcattcttaacagtgtctctggcacagcagacatgtttcactttaatgaggtccatcttgtccattttttcttcagtagatggtgtttttgtgttgcatctagaaactcattgccaaacccaaggtcacctagattttctcctatgttattaaacttacagaagtttgctagttttgtgttacatttaggtctatggtctgttttgtgttaattgttgggaaaggtgtaaggtcagtgtttatattcattattccacatgtggatgtctagttgtttccagcactatttattgtcaagacaatcttttctccattaaattgcgttcgctcctctgccaaaaaaaaaaaaa

SEQ ID NO: 5135 - DNA, 803 bp, Homo sapiens
gctaggaaaaaccatctctgatcaaacacatttacaacagagaagtgtccatgaagcctgagagagcaaacataagagagaccagttggagaagatgctgaaatacttggctttcataatggttttcttcttagtcaaggtctgctgagtgaaaaatactgtgaggccattcatgggcatggtcactgacaaaggatacatgtggctgtggaaacctgacccctgcataatctgtgctcaaaacgctttaaaattcaaaatgtaatgttggaagaaatttccactcttcatagcatgccaaattttgacatttttctcccggacatttcttattttctattatcaaaaaggacaggatttcttctgaaaaagagaagagagagaagatacacagaatatcagttttaaagtgttatttttgttctttaaaaagcttgtcattgactttaaaagaaagcttttttccttcacagatttattttgatagaattacctgagccttgcaaaggacaacaaaatttttgtgagcttaccatacgcaggaattgccaaattatatgctgcggaacaaaccgactaactctcgaaacagccccatctactcacccccctgcacccgcccctctcgcagctcgtcccagggcgcgcgcgcgtcgaccggggccagcgcacggcgcccccgcgcccttccaaaggcgcgacgatacaacccagccaccaaccactacaccgagaccacgcccagagtgcaagccaaccccacccaccattgggctgccagcgcgcccgtactacgataccca

SEQ ID NO: 5136 - DNA, 777 bp, Homo sapiens
  misc_feature (1)...(777): n = A,T,C or G
gtagactgagtctactctgtcccaggctggaatgcagtggcgtgatctccgctcactgcaccctctgcctcccaggttcaagtgattctcctgcctcagcctcccgagtagctgggactacaggtaagacttcaagtttctacagaacctgcacctgaccgattacttctgaaagtctctgcttaaactttttaatactgtgggttactggtacagaccatttctctttttgctttccaagatttaatgcacatgtttggcagtggctgtgctattttggatgcaattttggacactgaagagaagaaactgaaaccagaacttacagatttttttttaatgcctaaagttctccagtcatttctgaaataatacctttaaatctttctatttcttaaaatcattatttccttgtggtaccaattctacgttccctgtatgataactagataataattgtaccacatacaggtgaattcaataaatttggaataagtggttgactttagtactaggaaagttaaaaacaaatctcaagacttgtttctaatttaggaaaattctataggaatttgtctaaagagggctaaaaacanacaaaaaagcataaacatccataatatgcaaaatgtggtttacttacttgatagagggctatcatattgtaagntaactttggttatttgttttttttaagttaagaagacttaaagaatgtttaagcaaacactaaagcactcggtaatctcatttttttatcctcaaaaaaaagttttt

SEQ ID NO: 5137 - DNA, 228 bp, Homo sapiens
ctggtttgtctagatgacatggttgtggatgtgtggcattatttctgagggctctgttctgttccactggtctgtatctctgaagaattgaaaatgcaagatgggaaacagaacttagaggaagaatcctacaaagcaacttcaataagggaaacataaatttgcaaatgctattttatttaagttatcatatgataataaatgaaaactattgctaaaaaaacaaaa

SEQ ID NO: 5138 - DNA, 514 bp, Homo sapiens
cgcgaacagtctcatgaactgcgtctgcccttcagaagataactgaaacacacgtgagagccacacccagcccagaatggcagaagaaaaaagtcctaaaggagccaagactttaaaatgatgacagattttatctgaaagattcttccgggagcaatttatagttctgtgaagtgtcaatgacagcagcttctacagggagatatggattcttcttcagcttcatagcctttggcaccttgtggaaaggtgtgactcagaggcatcttgtacagaaattaaggtgcaggaagatttcaataaaaacaaacggggcagtcagttttaaaatattttaaatattgttctaagtcatttttaaagaataataataggcagtaaactgtgttgtgctgctctaattgcagtaaaaattcagagaaaagggtacaatgtgagctaaaagagctgggtatatagcagatgcctagtaaatatttgttggaggaacaataaacaaatacacgaatgaaaa

SEQ ID NO: 5139 - DNA, 598 bp, Homo sapiens
agctcatcagggcctgagaagaacttcctgacccatcaactggatcctggatgtgcagctgagcctctttcaaaactgctgtcaccatggactcctgcgcagaccaaacatcccttttgtgtggaatttcaatccccacgacaacagtactgtccagagacagacatcccatcatgatggagcaaaccaaggctcaagaaccaaactaaagccatcggtaatgtagagccagacgttatacttaaacaacaaatatgctttctctggaattacaggtgtgggtcttcacctcacacaacccctacggaatcacaagaggaaaataccactatttctcagtcaggcggaggactaagaattcaaggtgaacacctcttgctaatggctctttttagtgaaaccactactgagagctgacggaacacacacatttggcaaacagatggagggagggaacgggcatctccctttgtgaattcaataccagttgattcattaggcagaactgccaacacagaaaataaatacagcctctggttacaaaagtataactgctgcttaccaaacaacagaaataaaaaaaacaggcaatgcaaaa

SEQ ID NO: 5140 - DNA, 707 bp, Homo sapiens
cctgggtctctctctatcacccatattggagtgcagtggtgcaatcacagctcccttcagcctccaactcctggactcaagcgatcctaccacctcagcctcctgagtatttggggctacaggcatgatacactgtgcctggctctcaaccaaaagttcaagattattaagcattgttttacaaggtgtttggatctatccccaggcacaatcactacaaggtctataacaataatggatatcggatatcatcttcttgtgggaatcagtcatcgctgacttgagaactgggagccgctgagcctaaagcttccagttatcagtgcatgatggatgcagggatgtattttattcacttagaacaattcctagcattgaggcaccgcatattaaatgtttgtgaaatgaaaagaaagtttgaggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattaggccgggcgtagtggcgggcgcctgtagtcccagctacttgggaggctgaggcaggagaatggcgtgaacccaggaggcggagcttgcagtgagccgagatcccggcactgcactccagcctgggcgacagagcgaaactccgtctcaaaa

SEQ ID NO: 5141 - DNA, 340 bp, Homo sapiens
  misc_feature (1)...(340): n = A,T,C or G
ctaganngggatcgctcatgggctcccagnngcgacagcgtgaagagacacaacaaacgaaatctcattgtaggagaaacattaacaaaggtaaccagaactaaagcttcatacccaaaacaatttcaaactaatatagtgggatgaagaagacttctatgcatccttagccaagtaatgaagagaatcgatgtaaacatgatacaatatgaaggaaagtgtctagcctttggaagatgacggacctggatttaaatctcagctatgtggaactgcatgcattccataacttctcggagcttcagttttctaacatattaaatgtgtataaatgttaaaa

SEQ ID NO: 5142 - DNA, 504 bp, Homo sapiens
agggaatgttcattggggctcccagtgcgaacagcgtgaagagacacaacaaacgaaatctcattgtaggagaaacattaacaaaggtgaggaatgtcctttggaaaataaaatttttgaaggatcctagacacaacacagggtacaaccagtaaccagaactaaagcttcatacccaaaacaatttcaaactaatatagtgggatgaagaagtctcctaagcatccttagccaagtaatgaagagaatcgatgtaaacatgatacaatatgaaggaaagtgtctagcctttggaagatgacggacctggatttaaatctcagctatgtgaaactgcatgcattccataacttctcggagcttcagttttctaacatattaaatgtgtataaatgttctcttgtcttttttcctttaatttataaggatttgggggataaacgatgcaaatgggctgaatgtaggataaaatattcagtaaatcataattactgtgattagaaa

SEQ ID NO: 5143 - DNA, 596 bp, Homo sapiens
  misc_feature (1)...(596): n = A,T,C or G
cctgggcgagnnaaagcaanatattcctgggngaaaacagtgaanaaatcagccaggatggatataaagacatcaaaatgactttgagatctataaaaaaagatgccaaaatttgtatattctaccgatatccaggtaacacagtccatttgtttgcacaatgtttattttttctttactccttgctaattcttcatttcatctaaagctacatgaacactttgacttttcctactctttaccaactaattcatatggcttcactttaaaacaaaaataagagaatttcatggattagatatttatggcattgctcttaattttgagtttcagtttttaaattacagaagaatgtcagagctagtgatttttggaaagaggtattgatacaattatacaggaattattctgctaacataagtagaataatctggtatgttcttttctctaaagatactctgattgatatgagaatgccatagagtattgacaaagagaaaaaaagtttctgccaaattttcaagctatttaaacatgagttctgtttcataattttgcctacaatctcttccaataaaaatgttattgtctcaaaa

SEQ ID NO: 5144 - DNA, 602 bp, Homo sapiens
aggaaatgaagaatattccatgtgggaagaacagtgaagaaatcagccaggatggatataaagacatcaaaatgactttgagatctataaaaaatagatgccgaaatttgtatattctaccgatatccaggtaacacagcccatttgtttgcacaatgtttattttttctttactccttgctaattcttcatttcatctaaagctacatgaacactttgacttttcctactctttaccaactaattcatatggcttcactttaaaacaaaaataagagaatttcatggattagatatttatggcactgctcttaattttgagttccagtttttaaattacagaagaatgtcagagctagtgatttttggaaagaggtattgatacaattatacaggaattattctgctagcataagtagaataatctggtatgttctattctctaaagatactctgattgatatgagaatgccatagagtattgacaaagagaaaaaaagtttctgccaaattttcaagctatctaaacatgagttctgtttcataattttgcctacaatctcttccaataaaaatgttatttgctcagaaaaaaaaaaaaa

SEQ ID NO: 5145 - DNA, 796 bp, Homo sapiens
gaaacctggacattgacatgtgggagaccagccattatggtgaaggaaaagagaccacaagaaagagacctaaagatctctctaaccatcagcaaaccccaagaagcagagctgtctagctgattctcagctaatcacaatgcttgaggaaccccagccaaatcagaacttcttaactgatcataacctaaattgccaaccaaaatatgagctaaatatgtggttactattttaactcatttatgcctgaggttgcaattttttttactttttgcaatcagactttggtaatgactttgagcagtaggatataaataactcccacatgcttagtgttccaataatggaaaaccaggcataaatggggttaaccatttatgcctagtgtcattattggtgacctcatttatgcctagtgttccattattaggacactaagcatgctaagctttagggttgtttcttatggataagttaggtaatttgaccaagtatacaagtaattgcggatgagagtgttagttgcctataccaatatctataaagagtttacactgtgatgacaaacctcttattcttagtaggtagcttaccactaaaaatacaagctgtttcccaggctccatcgaataaagaaattaaccatttaactaagttctcataaataaaacattgcgacaaagattcgtacgagattactttgatcgctatttttaaaaaaaaaataaaccttgggctcgtttggcgttaagtagtagtcgttttgcagccagtcctcctcaaatggagcttaaac

SEQ ID NO: 5146 - DNA, 774 bp, Homo sapiens
aggcactgcattgcctcacagctaaattcccactggattgttggtctgaatcaccgattgaaaaatcaaatgtcttcagggacccggcaggatcccgaaggacgccgctctaagccagagggagcggtgtgtgttgtggctgaagtggaaaatacaagcccagtttaagggcattcaaacatgaattgttttttttaaagccgtgcgagtcaaacaaaacatgtcagcagttcttattaggctaacaggttgctggtttgtgacccttggaccgatcctcaaccaggttgggcaagggaaacgatgatatgctgagaatggaaaccagaccgcccattggtctccccctccggccccggttcacttctttgggaacatcttagatggctgcatggagaaacacggacctttggcctgtttttttcctccgagctctgccacctagtcttggtatgacttcaagcaaatagactaacctctatgagcttccgatttttcatcctttaaaactgagatttacttatctcacatttattggtccatggtgtgcgtcaggagctgcactggtcttggcttatctcaggaaatggcacctccaatactttcacttgctcagagaaaaacctttagtgggctccttgattcttctcttggtattacgcctatgaccaatctgtcagcacaccctgctgtctccgtatgcagtaagcataccggatcctgaacaattcttactttccatcactaatgaaaccgtgccccaaagagtaataa

SEQ ID NO: 5147 - DNA, 500 bp, Homo sapiens
cctggcaattggtttccaaacacattaaacaaaggcaatttagaaagcttcttcttcttcctggcatcattaacattgttgaacgtcctgggattctgcagtgtttcacaaagatattgtaatctaaatcattttaatgcccagaacatccgtggaagtaatcttgaagaaacacttctcctccacgaaaaatctctgaaattttatggcagtatacaggaattttcttcaagtattgatctttgggagacagccctatgaaactgtgtttgagtctacctgtcttatgagaacagtattcattgttttcttcttcagttgagcattttatgtgttttagtgtaaaagccaatatatacagaggtgattttacaaatatcatctgtatactttatttacaaagactaattatgaattttctagtaaactgtcatgcttttgcattaacatgttatagcattagaattaataaaataatttcaaagtcaaaaaaaaaaaaa

SEQ ID NO: 5148 - DNA, 770 bp, Homo sapiens
cctggctgtaccgtggggcccagctccacagtcataggcctgggtgatgaatgtgtactccttctgcaactcacagtcaatggggctcttggcacggagccggccctctcctgatgtcttgttgagcaccacagcctcaaagggcagctcctggccatggatcttgaacgcacagatttcccctgcagaaggatggaaaacagtgagtgggaatcctgagaattgccagactgaagacagtgcttccattggaccagattcacaaactcaaagcctccatgcaatttcttccacgcacatagtgtggtccatgagccagcagcatcagcattgcctgggagcttcttaaaaatacagaatcccaggccccacccagacctcctgaactggatctgcattttaacaggatcctcaagtgatgtgtgtgctcactaacgtatgagcagcactgctttcctctttcctttactcctggtttaatcactgcctaaattgctgaagctaaattccctctacctcccccacttctccattttctgtctccagctaccatttccccttccaagttgcagttttctcttttgaaacagtgggcgtgagtctatgtgagttccagaggttcagagcccctgtggagcctgtaaagcttacatcttaaaacagctgaacatgttgcgaaattaatgcattcctctccttcagctgcgttaatggttattataactatctctatgcattaaaattataatgccatgataaaaaaaaaaaaa

SEQ ID NO: 5149 - DNA, 789 bp, Homo sapiens
cctagaccttaacttcatggaatggtgatcattaaactactccaatcagtaaattactttccccatctctagtctccacttctgtggccccatcacatactagaaaatagagggagtgtattggattttacaggccacaaatattcaagcagaagtagttgagaaccatctcaagccacatgatgacagtaatgctaccttggtgaagaataaagaaattgagatgaaacaaacatttcttcagtaatgtagattattctgaacttacagtggggttacatcagataaacccatcataaattgaaaatatcattaagtcaagaatgcatttaatacacctaacctagcaaatataacttaacctaacttaccttaaatgtgctcagcacacttacattggcctacagttaggcaaaattatctagcaacacagtacgctgtagaatattgttttttcaccctttggattacttatctgactgggagctacagctcactgacgttgcccagcagcacatgagagtatcatgctggcaacacagtacactgtagaaaattgttttttcacccttgggattgcttagctgactgggagctacaggtcactgatgttgcccatcagcatgagagagtataatggctgcatatttgcttgccctggaaaaaatcaaaaatcaattttcaaaattggaaggttaagtttctactttcacaccatttggaagttggaaaatggaccattggaccataggaaatcagggatcattttgtctatggattgggaactgg

SEQ ID NO: 5150 - DNA, 535 bp, Homo sapiens
agattatcctgctgttgcccagaacggagcgcagtggcatgatcttggctcactgcaatcaccacctcccgagttcaattaattctcctgcatcaggctcctgagtagctcccatggcagacatccagctgatcacactgtgtccacataaggcaaatgctgagctgtaatccatcaagctgtttccaaatcaccagatctactccttggatgataaagcaatgcaaattgcagaaattagaggtgaaatcaaatggttgaaaggaaccctgctttgatcactttttggctaaattggagaattcattaagtgtttagatctcagttaatgtgtaggaaaaaatgtctttcttttaggtttgcagagtagcttagacatataatgtttaaatctgtgtataattctagccacaaaacctgtgatcagaaaatatatttcctttttcttctttattgataacaaaaggaatgaagaaattataggtctttagagatatcagtgtctttggatcatgtgatctgatggaaaaaagaa

SEQ ID NO: 5151 - DNA, 1139 bp, Homo sapiens
ttagggttagtgcctggaactattgcgacatttttccacttggctgcacaactctttcagttaggcatcccctcagaactttcagcacatggtggggcactgtgctctgtacataatatccagcgcctgccgtcaggaagctcacggtgcagtggggagatggaccttggaagagaccacgagaggaggctatgccgaggcctgagcagaggagtggacgttctgtgctggatgcctctgctcggactttgcctccctctatggctgagcggactcattcaggcagtgtgctttggtgcagtggtaccatttccccagtgctatcctggccccagccacctcatctcccattggagtgatggcagcaactgccctctggcctccctgttgccattctgtcctttgatatacattgtccacacagcacagagtgaccttttaaaacatccatcagggttatatcactcccccacttgaaaaactgcccttggccttctgttaacagtaaaatacaatcctgactccatactgcagccttcaaggctcctggtgacccagcccactcctgtcacccccattcggcttgctgtctgcagccacatgggtcttctttctccccctcagacctgctcctcacttgggccttctccttgctgtttccccatcccttttatcttccaagggtaccttcttgactaccctttttagaataatatcctcatcacctcccaccactttatcccataatcctgttttattttctgtacagcttttatctctctgtacaagctatgcagaaaatatttattcattatatgtatctcacactagagtgtaaactccatgaggacagggaccttatttgttttgttaaatggctgcattcccttagcatagtgcttggcatgtaatagacactagaaaaaaaaaaagaaaaaaactcttggctaaatgaatatcgaaagagtgcccatctagtgtgtccctgggacccagtgctaccctactgtctgaagtcattagtgaaaaaaattatcccttttatacttagagctgtgtccaaggaatacggtattgttcctaaatatcatgcatgagcagaaagaatgaatagcagtaataaaaatggtaaactctta

SEQ ID NO: 5152 - DNA, 315 bp, Homo sapiens
agggtccacctgactgagatctagtcaatggaatgtgagctgaaattacttctaggcttaaaccatattaaatgttttatattttttcccattcctctcctgcatgtcctcttgctccccacttccttccccacctctgttcagttgaattaaagatgacactcaagaaagcattgggagccagaatttgaagacgaagaacacctatcagcctgctggcttcaagagacttgtggatttatttattcattcagtgcttctattacaaatacattttaataaattttatttttaaaatagtcaaaaaaaaaaaaa

SEQ ID NO: 5153 - DNA, 482 bp, Homo sapiens
tgaccgagtctcgctctgtcgcccaggctggagtgcagtggtgtgatctcagctcactgcaagctctgcctcccaggttcaagcaattcccctgcctcagccaccctagaagctgggagtacaggcactcaccaccatgcccagctaatttttttgtatttttattagagacggggtttcaccatgagttagccaggatggtctcaatctcctgacctcgtgatctacctgcctcagcctcccaaagtgccgggattacaggtgtgagccaccacgcctggccttatttttgtatttctaaattgaatacatacatctctagtattgtggggctaattctaccttgcatggaatttgcagccatcctgtaaatttctgactataagttttcccatcatttctcttgactcaactattctattttaggaacaatttatatatcatgtttcagatgtatgcaaataaagaaagtggagctgaaa

SEQ ID NO: 5154 - DNA, 1194 bp, Homo sapiens
gtcttgtaaaaccactgctgaagatttgaaatattattctgacttgaataacttgccactccaagtgaagctgttttcttcgctagacttgccacagtttggaagggaagctgtccttcagcaatgataaatgacacagcaattgtttctgcaagtccaggatgatgaatagatcttgcttcatccaaagctttatttccaaaagctttgacacaaagagagaccaatttcattattgctacattctagaagaagaaacaaaaccatttgccagcatgcttaatatgatgaatttctaagctgaaagcactatccttgtaatctttttgatgtctcttaatatatctatccattttccttacaaagaccgtttgtttattaagatccattctgtgaaaagagtcacatggtgtatttcaaacgtccgtttaaaatgattcttcaggtatgatgccagtagttttaatagccctccgcctccccttcacattgcctgtgtgatctctggtgtgtcctgccaagtaccctcactctctcactgtcgatgcccaagtgcattctgagtagcaaggacttctgcttggactcattggttgggtcaggctcagagagagctcttatgttttttctcatcagctaataaagataaggggtggcatcaggggaagcatgccttaaagatgaagggcaaatggagatctttgattcaaagaatgcggctccatcactttctctcttacataaaaattctattcatcccacacttcctactgcaaatcacattggtacaccatgacaatgcagtagatacacaaggactttcccacatcacactacaaacacagccaccctctctggggaacgtaagagaaacttttgggcttcctcttcccctccatttgtttgaaggatcaagagaacactgttccattttcaacaaaaattaaaaaggaaaatcatgaaaagagccaacctcctcttttttgttttctcccttaatatattgttgcatccagggaagaggaaacagtgagcgccactgatactgggtccccagggaccccataaggttcactccccagctatcaaatgagcatgtcttcctccacttgcagagtgagtttttaacgggaatggaagttactcttggctcagctctgatgttgaaaaaaataaaatgaaaagaaaagaaaa

SEQ ID NO: 5155 - DNA, 807 bp, Homo sapiens
gtaaattaagccaacctcaactataaaattaaaacaaacggcaacttattcctcatgtagttgatcctcatcctgccatgtatgacaatctcctggtgaccctctccctatgggacagctagacataatcaccaggtccgtcccacagacctggctgagcgatggatgaaaggggagtactcagacacaggttgagtgtatgtgtcctgaactgtccctggccccacttcccactggccctgtaaggtgtgctgccctcttctttctgagatctaaggatctttctaggaaaactgtatggattgaatggattgaagaaagaacaagactggaaacagaaaaaatatcttctgccaaaagtattttgaaaaccaaagtgatttgcctctacttgaaaaatcaacttctaaattacactcaaaagatacagaaatggattatggataattttctttctgaggaagagtttatcaaaatgaagaacacacatcatctagtcagaaacctattattgggaaggaaaatagtgccttgttgtgaactgccctatggatagaaacacatggtaactttgatgcctctggatagcagcaagtatgcacttaaagcctgccaaagtccatgtgaagaagcatggaagtggattatcttccaaacactcactgacatggctacagcctcacccgacacttttactgcagtcttctgagagatactccctaagccaggggatccagctaagccattccaagattcttgacctatagaaactgcagtataataaatgtttgttttgctaagccaaaa

SEQ ID NO: 5156 - DNA, 406 bp, Homo sapiens
ggcgcacctacgacagaaactttgtatatatcacacaaaaagaaatctaggttctggctctgttgcccatgctggcatgcactggtgcaatcttggctcactgcaacctttgccccctcagttcaagtggttctcttgcctcagcctcccaagtagcatgggattacaggccactggcaaccactattgccttttctgcttctttgagtttgactatcatggatactactacaaatattgattttcaagatcaggaaaaataccgggaccagaagacaaatttcagagccacctaaattgtggagtctaataaaagattcctttctcctaatgatgtgaccatccaaaggatacactctcagtgtaaacgtaaacccagaataaaattttatcatcagccttcaaa

SEQ ID NO: 5157 - DNA, 402 bp, Homo sapiens
gtagagggccacccagatctggtcatcctgatcaacattcagtggcaagcctggaggggcaatgcttgcctcccattgtatggcaggccagatatgttcctggcccatcagaagcctccttctggatgcagtctataagccactgtgatggatgagaagagcccaggatggaggtgaaagtctggaactggaatctgagcccttatttttctgactcactgttttaccttggaagaatcactgaagttttctgcatctctgtttcctcatatgtttaaaaaagaaagcacttaaccttggtggatgtgaaaaataaatgaaataatttctagaaatgtgcctagttcaatacattgaaacccacctacattaaaacctttctcaaagtcaaaaaaaaaaaaa

SEQ ID NO: 5158 - DNA, 260 bp, Homo sapiens
ttcaggtctcacgggaaaaggaaattcagttcatattaaaactggaaaattccatacaatttttaaattaaaaattacaaaataatttttaaatgcagaaattccggaaaagaagaaggagaagaagaaatagctttggtctgtcataaagtgaaatgggatcttgattgaatttttttctctcgacactctgaaggacttggaagagggaaggtactattggaaaggattttgaataaagtttaattcctgactcaaaa

SEQ ID NO: 5159 - DNA, 776 bp, Homo sapiens
tggagccggcccatgaaactgataagtgatcacatctggtacctataaaagcagcatctgcattgcctgcaataatttgcattttgctttactgtgcatgctgctttgcctctatactgcaccctgaatcaaatggctttaagaccctgaattagttaatatacacaacacagctctcttgcccaatatctccaaaagatctgaagaaattttattcaaatttaaccagaaaatgggtgaaagtgaaattaggcaagcaaggcaataaagcaacaagcctagaataagaacacctggagatgagaaacctggagctgcgtttataagccatgctacttccctaagaattcctgagcactaatgaaagcaatcaacactgcacacagcttgcctccacgcatatcctgcatgctggtggactaccaatgccttggatgtgttcttcgtgagagcatagaagaaagcacaataaaggtcaactatcccatcgtcctagagtttcctttacattgagtgaaacaggaatgatagaaattattcaagaatgccaccttgttttctccagaagcactgggtattgtttaaaggcagttttaataaatgactcccagcaggtaacagcattatgttttgtctttgaaaaagtctaattgagctccccctctataacgccatgccctggggaatgtgaaacaatatagtcatacaattcttttctgattggtcagcagggattagcaacttattcattctggacagaacacaagtatgcttcg

SEQ ID NO: 5160 - DNA, 763 bp, Homo sapiens
tgaaaggaattcttttcaacaaagaatataaattctagaggaatatacatgaagagatgagagacaaacattacatcttctccacatccacacttccccaatgctcagataaactccaaccaacccagaaccacactattggtaagcatctgtcatgtgtatggaactgtgctatgagccatacacaaagatgaataggcgtggaccttatattcaaattattatgactctcttaaggaagaaggacacataaataaataattgcaacacagcatacaatgtataatagtagaagtaatttattcagtttggagaggagaggaggtagagaagatttctcagagggtagtgacagatatcacagaagacactctgactgaaagttaagtaggaggtgactcagcatgtgactgacagtggacagctctggttttagctttgatactatcaccgtggtactgacagctctttcctaagctgcccaagatcagctctgtcaactgaagaccctggactcagcccaacattctgcagaggatgatgagtaaaggcaggcaaaccaagccactgctgctggaacactgcacttacccttccttcactggtataacactatgaatacggctagagtttttaacgacactcttatgccactgtataggtggctttgaaacaacttaaatatcccgttttatgtaatttagattttggaaatatagctacctttaataaaaaaagtccaagaaccctaaaaaaaaaaaaa

SEQ ID NO: 5161 - DNA, 780 bp, Homo sapiens
caggtccaaggagtgatatgaattccaaaaggaatgatttccaggaggaagagaaacttttgatggttggcctaataaaatagaactacacattagtgaaactgaattcaaaggcgcttccaacgctgctgcacacagatgagccctctcgctggatcccgtccaaccccaacggctgcgcgcactgtaaccaccatgtgtcatctgcaaaccagatagtttctgtgcgggaaagaccagccagctttcttggccaagctgctgccataaaacacactagtgatttggtttttcatgttttttttttaagatatgctttgatgcacaggatacgtttggtctcacattgtccagagcactatcagaaatgactagttgatgaatgttgtaccagaatcaggtcacattttgacaggttgttttgtgtcactgcaaatcattgctttacaatatggactttttttcccccttaacttttaaatcttaagcgtaagaatataaagtgcggctaaacactctcaaacattaggagtaatctggctttaacaacttatatgcatcagctgccttttgatatcgtttgcaaaaagcaaaggcatcatgggatctcttaaaagaactggaaaactaaatgtcagaactgcatttttacactcagctagagaaattcctgcctcgtataaaacacctacgttctaacacctcgtgtttgctttggagacttacaaggagataatacagcttgtttggcatcagaaattggtataatgggcttttact

SEQ ID NO: 5162 - DNA, 786 bp, Homo sapiens
gtaggttgactggatacaccatatctcttcactcactcaaagacccaaactgatggagaagtaaacatctctaccagtcacagtggcagaaggaaagaaagctttgaagtgtcttcaactggaaatcaaattctccatcctagaagagacgatcattatttccttaatgattaattatttacaacttgtggacccggagtcattatatgacctaccccaatcaccagggactttgtagtataattttacaacatctggaatgcagacagcctaatatattggcaaagagaatcagtaactacttgatcaagcttaaattaaaggttgttttaggaaaagttttctttcattcaaacaagtttcatgtgtatagtactgacaaattgtagctcatcaaggtaagcttatagacatttcaactgatctaataatcattctagatagatatggttgaaagactcatgatctctcaaaggagttattcttctgtgagaaattcatttggcatattttactttatataatacattaagaaagggatattgatagaagagaaaaccagtgtttgaatgaaaaaactgatggtcagagtgacagatttccattatgttacaggtatgaaaaaggctacatatgcctattcacaatttaattatcaatctgtcttatgcctaattattactttaaaaaatatatattctccctatatctaaacttcagaaccaagatgaaccttctaatatccatacaccagattttttctttcctaatatatttgaaaaaaat

SEQ ID NO: 5163 - DNA, 781 bp, Homo sapiens
taggtggagatgtgtcttttttatccactcttcctaacgccaaagacatagaggaggagatagtgctcagggaaccatcatcatcatcatcacggtcatcatcatttaaccagtctagtcctccaaaggccactcgaggggttaactcattgttaaccagttactgttattaactagcttcatggtttgttttagtagaacacagagctggaccaaaactttatgggaagcagccagccaacatgtggcagtaccatgaacagaactacctctgtagggagcacaaaagaagccaaagacagaattcataacagcttaaatgctattcagtagaaaaggcttttgattattaccatcagatcttctacagccttactcctcaaagtgtgatccctgaaccagaaggatggggatcactgggaacttgccagaaatgcagcctctcaccaccccgcccagaccttctgaatcagaatctgcatttggttgagattacaggtaatgtccacggtgctacagtttgggaagctctgctctgcactgcagagctggttctctacatcagcatgcaactgggatatcttgagaaaaagaaagacaacggcgctcgtgtgcattttgatacaacctcttgtccacacctgttttgaagcctcgagtttgtcattcccgaaaacaaaaaattaaaacaaaaactcccctcaccggccgggtgacctttcctattatactgcccttgaaggagaaacaaccctccctgttatccctaatagagggaagg

SEQ ID NO: 5164 - DNA, 355 bp, Homo sapiens
acagttttccggtttgggtttcggatttaagtctctactagtccagggatcaagtagctgctatggctctgtttcatgccctctcagctctcaggggcgtccagcagcctcagaactggagcaccatgatgacaggaggaaaagacagctgggctgctaagcagcagcagaggggacctcacgtgttataactacacatttgggtgttgctttgtttaatgtctgtctctgccatgaaatgcaagctgtaagggcagagcctgtgtcttttgctcattgttctttcccagcacctggaacactgcatgcacataacaggcccttaataaaaatttggtgaataaaaaaaaaaaaa

SEQ ID NO: 5165 - DNA, 769 bp, Homo sapiens
  misc_feature (1)...(769): n = A,T,C or G
agtatgacttctccccctctgtacaccctggaacataactctgctgtactggccaagtgctacagccgtaacgagaacagtatctggttaagcagatgtgtatcaacaactacactctggaaaaaaggatgtaactccagttctgccacttagcaactgcaagatcaaccactctgtgcctcagtgtcctttaaaatcgggttaataacactacccaatgcagaaagctgtgtgagatggtatattaaagggtccataagagtgccttggacatggtcatgcaacataaatcttagttttctattacagtattcacggagtaaaaagaaattgactgcatctcactgcagttgacaccactgaatgagctgggagagctggtgtgaactggagggacccgcaaaatgagtgtctttttatggagccatgacagaccccaacaagatgatcatcaacttggccctctttggcatgactcagagtggaaaaagttctgctggaaacattctgctgggaagcacagactttcacagcagctntgctccctgttctgtgaccacatgttgtagcctgggccgcagttgtcacctccacagcttcatgcgtcgaggtgggctagaggtagccctgcaggtccagggtgtggacactccaggttatccacacaggcaggctgagcaagaggtatgtgaaacaggaagtcaaagaggctctggcacatcacttcggggcagggggtctcaacttgcttttctggtcaaagagcaaa

SEQ ID NO: 5166 - DNA, 774 bp, Homo sapiens
caggtctggaggctgagcaagtccaagatcaaggaaggcaccagcaggtttggtatgtggtgaagacccagtttcgacttccatgatagtgcctcgttgctgcatcctctggagaaaggaagccatgtcttcacatggtggaaggaatggaagagcagaaaaggactaagctagttccctccaagccttttataaggcagttatctattcatgaggatggagtcctcatgatttaattacttcctaaaaggccccacatcttaacactactataatggggataagtttcaacatacaaattttgaggaactttcagaccagagcacatgataatacctaattcacatagcttttgtgaataaacgaaatacgtatattaaacacttagctgattgccagacctgccgatcatgaaatattaatcccattccttttctcttttctgagtctcaattttatcatctgtaaaatggaattattactatccaatgtaagataatattgacacagttatttttctattttcttcactgttttattgagacttatattgctaaacaagatttttttttaactaacgccatttctttgtcttatatcttttgcaggaaatgcacattcaccccccaaaagtatgtttgaagtagcataagccagcaactaagcgtagggaatcctagggttagaaaattccagaaagccacctacagtgaaagatagttgcaaccattaaagaaaatcatgagggagtctcttaggtttcacttatatcag

SEQ ID NO: 5167 - DNA, 791 bp, Homo sapiens
  misc_feature (1)...(791): n = A,T,C or G
agaaaaagtctgccaaatcctggtctcatcaaatgcttctcagactttagtgtgcatactaatcacctgggggaccttgctctaatgcatgttttgattcagtaagtcgagagtggaacctgagagtctgcgtttgtaacaagttcccagatgctgctgatgctgctggtctgcaggccactcttgagaagcattaagtccagatggccgagactgctgaactgattgagaaaaggagaagaaccaactgcataatattctaaaaagtttattgcctatggtctcagaaatgaaattttctcttcttgaagcttaagaattctctcctctttcaagtcaagtacagcaattcacttatccaatggtcgcatctccaacctcatcgatctggagtatcggtcccaattaggaaataagaagggtactgtaacactccagaacaataaaataagattcacaatgaggttcataagcaggagcaaacatcaagaaaaagtgacgttctaactttatagtgatatctaaagcagataaacatgtaactttcttttaaaaccaccattaaataaatattcacatttgaatatgtcagcttcataattaggacagcttttttaataatacagcatgcgatgtcaggagcatcctggattcccccaaagtcaattcacaaaacctagttatttccttaccttgtgacaacaatccanggagggagaggtctcgactggcttcctttgttttttcttctctgatatccacaagacttgaaactttctttccttgcttga

SEQ ID NO: 5168 - DNA, 787 bp, Homo sapiens
caggtatcttccacgtggcttcatccatccattcatggccttcaccaagttccagtatcatgaataaatttggaaagatcaaggtgtcctgggttatgtgcttccatgaaaagtctaaatccattgacaagtttctgggggttttctcctgggacagacaaaactttcactattgctttgagctctaagttttgttcatggaataaaggtggttaaaggagcggaacctgttgatgtcagggactaactttataaggggcttatctagttttctagactaggaagataactggagttacctaggagtgggaagataactgaacacctaacacgaagtcctaaaatcttccacccgactggaagctcccccttctgctcatgacaacccctgcgacgcctcgttcactgaactgcccgacattacacgacacacactgtcatccattttcttatacatacatactttccaacccgatacagcttgagcttcgtccgcctcccgcgcaaccaaatctcctgcctttaaagtcgcttcaatcgccatatagatcgactccctcccaccactactccccttcacggattatatccgtccccgtacttaactaaagggccccaccgacactagcgttcatactgtcccgtcgactgcggcgcttcctatcctgcataataccacaccattacatcattatctcacccgttcgcctaccgcctacacctctaatacgttaacttcatgcgtagccaatgtgaaagtctgggaaagtggactgcgtggttcttg

SEQ ID NO: 5169 - DNA, 786 bp, Homo sapiens
ctacagtgtacgttcaggactggttatgtgaatgaagttgggccaatcaaatggatgcattgattgatggttgtggaaaatcctctccttctccaagcctacatatgaatatttgtctcagttgctgttctcagccatgtagtaacaatgaggaaattcatctttatgataaagttgacaatgcagaaggatagcacggagagatttttttttaactggagccagatccttaactagaacattaatgaatctgactaaactctagaattttgtgagcagacatctttcctcaacggtttaagctactctgagttatttatgttcttattataacaactaaaagcattgggatcccgtaccagcagagccatgatagaacaccaagaacccgaaatgttttccactggttaaactcagaatgactaagaagccactagcaactataatatttttttgaagttcattagattcattgctaccctgtggaattagaaggaaagccgtttatcaaccttaatggaaatttttaattttttctattccaaatctaaaacctaaaaggtatacccggtataaagaaatgggttaggggcatactttacctggttatctcatgaattctggcaaagcatttctttagaaaaactaagagggcgtatcactctggcatatgaaaaatcacaccctcaaggctataagggttagctgaccggcctcctggacgccaagcactggggtgtttgaagaaagtggagtcccgaattactacaattatgcagcgaaagg

SEQ ID NO: 5170 - DNA, 799 bp, Homo sapiens
ctagctagatcgagtttcgttctctttgcccaggctggagtgtaatggcatgatcttggctcacagcaatctccgcctcccgtgttcaagcgaatctcctgcctcagcctcctgactacctgggattacagatcagtctccaaccattttcaccctctcttctctaagctgacctgtatgcacaccatcaacaaattattttctgccctggcttccagctgggttcagtcagtgaaaggcactggcagaagactgagttgggatagggttcttattgaactctcctcaattacctatttaagcatgctatctgacgtctgctaggatcctgatggatataccttttgaattgctacttcctttatctgaaaattgaggacaacaatagaaatctgcttcacctggaatactgcaagggttaagaaaaatcactgcgtggagattattgagcacctttcaggcggcacatattcaactgtgcccgttaccattactggctacgcatcataccttatccacatcggaaagactaccgcaactattattattctacaacatatacaccccctacagactaccactggagattaactcacaccctgaacacctctcgtgactatcaaccctattcctttaagcctgcgcacactcatactcacgctcctggcctacccagcaacccgcacccaagcttctagaagccggaccacgacgactctcaccttccggactgcgcactcgaatccaggatcagaatgacacgcaccaatctccaacacacacaccactcactttgtgc

SEQ ID NO: 5171 - DNA, 840 bp, Homo sapiens
  misc_feature (1)...(840): n = A,T,C or G
tttaatttccgaactttcacatctaaaatgcgtcttagtttgttccgtaatgcacccctggcctcttgagccctggaaggccgagctgctcactggggagaacgtgtgttggcatcaggatggccgggtgggacctccgctccactgtgtgagcccgtgatgactcatcctcaccaggctgccatttccagacttccgagctgggccctgcctagttcatctttgagttcctacggatgtaaaaagtcacagacaaaccaaatctccagcagcagcagagaggaagcctatcaataataggccataacgcagttatcaggcggattggctttgggaaagaagcaggatcactctggccactgttgagaattggctaagcaagggggcaggcaggaaaaccatttgggggccatgcaataatccacctgagagagattgacgaagatgatgaaggtgatactttacagcgttgtggaatacgtggccacacaggcaatctcatgcactgctcatgaaatgaatattaggtccctctgccgcaattagcggtctgcattattttttattttagttcagtttatttttcgagatggactctcacacttatcgtcccgggttggttttgcccttctttctgtgttcgttttttgtacccttcttgtggttctgtgacgccctctcccgagtgttttcattggctttttgttctttgctatgttatttatttttacctcgcctctattgcacgtagtaccccctatttcacgatgttttcttgtgtgtttatntgtttctaaggattggtagnccccccccgcacctccggcccggccgcgacgc

SEQ ID NO: 5172 - DNA, 796 bp, Homo sapiens
aggttgttttcctattggctccctggaaagccttagaaattctcaagaagtcttggctactgattccagatatccgtgtcaagaaaattcaaaagccaagctcaaaaagttgacaatgaaaacaacagaaatgtatcggaaatatgaagagtggtttctaagatctaatatggcagaatattctagaaccaatttatgtgtctccctctatgcattcagtttcaattaccaagccaggtttcagtcacctgtgggtgttttctagatggtaaagttaccttacctgtggttgtgaaatcttggctgccacctgtgttactcaccaccacacactgccacactgctggttttttaaccttccccagagatgtggacggggcttagacatggcatccactgggcctgttagaatgggaggccatagctctcagcctaagtctgacacatctagaaaaaacaaaaatctggctatgccaaagtctgtctagaagggcccagtaacataatctgtgttgatgggtcaatggcccttggtcaaaattaaggagattgggagactgggaagagccagaagaaaacgttctcattcacctctctttcatcaacttttctaaactgtcctgggttcatatggtcttttcggaaatgcttttgctcctttcaaaaagttggaaggccacttctgtgccatcttacacttgagttcctcattcctctgctcatttttctcccttttaaaatttttccttctggggttatgctgcttctccaaattagcagaacctataaaattccc

SEQ ID NO: 5173 - DNA, 788 bp, Homo sapiens
agtcccctgctcctgtcttccggggccagaggccctatcacctacagcttctctccacacaggggacctgcagtcagagccgagaaatcaagtcagcctcgacttgggccactggagaaggcctatcctcctcgttgtttatgagtagactgagtagacagagaaaaagatcttggtgggggctaaaggacttgccccttcgtttgccattttgcccagctgcttcctgtgttgttaaggttgaggtggcctttgtggtgacaccaaaccaggctaccagcagctcaggggaacggcctcatgctctcaggaggggaagtcatgccaccaaggtggcttgctgatttgctcctgctggggccctggggctgtcatatgaggaacaccagcatgacgcgtatgtggggagaggagctgcctctcagatgcacctgctaaaactcacaagggaagccatgcatctgctacggaaacaaagaggagggcttcaggtctggccaccagatcggagcacgtggaactcagctccatcgatgtgaaaccacaactcgaacatggctcagtatgaagacaaaggcccccaaatcacattttcactcactctaaaagggcaaatttctctgtcctgtaaatgtggaggttagccttggttctctctcaaccatgatgtccaaacctgccttgggaaggttattgcgggtaacttgtgctaataatagcttaagcactgaggtttgcaaaccaggtacattttattgaatgtgaggcgagggttcaagatctctgtg

SEQ ID NO: 5174 - DNA, 801 bp, Homo sapiens
  misc_feature (1)...(801): n = A,T,C or G
tagaataagagagtncagtcctcaaaattcatatgaaatctcaaaggatccagaacagcctatggtatcttgtaaaagaagaaaagttggaagactcacacttcccaatttcaaaacttactacaaagctacagtaatccaaatagtatctgaatggaataaggactgacacatagaccactgaaatagaactgagagttccgaaatcaacccaaaaatctatggctaattgatgtttgacaatggtgccaagacagtttaataggcaaagaagaggatcttcaacaaatggtgctggcacaaatggataaccaacatgttagaacttgaagttggacccctatgttacttcataaacaaaaatgatgttaaactagatcaacgacctaaatgtgtaagcacaaactgtaaatctgttaacagaaaacactggggtaaatcttcatgatcttgaattaagcaatgggttctttgacagcaaaaacacacaaaaaatgttaaaaatagttaaatttgacttggccaaaattgggaacttgtgtagcaaagaatataatcaagaaaatgaaaagacaacttacgagatgtgagaaaatatttgcaaatcatatatgataaaggtttagtatgcagaatatataaagaacttacaattcggcaacaaaaagacaaaccacccaatcgaaaactgggcaaaggacttgagtagacatttctctaaagaagacacacaaatggcccaagaagcacatgaaaaagatgttcaacatcatttagccgttaaggtagtacaaatcacac

SEQ ID NO: 5175 - DNA, 815 bp, Homo sapiens
ctgacagtttcgatattaatgctatatattatttataagctactaattcacattttaataaatttaggcactttgtgagggtctttatacatcataaaaagtggcccatttttataatttctgtagtatttattgaaataatggcaactaccattaatatgaggatatgattccagtaggctctagcttatcttaaagagaacatcttcacaaagaattataaaaatcaatatgaaagtttgtataataaggataatataaatcagtatttgtgtggtatattacactttctgcttcagtcccaatgtaaacctaaccataatcttaacaaacatctttcaagaaaagtagcacacataatcacaaatgaaaaacaaaaggctgacaatgtgactgtcttaacttggctttagaaaatcaatctttttgctttgagccctaagcatgggttgatctaccccacttaattatgaattataaacgctgtttcacacatgcctagaattgggaaccactcaataaattgttccttattgataggccacaataagtggcctaaattaaccattcacatgaaccacatctatataccagctaccaaaaaacttaaagggctacataacctgaccctggttcacaccccttacggtccccatgaagtactccattaaatgtatccccctattcaagtgcggcagacccacacgaaatagacttttcgaccacacccataccacaaagaggcgaaaaaaataactcctcttctccggactaagtggggcagccttagcgccgggaacctctaagagagcaat

SEQ ID NO: 5176 - DNA, 806 bp, Homo sapiens
ctgggttgacatatagaattcctctcaaatgccaactccaattgactggtggtggctgcctgaggcacggaagagagaaggacgctgaggccctgttgggcttcctggaaagaatgccacaattgattagtgatgtctgtcaggagttgctgcacctgtgtcacccccataatctgtgatacagttggggaaatttgcccagcaagatgaatgatctgggaagacaaccagacttggttctggaattggtacatttaccgtcctttgaaaatgaacaaatggattcttagataaccagtatatctctgtcagtttcacctgacgctgctcatttgggtgagctgagaaagtggagtgtttaaacaagcaatgctaaagacattagaagtcctaacagcaacaatgctacttaactggaaaagcaccgcttaaaggatcctaccattcattatcttttgacttgtcatggattgagaaactgtagagtatttactggtccctcttcccttcaccttacttaggacttgccattattcttgcaactatagaatgcccctccttccgtattcaccaaggagatagtcaagattgtagttttcacatgtgggaacttgggatttcttggggctttggaatggggcatttgtactcttgattttttaaacaacaaattccttaaaaccattggaggaaaaaattgaaggcaggtgcgtgcttaaaactcttcttcccttgaaaaaataaacttatccctcttgagaaaggggcgggttcttaaaaaaaccagaaaatttttttggggaatt

SEQ ID NO: 5177 - DNA, 1013 bp, Homo sapiens
cgttaagaaatctcgttcacacaaatagcatacataaattttggaagcactgcattacagtaaagggtctcgtgaaataatcttccttcaagagcaaagaaagtttgtctcgtctacttaattaaattctccagaataactcctggtgctttccaaatatattgatctcttttctatgattccttctctgtgaacattcaggactatctgaacgaaatgggacccccatctcctgccacttctggagaacaaacaacccactcaaaaccatttacccatcatcactgtccagatcattgcacagggtgtagtcccagctacttggaaggctgaggcaagaggatcacttgagacgttcaaggctgtagtgcaccatgattgccccttgtgaatagccactgaactccagcctgagcaacaaagtgagacctcatctgtaaacaaacaaacaaaactgctcctgaatttcaatgtcaatttattgtagaaatcttaaaaacttaatcctcctaaaataatgctgtgtttaggggcaacacataattgtgtacaatttcatgcgttttttgacgtgatatttataaatattttgagcatttgttatagaataaagacgtcgagacaagataagacctgtaaccgtattagactagtaattttgtgattatagataatgttgattatttcgcctatctctctgtaaatagtttctttttttgtttatattttagtatgctctttctgatagacagtttaatggcgatagagctcatgatgtgtattccgttgggtctcgatatttttataatggataactgatatgtagatcacccctacccgtattcttatctttcttaccttgttgtctacgtcattcctgttaccagcgctcacaaaataacagacacgtccgtctatgtgcttgtattgtgcctttgttcctttacgcgacgtgttggtcttgtaagaccaaggaactaccagcaagagctgtctctatgatctttcagcct

SEQ ID NO: 5178 - DNA, 856 bp, Homo sapiens
cttggcatctgattgggtcctttctgcgctcatcactattgagaaaggaagacagttaatagaaaagatggttgtaatcgtggaaactatagttaatagcaatatattgtgtacttcaaaattgctaacaaagtaaataagtgttctcaccacaaacaaggcttgacactattttgaaagatctatgcatatgaataagtgcatatgagagagaaacagagacagacagatataacagataacaactggaaagttggagaaacaaaatgtttgtgaccccatctgacctttggaaaacaactacaggatccagatttaaagttcccaggaccactcctggattgcatgaaaaaactgcaaaaataggcaattcctgagtgtttcttttcatgtctacatggttttattccagctttgatacgactagactgatgacacttaatcctagatggggccaaccttaatagatttgctgtaaaggaatataatttttctaatattcatctataaacaatgagcatattaacagaggattttaatattgtcatatatctggttcttcttcagcaattttcggactattggaaccacaatcattcttcctttagtaggacccttaaaagatcgagagtttttcatacattttattataacaattaaagatctcttaaataagcatttcattccagtataatctccacatcatcgcaacattcttgatgattactgtttcaggaagataattatctcaggtttgtggaaacccataattattgaggttgaaagaaaattcaaacctctctgttgactctttgataggaaacccccggcatatattatttttaacccaaagaag

SEQ ID NO: 5179 - DNA, 757 bp, Homo sapiens
cctagctgagacctgaagaagatggaaacccagaatgagcactgactgaacaagaaaaaagaaagcttgctctctagtcaaagtacaaggaaaggagaagcacagcaagaaagaaaactttttgaaaataacctctctattccagccaaacaaaacggaaaataagttgttgccctactctcacccatcctatttaagaactactagacctagatatccccccacaaaagaatctaacaagttgcctccaaaatctcattgtggtggtatcagagaggactaaatagggagaatgtggtcttctaccccaccaagcaataaggaagttcagcttttcctctcagcttaaatggtgtcttaggaggtctaatgcaaagtcagaacttttgccatcactcagctgtacagaacctgcacccactacgttgtcatagagatcacctgagaaaccaattgccaacactagccctgcagtaaaaaggaaggagctgcccattcccatcactcaaatgtcaatagaggtcaagtgaggaatcctgaacttctacctccaaatagcagtaataagggtggtgccctctatcccctaccagagcagagaaatattgttaaaacagaagttttaagtaaaatccagagtttcatagcacaatacgaaaatgtctgagttttaatagacaatcacttatcatgccaagaaccaggaagatgtcaaactgaataaaaaaaacactcagttgtgggagtgggctgagat

SEQ ID NO: 5180 - DNA, 558 bp, Homo sapiens
cctggagactcccagctctactcacttttcacttgctgttcaggagcattgatgtgcgtcatcattctggcatgtccacgctgttcccgtgcaggtatttcaggaagacgtctgcattcctccgagctagggtgcaagcctaaaaaacaatggagagcaatgtgttgctaatttgacttctacaaacgtgtatattggagtacacatcactgcactctaacgtatttcttcacggcgcatgagaatggactaatacgctgtcaaaccaaacaacaaggaagacgctgaagactacgagggtgatggctaaggacagctaagcaacctgccttgaaagggctcctatggataggatgagctgcgtgttaaaagataaatgacagtgactgctttgaaactcaccaaatatattcagatccatgatgatactaaaaaaaagtcaaatgtagaagctgctatagcaacaattcattatcctgaaaatggcgaataaaaaggatcaagcaagcaaaaaaaaaaaatcggccctcgttgggcctcaagggtggattctctgag

SEQ ID NO: 5181 - DNA, 799 bp, Homo sapiens
agcttgacgatacatgtgtccacagaggaagaaagaccaggacagagccatgcagaagtgtgactggagccctgatgggccggggtgaagttcgtatcacctctggactttctgttaggacctgtttccacaaagatgcacctgtctggctgttggacagagaccctggagaaggctgctgacagaggccaccacgtggatctctccatagagttgctggagcatcctcacgggggggctgtcttccccagagataaagtgccccagagttcagagcactgaaatctgctccctttgacttattttcatacgaagttaaaagagaaggcccaatggtgacaaagagagatggaacagaggaagctacaggtgctggtgactatcgtcatttagggggtggggctctaactgggagctgtgcttgttccttaagaagtatgtggcaatttctagagacatttttggttggcacaacttggggagaggctggagagtactactatcatctagtgagtaaaaaccaggatgctggtcaatatcccctcttaccaattatttagtcccaatatcaataagggggcacgttgagaaatcctgattaggaggatgggtgcctttaaccaggggcgtgacttaaaatctttgtttttagtggtgagcctctttatgaaattacatgtaaaagtgggcgggtgggggtgagaccacggaataggatcttcacggctcgcttcatatgggtccggactaaaaatttcttcccgagggcggggggcggggctttccttaagtttttcct

SEQ ID NO: 5182 - DNA, 785 bp, Homo sapiens
caggatgagttctacaagtgctatagtggaggagaccagatggctggtgagtttgcctgcttgacactgacttgcaaatgactgtgaatctgagacagcaatgctacatttagctcctgcactaaaactgctgagatgtttgccaggaagttcttggatagtgacttactggggatagagaacgtgtatgacctgttctgtcttttcgcagcatccctctgcctcccagtccttgaactctaggtgtgaatacatgtccaggtctgggcaataagagtattgaatcctcctggccagggtgacttcttaggggataagcctaggacccaagcctggtcaatcccagtcctccccaggatgtcagcaccctcttctgctgagcctggggcctccttgagaattacacaaggaagaaagcaaagctgagagcaagtgagcctgcttgatgccatcgtctgaggccctgtacccagacatgagagcttacagtcctctctcttaatgctggactaaaacagggattctaaggttcagggaaacctggtgggcatgaccaacctgggatctcgtaagaactctcttatttaaacatgatgatgacttccctggcacgaagaccttccattacggctcctctctggctggattttaaaaagtacaacaagggagaccgactccttggaaaagcctaaggctgcgcttctttttggagatgagagggtttcctgaggagcctcacttctaccaggatgcccatggtctaagccgaaaccccgaacagattt

SEQ ID NO: 5183 - DNA, 789 bp, Homo sapiens
agagggaaaagaagatattgctgctcaacgaattaggggatccagtgcagacagccttgtcactgctgatagccccccaccatccatgtcatcagttatgaagaataacccactctatggtgacctaagtttggaggaagctatggaagaaagaaaaaagaacccctcatggaccattgaggaatatgacaaacattccctgcacacaaacctctctggacatctgaaggaagatcctaatgacctgcggttttggttgggagacatgtacactccaggttttgacactttattgaagaaggaagagaaacaagagaagcattcaaaattctgtcgtatgggtctgattttacttgtcgttatctccatcttggttaccatagtgactatcattacttttttcacctgaggaaactgcaacaatcagagctactttaaatttcctaaaaatttttctgataaacatttgaaacccccccaccaaaataataaaaaacacatgtacatgcagtgtgaatggattgttgattgtattattaaatgtaattgtcctgaagaatgtgaatgtaagggggggtatgctggctgctccactttgttctattaaagctttataagagtgccaccctgaactttgggaagcaggaattctgaggaccataatcacagaatagtcactatatgcaacccacattaaatatctttataggggagcaaacagtatcaaaaattgtcagcagctttgttttcatgccttaactatattagccttggtttaaaatactgtaa

SEQ ID NO: 5184 - DNA, 1033 bp, Homo sapiens
ttatgttaatattattatattttttcggtccatttgttttctccctccccctgagacttcaggtctcgttctgaaccttgctggagtgcaatggcatgatcttggctcactgcaacctccatcttccgggttcgagtgaatctcctgcctcagcctcccgagtaggtgggactacagttgttctggaaatgatgcagaagggctggaccccggctaaaccccactcttaagcctggaaccatggccctaagtgaaaacagctgaccccatttttctgtgcaaatgttgcctttttggcctgccccgcccctatcttgtgcccataaaagacttcagctggcagagcaatactagcggctgagctttgaagatacaagtggctgagtgttggagactacagacagacaaagctaacttcagaatgtacagcttcggaaaggggcccagctggaaatagccgggcttcagaggaagatcaccctcccttcccctttccagtctccctttctgctgagagccacccaccgctcagtaaagtcttccacattcatcacctttcaaacattcctatgacctgattcttcctggatgtcggacaagaacccaggtgccaagagggcaggggctgccaccctgaccctccactgagccagttgacacttggccatccctagatggcagctgaaagagctttggttgtaacacacttggaggctgccgtgaggtctgcacagagcctgctcccaccagagaggagccactgactggttctagcattcattcactctggttcctgcagtcccttgctcacatacctccctcctgtgatgaatggccagcaacactactatgatatgagccactccaggtccagcctgtgaagggggataggggactatcccatctcatacagtattatatagtacaattgtgggagaatctcactgagagagaatggcattgttccataccattaaatagaattgttgcatagatgcagtatagcgtgtgggtatgcttgtattcatcagtg

SEQ ID NO: 5185 - DNA, 1133 bp, Homo sapiens
agcgaagatgagtaaatgagcttgaaaactactttgggtatggtattatcaaagaggaacttcagttgagctttgagattcccattaagcctacaagagagaatgagtaaaaccatgttctgactttgtgactttaaccattactaatcatcaaaacacggtgaaaaatgatttcaagatcaaagcaaaacacagcaacttcaaagacagatggagagctcagtgctgagaaagcagggtcctcaaaatgtaacccccattagaaggctgtagaaagtcaggtaaacaagacctggatctgaaatagacctctctgagaacatctgcagcaacctaccaagtttccccttcaagtatccatgcctacgtgagaaaatcctttcctttgcaactgctaaatgcaactgcaacttttggatgggagtgatacatgtggacagcaaagatgaaaagaacttcaccaaatagtgtttctcattactttgaaaaatgtcggccatgtacagcatgcaagaagaaacagtgaagaatgttaacatgctcagcatgggaaaccgagtcatagctttacatcttcacttgattatttccaacattattttacacccttctgatcaaagacttcaattatctcaatttttcagagcatttttggcactggaacatcattaaacgagttcttggaacagtactttgccctattattagtttgacctactacctttcttatattaagctcctcacaaatggactatagaaatacaaaataaaggttttctaaccaatcctagccaattgctgattttagatattaggtaacctgtgggcttccttaagtatgttttacggagtcatcaacagaacctctgtattaaagatgtttttacattgtaactgaaaaagaaaacatccgcctctctcggtctaaccggcgaaatttcgtgaggacagttccctttagggagggactaatatcgaacctccgtcactgactctctagtctcggctattcacccgcggcacaccgctacacttcactcctagccagtaatgccgcgctctacccaatctgcgtctcttcctctgcacgatccttgccctcgcagcgcatccaagtcactaccacctcctcg

SEQ ID NO: 5186 - DNA, 300 bp, Homo sapiens
taggttttcaacttaagcaaaatatttataaggaagacaacatttcatatcaagagaagtaagccagggctgggttcattgatgtagttccaatattgccttaagaacttgcctttggaggaattttttttttttttttttgaaattaaaagaacttgcaagggtctctataagcaaaagacactcagtatgcatttaatgctcgactttggaatcaatattttttgctagctgtgtgctaagtgccttctgtaaattaaagctaaagatgatcaaattcagcttttaaaaaaaaaaaaa

SEQ ID NO: 5187 - DNA, 750 bp, Homo sapiens
ccttagttattggagatgaagatgatataaagacaacaggataccccaaaccttgatccctggatggctgcaaggattttgagaccactttgaagctgtgtacagaagacttttccacaggcatacacaacaccctgccttcataccctgaaggaatgaaagctgttgacattacttggaagaaaataaagaacttgaatctgtttttgtgctatacaggtattcaactcggtaaaataaaactagttaatgaggaattaatttaagatactgaaaagtgcattgatatatcaagtaaatttgtacttgtgcaataaattaagcttagaggttgcctaagagagaggtaaatatgtcacattcaacttaaatatctggtgtattttaaaatttagacctatagaaagacaaaaataactgccaactcatcaatcacccaactcttaaacaaaatcagattatttcagcaattattcaatggttttattacgatgatacacaacagttatttacttccacttcaatgtcccttaaatatctacttgtttgcactataacatgagcagcaagaagtcactaggtttataaactagagtgtcactgcacttttctggaaaataatcagcattttgggtccctgggttttaaaatctgggtaagtaaaccacatcatcgtggattctgtagaatgaaaagcaataagccagaacaaattgaatttaatacaatatgctatatctctgaataaaa

SEQ ID NO: 5188 - DNA, 776 bp, Homo sapiens
ctagagtttcttgcaaaatcgtcctatcctgcatgcactcttggatactctttcaactcagaagtcaacataaagggtaatcaacttcagagactagaattataagagaaaaacaatgaggacagaactctccagaagactggaatgcactatatacactaaagcaagatgagactggttttatggggactatgaaaaccaaaagaggctgggcaggtggctcatgcctgtaatcccagcactttggaggcagaggtgggcggatcacgaggtcaagagatcaagatcatcctggccaacatggtgaaaccccgtctctactaaaaatacaaaaattagctgggcatggtggcgtgtatctgtagtcccagctacttgggaggctgaggcaggagaatcgcttgaacccaggaggcaggggttgcagtgagccaagattgcaccaccgcactccagcctggtgacagtgagagactccgtctaaaaaagaagaaaaaaaaaaaacatggtgtgaagaccggatgttccatgagcagctgtgtcgaattgcttgcgctgtgaagcctagaaaggattaaaaaattcaaatgcagctgagagccattagcgatcccagaaaaaacagtgggaaaattgagaacctgctccagtgtggtaatgatgaaagtattagcagtggaggggactaggtgcctattatttctcaggaggggtgtcctcggctaaaggagagtatgaagatataaacaaaggtgcagattcccaacgagtgctgg

SEQ ID NO: 5189 - DNA, 807 bp, Homo sapiens
cagagtttcttacaaaatcgtcctatccagcatgcacttttggatactctttcaactcagaagtcaacataaaggttccacagactgtacaggaggcaaggctgtggaggcctcaagaaacatacaatcatggtggaaggtgaagaggaagcaatcacgtcttcacatggtgacgggagagagacagagtgaagagggaagtgccacacacttttaaatcatcagataacatgagaagttactcactatcatgagaacagcatgatttaatcatctcccatcaggtccctctctccacgttgggaattacaattcaacatgagatttgggtggggacacagagccaaaacatatcattctgccccttgaccctccaaaatctcaaggccttctcacatttcaaaacgcaatcctgctttccctatagtcccccaaagtcttaaatcattccagcattaactcaaatctccaagtccaaagtcttacctgaggcaaggcaagtttctcacactggtgaacttgtaaaatgaaaaacaagttatttacttacaagagaaaatgggggtacaggcattgggtaaatgctcccatttttaaatggaaaaaattggccaaaaccaaggggctacagttcccatgcaagtccgaaacccagcagggcagtcattaaatcttaaatccctcaaataatctcctctgaccccatgtctctcacccagggcatgctgatgccaggcgtggcctctcaaggccttcagcacctggtgcccctgtggctattcaggatacagcccctgcagttgcttt

SEQ ID NO: 5190 - DNA, 772 bp, Homo sapiens
ctaggacatatgtccttggaatcatgagctgctgtgaaaaaagcctatgaccctgaagccactatgttggagagacttaatggaaaggcccatttggagaggagaggccatcagtcagaagcaggcatcaactacctgacataggagggtagctgtctttagatgattgcacttcctcatctttgagtcttccatctgagaccgcagacgttataaggcatagaaaagccacctctgttgtaccctgttggacttcttagtccataaaacctaagagcaaaataaatggctgctttatattatacatgtttattagtgtgagagcaatctgttatgtgaccatagtaactgaagcaacaatgaagaaaataatttaaaactagctgatctactatacataatggttcccagactcatatactaagactctccataagaagtcttctactggccatctgtctccttagggtctggctttctaccatgttgtaaagactgctctactgctcagttggaatatcttgaagagatcttgtcacttcctatttgaattcaggccctcagaaaggaaaaacagcatcctaaagaagaaaaaattctagatatttgaaacatcactggcaatgaatactcagccaatgacagttcatggaaaagtgcctgagcacccttattaattcacagcttttcatgccatatgggttccttggttatttttacctaaccaaactatgttttaaattgtcttatcctaaagtgaaaatgtgtctct

SEQ ID NO: 5191 - DNA, 799 bp, Homo sapiens
cgaggccgattttttttttttcactttataaagagtttaatgtaaatcacaatggaaaataaaataagaggaggtaaatatcaagatgttaaatagtaccagaattttgtaggactctcccagccacagttaagggctacttttcctaacttctcattagaagatttgcaagagttttgctcttccttctcgtgtctgagaattgaatttatcaatcacccaaagaacaacaaaatgatttgtaacattttcatgaaatataagcctcttctttatcaaaagtagaaaagctgtggtatattagatgctccttagggattagttgattgaacaattaattaattaatgctaatttaaaaactttgaagtaaatagaaccatttcctatttggatgaaacactgtccttctcctaagaaaatgtattgtgaaaaaaatagaagttccacctttgccccatcatttaggcttcagagccaatttttccaggacctttactctaatctgccgagtttttacacaatacgcaatgggattcatcaaggggtggtaccagcaagaatgcatctgctatcagaatcatagctaaagggggatttatgcttagcaaagcgacgcatggtagccaaggtgatgatgggcacatagaggacgagtacagcacagatttgagacacaccaggtgtcaagagacttcgaggcactccccatgggatgcaatacccaacacagtcttcaggatgaacacatattggaaaatggcataaaaacactgtctgacatcatgcagagtgcaacgg

SEQ ID NO: 5192 - DNA, 936 bp, Homo sapiens
gttagagtttcttacaaaatcgtcctatccagcatgcacttttggatactctttcaactcagaagtcaacataaagggggactaggtgcctattaattctcaggagggtgttcctcggctaaaggagagtatgaagatataaacaaaggtgcagattcccaacagagtgctggaacagagaagctgcagaagctggaggatctgaaggctttccattcttggtctggaataaggtagccataagcctgacccatgagtggataagctagtgacctatctgtgatgtttctgctcaatacctcagaagttgaagtctccacattcctattgattgggataccaggacttgagcatgcacacatttggatctctatccccatctgccttatgtacctcatggacatcctgggcaactgcaccatcctatttgttatcagaacagagcattccctgcaagagcccatgtactatttcctctccatgctggccctgtccgacctgggcctgtctttctcctccctactcacgatgctgagaatcttcttgttcaacaacatggggatttctgctgatacatgcattgcccaggaattcttcatccatggattcacagacatggagtcttcggttctcctaatcatgtcctttgatcacttagtagccatttgcaaccccctaagatatagctctattctcacagcttcagggttttgcaaattggactggcttttgccattaaaagcattctcctagtgctaccccttttactttaaagagactcagatactgtaataaacgccttttatcccactcctactgccttcaccaggatgtaatgaagctgggctgctctgacaacagggttaacttttactatgggtttggtctgtgcactcctgttgaatgtaaacagtgtttttattggtttttccttat

SEQ ID NO: 5193 - DNA, 599 bp, Homo sapiens
gctgctactctcctgcctggccggattccatctactcaaaacaaggtctcgccgtcacccaggctggagtacaatggcacaatcggctcactgcagcctcaatcacccaggctcaagctatccttccacctcagcctcccaagcacccaggaccacatgtgtgcattaccacacctggctaatttttttgtttgtttcttgtttgagacactctcactttgtcacccaggctggggtgcagggataccatcatggctcactgtaagcctttacctcccaggctcaagcagtcttcccgcctcagcctcccaagaagagagatacagagacacggaggagacagacacacagagaaggccttgggaagacagaggcagagcctggagtgatgctgctacaagccgaggaacccaagactgaaggcatgggatgcttctccttcagagcctccagaaggaacctaccctgcctacaccctgatcttggacttgcaccctccagaactatgaggcaatacgtgtttttgctgttttaagctgccctgttttttgtactttgttacagcaacaatacacctttgaaatgtaaaaaaaaaaaaa

SEQ ID NO: 5194 - DNA, 774 bp, Homo sapiens
  misc_feature (1)...(774): n = A,T,C or G
ctttgaagacacaaaggaaaggagctactggtggcctgtcagttctcaacactctgccaaaagacctggctgtcatcacgaggatttatcagcttgccttacaggacacctaaacctgtcatgaggctcagggttcctgaccaaagtcactaaagaagctattacctgagagcccagcaaatactgtggcctggagcaatatttggtgcacagaagtcaagaattgaggttttttaatctcagcctagatttcagaggatgtatggaagtgcctggatgtctaggcagaagtttgctgcaggggtgtggccctcatgaagaacctctactatggcagtgtggaaggaaaatgtggagttggagcccccccacagagagtggcctctagggcactgcctagtggagctgtgagaaaagggccaccatcctccaccatcttccagaccccagaatggtagatctactgcttgcaccatccacctggaaaagccacagacactcaacaccagcccatgaaaacggccaggagcagggctgtaccctgaaaagccacaggggtggagctgcccaaggctgtgggagcccaactcttgcatcctgtacgtgagacatcgaaacaaaggagatcattttggagctntaagatttgactgctccatggtggcacatgcccgtaatcccagctactcgggaggctgaggcaggagaatcgcctgaacctgagagatggaggttgcagtgagctgaaatcgcgccattgcactccagcctggg

SEQ ID NO: 5195 - DNA, 729 bp, Homo sapiens
caggaaactttctgagatgcaagtgggtgttaaatggttcagcaaagccaagccagagcagttggtgtgctttgaaatgaagcaacattggaaaaatgaaatctactgaaagatcactacgtgtttcaaaggccttcagactcagactggaactgcaccgttggctctcctgggtgggtctccagcttgctgaccacagaccttgagacttctcagcctttagaatcatggaagccaattccttataataatatatatccttttcctagtctgtggacttttcccagctccagacagacaaccttctataaactccaggatgctccatcaatgccgtctggactctacagattttgaccctgaagtaaagtaggaaaggctatgaggacatgttaaatgttgtactaccgcctgaagccttttcttctctaaatttttcaacaagagttgaatgcacacgtggagcttaattggacaacaacttttctcctcttctgtgggatcccgtcagtgctttaagcaatgagaaggcagctcatttccaagtttgtgtggtaaatttggggcaagtgggagaaaagaaagaaaggctgagtcttatagggtgtgatttggctctagacatgctttgttactttttataagattatccatttgactagatttctttcctgctgacaaaagaggcaatttctacatataaaataaatctgattaaaactcaaaaat

SEQ ID NO: 5196 - DNA, 798 bp, Homo sapiens
agaatgcaacagaagagagtgcacggcttctgaggttgcagcttttgggagaagccatctaccattgatgacagacatgccgtgtggaaaccaaaccagccatgtggagaggctacctggacagaggcacagggccagcagcagctgtggagacagacatgtgagcaaagaaatcatctttgatgtacagccaagttgagccttcagatgactccgatttcagccacctttggactgcaaccacatgaaagactctaaatagaagcctcccagctgatcccggttaacccacagtgctgaaggggataataataaattgttgttttaagccactaagttttgtgggcctttgttgcatagcaatagattatccaaactattttttttattgcaaggtattctaggtgtctgctgagctcaggaaactgggaactccttcaaggcagggcctgcagtttagcacctttgttattgtgagagctaaatccttcggcatggagaggcaaacctggaatattcaaacagtactttgttagaagtcttgggataacataagaagcatatgcagagaagtgtatgaaatgctaatctgtctactaaatgtatcttattcattttctgctgtgggccaccatgggatgcttctatttcaggcacttgaccagcttctaggtgaccgaagtcatttttttctttacctacttttgaaaaagtaatacactgatttaaaaaaaattggtttaaatgggaaagatccaaagtttccctttattcccttcacagccttctgattccttt

SEQ ID NO: 5197 - DNA, 275 bp, Homo sapiens
gaactgcccttaggagatcagaatatcaaaccaaggttgagagtgtcccatctcaggaaagaatgaacaattgatttacagccttgttgcctccagctagaccaccaggtggcccattacccaacataaccattgcaactagataatgctgacctgcatactctacccctcagagctttgccccgtcctgcctgcatatctacccccgatatttattctttattttttaaataatttttaattaaaatatggaatgcttcacaaaaaaaaaaaaa

SEQ ID NO: 5198 - DNA, 359 bp, Homo sapiens
agaatcttgctctgtcaccaggctggaatgcagtggcgtgacctcggctcactgcagcctccacctccctggttcaagcgattctcctgcctcagcctgctgagtaggttttggagttaagatttgggtgccaatctcataaaaagaactagagactattcactgttttcaacttcctgaaagaattgatgtctgatttatgttatttcttatttgcatttattctttttatgtttgcaaagatgcatcaatgattctatctgagtctaggattttcataattgtgagaaggtttttaaataatgtgttcaattgttagactattaaagaatgacatttaatccctaaaaaaaaaaaaa

SEQ ID NO: 5199 - DNA, 362 bp, Homo sapiens
tagatgagaaattgggatttttcagatgtgattccgttgtccaagattcttaagatgaaaacaaagttgatatctcactcacttcgatttgatgcactttacctcccatagcaaatatttattacatccgacaagacaaaggcaacgggcagaaaagtgtacagccatttctgtcacactgagaatcaagcctggattgcctccagtgagaagatgatacaggactattataaggacaagatttttcaggataagacacagttctcatgtgttcagacagattgcttttcaaatcactctgtatagggatgggttaaacccagctctaaaataaatatttatatgccctaaaaaaaaaaaaa

SEQ ID NO: 5200 - DNA, 340 bp, Homo sapiens
cctggttagatagtacagaaatgttgggagtaaagaaaatagaaacgccattttcctactcccctccaggggcagtcaagatcgtgtaggaatgagagctacgggaatggaaaggacttcggattaatgagctgagagaaaataaggagaaaacatgactgagaatcatactagtcaaaaaaacagttaaaatatatcataaaaaggtatttctttaaaatagctttttctaatttaaaaaataatacatgttcatcttaaacttatttataaaatgcagggaactgtaaagaagaaaataaaagtcactgacagtcctattgagttaaaaaaaaaaaaa

SEQ ID NO: 5201 - DNA, 265 bp, Homo sapiens
cctctgatcaatccttttcctacttgtgccgaccaccgcacccctgctatcaaaccacacttcttgtcgggattttctctggtgcagcataaatgctactacaacgtttacgaaggaagtgattgcgcatgagtttgttctatgtatcgggttcacattacaatttaagcctccagtaatgttttcattttctaaaaatttcaattctaaatattcctatgtgagaaaagtgggaataaaactcaaatgagcaaaaaaaaaaaaa

SEQ ID NO: 5202 - DNA, 347 bp, Homo sapiens
cctgatggagcagggaccctcccgaggagacgagggtgtgggggtctgccccctccttcaggagccgaagcactgaaaacaacagagaggagaatggagttacagagagtccttcttccacgtgtggaaccaaatgtgtaggctttcgttaatatctaaaatgcaaacagctgtgaaaaccaaagactacggcttctgtgccatctgaccctatttattatgatgattggtggtgtttcttgtcatcttcaaacttattccatggttgggcaacataatttcgtattacaatcatgcaaatgaatgagaaagtgaaacagattttttaaagtttaaaaaaaaaaaaa

SEQ ID NO: 5203 - DNA, 421 bp, Homo sapiens
cctacccgttcagcctggtcatgatccattgctggggaactactgtgatcatttgtagggagtcatgccttggattcaccactctcatgtcaagatggttccagttcagcagattgaccttctccccacagtcatgccattagaatgggaactgtgctgaggatttccataagggctaaggccaccccaacatcgattggaagcctacccctgacacagacttctctcagcctcctatttttgtgaggctttggctgctcttagctgcttttcaaaagaaagccacaagagaagatatggatgcttcttagattcttgatttacttgttgcttgctttgtcctaaatttctgttaatttgtgatttgtgtgtgtgttacttgaaaaattaaatcatttcttcatgatcaaaaaaaaaaaaa

SEQ ID NO: 5204 - DNA, 793 bp, Homo sapiens
ctttggccaatagcttatccagaaattagacagaactatgggtttactgcaaatgaccagcatccgcaaagtgatcaagactaccaactttgggtaatgtgtcccacatctcagatgtcagttgatataagacattacagtaaggaattatgagtgttcactctgcaatgaaaaaatgaaccagcagaaggtgaatgtgaaagactaagaagagccctgcagaaaacccgttagcccatgttttcatctgtaatgtggatgtgggataggaagagggacaacgacatagtaccgaccaggttccagaaactattccaagtgctttacgtgataaaaatctcttaattgtctcaacgaccatacgaagtatatctctagtgttgcccctattttatagatgacaaaaccttactgatatctgtatagctagtaagtaggagagacaggattcaatctgtcagcccaactctgccggtgcccgtgtccctgctctgtgatcctgacaggcagccacagccaggagtccgtccttgttttagatatttcccatgtctgctgctcaactagaccctaacggggggattcttggtacatccttacccaaggatgacccataagttttcatgacattaccacggactcgtcttgcttgtgaaaccaagaatagtaaaaacagaagaatcatgtgttaaaaattttttgaagaaatgattctgtaatcattattcttaagaaagtgatgtccccaaggcacacacttaggcactggtcagtcctggggcaacaccccttg

SEQ ID NO: 5205 - DNA, 227 bp, Homo sapiens
cctagttccagattagatggatattcaacataatcatatggaaggataagcaacaacacaagtcgcctcctaactgatctccctactacctccagtccatattcctcacatcagcaaaggcatcatagtacttctctgcttaaaatgcttcaaggatgtatattcttaaagtataataaaataaataaataaataaataaatggtgctaatattaaaaaaaaaaaaa

SEQ ID NO: 5206 - DNA, 783 bp, Homo sapiens
cctagaacattcctatgaatgctccttggctgagactgaaggaaattactgcaatcaactccagcaaattcaggatcagataggggtgatggaggaacaactgcaacagattcgaacagaaacagaaggccagaagctggagtatgaacagcttcttgatgtaaaaatatttttagaaaaagaaattgacatttattgcaacttactagatggagaagaaagaaaaagcaaatccacatgttacaaatcaaaaggatacaggcctgtgaattctggaaatcaagccaaagactcaacagaagaagctattgttaaaacagtggttgaggaactggatcaaattggcaatctcctttcactgagagtccactcagttgaagaaaagtcctctaaaataagcaacattacagtagagcaacgagtaccttctaaagcaccataatgaggaaaaagttatttggaaagaaagaaagaaagagagagagaaaaagaaagaaagaaaggctgcctttgcaaaaatcctactggtcaaataacctaaggaaattattcatttctgttcttaaaagggctagaatttggtctccttctcttcctcttctcatgttccatgcattgaatccttttccagagtagaaaaatcctgctctgtccctaatttttgtttttattttgggggccttttttgacatttaattaaaaattttttctatcgccagttatttttttttaataacctgggtcttttttaacttcttaaaggtcgatcccaatgggggcaat

SEQ ID NO: 5207 - DNA, 387 bp, Homo sapiens
cctaggataaagaattgctgattatagaccaatttctggtctggttacagaggctttataagttttagaatatttgaatttcttgttgtaatttcttatcaaagattattaatccatatgcataatttttgtaccattgtagacgtttgcttttgtacatctgtaataaatagaagtgaactaaacatcagagacatgggtgaagtattgagtagtgaggttagtttttggacatacttatcagaatttatacattccgatgaaggttgtcttctgtggcagaggattgcatcattatacttttcaagattgtctaaaacatttatatgaataatagcttaataaagctcatgaatttatatatctaaaaaaaaaaaaaaaaaaaaa

SEQ ID NO: 5208 - DNA, 827 bp, Homo sapiens
cccccctccccccagggggtacggtcctcagaagaagagagagacctgacaggaaacctggcattcctctaccttggccccacggccctcctccttctggctggctatggctgtgtcctcggtgcctccagtgggaacctgcgcacctttgtgggctgtgccgtgagggagtttactttcctggccaagaagccaggctgcaggggccttcggatcaccacggatgcctgctggggtcgctgtgagacctggagaaacccattctggaacccccctatattgaagcccatcatcgagtctgtacctacaacgagaccaaacaggtgactgtcaagctgcccaactgtgccccgggagtcgaccccttctacacctatcccgtggccatccgctgtgactgcggagcctgctccactgccaccacggagtgtaagaccatctgaggccgctaactgctctctgcagacccacctgtgtgagcagcacatgcagttatacttcctggatgcaagactgtttaatttcgaccacacccatggaggaggttacctgtcgccccttaggtccagctcaggcaaaaggcccaaatgcagcctacttatgctaaaaagttaaaacaataattcgtgccttcaccaaaataatttctgccagctcacatacctgcgaattaatttttctttgccttgagtcttggaacataatttgtgtattacaatcctccccccattgcggacttataatatgctaatgatttaaacacctgggatggtattaggatatgcggcttgaaagtcttaagttctcatggtcatttaaactctgat

SEQ ID NO: 5209 - DNA, 252 bp, Homo sapiens
ctaggagctgccttgtagggtccaagcagacccataggaagagaaaggccccagggactaaaagatcaagaggagagagaggaaggagggagcagatccagccagcccccagctgttcaagccatctcagctgaagagccagtgtcaaccaacaccctgtgaagcagagttgacctagctctgtcaagtcctgtccaattgctgaattatgagcaaataaatgagtgctgttttaagctaaaaaaaaaaaaa

SEQ ID NO: 5210 - DNA, 275 bp, Homo sapiens
aaccataaaacaaacttctacatggcaaaataaatctctacatggcaaaataaacctctacatggatagagatctgtctcagacacattttggtttccatgacttctgaatggcagcatgaggagctccaagaaccctctccccagtgaaatgaccataatctctggaaattgcttaagatcaaagccacaactatttaaagcctttggaaattgttttatggggatgcggcaaattaataaacttttattcaagacaatgtaaaaaaaaaaaaa

SEQ ID NO: 5211 - DNA, 419 bp, Homo sapiens
agtcctagcggcacatctggacaccaaggtgtggtgagcctccagaagataacctggcctcctcaccccaggcaatgacccaggagtagcggaattactagaagaaccacagcccagcagagaagtcatcctcttcgcttattatgttattccatagtagtaactgaggcactgcagagaaaaagtctcaagattaaaacctcaaaactcaggagtgaaaagtggaacaagcgaattatagaaaagcctggcttgaaacacactccaatcagacattcccgttttaccaagagtggtacatcacagtactctatggatgccagctaccgtagttctttttcctttaggagagactaagatactgggaaatgaacgttgtttggtcaggaataaaatggtgaaagataaaaaaaaaaaaa

SEQ ID NO: 5212 - DNA, 364 bp, Homo sapiens
agatgagctatgttgcccaggctggtcgcaaactccaggcctccgggaatcctcctgcctcagccttctgaagtgctgaaattacagctgcttcggcgacagcacggaatagacggatcattggtggaaacagggatggagatatgccaggagtgtgcaatgaagaataagaggggagagttcacacatttccataggaagagagccacaccgcacaaacaacaggtgtaattctaaggtgctgtttctccgaatgccacacatgtttaccactgctcatctcaaggaatcaaaacccagtttcgacttttatacaatacccatgaaagacttaaccttctataaaaatatgtgaacaaaaaag

SEQ ID NO: 5213 - DNA, 293 bp, Homo sapiens
taggccgtgtcactggcgaaaagacggagcaccagagggtttgtttttagctgcacggctcctgggatctgtgacagaaactgaccttctagtacaccagacccttaaagaaatatctgccttccttccatgtcaaggattgacttaaaaggttttctgggctaatagattaaattactctttaaggccaaagggctgaggtatggaattatacctgatgtaagaaagaaagaaattaataagaggatatgaaggtaataaatcttcctttatgcgtaacaaaaaaaaaaaaa

SEQ ID NO: 5214 - DNA, 267 bp, Homo sapiens
ctgggaggtcgagaagaggagtcaaatgtacattttggaagtcttgcccagcaacctattaaagagaatattcttcataaaatattctacagagaaacccataacagtggttgcttctggtgaagagatctggtggttggggcaggggagggtgagaagcatacttttcaatatataccctgttgtacttttggaattttgtaccacatgtatgtattacctagtttcaataaattaaataatttctttaaaataaaaaaaaaaaaa

SEQ ID NO: 5215 - DNA, 307 bp, Homo sapiens
agcaagccccatgtggtgagctgccctactgagaagctcacatagcaaggagggcagcctccagcctgcagccaccgagaaactgaggtccacagggactgaaccctgccaataacctcttgatgagcttggaagtcaatccacccccagttaagcttggagatgtctgcaggcccagccatcaccttgactacagcctcacagccaacccagaagcagagagcccggttaagtgatggccaggttcctgactcacagaaactatgggataataaatgtgatttgttttaagtcaaaaaaaaaaaaa

SEQ ID NO: 5216 - DNA, 510 bp, Homo sapiens
cctaggggtctccaaagactgaaatcaagatgtcagccagcctagctcttcactagaggctttggggagaatccacttccaactcatcaaacaccaatcagaaacatcagaaacaaacagaccacagaaaaccagagtcaaaaccggcattttgtcaactgattagatagcagttagtttaatgctaacattaatcaagggctgattgctccattgtgaggaacaaggactatgtgcaaagattaatacacaagatctggttcagaatatctctgcagaaaccccaatgcagtaattaagaagaacacaaaatgaaggttattgatccgttatgttattgagaaacaacataattgatatgttaaatcttaattgttcattccaaagtaaaagagacagttctcacagatcattagtaacaagatttttttgttgtttttatcatttaaaacaaaatattgagttcatatgttaccctacttcaaataaacattgatttaattgtcaaaa

SEQ ID NO: 5217 - DNA, 291 bp, Homo sapiens
caggaaacaaatctggtagtctgaaaaccagggctgtgactctacctctttggcatcccactgggccagatctgttttactgaaaatgccctgctgctaagactatatgagcaccttctctctaagcccagtaactgtggtggatgaggtggacgcgtgaaatggtgaagggttggttttaagggatagaatcagttcaaggtcaggccctccaaatcaaggatgggtacaaagacacgtaaacagatggtaaaataaaggactttgtcttctaagcgaaaaaaaaaaaaa

SEQ ID NO: 5218 - DNA, 276 bp, Homo sapiens
tggtagtctgaagaccagggatgtgactctacctcatttggcatcccgctgggccggatctgttattcactgaaaatgccctgctgctaagactatatgagcaccttctctctaagcccagtaactgtggtggatgaggtggacgcgtgaaatggtgaagggttggttttaagggatagaatcagttcaaggtcaggccctccaaatcaaggatgggtacaaagacacgtaaacagatggtaaaataaaggactttgtcttctaaaaaaaaaaaaa

SEQ ID NO: 5219 - DNA, 274 bp, Homo sapiens
agtgctaacttcatgttttagattttgtgtcgccttcggcacgtcaggtgatcattcacagactgtggtacatctacaccattaattactatgcagcagtaaaaacagagtggactacgactacacacagaagcttgggtagatctcgggaattatgctgaatgaaaaaaagccagtctcaaaatattacatgctgtatgattccatttatataacatttttgaaataaaaaaattatgaaaaaaaataaaataaaaaaataaaaaaaaaaaaa

SEQ ID NO: 5220 - DNA, 624 bp, Homo sapiens
gtaggtgccctgctcaattagtttatggtaattggccagcatctgccctgtttccattttcctccaggtacaggacaaagaaagaactgagagtcatcccttgatcaggctcacctgagacaaatgcatatctgattgcttcatctactgtagaaaaaatggaaacaagaaaggaaaaaaaggaaagagtaaagggaaggtgaaagggaagaaccaaggaaaattagaaaaaaaggaggaagaaaggagagaagacaagacggaggaaaagagaaatatcttttatactacagttgttctaaaatatttttgtttctaaaaacattattcaaaggacacacaaaaccaagcttgtatcacaataattgatatataaaagcagagaggtattgggtcataagcttaaaactgtgctttgtcttcctttcttgtcaaattgttacagaaatttgtgatattatttatttttagggatgtccaataataaatctgacgtcttgtgccatttctgccacagaaataaaacaatttgatgtttcccctcacacactgctgaaacatatcagtgttttctgattcttaagttgtttggcaataaaaaatatttcctgaaaaaaaaaaaaa

SEQ ID NO: 5221 - DNA, 775 bp, Homo sapiens
ctaggccttaaccccgaaactgactattactggagaaggaaaggccgtgtaaagacacaacaagaaagcagaatctgcaatccaggaagagaatcctcacaagaaaccaaacttgccaacaccttgatcatggtcttccagcctccagaactgtgagaaaataaatgcctattgttaaagctacccagtctgtggtatttcgttatggcagcccaagtggaacaagacaactgaggacagtgtttttagtgtttttttctataaaatgggtatgacatttgcattaatctaataggaattttttcatgagaataaatgtagagacgattgaaaagtgttaggtactatgttaagataaatactatcatatgtatggaagaaaactttttaaagtcatagttgatataaggcacaaaaacatcttctttcaatacaaactgaattgaagtaagattggaagttaaacccagaagagacaggtaaagtaagtgctacataaagaaaactttgtctctaaaatgactagtgtggaaccagatcattctcaaattccttctagctctaaaattccatcacccttgtgatatggaaccgagtgagaaaacatactaaaaaagccaagacttatatgacttatattcaaatcatttaaagggcccatgccaaaatatactgaacagctgacattttcaaagctttcattttaaacagcatattaacaccaaatgggataagtccttgaatctgactggctgcgttttcttttaagacactt

SEQ ID NO: 5222 - DNA, 188 bp, Homo sapiens
ctaggtttcaggttatgaataacttcttcaggaattctttgctgactcctgtaatcctggtgtgattggtgaactcttatatacttcatgttagtgtacttcttatgtacttcttattataaaatttaagaagacaattgttaaacaaataggataataaatagatgttattattaaaaaaaaaaaaa

SEQ ID NO: 5223 - DNA, 817 bp, Homo sapiens
caaataaattacctctccgatatcaccttcaattcacccaaccttcagtggtagctgatggatggatcctgttcattcccacactctcacccagtcccctcctgtgtccagagcacacatctgtgagacacctggttgtagctggagggagtctgagttagtatatctgctgttgaggatcctgcacttggagacaagaagacctgagttccagactctcactaccttggacaagtcacttaacttctctgtggctgcattattttaattgaaaattataaatagtaaacctattcttcctaacttataggattactgggaaaataatacgaaatcatgaatgtgaatgtatttagtgaaatattgcacgcattgtggaaatttgggaagtttgatgttaaccccctctttcccactctggaccctgaatataacagagatcctacttcatcttctaaattattgtcggtacgaatatacactgtttcatgccgtttcaatgtaatcacattatgcatccccctcactatgcccaaatccattgaaatcgtaccatttccctatagcctggctagcaactcttattattttaacatctaccaatgtcaggcaacatttgctttcaacatcattattataatcatgccatggtaatgagagtacacatcccgccccccatttacagttaaaaatctaatgtattgccctccggtcaccccaattctccacgtttttctattcactgtatcaatcaccctggcctgggtagaccaatacacgtgcacggttcctgtctttataacccggccccattcct

SEQ ID NO: 5224 - DNA, 432 bp, Homo sapiens
cttggggatgcagcgctggaggaaggcactgggtatggatgttgaagagagaaacccaaagagttccttccatactggaagaagacaggaaactggaaggattttgtaaacggcttgaagttctttatgaatcaagtgatcctgtctttcaaagaagatctaagttgttctggtgctagattgaaatccagctcacttttatctgtccgtagtgctgagaaaataaaaggtactcggtgagcacttctggactacatctcctaggaccgtgccattcaaagtgtgaccaaaagtccagcagcatcagcatcacttgggagcttgttaaagcacatcaaaatttgcactgttctccctctctttcttccacaattctcccatttctcctaaaggcccatcatattaaaccagtgcctcttaaaaaaaaaaaaa

SEQ ID NO: 5225 - DNA, 901 bp, Homo sapiens
tcagctctaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagaagatattgagacttaagactaggtgaaccaataccatatctttctttcactgagaagacatatgcctgttactgtattgaggatagacagaactacactatttgtccttgggacattatccatcaacattacattaagagaacaacattgttgcattgtactacagacaggcaggacccatatcttggctttctttactgacaggtggagccaaccctatagcattggatttcttcagtgggtcaacctaagccccctgtacctgaggatggcgcacaaccacatgtctgtgggcctaaaat

SEQ ID NO: 5226 - DNA, 521 bp, Homo sapiens
tcaaccatccatcggtgtgtggtccacaggtgatggttacggctttttctgcgagacaggagccgcacatttggtgatgcaagtggattccgctctcatctttctcacagagatgataccaggatttggtgaagaagccacatgtcaaagaatcccaaaactgctggctttttagtcagattcccttttaaacagggaacatcagactttggaaagcagggtggagtagactgcattgggaagcaactgtattgactttttttatttgggggtgttggaagattctctcatctgtggttctcttggtataagtaatcctttatcaccttcactgtttgctcatggccaactcatgcctcaaccacctaactcctgtgtttcactctcctctggggacccttcactccaggagggtctttggggaaacctccactaaaggagggtcaatccagcctcctttttgtgggtctatttccagcctataagatataatacaagaactaagcccaaaaaaaaaaaaa

SEQ ID NO: 5227 - DNA, 482 bp, Homo sapiens
aggaattctttggaccttctgtgaataagccccagtcgtctgtcggatatgttacagagaatatcctctcctcttccagtctctggctcgcctttccactaggttttttgtttttttttttctgagacggagtctcgctctctcacccagactggagtgcatggcatggtctcggctcactgcaacctccacctcccgagttcaggtgattctcctgcctcggcgtcccgggtagctgggactgcaggtgcccaccaccatgcctggctagtctttgtattttcagtagagacgggatttcaccgtgttggccgggctggtctcgaactcctgacttgtgatccgcccatctcggcctcccagggtgccgggattgcaggtgtgagccaccgcacccagacgcctttccactctttaatggtatttttgatgaacaaaagttcataaatgtttaatttacccatcttttaaaaaaaaaaaaa

SEQ ID NO: 5228 - DNA, 472 bp, Homo sapiens
caggaattctttggaccttctggatataagccccagtcgtctgtcggatatgttacagagaatatcctctcctcttccagtctctggctcgcctttccactaggttttttgttttttttttctgaaacagagtctcgctctctcacccaggctggagtgcatggcatgatctcggctcactacaacctccacctcccgagttcaagtgattctcctgcctcagcgtcccgggtagctgagactacaggtgcccagcaccatgcccggctaatctttgtattttcagtagagacgggatttcaccatattggccaggctggtttcgaactcctgacttgtgatccgcccatctcagcctcccaaagtgccgggattacaggtgtgagccgccgcacccagacgcctttccactctttaatggtatttttgatgaacaaaagttcataaatgttcaatttacccatcttttcag

SEQ ID NO: 5229 - DNA, 705 bp, Homo sapiens
ccagacgctaccaggggattttttgggttaagcttaaaaaagttagtccccctcctcaagttaaaaatatttttaggtagggagaatttttcaaaaccttaatggttttgcccaagagtccttttttggaactagtggacagcagcccaggctctatgcacaaacgggggcagtggaacccacctgcacatgtgaagattcacagacgcacacatcaccatcagggagcatactatgcacgctcccttcctctccctctccagaagaggagacagtgccacagtcagaactgcagctacagcagagctggagaagagcctcagagaccccagagcgtgttaggagacagactgcagccacaaacacatgtgtttacccatcagtgcctgctctgcttagtgtacaagtttcagctgtgggttcatacaggcaggagctccccattccagctagaagccctggaatctcagctcctgccctgatgctcccagatcacagaggcaacacctggagtcgccagagcctgcttgaagccatggggatatgtgccacctactaaggaagacagaatggagaacagaggaaacctgaggctcagacaccatcacagagctgcagccactgtctgaattgtcaacttctggacttcctgttttgtgagcaaataaaccactttgtttttaagccaaaaaaaaaaaaaaaaaa

SEQ ID NO: 5230 - DNA, 232 bp, Homo sapiens
atggctgcaagttgtctgggctgatttgtctatctgttaatagctcccgtggtcaaaactttcacacagatacaactttcactgcatgctccagaaagtatttcctccctttgtctctttaggcctaggagtagtagtaacttttgagtatgccatctgttttttgctaagaccctgactgatatcgactataagatccaataaagcttacaaattgtcaaaaaaaaaaaaa

SEQ ID NO: 5231 - DNA, 651 bp, Homo sapiens
agcctgaattgtattccactgtgacaaaggggcaaggccaagacagaatgtcctgggggacctgtcaccggacgcatgcaaggaatggaaaagaaatacattttgaaatgtacataattaaaaattgaatgaataaagtatgaattgaaaattttctctcaagtaatggaaattctctcttttcaaaaatatatgatataataaagcatatatagaaatcagtacattaactttggtggaaaatttcataaaatagaatttatcagaattactgcatgtgtagggcacaaatctgaagcagctccaaaaacagcaagcatgtaagtaacaaaccctgtgtgaaaaacgagatcagccgggcatgggggctcacgcctgtaatcccagcactttgggaggctgaggaggagggatcacctgaagtcaggagttcaagaccaccctggacaacgtggtgaaaccacgtttctactaaaaatacaaaaattagccggacctagtggggggggcaccctacagtcccagcaggagaatcgcttgaaccccagaggcagaggttgcagtgagccaagatcgcaccactgcactccaacctgggtgacaaagcgagactccgtctcgaaaacaacaacagcaacaaaaaaaaaaaaa

SEQ ID NO: 5232 - DNA, 852 bp, Homo sapiens
accccccacacacgccccccgcaccaccatccacctctcctccccattcctcctcccttccccccttgttcgtatttgctttggagacacatgctgtctatcacaataatgatgggactcacggcatggaggatggacagaggagctttctcctggagtggtatttctggaatttctagtgtcaggtgctacttaatacctctcacaagaaaagaagaaatccctctgccttttaatgttctgggaatagaaagaataaaggagactgaggtgaatccaccaaggagtatatcaatttctatttgtctccttaatagtccaacacttcactcacacaacaatgttacgtagtttcatcaaatgatgagtccagcccctttcttctgcagaaaatgtcagttcactgctccttgcctacaaaatagaaattagagagataccagcttttctagccagactacaaaattactttgactaaatcgctaaaaattcagcctctctaccaatttccacaatacgtctcaaatggtaactttaatctctgtttgtgcttttcaggaatccaatgagcaaacaattctttctctaaagcaactctcccttcagcccattgtgttgtaggtcttttcagtcccctgagaactcataattcctgtagctgatgtccatcttccccagaatgtattaccatttattatttgcatgtatgtcctttttcatttgctttattcctatgggttaatgctctccttctcttggtttcttaaagataaaatccccttactttatttcaatgatggtggaaaagggtgcgaataaaggtatcaatgttcaaaaaaaaaatcggccttt

SEQ ID NO: 5233 - DNA, 853 bp, Homo sapiens
tttaggaggcacgatgcctacagactcattccctggatgccccttctggaatgctggacgtttgaggagcgaggaaggagagagagagaatccaacctgatatctttgcttgtaactgaatctccaaaggactgtagctcctgcagggtgatctctctccaagatcaagctctcagtgtgctctgtgtttctcctcttgtcccttcaagcccaggagtgggtaactgattgttgttgctagtttcttgatgcctctgaatcatttatatgtttccttaactctcccttaactttgtaatgattttttgtattaaattctctttatttaaaccatctaattcaatttgaatattgcctaatacaaataaatctcaagcagattaaaatttttattttctatatttaatgacataaagaagggactttctcagcaatatttagtgacaggtcataactatcattcttgcattaattcttgatcaaatctgagttccttatgcatctgtgtaaatatggaatctgctctcagaaactcaattgcacgcttactaagcattacttacttactcactcaggatcttttgtttcagcccaggtagcttagttcattttatcctttctcttttttatgtattttttgggtttaagattctatttttggttcacttttgggtgatatatttcccccatttttttctgtcaccaacagcagccctttctcaaatggactgcagaaacaccttctgtcttatatatctatatacaccattacatgcttacttgctacacttccacgtcttgctgcaaaatatgccattcagctcccccccttaccccttccctaatacccccc

SEQ ID NO: 5234 - DNA, 318 bp, Homo sapiens
gagaaccaacactgtcagttttggagtaagtaacaaaaataagaaagggaagtctatcctgatgcccttccagggaaaaatgggaagaaagagaagagaagagaagagacagagaggttatcgcaggagtgggactggtgactaaagaggaaatgagacctaagctagcctccttgccatgtgatactctgcaccaccttgagactctgcagagagtacccaccaacaaggaagctctcaccagatgcgcccccttgaccttggacttctccacctccagaacagtacaaaataaatttcatttctcataaattaaaa

SEQ ID NO: 5235 - DNA, 783 bp, Homo sapiens
  misc_feature (1)...(783): n = A,T,C or G
caggaacttcttggactgcttggatgaattacacagccattctttttacccatgcagaaaaaatagaagaggctgggcttactgaagataaatatttacatgaggcctctgataccctgaaaacgctgctaaattctattcagcacaaatacgttttccagtacaaaaaaggaaaatcactcaatgaacaaagaatgaaaatcttagaaagaatcatggaatttataaaagagaactgttaccaagttcttacatttaaataaaatttattgtgaaaggaaaggagcattgggtattggagtcagaaacctagctataaagaatgcctttattgacatgaatgtggaccataagtattctgatatgctgctggtgagagtgtacattggtataaccactttggaaaactagaagttaaaaagaacatcaatgattcaagatttctaatgcaaatcccatgacatagcaattacacccctaagtgtatacccaacataaatgtgtacatttgtgtactagaagacatgtatgcacaataatgttcatggaactactattcaaaagctaaacatacagactattcaaatgtctattaatattagaatggttaaggaaaattgtggtatattcccacagtgggatattagaataagtaattagaataagcaggctaactatatgtaacgatacccgtgaattggccaacataatgttgaaaaataggccagacttaaagaagtcattactcatgattncctgggcagaaagttcaaaaccagtaaa

SEQ ID NO: 5236 - DNA, 798 bp, Homo sapiens
atacataggtctttctctgtgcttacctgctgggatccactatgatgtctaccactgaggctgttcctcctctcaagactcaagaccctctttacttcttttaactccactagaggaaggacagcagtaaaatgttcaatgccttttgtgtctgttcttggcagtgacattcagttctctttataaaacaagggagtagaaagagagtagaagtgacatcttcacacacacataccgtttgctagatttgtcaaacagctgatttcaaactgttaatatgacacagaatcaatttttttgagtcaaacttttcattatacaatagaattgaaaagttaatatcagaataactgtctgttagtaagattttatttaaaaaatttggttgcatacacacctaaacattcacttacattgttatagcatatgacattgtgatgtaaaatatatttcttactctagtcacggtcataaacgatcgaaagccatgacttaagggcattatttagtgctgagctgtctaatatggtagctattttatttaaatgtaaatgaattaaaattacataaaattaaaatcagtgtcttaaccaaagcggccacatttaatttgctcaataattaacttgcggcaactttattcgtatgtctttgggtcccagccttttattcatcgcagaaagtttttgctggcagtgctgatgcaaaaacaatctaatactatatttgtaacattttctttatatgaaatttgtacataacaaataatgtccaacaattaataagaattgtggtggg

SEQ ID NO: 5237 - DNA, 795 bp, Homo sapiens
tgcttacaggaccgcactcagtttagtgaccgagacttagccacccttaagaagtattgggacaatggcttgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccatgagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacggataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcaccggagcctgatgatacctcattcagtgtatcttctttgtcagggaaaaatggctcaaaaagtttgtgatttcagttggagggaatatatgat

SEQ ID NO: 5238 - DNA, 791 bp, Homo sapiens
ttagatttcacctgattcttggctccaaagtttcaagggaaccagagctaatgaagacagcatggaagggctccgccgagacctacctgtgggagtccacctcaccctcaagaacagctaccatcttaacacagatggataaaccccatgaaagtgaacttcctaaatgcaaattctgatcttgaagccccagctggcacatctactggagaccctcccaagcaacaagatgtagatactttagagataacaaactatacaagttgtcttccattctttctccttcctctattttcaacacggataaaatacatatatatttatcttgctgagctcagtaggattatttagctttatttccatggctgccttttcttaatgtaatagaatttccaatcgagcttattacttccttccgtcacaagcctgaggtcctttcacacccatcctgtcctaggcaaagatctttggaaagtagcctgggacatacctagtggtaagccacctgctctgggttgagggtggatctattctagtcagaggctttgcggacctggacaaaggaattgagtatgtggctgtcaaactgtcaggcaatactaaatttggctggccagctgaattctagcagacaatcattgcaaataaggggtaccaattggggaaaaatggcccacaggaaaaacaaagggatgaaaattccgtaggactacacgggcatagaattctaacttgagggctgaaccagctatgtgaccttgtagtacaaggaccagtcttcagatacaaaa

SEQ ID NO: 5239 - DNA, 251 bp, Homo sapiens
tagaacagcattcctcccctctgaaccatacagccatcaagatatcatcttggaagcggagagcagacctcatcaaacaccaaacctgtccgtgccttgattgtggactttccagcctccagaactctaagaaaattaatttcttttcttgatatattattcattcttgaatattttgttatagcagcataaatggactaagacagcgtacttaaaatagaaattatttggaagttaaaaaaaaaaaaaaa

SEQ ID NO: 5240 - DNA, 252 bp, Homo sapiens
ttaaaatgcattgacatgtggacagaaccttgaggcagaaggcaagatttctggaggacatagaaagaaaaggccaagattgattaagagaagaccgatgaagaaaaagaagagcccataggaattcctgaattttggttaactatttttaagaatgttgacttcgcttagtgatatgcttcaggaacatgatgaacctattctgaagcactttaaatttattaaagtgaagttctcggaaaaaaaaaaaaa

SEQ ID NO: 5241 - DNA, 302 bp, Homo sapiens
agcatattaataacatcactgatcatcggcagagatgcaaattaagaccacaagaagacaccatctcacattagtcagatggctattattaaaatgtcataaattaacagatcttggtgagaatgcagggaagagggaatgcctatacactgctggtggaaatgtaaattagtacaacctcaatggaaaatagtatggagatttctcagagaatgagaaatagaaataccattcaaacctgcaatcccactactgggcatttacccacaagaaaataaataattttatcaaaaaaaaaaaaa

SEQ ID NO: 5242 - DNA, 324 bp, Homo sapiens
caggactcacaggacccaagagtgaaaacagggccagaggaaggtctgtgcatgccatggtgccacggtttccaaactggacacaggaacaagaccggggcagaagctacatttcagacataaagttggaagaggtaataatttgcaatggcttcagctaaccatgcacaatgggaaaaggacaattgtgtcatttagaacgtgctggattaaatataatgtcttatattaacatggacagattctttccaggttattatgcagagggagggagggtgcaatcactctaattaaatgaaattaccggcaataaaaaaaaaaaaa

SEQ ID NO: 5243 - DNA, 778 bp, Homo sapiens
aggtatgcaatggataatattctctccgttggcaagaaggattccccgaacaatgctgaaatgaagcagtaagagtatcttcgtcttgttttcgatttaaaagaataatttctatatttcccctttaaacctgatgtatactgtggaatttattttgtagctatcctttatcaagttaataaacattttttatttctatttgtaaaaattgttcattatgattgggtagtttatcagctgcttttaaaacatttattgaaatatatttcttcctcattgtcttaatgtgatgaattataatgaattagttcggaaagttgatatgttatatttctagagtaaacccaatttttatgaacatttaagatcttgatgaactgctaatattatatttagggttttaactactatgactatgagaaatattgtcttatgatatggctttcttgagatattgtgttagggtgttgggttgggtatgacatacgcctcaagacaaaatacgcgatggattcttcctaccatgcattccttgattcctaaccacacttcgtgttgccggtgtgctcttcttcccctgctttccgcactctcctgacgtcacattcccgctgacactcccctctgctagtaactttctccatgcgtgtcctcgtctgtttttatttcttgtacaatctatcatggtgtacataaatccggactacgcagaacatggttcagcatacagtcacgggcgaccgccgcctcgccctgagacctagagctgtttatcgta

SEQ ID NO: 5244 - DNA, 333 bp, Homo sapiens
  misc_feature (1)...(333): n = A,T,C or G
caggaatactggcctagggatgcaatcttgcaactctaaagcaatgctgcgtgcactgccatttctccacatccagctccgtgggaaaacacagcacggcaggatggggcaggcagctgtccacagccacgggctcctcaacaccagccaccgggctttccaggggcttgaagccaatgacaaagagggtggtgtgaactctggagaccaaggcacaaaggatgtgggtttatcatcaattcaataagtagatttattttttaatcattngtaaagctgctaaaattctacaagcctcttttaataaagtgttgtaatctaaaaaaaaaaaaa

SEQ ID NO: 5245 - DNA, 308 bp, Homo sapiens
caggaaaatctgctttttgccactattgaggcctcaatgcttactcatactgctgagaacacagagctgcttgctgaggaagggcccaactgtgtgctgatggtctcccagggcccatggagtggcctgatgacttacctgcctgcccgaagaggcccttcactttaccctatgtcccaagattgtacagcatgactgtctggggaggtggaggggcacagaggatttgtactctcatatctagccagagacaaagcctggaatcccaatatttactaaaagcctgttgaaatacaaaaaaaaaaaaa

SEQ ID NO: 5246 - DNA, 211 bp, Homo sapiens
  misc_feature (1)...(211): n = A,T,C or G
tatttattatattatataaaaaaantttgcaaaannttctaaacaacttggcttataacaccagctgataactctgaggagagcatggagcccgatggaaggagtctagacctgcatatccatctgagacggaaaccccttccagcctgcactgttttgtgatatgactgagaaataaatctatattgtgttaaaaagaaaaaaaaaaaaa

SEQ ID NO: 5247 - DNA, 175 bp, Homo sapiens
ctagctggcttagaaatccgcatataactctgaggagagcatggagcccgatggaaggagtctagacctgcatatccatctgagatggaaaccccttccagcctgcactgttttgtgatatgactgagaaataaatctatattgtgttaagccaaaaaaaaaaaaaaaaaaaaaa

SEQ ID NO: 5248 - DNA, 792 bp, Homo sapiens
taggatctacattggtttctattgggaacgagaatggctctgaagaggagcattttaagaactcttttctactcagtgactgctaactgaactgtaaattctgtttgtctgttgacggtttttaacatttagattttaacacagaaatagaagttgggcattctagcctcataaatcattttaaataataaaaactatttttatgaaacatctggctcatttgaaacatttgaaaaacaaaatgactagctttaggagctaataatctgttcactttattaaattcattaatgattaatccacattggccatgtgcttgctcttagaaaattgtgtaaagaagaacttcatcagaaatatattgttttaatacactttctctgctatttatacatatgtgtgtgtgtgtatatatatatatgtgttctcttagttgtataaaaccccttaaagcagtataaaatgttctgcatttaaagtttcttctctgctcactaagaaaaacaacacacacggaaacacacattcaaacaacccaccaacaaccaaaccaccaacacatcacgccataatgtgcaccatcaagcactacccatctcccccacctcacgctgttccgcctccccctgcccgccgcgctgtgtctctacgatactctccatccttctcccctctctcctatcttccttactacacttttatctgatactcccccgcccaacggaagtgacaacgagccggcgatctgcaaagctccgagcgaaacgtcatagagttcccgaaacgtatatt

SEQ ID NO: 5249 - DNA, 495 bp, Homo sapiens
cttctgtaatgatgacccttaaggcaaccaaaagcagcaagattaagaggagagaagtctacatccctaatggaaccacagagccctgctgatctttctgcccaggttgcccttgacaaccacactactgagtatctccaaacagagaacaaggatatatgacttacacctcctctccatgatgccccaaaaattacgtacagacagcggattcagcatctgcttatagagtaaactgcacccaagatacccagagcttcaggaaacaaaagaaattaggttaggcttctaagggttgactcctgggagctgggtaattaaatgagtcaatacttaccaaaaaggtgccagcaggtcacaagaattcaacacaaaactaatataaggctattattaatacaatctaaaaagccgagcatcttcctgcatgtatatttttataatcggtcatcttattaaaacctcattctacccttcaaaataaaaaaaaaaaaa

SEQ ID NO: 5250 - DNA, 349 bp, Homo sapiens
ctaggtaaagtgtaacaacaacatgaaggcccattcctgacagatgaaagcataagaggactgtgatgcatgtgttacgactgtggggagactgacccacttctttcctccagactgaataccgcttccctctgtctttctggtgaaaccaccaagagtcattaagggcaagacatggcactcttcatgtcctcactctttctggtcacgtttcagcactagctgccctgagaccccagagtgcagaggttctgcaagacccatccccgtacttctgagaacacagccaaccctggctcagcctaaatctctaataaacgtgaccactagggatggaaaaaaaaaaaaa

SEQ ID NO: 5251 - DNA, 803 bp, Homo sapiens
agacggaccggccagataaaggatgcaatcttcaaaagtatgccaggaatgactctagcagaatcagcagcacctgtcaacagaggcctcttcagactatgtgtttcaaagcctgtgccaggctcctgctgtggaagcagaacaggactgagctgctgagctgcatccttctgaagcaaccagcttcaggaactctgggaagaatggtctaagagtaacaggactgtgagcagtgggataacaatgaagattgtctcagtccaaatgaagttcttgtttggggcagtgatagcaaggtgaagaggatttgatagattttgaaggtacttcagaggatagctcaacagcattcggagttggaatttataagaacggggaaaaggggctacaggtcagacaaatcattttgctttgtacaatttctggatctgccgtaccctgatttttataactacacactggcggcgtgtgtccaacattcacatgtataccatagaaagtgtcaaaggtaatctagcaatcaaaatcacaagagttcgctggacaaagccggcacggaccgcttacacagaatgttcctcacgccttctcctctcgtagccgccccgcgcccattccctatctcccgcgctgtaccccccgctgcccgaccccacgacccgcgggagatggacgtcgggtctgtcgttagcgggcttagcgccctccgctgccagcgctcactctactccctatgcttatggtatccactcgcgaacaacaggcggaaacacagcgcaggactaaggcaccccttagtttcg

SEQ ID NO: 5252 - DNA, 778 bp, Homo sapiens
ctggtccccacttgaatcactataattattgaaaatagcagctgatacgtaccaatataaaactgaagacttgctatgacccaggaactctgggaagcatgttatgtaattgcatctgccttccttgctgggctctaagctccttgaggacaaagatgtatccattgtgccacttctacattctccaagcctagcagagaaccaagaactaagggctcaaaaacatgtgttgaattaattaagaatatcacaacaaatcctctgaaaaactcagagataagtgacatcatcatccttattttatagatgacaaacctgaaatttgggtcaagaacacagagcctgtgggtgacaaacagcaatccaaaccaacaatcagattcccaaacttgaaaactcatctactctgcctcactgatcagtttgtttgcccagtttcaccataaaagagtaggtaagatggggagtgaggagagagacacaaggaaaaacatctcttgcttgagacaccctcttctttcttactcacttgccacacattctttaaggcttatttccagcccaaaattctccaagaaatctttttggaccatacagctctttttgtttcttctgaataccagcagcccttaatatccattgaaaagaattaaaaaactaccccagctctcctgcatagctcattcttgttcagggcatggagtcctctgaatttcccaaaagcatgataaggtcctaagggcaaggtacccaattattttccctgtttgcggaacag

SEQ ID NO: 5253 - DNA, 272 bp, Homo sapiens
tagggcaacaaacacaaagcaaacaaataaaaaaaaggaaacagcaagaacaacagaaagaaaaaagttgaattcttcaaactacctaattttgatttttctatatccaacccaaccttgttaattttttcttaaaatatcttcaatctatgaactcttataaccaccatcaccatctgtcacagagattgttggaattgctttcaaaaatctctatgtgacttctcatcttttccccaataaagttctcaatttcaacaaaaaaaaaaaaa

SEQ ID NO: 5254 - DNA, 774 bp, Homo sapiens
atgtgtctttcagacttggaatttgattttgggttattttaacgagttagcctgccacggtttcatggatgctaatagaagatacaagacttctgagtcagagacaagggacactttactcacagcatagcaagcaacatgatttgcgtgggatcctcttgctctcaagtcccatggggatgatgtgcgggccgcagatgggaactggatacacagtggatttgcagcatggctgaagaacttattggtttgtagcaaaataagcaaacctgtttttttgtcttgaagtcatgacttcatctctcaaaactgcttgcacatccaacgctgagaaacggcctggataaaaagtggcgagggtgttgcattcctggcacacccagcaatgatgcacagggatgcccagagcccttcgtggattgctgctccaaacgcttacccttcccattttgtgatactcttttctgatgatagcaaacctgacttctgctacgcttcattcatttatgtatctgctcaatcctacagtatgcactaagaagtttccgaatttctaaactttacctctgaaacactaacctaccaactactaacttgtttgccttttttttttttagccagaaagtttatagtcaaaatacccaattcaacaagcaatggggttagttccttatttctcagttgggtggattatggtattcatttccattctggattgattctatggcacccctcccttttcattaattttctccagctttgaagaattgaaaa

SEQ ID NO: 5255 - DNA, 400 bp, Homo sapiens
ctagaagaccaatggtcttacccgtattttgctcaggctggtctcaaactcctgggctcaagcaatctgcccactggcctctcaaagtgctgggattgaaggcatatcctcagaaaacagccaggaactttctggaaggaaggaatgagagcagaagggatgagtacctcctccaggttgggttcctgaaaccttgcaagtggctcacctccaacattctttctccccttcctgctgactggagtgccaatatctagggtgaccttgaaagcaacaactgcaaagccattgtcatccaaagtccctgagtgaccacatggagcagagtcactcatgaacctgaagggctctcctgagaaccattacaaactctgatgtattattcagaaaaaaaaaaaaa

SEQ ID NO: 5256 - DNA, 779 bp, Homo sapiens
ctagttcatggatcaggaatttgtagtgaggacagttgagttggcttttctctgctttatactgtctgaaacctcaacttggaagactcaaacctcagaaggtgttttaaacatacggaatctagagatatctgaagccttcttcattcacatgcatggtgtctgtatttggatgtgtcaaaatctgggctaagttgtacctcttgccagaacctctacatgtggcttcttcatgtgtcttttgttttctcatggtatggtgacatcagggtcattgaatttctatcatggcggttcaaggcatcaagagcaaatatttctgtaaatcaggtgaaagcttcaaggccttttttgacagcttcggaagtcacacagtgtcacttttgctgtacactattagtcaaagcagtaacaagcctgtcaagattcaagggcgaggagaattacagcccacatctcaatgggaagagtaataattcacagccatctttgtaaccactgaaatcaacagcataattataaaatcaattaatttaactttgatacaatacagtcagctcccaagttcttcagtcaggctgaccaggtctgaattctgtctctgcctcttatgagatacctgacatttggcaggtaactctggttaccaagccctcaggttcttcatctctaaatgaggccagtgacacctacgtcttttagagttgcttcaagggctaaataacataattacataatgaagcctgacatagatagtggcttacttagcattagggctt

SEQ ID NO: 5257 - DNA, 879 bp, Homo sapiens
taggggacgtagattgtgtcttcgtattgaataaggtttgagtatttattcagaggtgtctcctctgtcaccaggctggagtgcaacggtgcgatctcggctcactgcaacctccacctcccaggttcaagcgattctcctgcctcagcctcccgagtagctgggactacaggcgtgtgtcaccacgcccacctaatttttgtatttttagtagagatggggtttcaccatgttgaagaggtcaagagatcatgaggtctcccaaagtgctgggattacaggcttgagccattgcgcccaaccagtactttttttttttttaagagacaggatcttgccctgtcacctaggctagagtacaatggcatgattatagctaactgcaaccttgatgtcctgggctcaagtgttcctcttatctcagcctcccaagtagctgggactacaggtgtgtaccaccactcctggctaatttatttattatttgttgtagagatagggtcttgctatgttgcctaggctgatctcagactcacagccttaagcgatccttctgccttgacctcctaaagtacttggactagaagcgtgagccactgtgcctggactataacatatataattttatgtagtaagttaaaaaatgtatagtcattatcggtataaaacattgtatgtgcctggagtctaaattcctataaaacatgtaaggatttaatattactcacttacagttttacacgttttccaccagcttgttttggaagtaatttactcaatggctcattttcgtttcatcttcaggaatgagcaatttgtaattgacaaagaaaagcaataaaaaaacccattagcctctctcaaaaaaaaaaaaaaaaa

SEQ ID NO: 5258 - DNA, 555 bp, Homo sapiens
tttcgaaatctcatctgttgcccaactgggaagcagtggcatgatctcagctcgctgcatcatccgcctcccaggttcaagcgattcttctgccccctgagtagctgaaattacagaaagatacgtctacaatggactgggttaacaaatatgcttgtggctatacatactaaatgtagaaaattaaaataaaatactaaaaatagttaatttttaaacattaaaagtcgttgttttgttgtgatttgtaaagcattttattaaattctgtttttacctctggattctaaaaccaatttttactaaatatttagggtttgcacttttatctgattactcaatgttaagtttttttttgtgtgtctttaggcataaaagtgtattagtgcacaaattaagtgtaaaaatataatctattaatatttaaataatttgaaaactaaatgatatatgctttaaaactaagatataatccaaaatttcatatatgtattattctaaatctgaatgttgaattaaagtctgtatctcgctttcaaaaaaaaaaaaaaaaaa

SEQ ID NO: 5259 - DNA, 629 bp, Homo sapiens
tgatctgcgcctatggcaatggggccaccacatgagagctgtatgtccttgaatagacagtgaagaaaaatttgtccaagttggcttcacaaagtcatcacatatgttagtcctaaaatgatattaattgtttgatattgaacaaccgagagctgatttctgacaagccttatttggagagactaatattatctcttttttttcaaattcctaaaatattcatgtgaaaacaaatttggaccatgatgtgactggaacaagacgtgggtcaaagagttgtatcctgggctttacactctcttaagacccccatatcacaaatacacaaaatataaatttattgaagaaaatatgggtgacaattggtaaacacatagctttaccacagcaaaatctactaccttgaacatctgctcttgtaactaataattttctagctctaggaaaacacctctatttctcttgccttaaaacgaaagacaaatacatctgagtgctttgaagatttgtgagttgtgttactgcctactttttgaagagaaaaacagaaactgttgaaaatgttggggaggatttgaatggtagcggagcataagtaagggaaaagacaaattaattaacttgtaata

SEQ ID NO: 5260 - DNA, 340 bp, Homo sapiens
cctgatcccatatgaagagccataccatactgctagagacacacggctcagccaacagtcatcagtcagtctcaaacaagacttttgagtgaagctgtcttaaaatatcaatctccaggacactcacccaacaagatgcagaatggaagcaagcgaatgaacctagcccatattgctaacccagagaatcatgaagaagtaacatagttgttttaggtcactgattttcatagtagttggtattgcaacaatgcgtaactaatacagcatattattactaaatgtttaaattgtacttaaatataagacaaaataaatggttaatccaaaaaaaaaaaaa

SEQ ID NO: 5261 - DNA, 531 bp, Homo sapiens
tgatgttcttccggcaatggaaagagatatgtgaacagaagagaaaagtccatgccctcatgggagttacatctcagctaaagctctcactcacggtcgtccctgggactctgcaatgcagtagatttcctctgttgcttgagatggactagcttctggctgtcactttctcacttgactctcaggctgtcctctgcagaaaggctcgtggtgaagctattccatttctaagctaccttgaaatgtgtgtagcaaattgtattatttggcttaacaaagaaaaggaaaaagaagatttcaaaagactatattttgcttcttgtattcaaactccgcatttggagcccgtggcttgggttatacctgaaggtgtttatgctcccttacagggcacggcactgactcaacctggctcacagcaaatctttggaataaaagaataagaatgatctaatataacaaatatgagaaatcattctagattctcatcttgaaaaagtaaaattggttcttttctcaaaaaaaaaaaaa

SEQ ID NO: 5262 - DNA, 797 bp, Homo sapiens
cttggagaaactggagatgctgcatctgtatgtcaccttctctaagtacccaggagcagcaagaaacactgaattttggagtcttatctggaaaagacttggaattgtaatcccccacttactgactgtaagagccttggctgaaggagaggaaccaggcgtgtacttgagccaacttaatgatgagtcttgcttaagactctacttctctagaggatcaaggaagctctggcactgaatacaagaataggaggaagctggactcagcagccgtccccagcctcccacctcttgggctcagcagctgtgcacctccctgctcctgcaccctggacccctccctccacagggctcccagcctcaaacagtcaagctcacaagttggctggggccagctttcccagaaactagaaagctatgctatgcatctatcgtctgtgaatcactgccctcaggtcattaaggaaacttattggaggtctgatagctacaacgagcttaaaagaaaaactaaaactttttcatgaactgataataactagttgaaagtttcaactgttctccaaaggagtcaagggtggtgttatttgagcatagtaagattgcctcctcttctaagaagtcatgtcagagagctaagtacgtacccctggagactccagccccattgccaatgagactatcctcgactaactctgccctcttcccccttggagctgaggtctgccgaggggctttcagggagaatgctcctattctataaagagctaccctttctaaattccagatgcctaggg

SEQ ID NO: 5263 - DNA, 834 bp, Homo sapiens
  misc_feature (1)...(834): n = A,T,C or G
ggggnnnnnnnnnggggggggggnnnaggaggtgggaannnanattgacatccccctgcccacttgagggttcgttgtagagcataaatcagtcaatatatgtaatgcctttagaacactgctctgcaaatagcaagcactatgtacatgctattttattagtggcatcggaaaactgattcggatcaacaacttcattttgaagctagctctgcatgacagcattgaatacaaatatcactgatgatgatgaatggattgaggaatgccgaatgcattgtactaaaaggggttgctgagcattggaggtgacccagtattagagtatatgattcttcatttgctacaagagaacacctcatctgggtcaccaacagctttctgacgaatgctgaggaaattgcgtgcaactaattcctacaacgagaattccgcacccactgtgatgggtgatctgtttgctcaagacagaggagcccattacccatgcatcacgtatgacctgttcccgggagttagacaccatctgcagcctggcttgctgccccattgcacgttgcgccctggaatcacccattgtgacagagagggcactgggaattattattgactgaaatgaatcgcttcagaagaatctgtcacatcccccctcttgctccgcataggcgccaatgaacaaacagcatgggcttgtccggcacacgagacccttcatatgaaaaagccgcactacaatagcacaacacgcctggaaagcnaaaggtaacccagaccaagttatcagtccgcttagcgcacatcccgatatgttccaacccatggtttaacagagac

SEQ ID NO: 5264 - DNA, 803 bp, Homo sapiens
  misc_feature (1)...(803): n = A,T,C or G
ctagcttagctctgcatgacagcattngatacaaatatcactgatgatgatgaatggattgaggaatgcggaatgcattgtactaaaagggtccagaaattgccacaagtctctttttgagtctcagagaagcaaggccatcatgtataagccagggttgctgagcattggaggtgacccagtattagagtatatgattcttcatttgctacaagagaacacctcatctgggtcaccaacagctttctgacgaatgctgaggaaattgtgtgcaactaattcctacaacgagaatcccgtacccactgtgatgggtgatctgtttgctcaagacagaggagcccattaagcaagcatcacgtatgacctgttaccgggagttagacaccatctgcagcctggcctgctgcccattgcacgttgtggccgtgaatcaacattgtgacagagagggcactgggtcagctacattccattaatggatcanagtgtttcatttagattcctacagcanaggtgaaggaatatggatgatatgtagcctgggatggacaaaagcttagttggcagaaacagacatatagaattttntaatgtaaatctgacaaagccaaagtccctgatgaatttacacaacatggttgccataattaagtcttccaaccaattggttctcaatatttttctcaccactattcaaggaggccacaggtgctattangggctatcangacttttaaaatcccatcaggtgattcctgtgggacttaccatctcagtagagcagctcatttaactctatg

SEQ ID NO: 5265 - DNA, 1005 bp, Homo sapiens
ttagccagagccacaggggagagtgggcagagaaatcaaatgaaaatgccaaaacgctgactacacggccagtttgcatcatgtgaaccactttgagcctgaggacagaaaccaaaaatatgcttctgttcagaggcggctaacagcactagtgttattattgttatcatcatcatcaccaccatcattcgtccataaatttaaaaggaagctagctgatgtgtgatgagctgccgtgtatcaaggaactgatgtcttcagccaacaagcagctagaatctgaggggttgaaacagccacatgagtgagcttggaagttgaaatttattgcctgagtcaagccttgagatgactacagccttggcagacatcaagtgcctgagccagaggacccagctaagccactctcagatttctgacctacagaattcgtgtgataatattaatacatgtttattgttttaagttgctgaatttgggggtgggttgtcacacagccatagaaaactgatacaggtggaaataattttgaaaggtgaaaggcatagcatgaaatctgattctgtggtatggaggggtcccacacactggcgctaccatttggacgtggcccccaggccattggtagctctttgtctgatacctatatggacatgtcgttgacgatgcgctctgttggcgatttgcgtagtgccatctcgatctattgtggatcagacagcagaccgcgcgctgaatgacacaagctgtggagatcccccgatcgttgtggagacaactaattgttatcacagtgcgtgaagtatgagccgttgtggctcccgcagctcctatgtagctatactctcctcgtcgccccatttcgtcttttccggttcttcgttgcatcgcgcacccatttgatgtcgtttggcgcgcccttggctctatgttgccttccagcgcaggacgtctattggagcgcttatgtcgtcctgctgtgcgctgcgttgcctctgtctcccg

SEQ ID NO: 5266 - DNA, 783 bp, Homo sapiens
ctagagatggcgtcttgcccaggctggtctcaaattccagatctcaaatgatcctccctttggcctcccaaagtgctgggattacagagaaacactgaaggatagcatgcacaaagttgtgaaggaaggtgtggcagacagaccctaaggtttctactgagaaatttgctgatagctttatggaaatttccttatatgtgttttccatgtaacctcattcttctggacatgggacaaaatcctgggactcaccaaacagccagtgtgaaagaagctgtaaagctgtagtcctcccgtactctgttggcaacaggtggctgccccacaagacaggaagtggcggtggctcttggccagcccaggtgctgcaggcctagtggggcaatgggatcgaacaagctggaacatgcccctgtttgccaaagaaaggctgtggatggcaggaacgaacgaactgcaacatgaacgagctgcagccccttctggggcccagaccttcggactgccctagctagaactggaacacgctgtaacaccctcttttggggctctgggggtggctggcatatctcagttttttgggttccaccggattcccttcgttagatgctggcgcctaaagcaaaagttgctttgcagtacacctgggttcagcagacttggacaaaccggtgactggagcacccccccccccagctcttggacaacgggttggccccaggcttaaccctgaactgaatcccttacccccttactgtccccgcagggtgcctgcggggatgg

SEQ ID NO: 5267 - DNA, 193 bp, Homo sapiens
ctagagattgtcttgttcaggctcaggtctccgaacagagctctgaaaagtggattaatttgcttttcatttatctaacaaagactcactcaagcacctctcatgcacaatacttggattctaataaatagtgttttgttgtaaccaacacttcccaagggaatatcaagtgctaagattaaaaaaaaaaaaa

SEQ ID NO: 5268 - DNA, 800 bp, Homo sapiens
ctgtggtttgccatcagaactttgaatttaattttgtaaaaaagaaaacaaagaaagtcaaataagcaggctgtgtgctttttcttcctacaagactgctatcatctgggtaaccatgcagtccttctggatgaaactcaacaaatcttgagtatgacagaccatcttcaatatgaatgtctatcactaatttgttattttttccagttaattcaaggacaccgtactctattctacccattgtctcttttgcattgaacccaccattatatttataaaaatgatagtttcactccagagaactggaaacataaaacattttatatgtacctacaacatatgctgcatacatggacagaaattaaattgatttcctttattccttgatccttattttcaacatcagggatgaagcaggagtttaaatatgtacatttatgtgcacatgtggaaaatatgctaattgaaaaagtcatagatatggaaaatatgccacagttctcatttttaacttactgttcatggaatctaaaaatatgataactactaccttggtagatggagtggcaggggggcctgttatttttgaggctgctatccatggggaaaaataattaagaattgatacattaatcagagagaaaatgaagaatttgctgtcataaatttatgaaacatagaggttggaaatgactgatatatttactgagtacttgttatttgccaagcaaggggcaagaaaggacctaattagtttatgcaaaataataccccttaattttacaaaaatgggagggatt

SEQ ID NO: 5269 - DNA, 952 bp, Homo sapiens
  misc_feature (1)...(952): n = A,T,C or G
atggatgaaatatttagacattgttgactacgcaaaaggaagatgagttttttgaagacaaactacaagacaggatgaagaattgatgctaattttttcatgttgtgagtttcacagaagatatgagcagtagcagcaaatgtatctcacaaaactatttgctaaaattgtgacattttaataacattgtagttaatactaatagcagaagaggtgctcagcaggaagtagaaagcattttaggcccgatccaactttttcccattgaccctcaaatttgtctttgcttcatcattaagagagttatatcatatagggtagtcatattcacatcagtgtcaagtctcctgctactgataatgaagacaaattgatatcatgtttgcctatcagtaaaacttcaaaaattatttatcatattcaaccagtatgctttagtagtcttaaagccatagggaccttaattgtagttattgtaaatcctagattttcaccacaatcagattttaggtaattttcttttattttttaccaaaggcccggataattatacctttcaatagttgtatttatatttgtatacctttccacaaagacgcatttacaaataaaattatttaacaatgagcaccccaaaagtagcacatggtggtgtctatgctttgccacacacaaaccaaaatgttatattgggttgattataaacactgataatttttttaaaaaaaatcaactttaatacatattattgcaaatcctaatataacattntaaggggaattaaantagattacttanacttggnaagtcaatagacatgtacacaggggggaacgccatgttgagaatatactnaccacagtcaagaacntactgatgccagagaagagtctggaggtggatngttccctagcaccttcacagggagcattgnccctacacacnnctgatt

SEQ ID NO: 5270 - DNA, 207 bp, Homo sapiens
attaaatgttgagcagtgggcaagcagtgaaaatgaagactcgtgtcattttcttaataatcaaaagctaatgttgaaccagaagttgatatttgcagcttccagacccttccagaagattcaagatcatccaaatctgtggcattctctcctacttccacctcatctcttttggaaattttaaacaaataaaaatatggaaaacaa

SEQ ID NO: 5271 - DNA, 855 bp, Homo sapiens
tttaatctattatccttgtcgtcctttcgcaccaccttcaactccaaattttgcaagtgccaaccctgccctccttcctgaagactttctgctacttctgcctggaactcatttcctctggccatctcccacctgactcctcatcatttagagtcttctatatggcaagtttgtgacaacgcttcatctcttcctctttgctccagcttaactgtctccacttgtcataagcagtccccatatgacgcagctgttattttctggttgaatttctgtttgtcagttttccatgcagtacttatggcatagaatgtttctggaattccccaggtgtttttacactggggcatgctggaaaaagacggtcatctcctgagtttattttactcatcataacattaacttgtattttttcaagttgcatcatatgaagattcatgttgaggctccttaatcttatcacatatgcttctgttaaataatattgccttcatgttgaacttttgcagattattttttagcttaattcaagattacaatgattcttaatacatcccaggcaaagataatttacctatatcctatgctatcaattttttaatgatttttttaatgggcaccaaccttgagcacaagggaacattcttaactttctccctgaaattgagtagtctgaaatgctaaccattatggaattgcatgctgcgtttctctctactcaataaaatggacgccgaaaaatactcacctctggcgctttatgcgtgtgtacccacaccacacgacgcagtgtttttgcttgtcgattacagaattcctggtactcaaggaagcaatctcgcccacaccccatta

SEQ ID NO: 5272 - DNA, 721 bp, Homo sapiens
caggggcctagaccttccctgaaggaaagattctgtgaccttgctgaaacaagccaccatgagttctacagctgcagaaaatgaattctgtcaccacaaccttagcttggaatgggaccccaagcctccaaccagaccatagccctggccgacaccttgaacacagccttgtgaaactctgagcaggggacccaactaagccaagacaagattcctgacccacagaagctgtgagataataaatgtatattgttttaagctactaagtatgtggtgattggtcatgcatcaatagaaaactaacacatttacttttcacttttctgaattttctagattatctataataaatatgtttattttataatagaggaaaaaactttttacaacaaaaataaaagagaattaatgtggataattcaggctatatattccaaaaaagagaactgacatcatttttcttcatgttattaacaaagtactgcattaaataggaggaaattttctctttgtactttaatgctctggatcaaatccaaagttacccagctcagggctaaaagtgaacacactccgtataactgaactaatggtttctgaaacaaatgtactgaaagataagcctttgcaccattctactcttgctgtactatgattcactgaaaccatccagaataaacagattttaattttggtttagattccaacaaaaaaaaaaaaa

SEQ ID NO: 5273 - DNA, 373 bp, Homo sapiens
agagcaagacaacagtgaagcagtggacaaagaaatctgaacttcaatgtcaagtgccatggggagagaaatgaagcagaggagctcacaggagctggtcatcgctttcctgctccaccagctgtgtggctttccatcttcccattcagggcagaccggactctcgatgcccattctctgctggctgggggcaggagagaaagaagcctgggttctttggagttgaattccagtgccttcccttggcaaaatcagctggttctgcagccattgtgctcctgtctccctttcctgactcctgactcttaactggggggtaccctctccttatgcttcggccctaaaatagtaacataaaaaatcaatacagaaa

SEQ ID NO: 5274 - DNA, 885 bp, Homo sapiens
ttgaccatccggtatgacattgttatcagtaatacaccttggttgccttggctcctgagagggagaagagagtgcagcaaatccgaagacacattgttgggtcttccattttcctttctgtattttttgatgcagacgatattcttaggaactcaaagtcttctagaccaagcatccttccagggtttgaatttctgctctatgacttttctgccaagtggtagtccaagctatgctcaaatacctctggtcatggtgaagtcattgtctctcaaggctgcttattctgtctggcacagctctggataaacaatgcaatgattgccaaagtcttctagctcaagaatgccatcgactgaagcttgctaaactgtttttgcacatttaattactaacgttggcatgaagaaccatgggggcccataaccatgatggtggcggtgaagatgataaataacacttacataatagcacttgtatttgccagtttacttgccagtggcaaataaaaaacagcttctattttacaaggatcttgtaatactaacattttatagtttaaaatacgctttcacatatatcaagtctcagaaaaactaaatgagttgaccaaatctcatacctcataagcattgggtattaaacttggaatccaggtttttggactgccaaagcattgcttttatcactacaacatgatatctaaagacaatatgcctgttaaacaaaaacatgtactacctactgtatttgccagttggaccataacgatcctccccctaaacaaaaattcggcctattttgccatagacgggaattccttcgacctattcctttcatgaggcgcatccatgacactgcctaacgactcctgtgctagtcgtt

SEQ ID NO: 5275 - DNA, 232 bp, Homo sapiens
gcttcgaaatgaaggatttcttattttgaggaagggagagacgccgaggaagacaggatttgaggttttactaccttcgttattcgaactcccctctaacttgttcctgtactagaaacccactcactatggagaaggaaggagaggggctgaactgatggacaaacgttgtaaataataggttttatgtaatccacatataaataaattaatcgcctgaaaaaaaaaaaaa

SEQ ID NO: 5276 - DNA, 914 bp, Homo sapiens
agataagcagtgaaaatggagtctggagcatagctgcaggctgggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagcaagtaatcagtcccgtgtcatgttctatctctgcagggttattctgccaaggagaacagctccttaatcagaagagactagattaggggagagtgatataaggtaatagaaattgcaaagcagtattttaatcttaagccaactatagttctggattgcttaaaattagtcttctctaaatgaaaaaaaatttaaaaataataaattatcatgttttcttctatattctagcagagtgatagcataatttacattaaatgtactataataagtctgggttctttagaaacaattttgtttacttaactaaattgtactaaaactggagaaattagtaactaaacaaatatttcaagaccactgctgattgtaat

SEQ ID NO: 5277 - DNA, 737 bp, Homo sapiens
caggggataattcctcctgaaatccaaacacagtccatactcttctggtgcacccgtttttacgttggattttgcagaccaaagaaactttacttgcagaccaatatttaggaggttgggagaaaatgggcttccagttgtgcatttgggttagaatctacagacatcttttacttcatgcatcttcaaggaaaaaaactagacagaaaggtaacccagttataacagatttatgtcagcaggatgcttcctttcaaggcttattagatactaccggatgctacattttttctcaactttaaccaaggctgaataatttttttctaaatcatttgatttccactggaaccactgaccagaaaatggttgtaatccaactgatttcttaaggttgaaagtaacgacatttctttacatatgtttatgtaaactgagggtgactgtttgcttttgaaaagtaccaaaatttgaagaacagcaaattagtgtgggatcagcaaaggaaaagggtgtacctctctacctatgactgtccttataaacttggactttctggggctaggagaagctgacgtatgaatagcatataatctgtgaggaagaggtcaagttgcagactgcaagaatagggagtcggatttcctgtgagtaagagagttccttcttaaaagctgtcttaagtgaacaatgaccgatcagatgaccatactaccgaagtccaccagttagacaacttc

SEQ ID NO: 5278 - DNA, 307 bp, Homo sapiens
tttttttttttttgagagctcaatgcagctttatttacgatcatgaaatattagaaatatcttacatggacatcatatgagaaattttaaactgacagtggaacatagatgtcatgtagcaggtaagaacaggaaagaaaagagcttggtttatattaactggcattaaacaatctttaaggaaaaaattattacctagaaaaaaatgtacagtataattccacttagaaaaaaacaggacccaaagcactatatattcctatagaaatatgcatttcatctatgtacgtgaaggcagaagaaatgt

SEQ ID NO: 5279 - DNA, 294 bp, Homo sapiens
agccctaagctgccgtgtaaggcatctgactacgctgaagccactacattggaaaggtcacatggaggagctccagctgacagtctcggaggagctcagcttcaagccatccctgcaaggtatcagccatataaatgaatcagcccagctgccagtcaagtatctttgcatggcttccatcagtgcctcatgaaacggaagattgactagccaagacttgcccaaattcctgacccacaaaatcatgagatataataaaatggttgttattttaagccactaaaaaaaaaaaaa

SEQ ID NO: 5280 - DNA, 288 bp, Homo sapiens
agacaactatgcttgaattcagaaactgggcatgaatgactgtgtcactcgccagagctgagccacctccaagcagtgagccaggccaatcatgtgaggccctgccaccttcagacagtgtcctgtcccccttcaccaggaacaaacagaggacggcctgtcgcctctcagctccctgcctgccctcagactttcacatactctttatcgagttttacagagcttttctgactctgtaacaaacagtcaaataaaaatgctgtgttcccaaaactaaaaaaaaaaaaa

SEQ ID NO: 5281 - DNA, 858 bp, Homo sapiens
  misc_feature (1)...(858): n = A,T,C or G
ctagagggagatgatcattcagctacctgctaagagcatcatcggaccctgacaacacagaccccaaacctggcatggtgatattggtctaggttcattcttctgctcaaccagcaaattttagagatgtgtgaaatccatttctccctctgaacttgccatttcctagtttataaatcagagattattgtttcttctcttttatcttaaaaattcaaaaaaatttacagatttttctatttacaggcttataaaaatgtggaaatctagaaaagcataaagaataaaataaaattctccagttatcccatccctcagatatagaagtgctgggaagagtgtagtccctttaaatgatacagaagggggaagggaactgctggggacaggagggcatggtccctggctagggcgccacccaatggacctgcgtgaggtcaggcatttttgtttccctgcccaaatgttgcatttcccaagaccacccttggcctgccacgcccccatcctgtgcctataaaagcttgagaccctggcaaggcagagacagaaatggctggacgtcgggaggagcacatcggcggaggaacacacaagtggctggacgtcaagaggaacgcaccaacaggcaccggcacaccggcaggccgccgaccggcagaacgacacagagtttggctggggcagttagaggagtgctggggttccgagaggcctgactccagggaaaaacccgtttccttctggctccgccatctgctgagagctacngtccctcaataaaaccttgcactcattttcccagccccatgtgaacccagttgttttggtacacccaagcccagaccccgggaacaa

SEQ ID NO: 5282 - DNA, 755 bp, Homo sapiens
ttccttaagagaggcctattaacctaaatgtcttctatttcatgtgacctaagtagatctttggtaaataagctggtttaaaaatcattggtaaaataaaactagtaatatcttcaaaattgtgagtacacatttttgcctgggttgactggtgcaatagttttatatttgtctctgctagcctgaaacagagtgatctttgtgcaattctttaataaataagactaatttaatattgtggtttaataagacagctgtatcttcaaggttattgacaaaatacccatatatttaacttaaggttcttacttagatgaatgcctgatattcacaggctataaaaatggttaacaggagataacttgaaatgatgacaagccttgtctagtatctcagttttcataactaatctaggtaaattgttaaaaacaaactaggtaaatgtaaatggaataaatgcttataaataagcttttcttgtaatttgaaatcttcatattatgttaagttaaacaacagatattcattaaatgtctaggtcatttctaaataggatttaaaaacctgaaacatcaattgctaaacataaatataccttggctcttggcttcttacattgtctaaaaggactaaatatatttgggtttattaatatacattaaatattaatgaagtatggagaaacatatttttaagaattataagattgttctcatctatcaaataccaatatgtgacaactagttcaaattgct

SEQ ID NO: 5283 - DNA, 730 bp, Homo sapiens
atgatggaagaattgtctgaagaggatgagtgatcaccttccaggtggagggaaggggtctcattatgttgcccaggctggactcagtgactcaaatgtctgtgctcaagggatcctcctgcctcagcatctcaagaagctatgactacaggtgcatgtcacccatccagctcaatcacacatcagaccgctaaaaataaggatactagtctcaaagctaaattttattgttgtcaaaattttcaacatcagtactaaaaacctagaggaatatagatgagcatttaaaaaattctgtccagctaattctctccagtgttcatttaaatatcatgcgaaaaagctagttttataaaagcaaaatctgcattcacggtgggggggaatgcatacttaatggaaaaaaaaaccccaaccgaaggcaattttgtgctacgatattgaaaaatcaatggatcttactcagcggggctttaaagataaatggcgagatcacattctaaaaaaaacaaaaagagggcctcgagcgcctcaacgatggagccttaggggccacttgccgttagaagaagggtattccatgctcctcgatcactggatgcgctcgggtaagccgcacaggtgcgtgaagcagattcaggatactcaaaagtgggaaatacacgacactccagaatccaatggagaacgcgcgacataacacgcgataatagagggcacgcagagcgca

SEQ ID NO: 5284 - DNA, 722 bp, Homo sapiens
cctgttcgtaactgagtctttattggaaagcctggacccagcaggtgccacgacagccagcaggcctgtggaaatgcctcttcaaagctggcttggctctgcccagcaatgcaggctgagcccatccatcagctgtcctactgcctgccagcgagagtgtctgctgggcttgccccgccagccagattggaagtgtcaaatgcaggccgacagggctggggtttggaggaggccctcagaggagccgtctgtgccacagtgatggatgacaccaacagggacgacattccggggattttgattctgttccacacaactggcaagctccttaaccagagcagctgcaaagctcccatcgcaggaactctgagcattttctgagagaccccaaacatggactgagttaatcctggtcaagggacctggagcatgtgcttaagaaggtttgccaatgcatgctacttgctgaaagctaaaacccatggactttcatgaaacccgaacctataatagattccaggatcgtcaaaaggcaaagaaagcttggagttagggaaaaaaaaagaaataagggctcgttggcctaagacggcggaactctgcgcccgtttggtggaaggagggttaactgatgaaacctgctagtgagctcgtcccctacaacggtcgacgtatagtgatcggggtagcattacatcaaggcgagaagacgagagcgaaag

SEQ ID NO: 5285 - DNA, 798 bp, Homo sapiens
ctaggaatgaccccactatttatgcagttttaagcagagaaggagagtctccaggaactatacgaattaatcaacttgagcaatcagcctgttttacagcctcctgccttggagacaactttttccaaaactctatgtgggatgtggtcacctagttggttggaaccagctcctgacagaccccagcaactgacagatgaacctgagtgaactttcctcattatcatactaaagtctccatcccgaaaggaactatagcttcattaccagaacatgcaacctttgtgctggcataaaggctcactgcgtctaaagcaactgggacccgtcccgtacatgtgataatgcacactctcctctctccatagcgccataaactctctcagggagacactgctttgaggaatgcttccttacttgtgctaagtaataaaactcctattgattaaaatttacattcttgtggattcgtttgttactggacaagtgagtgaattcattttttttcaggttagtcatcaaaataaactttgtggatatgattgaacattacttattctttttattctcattacctcctttatatttcatgttcttggtaattctacattccctaaagaattaaacttttctcttccaaaagaactattatgcgctttataccatgcctttataattttctatgagaactattgaagtaccttgcctaactaataatcttccgtcttaaggtttggcaccctttttgttcattttgctagccttgtgccacaggaatctttcttagatgttgacctg

SEQ ID NO: 5286 - DNA, 521 bp, Homo sapiens
gctggtgaaccaaaagaaatgctttggttacccaagaatttggtccaagaggagaaagtcttcagataccttctaaggaatctttctatctggaagaagagaagtgtgtgagaagggttatcttactgagaaagacccactggctgggccattccaggagggacagtagaccgcagaaaaagaaagggcccatccagattgctgcgaatgcttcaaatacattcatgctctcagaaaatatagataattgtcattttcttcttccatgcactgttttatgttttctaaatctcccaaagttaaacaagtattaagaaaaacattgaaatggagataatgcaataagaacataatcattgttgtctataattctaaacaactctttaaagagacatttgattgaatgtcactaagtaaacatacaaatatgtaaactttcaaaatctcttattaggtcctgaatgatagattctcatcacacagatatatgaaatttttaagctcaaataaaaaaaaaaaaa

SEQ ID NO: 5287 - DNA, 332 bp, Homo sapiens
  misc_feature (1)...(332): n = A,T,C or G
cctagaaagctaacagtagcatcttttaaccaagaggtggccgagaccctgcctgaagccatttgtgtgactattgctgttggctctaaattcatctcgtccgtaaccagagaaatgcatttctactacctcaaggggaaggcaacctccatttttctgttcataaaaaatttttagttattttctgaattgaaacttccaggagaatattccacaggtgcaaggtttatgacctttataatcgcagcgctagtgtttcctctctcgcggtaggagcgcctgaactcacgtcaataaacatttgccttctcctcttcnnaaaaaaaaaaaaa

SEQ ID NO: 5288 - DNA, 526 bp, Homo sapiens
cggatggagcagtgtcctcactcattgcactcaccctacccaggatctatttttagagaaaatcccttaatcagagaggaagactaagagaaaaaggaagaaaagatctacaaaacaactaggaaaaagtaacaaaatggcagtagtaagcccttacctatcaataattaccatgaatgtaaatggattaaattctccagttaaaagacagactggctgaacggattaaaaaacatgacctaactaaagttggccattgaacaatatgagtttgagctgcaggagtccaatgtcatgcagattttcttccacctctgccactccgagtcagcaagaccagcccttcctcctcctctccctcagactcctcgatgtgaagaccacgaggatgatggcctttgtgtgatgatcacttccacttgataaacattaaatatattttatcttccttatgattttcttgataacattttttctctaggttgctttattggaaatatagtgtataatagaatcaacatataaa

SEQ ID NO: 5289 - DNA, 745 bp, Homo sapiens
tatgtaaagtggtaaagctgctctctaaaatatttcagacaatttattaaaaaacaagacatgcaatttttatagaaaccataaattgcactcctgggcttttattccatagaaataaaacttacattaacacacacacagacgcacacacaaacacacattattatatatgtaatatatattatatttgtgtatacacacacacacacacaagcaccttgttggtaaggtcaggtgtgggctatatccatatacacaaaatttagaacagttttattcataatagctcaaaactggaaacaacctagatgtccttcaaccttcaatcatgttcatggttaaacaagctgtggtacctccatatcatggaatcttacctatcaataaaagggaacctccatatcatggaatcttacctatcaataaaagggaacatccatatcatggaatcttacctatcagtaaaagggaacctccatatcatggaatcttacctatcaataaagggaacctccatatcatggaatcttacctatcagtaaaagggaacctccatatcatggactcttacctatcaataaaaagagaacctccatatcatggaatcgagcctatcaataaaaaggaaaaaaatacacacacaacctggatgaatctccaaaaggttatgctgagaaaatatttttattacgaggttacatacgctatgattccattaatatacattattaaatgacaaaattta

SEQ ID NO: 5290 - DNA, 851 bp, Homo sapiens
  misc_feature (1)...(851): n = A,T,C or G
cctggtgccctgctacattagtttatggtaattggccagcatctgccctgtttccattttcctccaggtagaaaaaatggagacaaggaaggaaaaaaaggaaagagtaaagggaaggtgaaagggaagaaccaaggaaaattagaaaaaaaggaggaagaaaggaaagaagacaagacggaggaaaagaaaaatatcttttatactacagttgttctaaaatatttttgtttctaaaaacattattcaaaggacacacaaaaccaagcttgtatcacaataattgatatataaaagcagagaggtattgggtcataagcttaaaactgcgctttgtcttcctttcttgtcaaattgttacagaaatttgtgatattatttatttttagggatgtccattaataaatgtgacgtcttgcgccatttctgcctcttctctttcgccttttaatgtttcccctcacacactgcttgccactatcactgttttctgattcttaagttgtccggccttatcgctctctcctgacccttttgttaattttctaattcttggcctccttggcctccgcggcggtgctctccgctcctntttcttcttttgggcgttctcttttgatcctctctcccttgctccctttgcgcgccggccttccgtcttgttccttgtggttttttntttctgtctcgggttgcttccgtgttgttttcgcgtttcatgctctctcttcccttccgcccctgtctcctgtcggncttacatttgcctctttccttttaataggttgcgttcctggtcgtgttttcctcgtcccccccctcccttccacaaatacaaacaaacaataaaa

SEQ ID NO: 5291 - DNA, 242 bp, Homo sapiens
tttgttattaactaggtctccccttctgtctgattgccctgcagtgccttcaggatgaagtgcagatggctttgttccaatgtgggagcctggatgttgtcatcttaatactccatctgataacaggaaccaccaaacaaaatgcaaagcccaagaagttggctatgacacttcagaatttgctcatcaaattgtcccctatcagaataataacaagctgtccattctcttcaaaaaaaaga

SEQ ID NO: 5292 - DNA, 671 bp, Homo sapiens
  misc_feature (1)...(671): n = A,T,C or G
ttttttttttttttttgtacacataaagaacatattttaatgaaaaataactgcattttgaaagacagtacaattagtgagaaaagtggcatttataaaaacctcattatatctggcttaatcaaagacagctgatttttcatatctgtttccttattcaacctgttgctgtatcacacatcatgtaacctctggaaatttccactgtacactcatgggagaaagacaatgagaaaggcaaataaaaacttggtattcttgtgagagtagttttcaattcagagaccctctgaaagactttaggaaccttcagaccacattttcaataccactgctctagaccatagaaggcactcatataaatcattaataatattagcagaagactacagcagtgttggcatttatcacacggggcacttctttatagaggtctgtcttgataaagaggccttgttgttgtcaatgattggaaaactcctatatgctggcagattaaaggcaggagatcttctgacaataggtggcttccctggaagccaggtctgaggctcaggacgaagagtgcaggtcttgcaaatgaagactgaaccagagagaagttcttatttttcagtcagttagtagcggtnggctgcccgttggggaggcaggaggcatttgcgtatttc

SEQ ID NO: 5293 - DNA, 879 bp, Homo sapiens
ctggtagaccacgctgtggatcatcttaagcattcctcatgttgccaaagaaactaaatacagaaaaagcatgtactaggtaaaatatgctgctgacaatcccaagaagtggaaaagctagctgccatccttacgtatgtaggccctgttgggtgcctttctctctgtgttcctggaatgatctgtactttcttctatcatagtgcttattcctgtactgcatgtattgtctccatgaactccttgaggatgagaagactgtcttatccatttgtattttcagcaactaatatactgtctgcatatagcagaggctgagtaaatatttgttgaataaagaatcatgaaagatacaaagaattgcaaaggataaaaaagaagtattagatagtgtgctgtcttaaaggagcttatgcatcatttacggaaataattacttatatattctaaccacaatgttctatagctaatacatattaacactatctctgctatatgcatcacctcacccccaactcttctttgtcgacacactgctcgcagcttctcctctatcctgtaacacaccatctatctatccaacccccgaaacactgtccccacccaaggtggattcttccgtgtatttcctggccccggtactatccgatctgcggcactcccctctgttccgattcatcccccccccttccccttccctcttttcccgccccccccctcccttttctatcctacacataccttccccgtccactgcgagctatccagcacgccctatatcattttaccccggcttacggtcctccacccgcgcccccccctatagggaccacccacagctacatttccaccttgccacgactccacccattctatccc

SEQ ID NO: 5294 - DNA, 528 bp, Homo sapiens
ctgacctcatggttcagcagactacatttgttgcacttgaccaactggaagactgttcatacctgccagaagaagccctgggggaggcaagaaggcaagagagggagaaggaacttaccccttcctgcttggctgtctttttgattacattaccccaggattagaacttcacatgggcagcagcagttggtcccactttccagctttctctacactcccagaacaagcctcatcataccgtcagcaccagcaccagttggtggtgccccctcctcaaaggtctcagctccttgccaaaatttgataataccacctcctcagaagactgggttccagttcagtgaggtctcatctgagcttgccggtcctaaaaccccactttttccctttaatttaccctaaatgtgcaattgcttcttgcagttattggctctgtgttattctagtattatttttctagcacctctcctcaacctacttgaacaatttctatattaaatcacttctgataaaataaaaaaaaaaaaa

SEQ ID NO: 5295 - DNA, 419 bp, Homo sapiens
gaagacttcatggctttgatttatccccacaattctaatttctcctctggagttcccaaagcacaaacgaggaatgtcacacagctgcataaacacccctttcagctggggcagagccaagatgaagattagaagctctgaaacaaagaagaaaaggagacagggaactacaagcaaagcaatcagagaggaaacaactgggaagattttgttgagcacaagtactgtctagtgcaaaagatgctgaaactgaagttccaacataagagaaaacacgagaagccacacaagagaagccctgccagtttatttgtccatcagtccctggatttcagttcaggcacttagacttttaaccccagaatttagtatacatttcaataattaaacataaagccatttcttcaaaaaaaaaaaaa

SEQ ID NO: 5296 - DNA, 859 bp, Homo sapiens
  misc_feature (1)...(859): n = A,T,C or G
agaggcggaggctgcggcgagttcctgagttttctccacaggctccacaggctcccagtactccacaatgaccactggttctcggacttaggtatgaatcagaatcaactgtggaatcctgaagatgctcaggctcaccaagggcctgaatttcaagggatgaggctgagttgtgtgcatttcaaataagtaattgttatttgtgctaaagttttaggatctcttgtttaaatagaccataataaattccaacctgggcaaaaaaaaatatacacatgattaattccaccgttcaacgtactccttctcataatgaanggcccgcgttggcctcacgcggtggcgtcttttgacaccgcattacttttattgtagggtcaatttaatatactcctcctctaacttgatctggcgtgtctctcggtcctgttaatctcgagcatagctggatctagatctatctcataaggctgtaccatctacgtcttttatcagatgtccagcgtgcaccaacccttatttagttttgagatatatatcccgtatacgtattggctcttacatcctgttatcagacctccatttcatccgtctttttcccctaattcatccttcagccttaatgtatgctacacaagtattcactacctttccgtcttcaggtagcatattcctcccaatattcatttttccgttgctagcttcgtcccaatctcacgatccacataacaggtctgcttgcatatctgtccgtagcttcgacttcatcccttatgactttcaatccgtttcgctatactatgctttgtacccgtgacttcctttgtgtgcccttgcgcctgcaatacatgtgagaggt

SEQ ID NO: 5297 - DNA, 472 bp, Homo sapiens
cccccccccccccagaccccgacgcgccgccgcaaccacgggatggaaggctctaggttggccctgactcatccttgggtgttttaaaagcagagagttttctttagctggtcacagaagaggatacagagatttgaaacatgaaaatgctctgacataccttggctgacttgaagatggtggggccatgtgtcaaagaaacatgggcagctccagaagaagagacaacacctggctcagagccagcaagaaaacaaggacaagagtcccatcaccatacagagctaaattctgctcacagcctgaatgagcttggaagcaggtacctcgccgatcctccaagtgaatacttagtcaacatctggattttggcctttgagaccctgggaagacaatcctgccacaatatgcctgggttcatgacctatagaactgtttgataataaatgttgctgctttaaaaaaaaaaaaa

SEQ ID NO: 5298 - DNA, 780 bp, Homo sapiens
agaacacaggatcaagcttgcaaccatgaatatgaaagactatatgtttaagatggtgggagcagaaaaacaggagcctggggaattgacaacatcatgaatatgctgcaccattctggaccactgcagtcaaataactccttatatgagaaaaatgggtaacctactggattaagcacctataggtcgtgttctctgttgaatgtaaccaaaaacaaacctaattaattcaaaactctgtacgaattacaagtattaggaaccttgatatttgattatttggttaagaccaataaaagaatgaaagatgataatatgtacaaatggaaaagaaaaataatatgtgtgtgttctcttaaacatcttccagtacaagttataacttcagcaattttgaaaatttttagtgattctaaaataatgtgtttttaatgaccaaaagcaggctgctaattcatcaagtaaatagtaaacttgttcctactttgctcagatatgaagctgactgatagaaatcatcaaagtccttgggttaaaattgttcaaattagaagtattggtgtataaagaaaattgactttttactaggtttggtaattatcccttcacatgatagaaacatatgatacagcaattgaatttttagtgtttgtgttacaagccagtatttgaaaacatttactagtcgacaaaattatatatgaaaaaagcaggactgactataacaaggaaattaattatttgttgcatgatacatccaacattactttttaaaataag

SEQ ID NO: 5299 - DNA, 753 bp, Homo sapiens
cagatggagtttagctgttgttgcccaggctggagtgcaatggcatggtctcggctcactgcaacttcaactttcgccttccagtttgaagcaattctcctgcctcagcctcccaagtaactgggattacaggcacccagcaccatgcccagctgatttttgtatctttagttgagacagggtttcaccatgttagccaggctggtctcaaactcctgacctcaggtgatctgcctgcttcggcctcccaaagtgctgggattacaggcatgagccactgcacctggcaactctatctcttttttttttttttttttttttttgggtactggttgggtgaaatacccttttccatcctttgactttcaatctctttgtgtttttgaactaaaattagactcttacagacggcatatagttgggtattgttttgtaattcattctgccaatctctgcctattaaagagtctaatattaattgatatatatctaatgtaatcactgataaagaacttctttctgccttttgctatacatttttctatatgtcttatctttttttctccttggtttttccatttttctcttcttttggttaaatagatattttttagggaactactttaattcctttgctatttattttactatatttccacatcatctcatttgcagttgctctggagatgagaactaacaccttatcttaaaacaatgaagggcagactaatatatttccctccctgttgttat

SEQ ID NO: 5300 - DNA, 665 bp, Homo sapiens
agctcatattctaatttgcttttcactgagttttaaaaaagacacaaagacaggcttgtgtttggaatgtgattctggtgagaagaacctgagaacacaggacaaagtctgacatagaaggatgatgatgacaagtattcaaagaaaatgctgcttttaacagaaaacttgaaaaataaagacaggctaaacgcaaaaggttagagaaagagaagacaaacaaacacaagcaaaataaaaggagctagagaacatggcatgcttaattagctctctctttcttcatataagcagctcccaaatctaaccaggccctttcagtctttttatgtgtttctcccactgtgcctctccaaaatcttctggcttagtatcataataaatccattgacttcatttcaaaaaaatatttattttgcaaaaacaaagttattaagaaaagctaaggaaaacaaatcacagacctatgtatggctcagtgacagaatgttgtagatctggcattcgttctttcagctggcaatgttctacttccagtctaagcatgtgtctgaagtatattttgctgttaagattgaacataaacattacgatttatatcaacggtgcatttccttctaaataaaagtgatgaccaactgctttactttacaaaaaaaaaaaaa

SEQ ID NO: 5301 - DNA, 755 bp, Homo sapiens
atggacacttcagaaaaaaaatgaaattatgagaattgttttctcaaatccttttctactgcaaccttcccaccattacgagcataatgaaactcaaatgtgagtccaaggaattattatcttcatttttctactgaggagaactatcaagacttctaatcacatggaataactcattcaggaaatgaggctgggttgctgatgatggaatgagggagttggagggattagaaatgacgtatccagaatagacaatggaatcggtgacagacttccactagtggcagcaacctgtgcctcactcctgcacaaatccaaaagggtctttgaggcatttgatggcatgtgcctgtgaaacaagtagatattctgtcttgggagcttgagaaaaggccagtagcactgttctagtagcctaaaggcaaacacacatttaaatagtggtggggttagtaggcatgggatgatgagtaatgagcaggtaagaaatgggcactttaaagatcagaggtgatatgcacacattttatgaaatcatgccattttggaaatcctcttacatccctacgaataaagagtgattctaccaacaacatttacaagaagttatctagtgcaacgtgaccgtgcccaaggtcaacacgagatttcattattttcaacaataatacgacggggcgctctgccatcatactagatagagtccacccagtacaccagtgaacacgttattttatcacgggggaggaaagctt

SEQ ID NO: 5302 - DNA, 436 bp, Homo sapiens
ttgggtgaaagtctttcagaatatagatttaagaagaaaattaaaacatgataaaaataaagcagtaatgaagaaagggatgtaaacaaactatgggtatgaagacgcattactgaaaggtcatttaaaaccacgtgaaaccatatgttaaagaagaaactgatgaagatggcaacagatgaaactaaatgttattaaaatatgaaaaggtattgtttgaatgatccaaaaatagtattaaatattaaaaattaaaatagacatttattattatataatattttttcattaactgtatttgcaacaaaatgagtatataccaacatgtaaattttggaatattaatttttgaaaatttattataattaatcattttaatactatatcaaatgaaaataaaattttaactattcaacaataaaaaaaaaaaaaaaaa

SEQ ID NO: 5303 - DNA, 826 bp, Homo sapiens
tattgtgcagaattttgttgtttattattatttaattcaggtttgtgtcactgccttgtgtgacaaattcgctgagcaaacatcatctcacagaagcctgaaagtaaagctctgtccaactgataactttcaccctacgagctacgcctcctgagcgggtcaactgagacaccaagtgaagaaagaagtcatcctccttaggacagcaggctgtgagccagcatcccttccaactccacggtcaacagcacattacagggacaggcagagagaggccacaggttcaagcaggagacgtgttagtttagccgtttcttttggttgttggtattagctcctcagacatgtgtatcagagaaaaaaggctgtggttgggttttgtagtttgtagttgtaataaaactctgtgtttgagtttaaaagaatcatgacttttgtgattccctataacaagttttatagaattagggactgccctaggacaagaatattaggtcagtgaaatttgtccctattctttctcctctcattgctacaccttggctgagagtgggtactcccccttaccaaatgctttcacgggacccagagtctttctggaatggagaatacatatctggcaagctcattatttgttcccagaggtgtatgaaattaatgcatagctcccaagtatttgtctcaaaaagaaaacctaccctgagggaagaaagagaacattttagcaaaaggggactgattgctaatgggggcattttaggtatcagaggggggacaaattttagggggagagttcggacatattcaccatggtatagaccgcgag

SEQ ID NO: 5304 - DNA, 751 bp, Homo sapiens
agacacttggtagaatgcaccggtgaagctatctggtcctgcgcttttctttgtggtcataaggctccgatccctgctgagaggaccctgctccacacccagaaggaaagaaagcatgctcacagagaccacaaaaaacctaaacagacactgggtttccccactcttttttcttttttcttttttttttttgaagtggagtttcattcttgtctcccaggctggagtgcagtggcgcaatctcagctcactgcaacctccacttccctggttccagtgattcttgtgcctcagctacccaagtagctgggattacaggcgtgtatcaccacacctggctaatttttgtgttagtagagacaggttttgctgtgttggccaggctggtcttgaacttctggcctcaagtgatccacctgtctcagcctcccaaagtgctggaattataggcatgagccactgcgcctggccttctatatttaaaaacattatcttcttaatgttgcttttgggattaaaattaataacatattaatctaattttgattaatatcaacttcattttaatggcatctaaacactttgggcctatagctctgttctttcccttctcctttgggcttgtattggcaaacaaactaatttttatacataggggatgcatcaacacagatttataattattgaattatttctctatgtggctggcttttacattaaataaaagaaagagtttcaaacaaaaaagaaa

SEQ ID NO: 5305 - DNA, 787 bp, Homo sapiens
aataaatttaaatttttattctgttcaagcggcaaccttttttactcgacgtcatttaaaaggcattcaaatttgcaattcaaatttttggttaaaatgtttcatcttgattgttttctaatctagttatgaattttattagttggctttattaataacaaacaaccccccaaatgacagtggctacaaccgtcattgatttattgttccagacagatatccatggctgtggatcaacttctgtggctctgtcccccttgtcttctcacaccagattccagcctcttcaagaagtggtccttatttgggacatctagcaagacagacctgtcagaaacacttgatgccttctgaagtttttctttttcttctcagatgtttctatacgctatattccctcacattccattggctaaagcttgaaatgtggccaggccctaaatcaatgggacaataatgtagtacctctttaaggaggtctctataggccgcatgtcgataaatgattcaggataaagcccttactagaaagggaacagagcaaaaattgagcggcaaaaataagatctaccgctggaaggtggtactgatccctcacacaagttatgaaaatgtggtggataaatcattgagaaactaatattcaggagataaatccacactttttaaagagacatgtatctgtcatgaataaaatccaaatgctgacgatgtcttcagggtccaagaggatagaggatttaagaaaagaataaatgtcaggaatactttttttctgaaaaagtct

SEQ ID NO: 5306 - DNA, 402 bp, Homo sapiens
cgcccacggtgcgtacgaggggggggggtggagaaaaaggaggagggctgtggccacggaccctcagctctcatacctgagcatgctcagatgagccaagactgcaatctcaggagtgtaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctcaaaaaaaaaaaaa

SEQ ID NO: 5307 - DNA, 163 bp, Homo sapiens
aggataattcctctaaaagataaatggtatgtgagcagatgagagcatccatgcaagtctgtatgtcagttatccagcaacgttcgtgaactaaactaacatgaaaatccttcctctccaaattgccgaataaaatatttaaacatgtttaaaaaaaaaaaaa

SEQ ID NO: 5308 - DNA, 348 bp, Homo sapiens
cctagcagccaacagaatgaagaagcagctgtactggaaggatgaattttggacgggctatagttccagtgattcaacggttttttttccactgtctgttctctaacaatttccgggcctgattaaatgtttttatggatgaaaacatttttttgaaaaaaatggctgaagaattaatgaaaaatgagaagaatgaagaaaacatttatgctgaatattggatatttctgtgcccatatacttgcttgatgagattattacctacttttgtatatatgtttgccagcaagtcattttaagaaaaataaaaataaaagataatatgctttccaaaaaaaaaaaaaaaaa

SEQ ID NO: 5309 - DNA, 836 bp, Homo sapiens
cacgagaagcactattacggcgcgccgcgccacacgacaaatttgtactgctgaaaaataagacttctctctggtttagtcttcatttgcaagacctgcactcttcgtcctgagcctcagacctggcttccagggaagccacctattgtcagaagatctcctgcctttaatctgccagcatataggagttttccaatcattgacaacaacaaggcctctttatcaagacagacctctataaagaagtgccccttgtgataaatgccaacactgttatagtcttctgctaatattattaatgatttatatgagtgccttctatggtctagagcagtggtattgaaaatgtggtctgaaggttcccaaagtctttcagagggtctctgaattgaaaactactctcacaagaataccaagtttttatttgcctttctcattgtctttctcccatgagtgtacagtggaaatttccagaggttacatgatgtgtgatacagcaacaggttgaataaggaaacagatatgaaaaatcagctgtctttgattaagccagatataatgagatttttttaacaggccacttttctcactaattgtactgtctttcaaaatgccagtatgtctcattaaaatattgaccttcatcggcacctacaatggggttattgttattccccaatgaaaataacatttttattttttttcaaaaacacacaaaaaaataggcccgttgggcctcaggcggcggggccttagcgggccgccttccctttaggggaggggttaactcatgaacctttagtcaccgaatattctgtcattccggcaggctggtg

SEQ ID NO: 5310 - DNA, 461 bp, Homo sapiens
ctgcgtgaacatggagaattcccaagcagatttccacgactgatccatctttgatttgttaaaatgaacctcacttggctgtggtgctatccttttattcattgctaggttgtttttgcttgtactttatttgggactttcatatcaatattctcataaaagattacattgcatagctaaattgtttttaagtgccactctcactcatcttttatactaatgttatgcttgcttcataaagataattcagaaggttcactttctctgttctgaaatactattaaactgcctaagagccatctgatccttaataatttaaaattatccaactggaaactgtttgtgcctgattttttatgataactggctcaatttcttctgcaataattggtcagattcattttttcagttctttttgagacctttttttattaaagcctttttaaagaaaaaaaaaaaaa

SEQ ID NO: 5311 - DNA, 285 bp, Homo sapiens
gctttgaaaaagttagctgccatgctttcaggacactcaaccaccctataaagaggcccatgtgacaatgaactgaggactgctgtaaagaaccatgtgagtgaaacatcttagaactgggtctgatagcccctgtcaagccttcagataactatagcctcagccaacaactggactgcagacgcctgagaaactctacaccagaacctcagctaacttctctccaatccctgattcacagaaattgtgatttaataaatgtttgttattttaaaaaaaaaaaaa

SEQ ID NO: 5312 - DNA, 624 bp, Homo sapiens
aatataccagccatgtacactcaagcttcccacagcgatcagcttgaaagagtctactgctgctacaatgagtttttatcaagggtttcaccaggttgtccagtgctgttcccaaacttctggacttgagcaattcgccagcctcaacctcccaaagtgtgggtattacaggcgtgaggtaccacccccagcctaaaatactgacttctagcaattaatatcctaagaaaaaccaatggacatggaagcgtcatcgatgacatgacacgtaactactttcagcctcatttcagcgtcatcgatgacacgacacataactactttcagcctcatttcagcgtcatcgatgacacgacacataactactttcagcctctaaagaactgacagcagctaaggataatttctaatgccacaagctcaggatggatttgacgaaggaactgctctggagaaatataatttttaaagtactgaccttatactaaaaagaaaatatttgagaggcaagtggaagagaataaaatattagggtttggcacttctgtaagtgagcctatgtgtgtgggaaaagtgaagggattaaatataagacctgaattccccataagaaaaaaaaaaaaa

SEQ ID NO: 5313 - DNA, 287 bp, Homo sapiens
ctaggtgtttcaggagactggaagtatcaattcactgtagcccagtatgggaaatttgaagattatgaaaaaaaaaatgaaagagtccacactgcagtttcgatcagaaatctaagaagtacctgctttttctcaatctcctttagttagcacttaatttataagaaaaaagtctttcctgtgtttggtaaaggaaaattcagtagtgatgtatttcttatttacccacattgtttgtaatagaataataaaaaaattgcaaagtctacataggaaaaaaaaaaaaa

SEQ ID NO: 5314 - DNA, 215 bp, Homo sapiens
cctagaaatgtgcaagtataacttttcctgaaatcagacgactgaggcaggtgtctcttcatgaaccctttcattactagcatcttgtgatttttataggcatgaaatgtagatactatggcactgttgcttcattcattttaaccatctctaacaccctatgatgatgaccgggagaaataaagcagccagtttgcaatccaaaaaaaaaaaaa

SEQ ID NO: 5315 - DNA, 267 bp, Homo sapiens
ccggccccattaagcctctctggtatatgtttttctgactgacttgttacgtgtaacgcccagcaatgaagtatgaagaattcagaaatgaagaatttggtatctaacgttttcaacttactgccagtacatacgctgcccaaaaatcaacataaaaagaacatttggaacaggaaaaataatttacagaaaacaaacattttaagaataccactttcttgttccagggtgaaaaataaacaatgataatcctcaaaaaaaaaaaaa

SEQ ID NO: 5316 - DNA, 214 bp, Homo sapiens
ctacgggtttgtctccaccctcccacctaaaagggaacgtgatggaatacagcgatgaagagtactggcactagagccaagctggccagcttcaagccccagcttctccgtttcctatttctgtgaccactgagcaatttaacttcttaaagctaattttaaaaatatctttttattagagaaataaaaatgataattcctaaaaaaaaaaaaa

SEQ ID NO: 5317 - DNA, 557 bp, Homo sapiens
atggttgcaagatctattaggctgatagaaatgcatccctctgcaacaacacacagcacatgtggtgggggaatgagctgagagaaaatccgcgggatggagactgggagcctcatgcctctaatttgtcatcacgctgaatcatccaacatcctcacctacaacaaattactgagactagcaccctgcttactcccttccccagctctgtgtgagacaccttggcgccagatggcaggcaggagatggccaggcagataatacaggttctcctgagtctgtaattttaatacattccaggcagagaggtcctgtgtgatctgcccgcaggagaaacccagggcattgagcctctctggtagacaacactctcctcgtgttgtcacaatttgctgatggaaggattaagtgcatccagtgtgattccactggaagaagactcttggaagatcacaccttgttttcttcatgatctatccatgcacctcttgtctttgctaatttttttttccttcactgtaataaatcacaggcatgcatgactaaaaaaaaaaaaa

SEQ ID NO: 5318 - DNA, 413 bp, Homo sapiens
  misc_feature (1)...(413): n = A,T,C or G
ccttagggaatctcatcaaacaaccagtgnaggatcaaccaccagagaaaagaagagaccgggagtcatcaccatgtccccaacagaattttcatctatccttctgaggacagctccaagtgactacctagaggactttgcttcacaataagtcaaccttcattcctgtgcagccccacccctcaccttcccaaagtgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccaacaattctcccatcctgtgcacatcaaataaattctgtatgcgttttcctttaaaaaaaaaaaaa

SEQ ID NO: 5319 - DNA, 521 bp, Homo sapiens
cacatgttcctaggagacaagtacatttgcttggaaaactggtcacctaatttccaagaggacagagctaacattatatgtctcagcatccagtccatcctagatggatttcgattctatctagggaatctcatcaaacaaccagggaggttcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttaaaa

SEQ ID NO: 5320 - DNA, 440 bp, Homo sapiens
gggaccaagagaattaagccaaaaactagactattacaaaatctttcttctcaaggaccagcttcacatcagcaagtaccttcttcagttaaaactggtcacattagacttcaatcaaatccatctagtcaaaagatccatggtctctcaaagtcatttaaatcctattgcttccaggagatccgagatgaatcctagtcaaattttccctgtacaacaaggaagtcttctttcatcctcaaactcatgtgaacttacttcttaaacaagttccagatctgctaaacctcacccaggaaaatcttcactgaagttcaccaaaaaatctaaaacacccagatgtttatattcaccataaattagatcaattcaaatctctttccattaattgaagaaattctcaaatcaaaatcaagccaaactcattaatttggccaaaa

SEQ ID NO: 5321 - DNA, 271 bp, Homo sapiens
atgagcttgaccataagagaaatgccaagattgatacataaattcgggagaaatgatcatataagaggaagttgaagtgatggaagtaaatccttcttgaagacaactagaagagaaaagatctgatgatagaactctggagacatttgctgagagattgaaggaagcagaaatcaatgagagaattggctcttcttggctccttcgttccttgtattatatattcatttattcaaataaatatttactgggcgaagtcctcgagagagaa

SEQ ID NO: 5322 - DNA, 709 bp, Homo sapiens
tagggggcccacttcacagtcgacatggcagaagtttaattagattgcctcaagcaagaatgttattctccaagtttcacgatattggcattaactcccggactgaagagttcacacaggtgagcagctacaagggactgaaacatccacttccgcggcccactccactctccagaagacaagagtccttcagaacagggagaagtttaaaaaaacacatacacacaaaacaaaacaacttctttcacttggaatatccctgagaaatccagggttaatgttcaactctgggtgtgtagtggagaccagcccagcccacaggttcagcggagcagagagcaaagaggccagccaaggggcacttccctgctcatgtctcatagtcaagggaaagcacagccttccagccagtgtccaccctccaggggcggtcaaggtgaccaaacggaaacttggtgaaaaggcacagatgcaatcaacatcacacaagctacctctaggtctacacctgcgccatccaagacagcagtcaccatccacctgtgactcctggagggtggctagtcccaactgaaatgtgctgcgagaaatacagcccagatctcgaggactgagtacaagagaaatagtaaatatgttaatcttcatatgaattacatgttgaaatgatacatattgatagattatattaaataaactaaaattaaaa

SEQ ID NO: 5323 - DNA, 787 bp, Homo sapiens
ctggcttaacaggaagcatgactttgaagcctcaggaatcttacaatcatggtggaagatggagaggaagcaggaacatcttcagacgttggatcaggagagaaagagagcaaactgcgaagtgccacacacttataagccatcagatctggtgagaactcactcactatcaggagaacagcaagggggaaatctgcccccatgatccaatcacatcccaccaggccacacccctgacagggtgaaaacaattgtacacgagattttgttggggacacagaaccaaaccatatcactattgaattggctaaattcatgatacacggcataactacattttgaattggctaaatacatgatacacggcataactacattatccaaattcaatttgagatcccttctggtccagtttttactttttgttcctgttctattgccttgtattcctatagtcctgactatttttattgattacagaatactgtattttaaaaaaggagaaaaatttatcccaggatcatgttgtcttctgcagagaacatttctcattaattttgacccggagataagagacgctagcaatccctgatatctttaatccaattaagacattgaggacctggcttcagtccccgtgaagcctttgcttttccagttatgtttatcctacagggtatcatttagagtccccatctggaaaaatggagggtatactaggggacccccttttcaaagaattgtggatatacctccaaagctctcactcctggacctaacattaacc

SEQ ID NO: 5324 - DNA, 468 bp, Homo sapiens
cctccctatagtgagtcgtgttgctggcttcatagaaggagtttgagtcgggctctgccacccaggatgaagttcagcggcatgatttcagctcactgtaaaactccgccatcagggataagtcatcctcccacttcagtctcctgagtatctgggactacaggcacgtgccaccatacctggctttttttttttttttttttttcttcgggggagacacagtttttccatattgctcaggctggtcttgaactcctgggcacaaggtatctgcctgtcatggcctcctgaagtgctgggattgcagacgtgaacccctgtgcctggctgacttatttttaaataacttctgaaaatgcacaaagcttaattgtgtagcttggtatattttcacaaatgtatacacttctgtaactattacccaactcaaaataaaaaaaaaaaacatttccttcaaaaaaaaaaaaa

SEQ ID NO: 5325 - DNA, 730 bp, Homo sapiens
gcatgttatgtcggaccctaccaactgatagggccggtcttggtgtgccaatagcctcaaaacacctgtgtgataaaagccaaccatcccctaaaagaaggactgtaacatcagaatcctaatgttagaaattaatcatttgagtaaattaaccatgagaatggggacagtccttgtcacctaagtttctaaagagctatatccgatatttggactgtttttaaattttagaattgaattgaatgttgcggcaatgttcgatgttgttcttgtagagtatttgtattttccattgccatggtgagagaataagcttagttttagtttctgtttttgttttctcattacaaattttcatgagtaatattgttcatgagcatctcactacttcaaaatcacttggaaaggaaatcaatttcaccagaaaaagccatttttttcactcttctttgtaaaagaattggtggagtctgttgtcaaaatcttcagagcaaactctttcactgtaataaatgtaatgcaaatctcctttgctgtcctccaaattttacataccaaatatgggaatcaattcctcagtgtctaagatgtatttctaaattgaataaaaatcaactgctgtggaaaaaaagaaaaacaaatgtatgcacgcacacacacacatatacgtaattttatgtcactattttttagaataaaagactatattctttctggaaaaaaaaaaaaa

SEQ ID NO: 5326 - DNA, 461 bp, Homo sapiens
cctgatgaaaacgcctgcacagtctactgctgggtcgccaaatggctgactttgcatgcatctgtattaaaaatggcatccggctctcagtcttggatctgggaaaatgtctgcagatattcccagtgtctttcccacacagcatctccaagcctctccttaactccaggaggtgggaagcaaagtgctctctcttggcctgggttgcttggatccccagtgggaagtcactgaaccatcaatcttccaatcaacgagcctttaaggtgggcctacaagctgtcacttgataattaagagatgtgatgaattctgttgaggccttcctgctgtgaagctcatgaagtcccatggtgctgattgcagtgagccaagattgtgccactgcactccagcctggcaacagagcgagactccatctcaaaataaataaataaataaaaattttaaaaaaaaaaaaa

SEQ ID NO: 5327 - DNA, 543 bp, Homo sapiens
ccgcgctcctctgcttgctgtcattcctggttgcttgatggcagtagggtgtcttggctaagtgctccgcttctctaattgctgtgggccagctcttctccctcataggaagaagctacgtcgctttctgcaagtctcttaactcttaaggaacctacactcccatctcctacatgagcggcaattgctagaagatgtctcaggtcacttcaagccctaagttgctacattaaccctgcactgctgtggtctctagacaacaagatatttgaaaaaggacggaaattgaaatactatctttccatgggagctgacatttattactacgttgacatttattactattactcatttaattttacagaagtcctataactagacagttattaagaaaagcagaggtcaaatgacttgtccaagaccacgcagcccataaagagcctgcctgtgtccaatatacgtgccttctctataatattttcttccaaagaatacctaagcctacatgtaatgcagaataaaatataccatctcactctaaaa

SEQ ID NO: 5328 - DNA, 780 bp, Homo sapiens
ctaggtacctagatgcctaaaagaattagaacagagtacctctgaggctttatgttgtctactgacttatggattttgaatggatgaaaaaggccttgctttgccatgctgttttgatttatgggagtttatcctcataaatggtatgaagatatttttccagatcattactcagttttatcaacaccatttattgaaagtccaacctaatctcctggatttcaaatactcaacatgtacagatttttctttgtttttattccttaaacaatatggtataacaactatttatataacatttatattgtattagatattataagtaatctaaaaatatttaaaatatatgggaggatgtgcatagcttatatgcaaatactatgacattttgtatcagggacttgagtctgtggattttagtgttcatgggagtgagatgtgggcaggagtttggggggtagcttctgcacccactttctgaccgctactgcaccccaccaccgcactttaccgctcggccttgcccacccccgatttctaacccctattatccgctccatacagccctctcccctccttatgtttctcattatttctctcccttacctctgcatctaatctcatcccgctcgcgccaatcgtcctcccctgcctaagcccgtcgcatcattccctcgcccttcctttattcgggtctcatttctgatcctctcttattcgcttttttgctcctccacattactatccagatctccgacatctattaccttactacgtcct

SEQ ID NO: 5329 - DNA, 508 bp, Homo sapiens
ggagtttctctcctgttgtccaggctggagtgaaacgacattatcttggctcactgcaacctccacatcctgggttcaagcgattctcctgcctcagcctcctgagtagctggggttacaggcaccagccgccacgcccagctaattttttgtatttttagtacagatgggatttcactatgttggtcaagttggtcttgaactcctgacctcaggcgatccacgctcctcggccttccagagtgctgggattacaggcgtgaaccactgcgcccggctcacgatgttaatctttactcaatttcatgtttcccctctataggaatattacattcctggcttcatttattaaatacccccaactctcctctgatctggcataaccctctgtcgatataccagagtttatatatgtatgggctttttaaatgaactcttttcatattttgtcaactcaagattttatatcagtacctgttttaatatacgaatttctggaatgtcaaaa

SEQ ID NO: 5330 - DNA, 645 bp, Homo sapiens
ccagtgatcagcccagtctgcagtgagatgaattcatgcctatgcactcaaagcaggctggctcaggcccgaggtggagtcatcacccccctggttcgactggattggaactgtggcattccacagactgcccagaccagcgtcagcttatcagcagcctgcgctgaattccacccacttgtcaatgctttctgcccagtgaaacgctatctcctaaaatcagtgctagtgtgacaggtctgagcagaaaagtgtccccacgacttacttgtttttcctgtactgccaggtatctaccataaattttatcatgttcaatggaacacaaatggcttcccggggggcagcgttatgttaataactttggatcttgcaaaagttgcttatctgtatgagcttgaacttactcatttttaacacaaaataagagaatctaattcagagggctgttgtgagcattgaagccattcacatgatatagtgatttagggcatggtagagtgactggtagataaatcttttcttggtggggtacttacgtcaatttttataataaaattttgtacgctcctccctcatagcctccccccccccgcgcccgatgcccacaataatacacaccaaaatcggcgctagttggcctca

SEQ ID NO: 5331 - DNA, 759 bp, Homo sapiens
taacaccccgctaatttttgtatttttgtagagatggggtttcgccatgttgcccaggctggtcgcaaattcctgggctcaattaatcctcttgtcttgccctcccaaagtgctgggattataggtgttgagtcaccccgcccagcctcgaatttttacttctaatcactctatatatacattacttacttcatttcatagcaaccctatgaggtaaaactattatcctattttacagatgaggaaactgaggcagagaagtcaagttacatgcccaacatcatacaaccaggaaatggcacagccaggatctgaatccgggttgtctggtgccaggacccaggttctcaagtactctacgtgtctcctctcaaattagccttaaaatgagatctgagatatccttctctctctcctcctctctacgtctctttctctctctccctacccctcccctcatcagatgcctcattatgactctggttccactctcctagttcagccccaggaggataggagatcccaggtaacggaccatccacaaagtgagaaatctacttactcattcggataatcaggaagccactagctgtattacagtttacttcccatatatctgtcctttgtcaggagaaaggcttctttctctgcccctacaatcttcgtgtgaattttagacccagctacttgaccatacacctaggaaatctaaatcctcaagattcaaggcacaagtgggaagataaattgggaaatcga

SEQ ID NO: 5332 - DNA, 238 bp, Homo sapiens
atctggggatgaagccttgatttgaaccaccaaaactcagggtacaggaatgctcctccccaagaatgctgttatctgtaaagactttcagtgctctttacttttcaattaccttgccataaggatcttatcacacctctctccacgttctcttccagccaaattataacagaaactaggtgaatagccaggtgatacatcaattaaaataattcttgataatagaaaaaaaaaaaaa

SEQ ID NO: 5333 - DNA, 232 bp, Homo sapiens
ccggactggagcattgaaaacaccaccaaatctcagggtacaggaatgctcctccccaaaaatgctgttatctgtaaagactttcagtgctctttactttccaattaccttgccataaggatcttatcacacctctctccacgttctcttccagccaaattataacagaaactaggtgaatagccaggtgatacatcaattaaaataatttttgataacaaaaaaaaaaaaa

SEQ ID NO: 5334 - DNA, 585 bp, Homo sapiens
aatcacccaaatctcaagggtacaggaatgctcctccccaagaatgctgttatctgtaaagactttcagtgctctttacttttcaattaccttgccataaggatcttatcacacctctctccacgttctcttccagccaaattataacagaaactaggtgaatagccaggtgatacatcaattaaaataatttttgataatagaatgcttgatgacttttgtcaaatatcttgggagacaagcaaatacatctatttttgctcaaataagaggattgtttagatctccaataatttagagcacgttattgatatagtgcattgccatacataccctggggtcacaagattttccagagtatatgtgagcataagaagctttaaagaactcaacttccagatacacaaactccttttgaccactttccttaaaaagatgcttgagaaggcatttgtggacttccagttcttcttttccacttccgtttttgcattttttctggtttacaaaagacaggcattcctggtactgattctgaatcttactgtggaacattactccgaaaaataatcaaaaaaaaaaaaa

SEQ ID NO: 5335 - DNA, 1321 bp, Homo sapiens
  misc_feature (1)...(1321): n = A,T,C or G
ctccacctactacgatgagtcttatttcatcatgtctgcttggtctcctctggtctgtgaaagtgtctcagttttgagtgttttccatccactcttgcaggcctgtttctctacatgaactttagtatcaacttacctgaacaccccaagaaaagacttgttggaatttttattgatattgcaccatgttactcccataacctacagagaactgatatctttatgacattgagtcatcttgttcaacaattggagctatctttcccacttcttaaagcctacttttgtgtcttgcaagaatgtttttaaagtcctttttgtaaaatttggatgtttctaaccagaataagcttaacaaagtttataccaaagtatttaatatttcttattgctgttataaatgaaattttctctaacattatgtcctttaactggttattatttgtgtatatgatagatattgggttttatatgttaattttatttttatttttagtatttatgggcacataatagttgtacatatttatgaggtacatgtattattttgatacaagcatataatatgtaatgatcaagtcagggcaattgggtatctatcacctcaaacatttatcctttgtgttaagaaaattccaaatctacttctccagttattttgaaatatataaaacatagttacgctattgtactaccaaatactagatcttattcttactatctaattgtatttttgtacccattaatcaacccttctttcccccctcaccatatgntaattttataccctggtactttactgaaatttttgttgtttgagatattttatcattggattctaagccttttcaggacagtacctgtcatggactgacttgtgcttccncaaaattcacgtgntgaagccccaagcctcagtacctcacaatgagactgcatttgcagatcgagccttagagagtacagtaacgtgaggcctttaaaggggccctaatccatcctgagtgggccctcatatcagaggananttgacacaccaatagatgaccggcatgtccttgccacacaagacactgtaccagaaagagccattgagcccaggagaaggcaggagagacacctccacactatctgcatccaactacacttgaatgactccttatccagtcacaaaaccacaggttcctgcctcacgtgccgtgccctcctctggcgtaccgaatgcatgtccgcctggcgtgtatgcagcgacacacgcgttcccttccgatgcgacgtataatcgtaagccggcgcatgtcgtggtgttgtccctcgttcg

SEQ ID NO: 5336 - DNA, 739 bp, Homo sapiens
taggattgaggccatcaagctacagatggtcttacaaatggaaccccaatgagctcaactaacaacttctactgaggacccctgcaccaacccgctggccctttgactggcataaagagttcccctctggaggacactacaactgcagggctccttcttcaacccatccagcaggaagtagctacagaggtcattgcccaattcccaacagctcttggggtgtcctctttagaggggggattgagaggtgaagccagctagacttcctgggttgagtagggacttggagaacttttctgtctagctagaggattgtaaatgcaccaatcagtgctctgtgtctagctgaaggactgtaaatgcaccaatcagcactctgtaaaaacacaccaatcagtgctctgtgtctagctagaagattgtaaatgcaccaatcagcactctgtaaaaatgcacccatcaacactctgtgtctagctaaaggattgtaaatgcaccaatcagcattctttacaatggaccaatcagcactctgtaaaatggaccaagcagcaggatgagggcagtgacaaataaataaataaaggctggccacccgagccagcagcagcaacccagtcaggtccccttccacgctacgggaagctctgatctttcgctcttcacaataaatcttgctgatgctcactctgggtctgtgccaccttgaaaagctgtaacactcaccacaaaggttcgt

SEQ ID NO: 5337 - DNA, 777 bp, Homo sapiens
tcaggcctggagcacagtggcgtgatcaaggctcacttcagcctccatctcccaggctcaagagatcctcccacctcagcctcccaggtagctgggactagagggtttggaggttggaggctgctggtctataaggaagagagaaaggcagaagagagagagatgacatcaccgactccccttatggccttggtatttgcgtcacccacaggaaactcaggcaatgagcattccctggcccaaggacaagtgcctagaggagcagcaacagagggaagttccccccaattccctcttccgtgaaagaaaaataaatcttgggacccccaaatcactaagctaaagggaaaagtcaagctgggaactgcttagggcaatccagcctcccattctattcaaagtcatccctctgagggtcacctgagacaaatgtatatctgattgcttcctctcccctattgtttatgtaaaaatacagattcactgagccagactaaattgtatatttagtggaagactgacaaaggactcagaagaatgcaaccttttgtctcttatctactcctaacctggaaggaccacgctttgagttgtcccaaattactggacccaaccaacgtacatcttacacatattgattaaagtctcatgtctctcttaaacgcataaaagcacactgtccccccaacaccttgggcccatgtctcaggactttcagaaactgtggcacaggcacgtccttacctttggaaaataaactttctaattgactgaaaa

SEQ ID NO: 5338 - DNA, 785 bp, Homo sapiens
agactcatgaaacttactttgaagtatttgcagcccttgcaaattcagtaagacattctcctgtcaacaaaatttggaccatgtttgttttaaactccatcaaacctacatagtgctgcaaactgaaccacacatggacacactgctcttctgaggacccctaggtgaaccccagaaggaaccctccctgctgttccccatttgctgtgcccttttagcatgaagcatccagaaagagtcatcgccccaaaccctctaacatcagttaaggtgacttctgcagacggggagagatggaatgttaaaggagttattaagaaattattttaagcagatagagaagaaaagaggcccttggaaattttttctcttttaaagcagctccagaaatgtttcttgtttcacaggaaagccccagatcttagacccagaaagcaaactttgatatgcaaatgctggccagaagaaaatgggcccacccaagcgtcgcaattcctgccttcttctctttaaccttgccttcacatgtccctggcagcatggtcaccctcatacatccccacatgtgtagaatggtgccctgcattttcatattgaaaggctagggtgggagagccaggtttttcaaaggctatagtgagtgacatgcctggtcaaaccattcccctgagactaggcaaatcagacatcgcctccttcagcccttcttctataactggatcgattcccccccacttcgcagctcctcagaacgcttggacaccctctccctttgaataacacag

SEQ ID NO: 5339 - DNA, 785 bp, Homo sapiens
aggggataattcctcctgaaatccaaacactgtccatactcttctggtgcacccgtttttacgttggattttgcagaccaaagaaactttacttgcagaccaatatttaggaggttgggagaaaatgggcttccagttgtgcatttgggttagaatctacagacatcttttacttcatgcatcttcaaggaaaaaaactggacagaaaggtaacccagttaaaacagatttatgtcagcaggatgcttcctttcaaggcttattagatactaccggatgctacattttttctcaactttaaccaaggctgaataatttttttctaaatcatttgatttccactggaaccactgaccagaaaatggttgtaatccaactgatttcttaaggttgaaagtaacgacatttctttacatatgtttatgtaaactgagggtgactgttgcttttgaaaagtaccaaaatctgaagaacagcaaattagtgtgggatcagcaaaggaaaagggtgtacctctctacctatgactgtccttataaacttggactttctggggctaggagaagctgacttatgaatagcatacaatctgtgaggaagaggccaagctgcagacctgcatgaatagggacgcggtttcactgagaacacgagagttccttcttaaaggccgtcttagatgagcccggccccgttcagacgaccatactaccgaagttcaacgagttaacaaccctcactttacttgaacaaccaaaaactaacacggtctccaatacaatggc

SEQ ID NO: 5340 - DNA, 784 bp, Homo sapiens
tacctgtgactcggtctccaggcttcctttgggttgacttggctgagtgacatctggcccagcactccggggccatgcaaagaccttggggtgtgctcctcccccagcatctggaatgttattgctccgtctgctctgctgtggtccctccagtgggccacttgctcggtcagctttcccagtctctccatagcaggttttgaccgcatcttcaaactggagtagtcaatactgtatgtgacaagggaatactatgtgcgacaaggaaagttttaaggctcatgactgtaatcccagcactttgggaggcagaggcaggtggatcacctgaggtcaggagttcaagaccagcctggccaacatggtgaaaccctgtctctacaaaaatacaaaaattatctgcgcacgatggccggtgcctgtaattccagctactcgagaggctggggcagaaggattgcttgaacccaccatgcagaggctgcagtgagccgagatcatgccaccatgccattgcactccaacctgcgcgacagagtgagactccctcttaaagaaaacataaatagaactactgttccagacttcccagtttctggctaaaactgccttctcctttccttctcagcgtatctgtccctaaaaaaagacaccttttcacctacattgtacctaacaattgtccaaggtggaaacactttgtaagggccaatgaggcattctgacaacttgaaaacccatactacatatcaccacctgcatatatccggttgctttgcgcacg

SEQ ID NO: 5341 - DNA, 782 bp, Homo sapiens
  misc_feature (1)...(782): n = A,T,C or G
aggaataagatgtctttcacctgcagtgcccacaagcatgatgctataatgagtcacctgcctgtggttactctgagtctccttttatgaagcatcaggtacttgctcctccagggcctcctgcctgctgttactctaagcctcctacctctacgaagtatcgggtgcctgctcctctacgccctcctgcctctaagaagcatcgggtacctgctcctccagggcctcctgcctgctgttactctaagcttcctgcctctatcgctcatcaggtacctgctcctccacgtcctactgcctccatgatgcatcaggtacctgctcctccagggcctcctgcctgctgttactctaagccttccacctgtatgaggcatcaggcacctgctcctcccggttctcctgcctgaagatgcccatcgtgacttcaccacccaagtagaaattcacacaattgtattccctttaaactcttcctaatgattcacttgatatgaaagtttaattattgatgcatgtcaatcttttagtactatattttctcctaatgtcaaagtccaagagaataagggcattaaaaaacataaaaattttagaagggtttctcanatgtaaacaaaaggttctatataatttcattttagaaattttagctggtttcctgttacttttctatgaccatttttccatatgaatgtttctatctctaacacaatnttatgttgaagaaaacacaatatccatgcctttctctcacagctggaaaggggagaagagagact

SEQ ID NO: 5342 - DNA, 778 bp, Homo sapiens
gcagtgccacaagcatgatgctataatgagtcacctgcctgtggttactctgagtctccttttatgaagcatcaggtacctgctcctccacgtcctacggcctccatgatgcatcaggtacctgctcctccagggcctcctgcctgctgttactctaagccttccacctgtatgaggcatcaggcacctgctcctcccggttctcctgcctgaagatgcccatcgtgacttcaccacccaagtagaaattcacacaattgtattccctttaaactcttcctaatgattcactcgatatgaaagtttaattattgatgcatgtcaatcttttagtactatattttctcctaatgtcaaagtccaagagaataagggcattaaaaaaacataaaaattttatcgaataaatatcagactatttgacaaacacgccagtcattataacccgcccgtcatcttcttctttctctctcccaactctcaagtcaaatataaataaacctcccatttgtgtcctccactaatttctttcgctaagtttattctctatattacttggtatcctgacacttagatatatctcactcttggctgtgagtagcgcaactcgctcgaccatgacgtaactctcatttaactcgataacccgtagactataccatttcttactatctaacaaataataaagttttcgactaactaaccgaacccacacctcccttctaaacaactcctattaatctatcgtccctcttattctctttatccctttcttttg

SEQ ID NO: 5343 - DNA, 779 bp, Homo sapiens
gacccgaagtttttaaaaatcaagacatttcacatagcaatctggctttctggcttctcttggaagtgcatctggtaacactgggacccatgcctgcagggctaaagccactggcggctgcctctgtggacagccagctctccccagttctccagagccgcatccctcccacttcactcagctgcattacctgcctggccccctgagatatatgcctgggatgactcaggtctagagaaagcttctcctttctacagtgggtttcacataggtatgccttgagtaaaaccatctgatgctttaaaagaaaagtttaaacatgactggcttagatgatcttcctgctctttccaatcagtcttacccttccattgtcacattcaacttgaacgagaggagaggcaatttcataaactctctctctgtggcctgttgtgctcactccaatccatgtcatggagtatgatgcctacatgaaggtcaccaccaccaatgccactgtgcttaccagaagtgcctcacaccagctggatcaataagaagaaaaccttcacatgcagctgccttctatatggggatgggggcaaagtcatttcatacagccccaaggtgtctaaaaccccaaatcacctcgcggggcatggcaaatatacctttggctataggaggtgcatttgacccttcccaggctcagcgtggaaacttggtcgccaatgttcacagtgggacttagcggaaggcgactggacctaggaagcgatccctgatggatgcgttgg

SEQ ID NO: 5344 - DNA, 331 bp, Homo sapiens
agctgaccacttcactcaaggaggtacagaggaaaagaaaatggagaaacaaaacgaaacgccacagcaagatgcctccaatccttctacctcttgagaagtagcatcactgtagctatttctgaataaacacaaggagattggaaagaagcagcttcagtatttcagttggaaactaaaattatccagcatattttaaaagaccattaaagaaagaaaggaagcaagcaagcaaaactatttattggcctcaaatgctatttctaaaatgtccatggtgttcagcgcctatgatattaaaaacaaaaatgtaaaaggaaaaaaaaaaaaa

SEQ ID NO: 5345 - DNA, 204 bp, Homo sapiens
cagaggctcatgacatgtgataagacaatagcctgaatgcagaagcaaataaaagaatccagctgactcctatgaagccaggcatcacagagatgcacatggaccctagaacttaaagaacaataaaaactaaattaaattaaaaaattaaaaagagatttgcaaaaaataaacaacagtgcaatgtctctaaaaaaaaaaaaa

SEQ ID NO: 5346 - DNA, 339 bp, Homo sapiens
ataagttatatttttgaagtttagtaagtattattagggatttttcactgccacattgtgagcaaatagacttattttctttataaattacctagtctgtggtattttgttaaagcatcagaaaattaaataagacaggtggataaagtttctcagtcacatgttggaagccagatgcatgagaatggaagtgatccaatcaaagtcaagtttaaattggcagtgtttgaattttgcatattcctctattctcttattgaaatacaatgtaattgtatgttctatttctaagcatatgaataaagtctaaagttattttcctagttaaaaaaaaaaaaa

SEQ ID NO: 5347 - DNA, 271 bp, Homo sapiens
  misc_feature (1)...(271): n = A,T,C or G
acttattttctttataaattacctagtctgtggtattttgttaaagcatcagnaaaattaaataagacaggtggataaagtttctcagtcacatgtcggaagccagatgcatgagaatggaaatgatccaatcaaagtcaagtttaaattggcagtgtttggattttgcatattcctctattctcttattgaaatacaatgtaattgtatgttctatttctaagcatatgaataaagtctaaatttattttcctagttaaaaaaaaaaaaa

SEQ ID NO: 5348 - DNA, 253 bp, Homo sapiens
atctcccttttatcatcggatgatcttgcatgtacactagcaacctcaaaagtcatggaatgagtgaaaaccatcatcctaggatattctgcattcctgcaatttgggagctggatttttggtaaacaatcaaaccaatcagcttgagagagagaaaatattgaatggcaacccaaattttaccccaattactgtaaaccatgaaatctgttttaaccaaataaatgctcagaaaattccaaaaaaaaaaaaa

SEQ ID NO: 5349 - DNA, 316 bp, Homo sapiens
tgggtctaatggaagaggaaaaccagaggggagtggtgcacttccacttccacttcttttcaacagacctggtggtggcttcctttataattgtggccttgatgttgcaccaagaagccttgttggacacttcacctttgggcccacagtctggcaagatcccttcctccatactccaatgacatggctcttcctggagaatatgctcgtattcattttctatgtggtgctgctgtttcagaaattcttttgtgattctatacacatggacatgagcattccctattaaattttttcttcttcaaaaaaaaaaaaa

SEQ ID NO: 5350 - DNA, 327 bp, Homo sapiens
  misc_feature (1)...(327): n = A,T,C or G
cctggtctaacggaagaggaaaactanaggggagtggtacacttccacttccacttcttttcaacagacctggtggtggcttcctttataattgtggccttgatgttgcaccaagaagccttgttggacacttcacctttgggcccacagtccggcaagatcccttcctccatattccaatgacatggctcttcctggagaatatgctcgtattcattttctatgtggtgctgctgttccagatattcttctgtgattctatacacatggacatgagcattccctattaaattttttcatcttctgtgccatccaaaaaaaaaaaaa

SEQ ID NO: 5351 - DNA, 392 bp, Homo sapiens
aaagaaggaggaaaatgtcacaggtaccacgaaagcagtctggaagatagattggagggagacagaatggaagaaaagataccagttggctcagaagatagattctggttgcttggactggagcagaagcagtggaggaggaagaaaacaaggaagaatcagagagaaggcaaagtgacaaaggaaaaagatattgtgccacaagctaaggactgttggcagcctctagaagctggaagatacaagaaatggaacctccctggagcctccagaagaaaccagtcctgctgatgccttaatcttagccccataagattcattatggacttccggtcttcagaactgtaagacaataaacttctcttgttttaagccatggaaaaaaaaaaaaa

SEQ ID NO: 5352 - DNA, 839 bp, Homo sapiens
  misc_feature (1)...(839): n = A,T,C or G
aagagtttacttgcccaagatgtcacagctataaaatggaagaacataatttaactcccagaaagttggacttcctagagtctatcacaatgaggagaaatacacatctgaatgtttaagtcatcatggagaatattaaagaaatttttgtatttagttgttaattactatttacatctccttgacattttcaacataataatggcttgattatttaaagggattgagaaaaacagtgccaaacttactggacacctgctatgttctcagcactgtgtcatttcatatgatcagcaagaaagtttaaaaactttgtttgattatccattatgctaaaataaaggcacttcgctctaatattcagatttcttaaattgttttaaaatatacctgaaaaagaagattatagtaaaatgatgggtaaaattagaaacaaatgagcaattgaattgaaagattacttgcccattttcaacatttgtcacaatatgaaggtatttgagacatataagcacataatattatggtaatacagaatacatttaaaggtgacaaaatatttttcaaaagcaggaagatataaactccttatctatctctctattcatatatctatccatccattttacttgtgtacaagaatctttgtagagaatagtttttgtcaccttatgcccattcatttgtatagctccacatctgtttttgctgataaactttcgtcacctatagctttgtgggcttcaaacattttcttcattggncggcggttgccccaggaaatgatgaaatcgaaaagataccttgggttgatgagcctttaaactctattgaatggg

SEQ ID NO: 5353 - DNA, 266 bp, Homo sapiens
agatctatggactgacagaaaatagaggtttgcttcacatactgatgaggtactttgcatccaaagaaacttcatatcaaaaaccaataggtaggtaagaattttaagattagtgaggtttccaaattctataggattattagatgataaaaaaattagaaaaataaagtacactccattcaggaataagctaatgtgatgtaaattatagtcaaaatatgtatgtataaatgaataaaagtgttactcatataaaaaaaaaaaaa

SEQ ID NO: 5354 - DNA, 784 bp, Homo sapiens
ctgttgggtgcggaccagcatccattagttcacataccaagaaaatgtccagatggatgtcctgtgctctctcatgggtcctcctggtctccgtctgcaaattcattgccaatttgccatccttcaaacaaagagtagtgtgattctatggaaagatgatgagcacccaggtctggtcctgccatactgactaggagcaagtgagtgggcctccctcacttacaccctccttgggtcgacacgcccaacccctgccgaccttccacccacaccgactactccctccccccctccccctgcccccgagccccgtcccctccgctcccgatggggtacatgggaggatgatgaggaggatgagggacacttcgcgccgcgctaccgcgcgctcgtccaccacattcccccccctccccccctccctcccccgcattctctcgccccgacgcggacgtaaagcttcacctcgccttcaatttaaccgccactctctccatcccactacctccccccacccccccggcgtcccccctccccccctccgcgcgcagggcgtgagtcatgtgccacctccgtccctcgcgccctttatatcgttttaccagctcgtagtgccgagtctttaactatcttgatagccggtcgatttatttcatctcccctactcgatgctcccgccctcttcactcacctcgtcaacgccacctcacgtcctaatatctctaagccccccttccgccccgtcattcccgtatttatagcagatttgtccgacacacctcgt

SEQ ID NO: 5355 - DNA, 558 bp, Homo sapiens
ctgtccgatctgtcagggtactccctctctttctacgtctgtccttctccatcgcctatccgctacggggagacccagctgccattggatttcccaccgggatggatgaggactcagacatcgcattccatttccgagtgcactttggtcattgtgtggccatgaacagccatgagtggggggtctggaattgtgaggtgaaatctgacaatatgccctttgagggtggccaatcatttgacctgcgcatgtgagtgctggacaaggatgaccagataatggtaagtggccaacactgctacagcttggcccatcaactcctgccaaggtctgagaaggtggtgcaagtgtggagaggtatccccctgacctcaatgtgtgtctgagattgaggtgatgtccacactccccactgactaggaatctctgtttctacgtgaccatgcgggtcccatagcctgctgacaacatgatccctacttactccttgccctacactagctcattacaacttcaccaaacttgaaaaaaaaaaaaccgggctctgtggcctcagca

SEQ ID NO: 5356 - DNA, 777 bp, Homo sapiens
tgttccctctggactccttttggaagaacctcctgatgattagcagcatgaagagcataaccgataactgcagggatacagttcagctgaggaggaaagtgggccaagatggagtgtcctatctataccacccatcacacagaacattgaaatgcatctatattagtggtgagaagagaggcggcctgggggtgaccttgaaataaaaaagaagcatatggaaataagcctagtgctctcaaattctggatctaaaaagcaacaaagagaatctcagtggttgatgtgtcggaaatagaaagtgaatgagtttgagattttatatatatatatgcaaataataacaaattgtcagttttctctgacaaaagttttaattctgcttcgtggctttaaacatatgcagtatatctagcttcgacttagaatatagaaagctggaaggaatattgtttccacccttacaataaacacaacaaaaacatgctggattgtctattaaattacaactttcttcaacctactagattgctgaggacaagaaaacaaactgaagaaaaagaacctccagggagacaaggaggcaagcatttgtgggagaagatacagctgatgacaagaagtttgctaaatttcgagtaaataattgaggccaagggtgggcaagtgtgagagtatagaaaccctcagcacccttttctcatggacctcttgagaaatatgggaacacagcgagacgcagaagccaactttctttgtggtgaaagtgtaagggag

SEQ ID NO: 5357 - DNA, 732 bp, Homo sapiens
gccctcttgttgctactgagcatgtttgagacctgcgaggaggaggaggcctctatcagggcaaagaatttggagctgcttccaatctgaaacttccttagcgttgtaaaaagcacccttcattcgaaatcgctcagtgcctggactcagagaaagtgggagagttaccaaggctcagggggcaacatggagtccatcccggagcactggggaaagggacccagaggctgtcctgccactctgcactaacaacaaggaacagtgtaaggttggggcattgatgtccctttctagggcacctggagctcttttggcttgcgaatggacatctgctgattttgcctgtctgggacctggtcactctctgccacactttggatcttcccttgtggcgggcagtcaaagggaccatcagttaaggttccacactcttatctagccaagaggttggaatgaagcccaagctgggtcagtcagattcgcataggaattttaaccttgaacaggaaaaggaaagaaattgaagatgacgtgaatcactggtacttccctaaagagactatgacttcttgctacgtaaaacttcctagttccaggactgtctgatactggattttcagcattggcttttgctaaatgactactacaaatccgttaataactccttttttcccttgtgagtcgcgagagtaatacccgccacttaccatccacaacgacggaattagggag

SEQ ID NO: 5358 - DNA, 779 bp, Homo sapiens
  misc_feature (1)...(779): n = A,T,C or G
taggtgtggcaggcaggccctgatatggccaattcaaagtccctcttgttgctactgaagcatgtttgagacctgcgaggaggaggaggcctctatcagagcaaagaatttggtgctgcttccaatctgaaacttccttagcgttgtaaaaagcacccttcattcgaaatcgctcagtgcctggactcagagaaagtgggagagttaccgaggctcggcccccaaggcacagtgagaagaaactgaggcaatgccaagaacaccccgacctcatgagcttcaaagaagctgctgctgcagttcccggttctgaggcacctccaagaccactctcatccaaactctcaaaacactccccttggggggcaacatggagtccatcccggagcactggggaaagggacccagaggctgtcctgccattctgcactaacaacaaggaacagtgtaaggttggggcattgatgtccctttctagggcacctggagctcttttggcttgcgaatggacatctgctgattttgcctgtctgggacctggtcactctctgccacactttggatcttcccttgtggcgggcagtcaaagggaccaccagttaaggttccacactcttatctagccaagaggttggaatgaagcccnagctgggtcagtcagattcgcataggaattttaacctttgacaggaaagggaaagaaattgaagatgacgtgaaacactggtacttncctaagagactattacttcctgctacttgaattctctagttccagt

SEQ ID NO: 5359 - DNA, 949 bp, Homo sapiens
aggaaatttggacacagggacagattccatagagggaagaattatgtggagatacagaatgaatatcagctacaagccaaggaatgcctgagactactaaaagctaggagcggagcctgggacagaatctccctcacagccctcagaaagaaccaaccctgctgatcttggacttctagctccagaactgttgtctgttcgatatcacaatggatgcagaagaagcatttgaaaaaagtcaacatcacttcatgataagaaccatgagcaaactaggcatagacggaacacatctcaaaataaaaaagtcatatatgacaaaaccacagccaacattatactgaatgcagaaaagttgaaagcattcctttcaacaagtggaacaagacaaggttgcccactttcaccatttctgttcaaacatagtactggaagacctaaccagagcaatcagacaagtaaaataaaaaacaggcatctaaattagaaaagaagaggtcaaattatctctgcttactaatgacatgatcttatgtctagaaaaccctgaagatttcaccataaactctcagatttgatgaatgaatttagtaaagctttaggatacaaaattatcatacccaaatcagcattgtttctatacatcaataatgatcaaactgaaaaacaaattaagaaggcaatcccaatgacaatagctatgaaaatagaagcctagaaatacacttagccacataagcgaaaggcctgtacacagaagactatgaaatactgatgtataaaattgtagatgatgcccacaaatggaaaaacatcccatgcttatggaatggaagaagtaatgcccattaaacaatcattcttttccaagcaacctatatagtcagtgcactttttatcaaaatgcaacatttttttaatacaaccacacaaacaacgctaaaattct

SEQ ID NO: 5360 - DNA, 296 bp, Homo sapiens
ctaggtggacgtgctgctgctttcatggcctcagatcaaaatacaacctcattggctgctgtgaacacaatgttcctgttgaagaatagaatggaatggagttaagagtgtagaaggtctgatgcaaatttactcctactcctattgacaaagagtttgaactactgaatttgtatatgaaagtcagggcatcctattgttttcagttgtcataagaaaaaaaaaaagaaaaaaaagaaatggcgttactactgtcaatataaataaatgaaaaatctaagctaaaaaaaaaaaaa

SEQ ID NO: 5361 - DNA, 391 bp, Homo sapiens
cctagacagtgcacaagcttcagctgaatctcaagcctcatgcagttttctctgcttggaatgttctctgcccagccttcacctgcccagcttcttgtcctacaggtctcaagtcaaatgccttcttctcagtgaagacttccctggccaccttgtcaacataaatgtcatctggttattctctctccagcctgtggcctattttttctaaagaacttttcagaatctcatccatatcttggtttacttgtttgtaaccagtgtctctcctccagaatgtaagctccaggagagcagcacttcctccttgatgttattcctgcttcaatccttagtgtctagcccagtgcttaatacagatttgttgaataaagatccattaaagtgaaaa

SEQ ID NO: 5362 - DNA, 781 bp, Homo sapiens
cctagattgaaactaaaaatcctgatgagttcaatagtgccctagttaagcagtaatgcaagctgaagaaaattcttccactgttaggctgggcacggtggctcacacctataatcccagcactttgggaggccaaggcgggtggatcacctgaggttaggagttcgagaccagcttggccaacgtggtggaaccccgtctctgctgaaaatacaaaaattagccaggcatgatggcaggtgcctgtaatcccagccacttggggggctgaggtgggagaatcgcttgaacccgggaggcggagattgcagtgagcagagatcgcgccattgcacaccagcctgggagacagagcgaaactccatctcaaaacaacaacgacaacaacaacaaagaaaattcttccactgtgtagaaaatgcatcaacattattctaagactttcttcaggatatcccaggcatttaaagtcagccctttaatactatggttcttatttaaaccagagattaatgtataaccaaaactgaaagcttcataggttacattgtgtgaacataaatgaaataaaattactgtgatagaaaaaaaagcggagcgacctcaattcgcttagctcggcccgcgctccagcgcgggtgcgagccacaatgatcaacgaaggagatacacggcccctctttgcccacggcgggggatcttcggcgcgccttccttttggggagggctctataacccccgcccccacacctgggggcaggcaaaccgttagcagaaagaa

SEQ ID NO: 5363 - DNA, 778 bp, Homo sapiens
  misc_feature (1)...(778): n = A,T,C or G
cctgggtttacgcctgggactatgcgaacatttttccacttggctgcacaactctttcagttaggcattccctcagaactttcagcacatggtggggcactgtgctctgtacataatatccagcgcctgccgtcaggaagctcacggtgcagtggggagatggaccttggaagagaccacgagaggaggctatgccgaggcctgagcagaggagtggacgttctgtgctggatgcctctgctcggactttgcctccctctatggctgagcggactcattcaggcagtgtgctttggtgcagtggtaccatttccccagtgctatcctggccccagccacctcatctcccattggagtgatggcagcaactgccctctggcctccctgttgccattctgtcctttgatatacattgtccacacagcacagagtgaccttttaaaacatccatcagggttatatcactcccccacttgaaaaactgcccttggccttctgttaacagtaaaatacaatcctgactccatactgcagccttcaaggctcctggtgacccagcccactcctgtcacccccatttggcttgctgtctgcagccacttgggtcttccttctccccctcagacctgctcctcacttgggcccttttccttgctgtttccccatnaccttttatttcccagggaaccttcttgactacccttttagaataatatcctaatcaccttccaccactttatcccataatcctgttttattttctgggcaccttttatct

SEQ ID NO: 5364 - DNA, 436 bp, Homo sapiens
ctaggctggacagcagtggcgccatctcagctcattacaagctccgcctcctgggttcatgccaatctcctgcctcagcctcccaagtagctgggactacaggcgcctgccaccacgcccgggagaaaactgaggaccagcgaagtggcttgcagaagtaacaaactccttaacaagtgctatggcaccagctcatcagaatggacactggctttaatggtattaactgagtcctgaaggccctcttctccttatttcctgaatattgggaagatccaaaggtttctgcaacaaaggggacagccaagtaaatggtggaggaggatcttttaggggctcgtggctgaagccactttgtctaccagaatggcaccattacaatattttgtcaatgaatatagctacacctatgcttattaaacaagtctggtgaaaa

SEQ ID NO: 5365 - DNA, 752 bp, Homo sapiens
ctgcctattgatgtacgatcatatgcagaaaagacttacgcatctattatctactgaaagaaaaactacagaaaacaataaaatgctagagactctttaaccaatcagaaaaaaatacgtaagtgaagcagctacgacatcacaaagcttctatttttcgctagcacatgaaaatatgagacctgacaaattgcaaactctcattgaacagatagtttagggttttgccttgaaaaccatagtccacggatcaagcatcacatcttttgggagtttgtgagaatctcagacccctggcagacctgctggatcagaatctgcattttaacaagattcacgagccactgtgtctggtctgaataaaggaatttttaacttttaattttaactactttaaatttaaaaactgatgtttggttcagcgatttgaaaacagtatatttggaaccgcttggatatgagaatctgctttttaaccatacattgatgaaatctaaatagagaacaagcatttccgatgacagctgctctctcagattgaaatgcactgcaaatgtaaaatacacaccggatttcaaagtctttgcaaaagagaatgtagcatatcacattcctttttttattgattgattacatgttgagtattgattggttacatgttgaaacgatatttcgggtataataaagcggggtcagggaaatacatttttcccaaataggaaaaataactggcaaaataaacgactatcaaa

SEQ ID NO: 5366 - DNA, 767 bp, Homo sapiens
ctagaatccaccatggatttattacgagtgaactgcattgatttactacaagtagaaggatataatttgatagcagctggaaccttaaatggtgtgatcatcttatggaattttgtgacgtctacagtcaaaaaagtgtaccgacctgaagattgcttcactgtaaaccctgacttgcatcccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatgcatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagaaggacatgttatcctttgcaatattagctctttcctggatccacctcatgatgaaaaggctctggcatgccctcaatggacattattgtggatattttggacagcggaggctctttgattatcacagacaagagatttcattttgccttgtgatgttactgaatatcccatagaaataaaagaagaaagcaagttcacagagaggccaaaatatgaatatcctctgatatttgacccggaaaatggagaaaaatgacctaattgtctctacttttcaaac

SEQ ID NO: 5367 - DNA, 752 bp, Homo sapiens
ctggatatacttcttgaaatcttcaagcaaatgaaacgtcttgcaattcccccaatcatactcactctttacccactctgtgcatttcctctacctagaacagtctccccattacatccccaaagtctaaatcccatccttttcaggccctgtctggatgacaagaagccattctctgtggctcagtggaattatccaggatcttaactttcataactttcactcagcacctatgggaatttcctcagcccatctcgatcaaagttactaacacatgccttttattttcaagactggatgctctctgagggcaatgtctacaactgctccatctttgtaagcccacctgcaccatttgcacttatgcccatggcaggtgctcatgctttttgctacagtatgcaagaaggatgctaaagtgtgctaaagctcaagtgactgatcatttaaaccaaatggacaagtacctgcactcagacaagttttgctgaagaaagacttcagttaaaaagatatgcaatgagacttgtttccttgtgaagcaaactgagagaggagaattgtaatgctactcccagggcatttaccgactagtgatctgccaacagctactaacggtggtgcattaaaagcttccttcccattgaggtaactgataatatacttccaaattagataaaacataagatagctgatcctgtctttcccctgctgcaaacttaaaatcccgtttgcctctggggcccttggat

SEQ ID NO: 5368 - DNA, 767 bp, Homo sapiens
  misc_feature (1)...(767): n = A,T,C or G
gaaccaacccctgatatttctatgatgtgcctgtagattgaggaggcagtagcagcactgggagctggtcctctcagcaccgacagcaagccccacagcaccactgttaggttttggcatgatcagcaaccaggaatattcccacaaccatcccagccaggaggggaaatggggtcgtcacccagtgtgcagaacatataaagacatcccttgggaacctcaaaattggaacggagatgggccagagaaatacatttgtgactacgtctgtgacctgaatttttcctaccacagtatgtgactcctcagcttctgactaatggggtacaggggatgctaccacaaaatatggcagcttggcatactgggttttttaacctgaattaaattgagaaaactgtagaggcaagaaagtcactctaccttctcctgcctttttcccatggaacatggatcgaaaagaattttctgacctactttgcctgaaaataagtcctaagaccctcattccagaggggtcctgccctatacctggagagcatgatgattctgaacaaacaggccttccttaattctccacagcttcttaccatcacatgcttttgtctttcaatcacacttctgtacaagtgatcatacaaatactgttttccctgggcctttggcgtcttcttttataacggttcccatgctatgtanaactctggataaatacaattcgtttgtccttgtcctgtgagaacataaacatatccgttaaccgtctg

SEQ ID NO: 5369 - DNA, 295 bp, Homo sapiens
ttattctcaaccccccccgcattctttcatactgagcggccgccaacccagaccttgtgcgacacagaagaggaaaatttttctctggatcactggaaagaatcctagaaatcagagtattgtgccctttgaaaaatattgaagaaactctacaaagtcttgctcttcaacacagttttttggactccatacagaacactctgcattatgaccagacaatggacttattgccacggtggaataaaggatagattttaatctgtgtaaaaaaaaaaaatcggtctttttggcctca

SEQ ID NO: 5370 - DNA, 225 bp, Homo sapiens
agaggctctgaggatcctggtcatggtctatgtgtaatatcaaagcaaacatggtccctggataagcctgcaccaagaacctcttcttctgtgtcacgactgagcttataaaatttctggaaagtttctctcagagtcaagcttggacaggattttatctgctttccaatatgtactagatgtcatatgctaataaaatatgcctaagatctaaaaaaaaaaaaa

SEQ ID NO: 5371 - DNA, 875 bp, Homo sapiens
gtaggtacaccaagctcagaactgaattcaaagcaagaatgaccagaatgtctacaggtttggcccagacttcagcctggaggtacaacaacagcctctctctacctcttctcagggctcaggacggctcaaaagcacattccaccttcaccgccactcctaactacgagccagctgggcccagagcccggaacataccaccaggatgtaccaggacagtctatgccttcctggagtggctcaatcatgggcagcctgaagccccctcttcacaccctagagacggcatccagactccaacctaggcccaaggagggccttccttcctggtcagtgatctcctctgttccttattgggctgatccagggaatgtgtccagtgcagccctcaccacagaccctgaggatcagatcatccctcaggctcctggctcagtctgggccaaggatctgaccacgggaagcacaggaagatgagctccaggcaaacccaggaaccagggcccgagcagggaagctctccagtggtttgggagtaaccatcaccaggtcttgaatgctggtccaaagaggggcagggcagtgtgaagagcaggagccagacccagttcacatccagccttatgaatctcatgctttgtaacctggaacaagtaactcaacctctctgtgcttcagttcccttcagtaaacctgggattaatagtagcatttacttgtatagttactgggaggattaaaatagtgaaaacgtgaaaaaaacaaaaataaattaaaaattttttaatataataccccaacaaacaactcatggccctcgtggcctaaggggggggctctggggccgttccctttaggggggttaataatgatcc

SEQ ID NO: 5372 - DNA, 773 bp, Homo sapiens
cctggtttgaaaatttgcttttatgcaatgacagagtcttgctgtgtcaccaggctggagtgcagtggcgcgatctcagctcactgcaacctccgcctcttgggttcaagcgattctcctgcctcaacctcctgcgtagctgggaccacagccatgcgccaccacgacaagctaatttttgtatttttggtagagatagagtttcaccatgttggccaggatggtcttgatctcctgacttcatgatacgcccacctcggcggatcccaaagtacatcagtttttttcagtttgttgttttcatgttgtattttatgtctttcaattttctgttttaagagtgtcacctataaagcacgtttttttgtttgtttgtttgctttttactgagtttgacaatcttagtgacaactgaagtatttagtctatggtgaatcataataattactaaaatagtggggttttaattagccatataactatgtttttagttcacctattccttgttttcttttttaatttttatctcttcaacagcttttgaattaataatttttttctttatttggactccttagtgtcattctttcaatcttctattactggtgctactaaatatgtaggagacattacattttctgtggtttatttattatattgaatacaaattattttctctaccagttcattcaggtattgttagaattagaaaacattcaaaatgtgtttacttcatttcagattttgcggtcattgttaaattcattttactt

SEQ ID NO: 5373 - DNA, 442 bp, Homo sapiens
tagaaaaagaggacatcaaatggaattatgtacgtggaataacggacatacttcaggaaaattcttatggatactacaacaggatgaaacttagcaggacatggttctacttggagccaagggatttattcataaaatggaagagggaatcatggtttcacagaaacaggggattatgtgctctgcatcacagccaagcttttggaagaaatattacaaccttaagagtgggcaatggcaaccactgagaaaagaaagcaaaatgtacccgtgggagctacactacaaagagaaaaggagccacagggagtctttgtggatatgaaaatgggccctgagcttgagggtagcaagctctctgctaatagcttgtacttactagtatttcctacagtttgaacatgtatattaataaaataattcaaaaggaaaaaaaaaaaaa

SEQ ID NO: 5374 - DNA, 764 bp, Homo sapiens
taggcccaaaatgcatggcacagggaagggtttgacaactttttgatggatgaacaaagaagattcaagccacttgtcaacaagctcaaagtgattgaaagtggaagcatttacccacacgctcatgcagaaaatgacaggaaatcatccagagacacttgtgacagagatgagaactgtcactgttgagaggtgctgcggagatgggtgtccacggatgaccgttcggaggccgacttcggggatgtggccccattagctcaagagtgggtgactccctaccacactgatggcgttggccaggacaggacaagcctactgcagtgacacagtgtcactgatccctgatgcccacgtgggtgtttactttagctgatgctgcagagataatgcagacagagaaatgaggccccagcgctgagcagcccaatcacctggttgtaagcagcgagtgtttctggctctgctcctgggccccaaaccactgtgggctcacgaagaatctttcagagttggagtcagaatgtcagggtttgagtgtagtctccaccccttaatgaccttgcattgatgattctattggccgagcctcattttacccatctataaaatgaggacaaatagcttatttgctggatacttcactaagatgttgtatcgaaaaagactatactgcctacactgctttccttacttgataaggtgagggtttttgtttgtctttggttcctctctgcagtccgtggagggatcggtgggatggg

SEQ ID NO: 5375 - DNA, 166 bp, Homo sapiens
atggtctatgctcccttgcgagttactggctggctagctgtggattaaaatgatcaagtagtctactgggacaagaagaaggccttgggcaaccactcaccttacgatgtaaaacctgctcttacaaaattaaacacagaatgagttgcattgaaaaaaaaaaaaa

SEQ ID NO: 5376 - DNA, 1035 bp, Homo sapiens
tgcataagtttaattgaaaagtagcttaaaagccagactgacgttgcaatgaagatgaagaaaaacgatttcagtttgcaactacttatgggtgtgagtcaggatgttctcaatactatgtcactagaatggaaggtggaagtcagaggctgcacagttggaaggctacagttgttgcgttgtatttttaagcctgatggtgtaagaattggaacaatgtgggacaaatgccagacagcagtgtggcgggggctcccttgcgtgggagtagatgggcccttgagcactgatatagcctttctttccctgagcaccaaggcctgagcacctctggtctggctggttcctgactatccatgggctgcaatgaccactgaacttgagcaagcccctgtgagcaccctggggcagccgggaaccgagtcttccttgcccctgctggctgactttccgcagtcaaccaaaattcaacctgcccaaggcatcattctcagcaatttttgcacccattcttgatctcatgatctggcctgactcaactatatagatgcctattgctctgtctgccacccacttcccacctacacgtctctgggaattgctcttctgcctacaggaacaccacaggaacccaggagcagccatatcacacacgccttaaaccctggccatgactcacttaggagtgggccctccccactggacgggacaatctcagcttccggaccaatcaagctcttcttccagaagttttggaactgggtctggagaaaaagacctgtctctatctgaatggctgaacttggacttgtgcaagttttccatgatgtgggctggaaaatgaaggaagctggtctgcaatgagagggtggtgatagacagtcatggtaatgctgaagagcggcgatgagagctggagaaaggatatggagggacctgatattgtgaactatgttcttcatgagtcttggtggcacttctgtcctagaattctgaatttccataataaatctctaaattttgcctaaactaaaa

SEQ ID NO: 5377 - DNA, 346 bp, Homo sapiens
ctagagcctctgactgctggagctcactgaggtaccgctcagcctgcttggttgcatcctccgcatggcgagtcagctctgagatctgaaggtcagcatgctcacgctcggcctcacatgtgtcaaagtgattctggatctccttaagtcgatccaacatctgcagttgctgtttttccccattctccagttcacatgttaaattctacgaataaagcatgcaaaacattaggaacaaatccttgtcaaaattggatgtgtagcatatcatcaaacaagaatctctaatgtcactgaagtggaaatcatctgtattaaaattcattagcaatcaaaaaaaaaaaaa

SEQ ID NO: 5378 - DNA, 784 bp, Homo sapiens
cttgttctaggaagtcagcgtgaatcggctttgcgttccctgcctccagaccctattttcctgcctcatttgggagaagattctaatccagaacccgtggctcttcacgcgtacagaaccagctccacacagagaccccagaaacctgcagatggtgcagtctcgggaaagttttgtgaacacatggcgagaaaatatcagtgccagagaaataagtgggtgaaagactctgtgagttttggtgatattatgatatggttttgatttactggtattgactgaaaataaaagagggcacagatcttttctgaaagtgaattttacttttgtctccgtggacttgagaaaaagaaagtcactacagagacactcgcatctgcccaatcctgggaagcaagaacctataacactgcgttggccctgcttcaaaaacgaaacaaagcaacttcataaatcctggggcttgggctggtgcttgtcataggaggaaccatgctgccccctctaagatgtgcaaggctctgggacaatgtgctgggggcttaatgtaacctgagaggtgggcggggccaatcacctgcctcagtctttgcagctgatcctaggtgcagaggggaccctacctccctgaggccatgcttgccagtaactggcagagctgggatttaactctcagagtgtctatctccaaaacattcttcttggctaaattaaggagaaagaggcaaaccagtgtcacataaacactgtgtgcccctcttcactttccaatctttttcctaat

SEQ ID NO: 5379 - DNA, 412 bp, Homo sapiens
agaattgcctagaaaaataccatggactggttccttcaacaatagaaattcatgttctcacagttttggatgctaatccaagatcgagatgctggcagggttggtttcctctgcggcctcactctggcttacagatggctgcattctagcagcctcttcacaagatattttctccgtgtgcaacatccctggtgcctctcctgttcatcccaatcttttcttcttaaccattttttcctactgtattatagaaataactaaagaagaaggaagagttatgtgccttatactatgatgaagaaggacacccacaccttacctaacatgtacattaacacctgcattggcaaaaacctaaaaaataaaatatttacttagcaaagaaaaaaaaaagaaaagaaaaaaaaaaaaa

SEQ ID NO: 5380 - DNA, 270 bp, Homo sapiens
cccaccccctactcatcgaaacctcacaacaacaaaaacgcgcacgaagttgagctagcactaccctgggatttatacactgggcaggattacactgggatggatacactgggatgaattacactgggatgaattcatgggcaggaaaaaattctctgttggtcacaatgtattattatttttacatattatagggattagatttgctgaaattgtattttgcatccttgcattgatttatacacataagttgttttttataacctaaaa

SEQ ID NO: 5381 - DNA, 533 bp, Homo sapiens
aaataaatctagttatttgctttgggggaagccagctgccatgttgtaagcagccatatgaagagatccatatggcgagaactgagacctccagctacagccacatgagggagcctggaagtggattcccctgccctgtcatatcttcagatgactgcagccctgcccaacaccttgagtgcaacctcatgagagaccttgagacagaaccacccaattaagttactcccaggttcctgactctcagaaactgtataagattatagatatttgttgttttaagctgttaaagttttcaattaatttgttatgtgtcctaatacaaagcaaaaggtactataggtttttgttttgttttgcttttcttctaatttttaagtgacttgaggataggagccacatcttattcatctacaggtttagcagagtgcctaaggacataacagatccaataaccattttctgaatgaatgatcctctccttcctgtttttatcattaaagtaaattcaatgaaaattaaaaaaaaaaaaa

SEQ ID NO: 5382 - DNA, 782 bp, Homo sapiens
tagaactttcggagacattaatactataagaggaaactcaggaatttatatttcaatataaaatcagttgaagacagaagacctctcacctggcataagatgtgtgatccattatatggctagcacaaagttgtgaggcatctattttgactgttttcacatctaatttaggaatatgtaattttaaagatggaaatggtattcagatcatatagattattttgcatatgtgaataatgcgtaacagatctgttaaatgacttcacatgggtcaaacatttaattaagaagatatctgctaaaataaatagcatgtgattcctaattcaatgaacttctacaggcatgtaatcttctttatgtctatgttttgaagtaaatctagttataattattatactgccatattaagcattttggaaattttacataaaaataaaaatatgagtatatagctatatatataaatgagtagatacaattagtgaatatatgtgtctatgtatgcatataaaacactacggagaaatctctcaggaaagaaaatgttctactaaattaaaatcattaaactcagcttagtcagtagctatgaaaaattttaccttctctctactgactttaaggtttatggaaaaatgtaattttactgttattttaatggataaatttcaaaatacatttttttgaattgatactctcttctaaactaattttcacctaaatttatgtgtttttgaagccattattacatttaataaaattatcacacaaaaacaaaa

SEQ ID NO: 5383 - DNA, 411 bp, Homo sapiens
gaagacataataatctataaaaacgaatgtttatcattcccgcctctcccttgtgagcaacagaaaaccagtgttattttcagccaactgatttgcagaggagtgtgaaagaaggggtttctgaaaacaggacaaaaatcttacccagaaaatgaaaatgtaccaggaacatgttgtgctttgcgtcaacctaagttgattaatgttctggaaaagatgtggatgagtaattgccatcaaagacattacctgagaaaagaagagttttttgagcagtgacttcattggtcactggggggagttcagcatgttaatggcagccagcaagagaaaataggcttgaagaggaggctgcacgggttgccagtataccttttaaatatatcttcttgtaacacaaaaaaaaaaaaa

SEQ ID NO: 5384 - DNA, 308 bp, Homo sapiens
atgggaaaccagatgccactggtgtgagcaataccatcggagagacccacaggctgaagaatcaaagcctcctgccagtagccatgcaaataagcttgaaagagggtccgccatcccagccgagccttgagatgactgcagccccagccaacatcttgactgcaacctcatgaaaaactctgagctgcaattaccagcccaggcactcctgaattcctgaccctcagaaactgtcttagataacaagcatctgtttgtttaaggtgctaagttttggtgcaatatgttacttagcaaaaagattaaaa

SEQ ID NO: 5385 - DNA, 422 bp, Homo sapiens
agtaggttttgattgtaccaaaaatagaaggaaataaagaaggtggagatggaaactggaaccaaggaggatgcagagcaagaataagaaaggagtggtgctatgtgacggaacttatggcagagcatgtgatcaagctttcctctggatctattttattcactgtgaagctcaagacacacagagaggcctatgtggagaggaactgagctcaggcagcatcttcatctgatctcctagttgacagccagccaaacttttctagccaagtgaaaaatgggccatcttggaaatggattatccaaccttcgggaaagttctccctaccattgctccatggagcactaccattctctgtcaaaattgcaaattcgtaaagaaaataaatggcggttgtttttaagaccctaaaaaaaaaaaaa

SEQ ID NO: 5386 - DNA, 298 bp, Homo sapiens
ttggaaggtggctgttcagtgattgggagatcttgacaatacatcgagacacatttttggatgtttccaacgccacaggcattgttttagattagactctacatgaagatttcaagtatcacagcagatatctggagcactgacagttatcttgcaaccatgaggtcaagaaaaggtcaagagaatcacagagatgacagccttaacatcactggaccactcactcagtgccagaaactacctgcctctagacaccttgctatgtaaacacgaataaatacattttcaactgttaaaa

SEQ ID NO: 5387 - DNA, 542 bp, Homo sapiens
cgtagatgaataatacagaggaaagcccacgtggactgaggacatactacatggagcatggaggtgataagaccatttcttcaggaatgaccagaatagcataaaagatcaatggaagcattgccaaaaaaggaagactgaaatctcaacctttcagggagtaatttatcatttggatgagcctaatgagaaaagcagtgcagtgaatgatgtgacaatatgaaacaacaaaatagtgaatgattaacgagtgacaaattgagagggaaaaaaaaggataacgctttcattatggtacaaaagagaatttgacaaactcatccaagaaagcaaccactttttcctccgtcttagttgaacgccttgaaaaacgaacaatcatactgctttcaaggaatttcataagagtaaaatagttaaacttctatagaatttcaataattaagggttacaaatatatttaaaggattttgaagctttaataatcaaaactttataaaaattatgctgcaattattcagggcaaatcaaaaaaaaaaaaa

SEQ ID NO: 5388 - DNA, 797 bp, Homo sapiens
ctagggagtcaacaatggagccctatacttggagtaaaacaaccccttccccagcaggagtcaagaatgagcctcaggcctcttcatctcaagctgaaaaggacagagggagccatagacaatacaactaacaacctccaaaaacgcacagcctcaccaccactatcttgagtcagccaggactaatcacaccctgcccttcattatgtctgtccccataagccccaaactcaaaggttatccttcataacccatacactgatccccataatgctctgcatgctccctaacctgcaccaatctcccatattcctaacccttacactgtgatttctggaatatggagcccaatatcagcgaaacttaagttatattaagttttattaaaatgtaagttttagaacttaaaactttaagtgtattaaaactcaggttttatttacctaataaaacttaactttaaattggctccatctgaaattaatatagctactcctgctttctttcaattagcatcaccatggtatatctttctccactcatttactttatatgtatatgtatttttatatttaaagtgggtttcttggagacaccatataggtggggtcttaccttttcatccactatgaccatctttatctttaattggggcttttacactactgatgttgaaagaaataactaacaccagttgattaatatctaccattgtttgtaacggttttctatttgttgcccttgctacttttttcctatgtttggcttccaccaactgagcattgtaaataatttag

SEQ ID NO: 5389 - DNA, 1087 bp, Homo sapiens
agaaatgcagaattctgttcagtgtcttcctacaggaatcaagagaaagcacatttgaagaatctgggcttgggtaaagcagttcttctggcttattctttttcatttcattgaaagaaagaaatattatcaagataaaacatctatactgccaacatgggttccaactcttgagttgggtttcagtccaagcagactctcttcatcctgctacctaccgtcatccaaggccattttgttggaagattatgagctgatattatactatctgagagattataatcctgaaatgtactgacctcaagaacatggaaaagacagtctatgctaccatactgaaggggaagaaaagaggctagaagacagaatagggagagattaattcaaaacgtttaaaactatagagaacagtctctctgcagttactcggcacccaatatatgttaattgttgagtatatagtggtgatcaaagcagaactgacctctgtcttcgggaggtttaaacactagtaggttaggaaaagaaaagtcagaaaagtagtagtagtaataataatcataacgataagagaagaaagaaaagctagactaaataaatagatattcgtgtttttatcaggagttgagaacctattttaaatctcttactttcactcttgtgaacctgccccaggcccaatacctttgacattctctccagtgccagatataattagaaacctgtgtttctccactgtttctctgatacaaccttttctgttagctccttaagtagtttagccgtttagcagactttccctcaatacttcagagaaggcttatgtttgctcagctctgcctgaaatggggtaagaatttgggggtggaaggaaacatggggaaatgcttgggaaggaggatggattctaaggaatcccatatttaggcaactttacccattgggtaaaactcagaggaggaataaatcgattttcactaaaacttcaaccagagaaatgtattgttttgagatgcaagttgctttaatgtactttctttagcccagatatttagtgtaaaataaaaaattacaagttatttgaaaa

SEQ ID NO: 5390 - DNA, 391 bp, Homo sapiens
caggaaaaaaatacgagcctcagcatgtcgattctgtacagatttgcaagtgtagaccaaggactattagcacaaatgacaagaaatatctaagaaaatctcatgaatgttcattaagaaacatggtcacataggtcttctcatcttttgaataaataaagcatatgaaaaactgatatgtcagccacacgagtcaacaacactctaaccagaaaaactgtatatagccttcgcatgtactgattacacaaaacaaatactaccaaaatttgcatgtgactagtatgtaaacattttatcggtttttcttttccaaatgacataattacattgtattttgaaaccagattaaagtatattacccatgaaaaaaaaaagaaaaaaaaaaaaa

SEQ ID NO: 5391 - DNA, 584 bp, Homo sapiens
aaaacaacttggcttgattaatcttcttcaatttgttaagattctttatgtagactaacatgtaatctattctggagaatgttccatttgagtttgaaaagaatgtttgttattaactacagtcaacctacaactttattttctaaaagcaatctgcagattgcggagatgaaagtgcactttgaagagggtctggaatgcaggagattatgaagcacaggatgaagctcttctctgaggttcccttgtttacctagaaactggactcccaaagaggaacagaatcgccttccatcccctcccagaaacctcattaccaatagcaagaaagaagattgaggaatgcaaccacacatggatggactttcaccagatgatgtcttcctttcagtctcattccaattataaagataattatttacaagttaatttctgtctcctgatgtccatttattcttcctagtaatcatttatccttctaaagaattgagcacatttcccctacttccatctccctattgaagtgggtatataaacatcaaacatttggccttttctttgagattttaaaaaaaaaaaaaaaa

SEQ ID NO: 5392 - DNA, 802 bp, Homo sapiens
ctagatggggtcttgctatgttgcccaaactggtcttgaactcctggcctcaagaaatccttccaccttggcctcccaaagtgctgggtttagaggagtgagccaccatgcctggaccagattaataattatattatattttccaaggagtttccattttaatatttattatttgattaaccagtgtgatagttatatagtcaattgaagacatagcacattaactttgtcatctacccagaggaaatgttttcattaatgcagaggtgcaaatgatatgaagccagaaccaagaatgaattcaacgtcttcgagaaacactttactgatggcgagatctggtggtttcctaattattttggacttaagcctttcagcaatgtgtaattcctttgaagttatattggttttgtctatggaagaagcatattgttggaaataaaggtcactaatgtaactaatattttagatagattgatgaaaaacaaactctaaccttaaaaaattataacttctgaatgggacttattatcaagacattatgtctttgtatcagatttataaatgtcattttattaaaactgaggtttattgagcttttcatggaaattagggaccatattagcattctataaatttagttaattataatttgctgttcaaactctgcccactccaattgttcaaaaagccactaaactttaaaatcatgttttcgtattaaaatagatggaacacaaacatttcaggggcagtttttttaaggctttttttgcacacaaacttacctagataattctgg

SEQ ID NO: 5393 - DNA, 624 bp, Homo sapiens
caggttgagctctctccctcatttctatctggagctttggaaataattggacatataaaaaatttgttgaagaaatgaacaaagtaactctcctgttattaggcaaatcttgttgagactgagtgagtgcttacacaattctactttcagtggaattcaatgaatatgctgcatttctggtttggccaacatcactactaggttgctttctgtgcattagtattccagcccagttacttcattctagatataaagttcttttctttttttctgggttaagattttgctatgtaaatgtttatttcttgctagaaaatataagtaaattgctacagcgatttaattagtaattacgctacctgtcttcattcatttgggtgccttggtccattttagatggtaggaggcaggtcgtaatttggtaaaagtaaaataagctctcaattctctcacttatttagggaattagcaatgtgagcactcaaagtgtgccaggcattgtctttgagacactttaacatgcagcttaatagctatttaattgagcactgactctgtgcaagtcaccttgtatgtgaatactatattggtaattctcatctaaaattcatattgatgacaaaa

SEQ ID NO: 5394 - DNA, 764 bp, Homo sapiens
agaggccttggtttaagaggatggatgttcgtgtaaatgacagcaaggggagcttcgcataagatttcacttctgttcaaagacaagctaatgtaacctcactgcggtgccatcaacttgacaaatggacaccgcgcaaccctctgcctcccactgaaacccgagagcctgatttacacaatattctccctgtagatggaaaaagacttcatgctgctaggctgtataatgggttgatctgataattctttgcatgtaatgaaatttgataatatgaaggtgagatgcatctcaaagaatgaggcaagctaatgaacttgtaaaactacacttaagtcttttaaaacctgaataaacattaaaagggacttagctcgatccatgttgagaaaacgtagcagttctcatgttttaactctgcaatcaaagatacacggcctttacttaaaaggaataaaagattccagctccaaggagtatagctctattcaaacaattcaatatgatctgtacaaattgctgtgccttatctttaccatcagattttgctgggcctcagttccttacctaaagaattctacattactttatgctgttaaattattttgctgggagctgagtactcttgcttctaagcaggaaattccttaaagaattgatacataatgccatgcacatttaacaaataggtgatctgtagattgagacgtaccttagactgtcacagcaattccaaccattatagcttcataccaacatgccct

SEQ ID NO: 5395 - DNA, 600 bp, Homo sapiens
  misc_feature (1)...(600): n = A,T,C or G
cgccataataaacgagagtagagttggtcaagcattcgttacaacactacgtagagtctgacgggtaaaagtacaaggaccgagctgcgtctatcgtcaatccgcgtaaacaaaaaacaacagattaagaatctacacgaaacgcaactaccggactagggcatgcagcatgtctggcgtctgggcatacaacggactccatgcgtgattatggacttatatccggacaatcagtaactcatcttcccatccagccgcatataaactaatcacatgacgagaccaatctatcgctcaggcccgctcacgaccgggacaccttattatattaaatcacaaggcgacaaaagaaaaccacaaccccgattagtacggctggcgtctacaagactcgataaccacagaatagttaagaggcatcaaaaatggttagaagcgagaacgagttatagggagataaatgagataatatattaaataaatcaatgatgagaattgtggtaggacgaaaacttagcacatctacaaatacacgcaccgggatagagactggcacctgggcacatataacaataatacccaatacantcttnncnnttt

SEQ ID NO: 5396 - DNA, 173 bp, Homo sapiens
gctaggacataccttgcttctccttcaccttctgccatgattgtaagtttcctgaggtctcctgaggaccattgtgaagaagaaaggagctgatgtatgtgaaatacttagcataggccctgttgtgcagcaggcactcaataaacgttagttgaatgtgaaaaaaaaaaaaa

SEQ ID NO: 5397 - DNA, 387 bp, Homo sapiens
gtaccaagcagcattgtcccatatttgtccagggtagcttctccaagttggatcttacaggactttataatttgaatgggtgagattgaccacagatgtgattaactgagcgctacagtttcacatggaattgcacttcaaaaacaaataaacaacaaacaaacaaacaaacaaacaagaaaacagcccagaattctttgtgggaagtgttcctctagaattgtaaaagagacttgtaactggctattagctaatggcagaacactccatgaagaccttcataacattctagactttctgggaggtttgttgtccttctgttgtgtcctcccatcatgtggcaaggaaaaaaataaaagaaattttgcacagttaaaaaaaaaaaaa

SEQ ID NO: 5398 - DNA, 778 bp, Homo sapiens
aataatgaacttctctttaaggaatatgtaaaatgctccagtgtgttgctcccctctatgtgtccatgtggtctcatcatttagctcccacttacagggtctctctctgtcaccaaacctggagtgtagtgatgcgatcatggcttactacaccctcaacctccggtgctcaagccatcctcccacctcagcctgctgagttgctgggactacagactcatgccaccatgcctgtctaatttttgtattttttgtagagataaggttttgccatgttgcctaggctggcaagttaactattaaaaatgaatgatctcatgctcatagcttgctgtccattttaaatacagttatctggcaacataattgggtaggctcaaggctgggctaggcacttttgttacagtgatgaatacatctaggcatactatggaaacaagaacatatttaattctaagacctgatcaaaccaatcttgaatcacctaatgcagtaacaccacctttaaaatcgacaaattgcccttagaagtatggaactaatccaatagctttaacatatccccgatcacctatcatttattatcccctcggacagatgaccacattacaccccccacacattctttaatgatacaattagaatccgcgttgccagaaccgatgacacataaaaacacccctatcgactaatctcttatatgataaaactatccagaaaacccgcctttcactatggattgttattcgacaccccgccgctccactaaacacactcg

SEQ ID NO: 5399 - DNA, 962 bp, Homo sapiens
ctggaatatgaacttctctttatggaatatgtaaaatgctccagtgtgttgctcccctctatgtgtccatgtggtcttatcatttagctcccacttacagggtctctctctgtcactacacttcaccaaacctggagtgtagtgatgcgatcatggcttactacaccctcaacctccggtgctcaagccatcctcccacctcagcctgctgagttgctgggactacagactcatgccaccatgcctgtctaatttttgtattttttgtagagataaggttttgccatgttgcctaggctggcaagttaactattaaaaatgaatgatctcatgctcatagcttgctgtccattttaaatacagttatctggcaacataattgggtaggctcaaggctgggctaggcacttttgttacagtgatgaatacatctaggcatactatggaaacaagaacatatttaattctaagacctgatcaaaccaatcttgaatcacctgatgtgaaaagaacacgtgttaaattgacaaatttcccttagaagtatggaactaattcaatagcttttaaaatattatttcccctatcaatctattagtcactttggagagatgtaaacagcaaagtcagcaagcattctttgatatcacatgtataatcttgttttgaaaaactgctcctgcctagtacatcttctggtgataaatttctagtgaagaaagcatctggtaaaacttacttatcaccatggtctcataatgaaaaatggcatcctcaggaaaagagtctcctaaagatgcaatttctggaacaaggttctgtgatatctaacaatgcaaccctgcatcacttctctttacccaggcattaaaaacaattctcaattttcaaacatactgtatgtcacatgtgttatcggcaaaatgtatttttcccatcaaataaactgcagaatgcgcccg

SEQ ID NO: 5400 - DNA, 667 bp, Homo sapiens
cctgggcagggcaggagagagaagaagagagagagatgtctggagagatactgcagaaaccaatgctgctgttttgggagtgaagaaatcgaaaagctgagtgcgagatggcgcccaacatccacacgtgtcctgttccttggttccacttttcaatttgcatctgtccctccagttttatgtacacaagctcaaaatatttccctattcttcttccttccctgttacttactccttgtgtgcgttcagggaaacctttatcccttggtttcctgcagggaaataatcttcagtgttgcactgacttggtccagctggaatctataccacacagaggaatgccggcccctgccgatggtcgggctggcttcgtggctccatcctccttggcctccaacacatggagctcatttttcctgcataactttgcctgctgttcccactgcctggaatgctgatccccgcgttttgtgtagctcatcctgattcaggtctcagttcacaggacccctcccctcatgccaccccttcgtcgccacgcaccatccactctttctttcaggtccttatttggttttctcatggcatttactattgtttgggatttttttgttagtatatcggtgagctgtctccaaaacaaaaaaaccggcctccttggccttaa

SEQ ID NO: 5401 - DNA, 775 bp, Homo sapiens
aggccttccccttccatgcaagaggaggcaagctcagttgagttctcacctccaagaacttgcagttctcctggggaggcaggaccgatgcccatggaacaaggtgtgccagtgagccccacagaaaggggcagtttcctgcaccaggatacacttcaaaaaagcacaattcagattatgcattccctgctgaagatgctccactgcgtcttataccacttgagaaaaaattccagactcctctccaatgtacttcagtccctgcccaactgggctccagtcagggtggggttttttgtcgttgttgttcttcaaatgctgtccaccaccccagaggttgtttctttgctgttcgtgggcctggagtcccctttccccaggtctttacatggctgctgcatctctccatagaagttgcagctcaagtgccaccttttcagagagcccttcctggaccgttcagtataaatgaagctccttccccaagtactcctgatggcaccaacttgtcacagtgtccttctttgcccttaccatgagctggtatttttcttgtgtattgattcactgattaattgcttccttgattatccctcatgctgcccattagaatgtagctccatgggagcagggaccttgtctatcttgtcctccatggtatcctagaattctaagatgtaggatagcttaacagaggagactcttgaaatatttgttaaatatgtgataaaaaataaaaggaagaatctatgcatggcaaaaaaaaaaaaaaaaa

SEQ ID NO: 5402 - DNA, 896 bp, Homo sapiens
ctcaggttccttcctgcgtctatggttgtcttcaggtgggctaagcatttctgctgttcttggtaagtctacagtggtgggatgaagaaatatgatgtactgaatgatatttaggagaaaacatcaacaggaattgctcattttattcctcttgtgcaaatataaaaaggaaagaatcttctgtgccctgagtccaaatgaaaatctcaagcaacaaaaaagcgaagtgattgggaaaataaaatcattttggactgatcccaacagcatttcagtttcattagtgttctattaatttaatactataaccagatttcaagttctgacaaagttctgtattgcagatctcagtattaggttaatgtatgaattgtactgcactacacataaaaatgatgtaaatgtgaatgtataagaatagcctgacaatttgaaaagtctttgtaatattttcagaaaatatcctagataggctataattgaattatttgatttttacaaattactttgtattatggaaacaaatggtagttttctcaagccttaacaccattgaggatatttatgtatgtctgtttaacaaatagaaaatggtttgtaattcaccccaatgattgatatgaattagattttatgaggttttcaggcattataaggaattatataattaaatatgcttgaaaattttctttattcaagttataagtaggttctatttacataagtgaaaacataaccataaagaaatgatagtatttatgggaacacgtttaatgctcattatccctcactatattcctcattataaaggatgtactgtgattattcctattttctaaatgatgaaatggaggaactgcgaggttcagatacttgcttaaggttattcagcccag

SEQ ID NO: 5403 - DNA, 509 bp, Homo sapiens
cttgttgctacattcccttccaaatatttgtaacataggaagactttcccaatctccgaggactttctgtcttccctctttccatctgagatgccttttcaccagactctggaacttctgcattcagggtcgtgtctgaagccaaagtcagggacatggatggagctggaagccattattctcagcaacctaatgaaggaagagaagaagaccaattattgcgtgttctcacttgtaagtgggagctgaataatgagaacacatggacacatggaggggaacaacacacactggccctgtcagagtgtgggtgtggaggagggagagcatcaggaagaatagctaatggatgctagtcttaatacctaggtgatgggatgatctgtacagcaaaccaccatggcaaatgtttacttatgcaacaaacctgcacatcctacacacgcacccctgaacttaaaaaagataaaataaaataataaaaatgtgctcaatgaaaaaaaaaaaaa

SEQ ID NO: 5404 - DNA, 782 bp, Homo sapiens
cagtcactatcttcaacacaacgtcttagaaaattggacaaaactcaactttcccgccaactgaatacttggcatctcctgagggattcccatccagtcgtctctctttggaaaaccttcctggcaaagataccccaagtcagaggacaggaataagaactgtaaaatattcactatttaaaaaacaatatatagtctcatgtttatgtaaaagtttcaatttttctaatcttttaaaaataataaagtgaatttattttccagctctgattctatttttatttccaaaagcttttgaagatgcctcagaaagttatctctgtctgctatttctgacacttcagtaggaatatgcctaattgaacaggtgactttatgcctgtatttttggaatttagaagctgcagaaagcaaaatatgtaaatgtcacgtgtctttgctacatcaccatcatcattagcatcatgttggtataattatataaacaatgagaggactctactgataattgactaaaggcaagtatatgtacctatatgtatttgtgtttctgtatctgtgataggctttaaggggagattttaaaacatattttataatcctcatttcctcaaaataaagtagtacatccccaaaccgataactggatattttaatggtgatttgacatcagctgaagatattagattttatataacccatacaatttgagattgctttaaaatttatgcaaaactggaaaataacacatttttttgggggcacaatctttcattatgtag

SEQ ID NO: 5405 - DNA, 377 bp, Homo sapiens
tctagggagaataatctcactgtcttcccaagaaaggataaatcttggcttttccgggcatggtggcacatgcatgtactcccagctactcgggaggctgaggcagaagaatcactagaacccaggaggcggaggttgcagtgagccgagattgtgccactgcactccagcctgggcaacagcagagaaactccatctcaaaaacaaacaaacaaaaaaaatattggcttttgacacccacccttcatatcacagtccgaccaaaccccaacccgttcattgtcagaactatccactcattgaatctagcatgattcattgcatccacagtaagaaatttgaggagggagattaaataaaatgcttaaatgagaaaa

SEQ ID NO: 5406 - DNA, 470 bp, Homo sapiens
cgtgaccatccagaaaatcttcagcaagtacttgtggaataaaggaatgaagaaaggcatggacacttctgaaatcaagtattttcaataagttacagctatcaggaaaagactagaaggaacactagggagtacctacaggagtgagtggatttcagacctggctgaaggtctaaattgtccgatgactgctgaagataacaggacgaaccctgggcacacccacaattctcacttagaggaatgtccacatgtctgtgtgtgaagcaagaagcttgacatagcatcgatgagcccaagtcaactatatgaacaaaacaatgtctcaggaggggcagggtatcacgtcagaagaatcctgagtccttagatgaccttgtagaaaagagccacaaacttactctgggctaccttcatacctctgaactattatgcagagagaaataaatgtattcaaatcactgttaaaa

SEQ ID NO: 5407 - DNA, 846 bp, Homo sapiens
agctagcatgtaattttctttctctacttctctacatttggaggatggaaatgtagatgttcttccattgtgccagcctcctcattcttctttctccaatgccgcatcttcctgcaaacttcctgccacaactcaaacaacaggaaaataaatgatctgaaatcctcctgaactgcagcctacctatcgtggtctctatgggtgcaaacttccttccagaagcttgttcagctggctaaaacaggacatttgccaatgcagccaaaagttgggtcttatactggctacctcctatgcagagtgaaaaacttttctttctcccacagccacagacatcgctcctcttccagctcaacatctttcaaagggatggctctcagtcccgaaatgaaaagaaaaggtggcttggtgcaaatcattctctttatcagcaaaagaaataccaaagcctgtgtccttctgacatagtgagctgtcgaggtagtccagggaaaagatgacagtgaattgagttatgggatggcaatggagactgaaaagaatctgtgtttattatatgtgtaaatattcatgaacggtacagctagtggatgttctctggcactgcacatgggaaccacgtgaagtgaagtgatctaggatgacgcccccatttttgcctgagaaattcagtactcagaggtgtctgtccttccgagagatgcaggaaacaagaagaggagccagttgcggggaagagggtaagcagaatcaaaaactgtgtggatacattaactttaggaagcatagtagactcacaatccggatggagtttagggaccaagcttttctacagagaaaaattcg

SEQ ID NO: 5408 - DNA, 233 bp, Homo sapiens
tgcatagacacacagaggaatgtgccatgtgatgatgaaggcaaagattgctctatgtgccaaggaacaggcagtattcctggcaacaaccagaaatgaagaattatggaacagattctcgctcagagcctccagaagtaaccaactctgccaactccttaattttggacttctggtctccagaattgtgagagaataaatttttgttgtttttagtgataaaaaaaaaaaaa

SEQ ID NO: 5409 - DNA, 202 bp, Homo sapiens
ctaggagaaaaatgatctgtcttggtcagtgtttcaagtacaactcgaaaagaatatacatactactgaagctgtatatattgccctataaatgtcagttaggtaatgacggttgtattaccatttttttttattacttgttttatcaattactgagaagggggtattaaaaactccagctatgattgtaaaaaaaaaaaaa

SEQ ID NO: 5410 - DNA, 886 bp, Homo sapiens
actagaaaacatcattcatcgggagataactgacatcattttgcaaatagaaaatttcacggaataaagcatgagataaagctggaaaattgtgcaacctggatgaaagcttgtgactccaaatacttttttgttttaaaaatatcattgcataatcccgggtggatttgggagcctgaatttgggtgttgatgatagaagctagaatatggatgtgagactgatgggggctgattattgaaaaacggaagtgggtataacagcaaaggagaacatataaaaagaaaaggaaactaagaaaggaagtttgaaagaaaaagttatatttaaagaaaaggagcataaggaaaaaacaaacaaacaaacaaacaaaaaactccccaaactagtgaaagaatttggggaaagaaatagacaagtaccatgtttattcaagaagaaagacaatcacaagaaaaattggtgggtcaaaagtgaaaactgctgtatcctcaaaaccaccacagtgcctaataccaagcatattctcaataagtactatttcagtgaaaatctgactctggtttacatgcactgtcttccttacaatcagttttcttgcttgcacttttaacccttgaatgagtcctctcggtttgaaatttcttcaatttgaaagagtaattgaaagagtgctgaaacacataaactaaaatatcgtcttgttggcctcaccggtggtactcttgctcctgcttccttaattggggtcaattcatgatccatcgctactgagtctctgccctcgtctgtttgatggcgaaagcagtatagcttactctaggcgtattccgtttctacaatattggcgatacgtcgaaaacttgctaataaatgccacaacgct

SEQ ID NO: 5411 - DNA, 762 bp, Homo sapiens
ctagactcatattggaaaaactggttattttcccaaggctttgactggaatggtgtgctctcctctaaggaatcaaacttaggaagccaatgaaacccttggaaaactggccccatattttgtgttcactgtccctgtacagggtttctgatgtgtgtttaaattatatccgttacagaaatcaactcctggatacatcatattcaagtcaaagcctaaagagctgagaaagcaacccctaacagtccaaaaaaagtcctattcatgtaaaaaaataaataagaaatcttaagctaaaaatcataaaagttaagtaactaagtaaaaattgctcatcttactcagtctcaaccctacctcaccaaatactttttgtcgtttctacttctccttttaagccaactattaaaaccttttttaatgaaaattatttactatgacaccctcgcgggaactgctgtactctctctactatttgcagtaggactgtgaaccctcagagtggaatatctgacagagaatctcaattactgtagcattttgcttaattattatcctcatagcaggaataacagttactaacaaaaaataacacgatgggtctttccaaacatgcaccctctgactgttattaataaacaaaaaaaaaaaacatccttacttctggtttaaaccagtgaggccttaataaaaaatgctgctgtaaaaaagaaatgaagcactcctgggtctcaccgggtgatctctcccccccctttcctt

SEQ ID NO: 5412 - DNA, 756 bp, Homo sapiens
agcacatgattacactctctctgttctccaccatgtgaggatccaacaagaaggtggccatctgcaacccacaagaggaccctcacaagaacccaatcacgttagcaccctcatctcggacttccagcttccaaaacggtggtaatgaaaacatcattaattagaacgtagcagaggaataaaggccacaaggagcacaaggaagatagtttggaattatgtatgaaggcaactgaaacacttcaggctctgaggaaataataataatccatttgatcgccagtctataacaaacagaccaaatacaattaaggtaggtattaggacgaccgcgcgcacattccgaacgagccgacgtgcatacggcacaaccggcagtggctgctcacctcaccgagcttgcgactaacctgatgggaaccgcggcccctccgaaccttcatggcaccccgccagatgggccggagtccatcgctgtctccccctcacccccatacacccacccccactcccacaccccccccccaccgacccctcatccccaaatactccgacgcaatcgtatttctcattattgttcactcccgacctctccactactctttctactttcaccactgattttcattactcagtcctctctgttcacacaccctcttattgatagagtctctatatcataccaagctcttctcccctcttctatcaccctcctataccgttacatgccgatatgtgaggtctctctactacact

SEQ ID NO: 5413 - DNA, 766 bp, Homo sapiens
ctaggatttctgtgaaagaaacatatggcataatccagttattagcagctggcacaacaggtaaagaatatcaccaatgaccaagagaataagaaggaaataaaaccaaaaacacaaactattaaatgttggaattagtcaaaagttatgaaaatattgatgaataatatgagaaaaacaaaaaatatatggacaacatagttggaaggaacaaaaataatggacataactcaaatccatactgttatggtttgaatatggtttgttgcttctgaaatgcatgctgaaatttgactaccattgtgcagtgtgtgaggtgggacctaatggaaagagttgggtcatggggttatgttctttatgaatagatttatgctatcttgtatgagtgaatctctctctcacagaactggattagttaccacagagcaggtggttataaaaagaggttcctcctggtgtttgctctctttgcgtgtgccctcttccccttccacttctacccatgttatgatgatgcagcatgagagcctcaccagaaagtgactagaatgggactccctgatctttcatttccaagactccagagccatcagcaaaaccaatcctttattctctataaaatacccagtctcaggcaatctgctacaataacagaaaactaagacacaaacaaatagaatcaaatggaaattattgaactaaaaaaatacacagtaactaaaagtgtctttattatacaataaaaagccagtcagataagcag

SEQ ID NO: 5414 - DNA, 338 bp, Homo sapiens
ggtaattacaagctcttgtgcttcatttgagccagaagacaccactgaacagatcatggtttcagtacctacactggctgtttttcattcaaggtgcaagagtggttccaaaagctatgcaagggattactttttgccaaactaattatcacaattattgagaaatatgacaaagacctaaaagtatcaaacattgcctacatttgataggctttgaataaaagataagttaatttcaacaggctgtgattaaaactgtccataataataataatgataaaacaattatcatatgttgagattaataaatgttacacaaaatgttaaaaaaaaaaaaa

SEQ ID NO: 5415 - DNA, 773 bp, Homo sapiens
  misc_feature (1)...(773): n = A,T,C or G
tgggggaagataaaaatctgatgaagaaattttatttttaaatatctttcattaagggaaaactgtcacaaatttttaagctgctattttcagcttcccttgcttgctctaaagtatccggtataaacaatatactttgtcttcacaccttccttgaagcttgaggaggtggaggtagaaacaaacctacgaggaaagagcaaatatgttcaaatctcttttctttcacagtcttgactcaaagtagccttcacttcaccttggctccaagaagacaacggtccgtgttgcaaatacagccaacactgctgacattaattggctcttcactgagccagagaagaaaaggaagaacagcttgagagtaactttaacttctcataaattcaaaaaaacttttgaggtttccaaactttcaggtaaattataaaagcattcactttattttttcatcagttactttcaggaagaaatacgtatttcctactaaaccaaaagcagctcattgattataatttaaaatggcagattaaaaattaatatttagtaaacagaaaagtccagaaaatatcttcccattgattccatagtatttagaattagacatatataaatcaactttaaaacctttcatctaatctctttagaaaataaaatagagctcagcaccacactgtatataatatctttgaagagtatgtaattttttaaccgtagcttgtctataaattcactttaaaattaaatataataatgaattntcttcaatatta

SEQ ID NO: 5416 - DNA, 630 bp, Homo sapiens
ctgattgacttcataaaggaaaacactctgcctcgcatggtttcttcagaaaagccctgtggaatctacctgttgaaataagcacatctagctgcttctacaactttaattactaaaaaaagaaaagatccaatgcaacactgagaaatgttatatattttttaaaatgactgcttcttatgagaaaagataatgttgcataaccaagacctgatattcaattctcatctatggtaactctggctgtttcaattatgtgaaatcatgttcatcaacaatttgacagagaaaagcaaaagaaaattatttcatgtcttctaacagctgcagatttgtgagcagagagcaaatgacaggagtatatttggatcaaaatgtgaagatgtgcttaattctattccaacactcattctcagccccatttttaacatataagaattcattctcatgtacaccaaccagatccagacttccatgggatttactaccatgagggacggtggagtttgttatgacataaacccttactccaaatatccaacctacaagataagtttcctaattcatacaacactctatcctgtttcaggcacaattaaaatatctttctttattccaaaaaaaaaaaaa

SEQ ID NO: 5417 - DNA, 767 bp, Homo sapiens
ctgggctattgtactctctgggattgtacgaacttggactggattggaactgcagcagaaaatcttccaggcaagtgccaaagacttacatacacaacagggacagctgatgccaggcgcacacctatgggagctccttccaccctctgggaggctccttgagctgacaagtgtcctggagccctgaagaaactatcctcacagaatgacccaacaacatggggcagacaccttttgcacatgggcagggcactgtcccactcaaaggatcatttggaaggtggtaggcaggggcccctcagtgcgagcggaatggggtgcccttaatgggaagacagcacagctggctggtgaggcctgtggtttagcacaacccctgagcccccaaccaggctccctaaatttagacctgcaggacgcaggagagagatgtcagttaaataaaatgaaatccaaatcaggaggtaatgcaaaataccatcaccatcacaagcaggccacttactcatatcctgtgacattctgcccctctctccatgcctagaaaataataaagccagtccccttcccagaaagcacacacgctacagagccatttctctgtgattgtcactagaaatgctattctttccactttcttgatctgcctgatttagtgacagcacaaatgatagaataattcagttgtgacaggagctcacaaggggacacacttgacaatgggcccatttgagtgctgacactctcattccttacaatgcctgcta

SEQ ID NO: 5418 - DNA, 744 bp, Homo sapiens
taggtcctaaattattttcaagctgagcaagagcatcatcaacatactcaagaatgaagctttcccaggaggactaaaaataaatctgaccagttccttgaagaatcacagcccacttctacccatgaagcagatttttttttgccccaggaaactaacctaaaaatattctgacattggtatattttctaaagtacacatttctgtttgatccatagttaatgtattacacttgcagagtcagtgtctgcttttaattacggatcagaattctggaaagaacaaatggaattgaaatcagagactgtggtttaaaatctgatattgtgtttaattatgttaaattaatgtagagtttcctcaacctagtcgattatttgattggcaaaatggaattataatgagttgaaaatggatgtataggaaaccgtggatgctcagaataataaaggctcaattatttcttttggcaatctctttatacattagtcccaagccaaaatataagtctatgtttcaaagcttcatggatttgcattttaatttttttcaaaaaatatgcactccatctggtatagcgttgtcaaataaggtatttccttcaacactcgaagatgtctcaaactggatacgtacaactattgcagtttttctttttatttaccaatgcttttaagcctctcctatcagggacggaattgggctaactctgctacgcctgtgaaatcgggaagcgcaagctcg

SEQ ID NO: 5419 - DNA, 508 bp, Homo sapiens
taggttcatcagccaaggaagtccagaagagctgcagaagcaaaagtagggagttccctgagggtgccgaggcaaacttcgagaaagggtactccttctatcatggttgatggctgtctctactcccgagcctggccacatcacactcctctttgtattcagtatgcccagcacatggaggagagtaagacacctctggtaagcatgaccagcttcagaaaacaaaacaaggaaatgtatcaagtgatttctcaataaaatgacacagccataccacccaacagtgaagccagtgattgaaaagcaccctgccagacccacacacataacattcaattagcatttaaaatgttccactcctaaatatgacccaaggatcaccaaacacctgaagaaattttctaacatgaaaaccagaagccaaagcaacaggaaaacaaagcatcttggaaacaaacttttaaacaggttatcattaataaccttagagataagaaaaaaaaaaaaa

SEQ ID NO: 5420 - DNA, 428 bp, Homo sapiens
agcttataagaaacgtaaaagtggacactccagggctggtataatggcccatgatgtacaggactctggctccttctattttgctgatccaccaactctcagcctaattcatcactctattcttccaagaaacccatcagggaccatcaaatgttttctgttacaacacagtcgaacttccttcaaacacagaaccatctgagaaaagttttcttgctgttattttcttgtttaaaatggtattttatttttgtctccttccttgcaatgttattttcgcacaatattttaggcactctacaacatacgccatagcatagctcaaaagctacatctcataccaggcttcctctcaaatgcctctttcattcttttatagaactgtataaaataaatctttccacgttaacattgcaaaaaaaaaaaaa

SEQ ID NO: 5421 - DNA, 691 bp, Homo sapiens
  misc_feature (1)...(691): n = A,T,C or G
agccttttctgaacccagccttgttaactttctggcaaaccctcatggcccaaggatgctctcctggactctgtgtgcatccaagtgcattcatcatcaatggactccatctgtcggctcctcacacaaagacctcaagttatttggcgaagatacattgctttccttaaatgctggattgagtttaaaagtagacagcttgtgtcaataacaaatggtttctggtaattattgttttcaatccaggataaaatataagtatccctaataaacaaatgacaaagtgtctctctttggattccaacaagagcagcgtgattcctccactggagcactgtctggttataacagtngcctgctgtgattctggtcagcctctgaaagcaagagtcagggccaacaaatgctccatctattcacatgtgccctgaggaatcaagccactgtgaaaatgcaaagagtccacagatgaccttatgactgacagccttttcctttgggtgcccttttttgggaattccaaaaatttggttgccagttttttttggccatggcaaggcaagggttccccccccttaaaaaaaacctttttttttttgggctttgccggttttcccccccaaaatatccccccccaaaatagggcaggggaaaaggtttaaaaaacaaaaaggggccccccgggaaaaat

SEQ ID NO: 5422 - DNA, 747 bp, Homo sapiens
agcccactattgatcaattcctggcatcacataacatgcatgtggtagaacatcggaaatccaatcatgaagaattggaaggacgggaatgtcatatcaaaatttcataagtgtgagtagtgcccatctctccaccaaaaactttatctctgtgggcaaaagtgaagaaaaagaaaatggcctctttacaaaatcagaaaatttctgagctagaacatgtagagtaggggcaatcagaatctcatatgtcaattactgttatactttttaaatgccttttcccttggtgttttataacttgaatgattctgttgtaaatgtagaataattaacttttctgtttaaaaaagtaggccgggcacagtggctcacgcctgtaatcccagcactttgggagtccaaggcgggcagatcacctaaagtcaggagttcgagaacagcctggctaacatggcaaaatcccatctctagtaaaaatacagaaattagccgggcatggtggtgtgtgcctgtagtcccagagactcaggaggctggggcaggagaatcacatgagcctaggaggtggaggctgcagtgagccaagatcgtgcccttgcattccagcctgggtgacagagcaagactccatctcaaaaaataaaataagtaaaataaaaataaaaagcaataatatgtacctcataaatatatacaactatgtaccacaaaagttaaaataaaaaatttaaaagaaaaaaaaaaaaa

SEQ ID NO: 5423 - DNA, 356 bp, Homo sapiens
agtacttccttgagtctactcatcaggagaagaggttgctggatactgaattctggtcgataaacacgtttctgtagtttacaagaaagagacagccaggcctgaactcaaaacttagaagacagagacacagagagggaatgaaagccacagagagagaaaatgaatctcaagaggaggacaggactgtaataagcgacatcatgaagttagaatcttccagcagaagactgaaatactgtaactgacagtaactgaccatctggaacactataaatgtcttctttacttcttactttgtttatttgtttgcttgcttgctttaaaaaaaaaaagtaaaaggaaaaaaaaaaaaa

SEQ ID NO: 5424 - DNA, 208 bp, Homo sapiens
agttatgtatacaaagcattcagaaaatttgccagcatggacttatatctctaaaataggattggctcaagtgatttcaaggcaccataccaagacctgtgttatgtcggagaaaacaaaagacaacagatattccttgtgtatgttggtgtaatactactattaaagtttcaagcttttccacaaaaaaaaaacaaaaaaaaaaaaa

SEQ ID NO: 5425 - DNA, 279 bp, Homo sapiens
aggacaagtcctgcgcttggggatcctctgtacgcccgttcactgaatctttcacaaaagtcctgtgtcgtcctcgtcctggccaactagactcagagggaggactgatggattttcatctccctcttccccttcgtcttttcttctcagcatcttcctaccctccccaccaccgcgcttctccaccaaaagtctgatgctggcatgtaatggaccctttccaagtttcaaggtgttgacagtaaatcttttgtatttagacaaagaaaaaaaaaaaaa

SEQ ID NO: 5426 - DNA, 605 bp, Homo sapiens
aggagccggaccaaatatgtagtaccctttgaagcaaatattccctccacctgagaagaaaaggggaaaaatgggaatgaggaaaaggaatgattacacttcaaaatttgaacaaaatctgatcctggcattgattgttctgagctgagccttgccagaaggcctgggaactctactacccgctgctgtcttgaatgcaggcttataaacagctagattctatgatggcttacaacaatttattcaaccaaaaattacggtaatttaaaatagaggacgggcggggtggcccatacctgtaatctcagcactttggaaggccgaggcaggcggaccacttgaggtcaggagttcaagaccagcctggccaacatggcgaaactccatctctactaaaaatacaaaaattagccgggtgtcatggcgcatgcctgtattcccagctactcgggaggctgaggcagaagaatcgtttgaacctgggagccggaggttgcagtgagccgaaatcgtgccactgcactccagcctgggtgacagagtgagacttcacctcaataaataaataaataataaaatagggatactgtacaaaaaaaaaaaaa

SEQ ID NO: 5427 - DNA, 750 bp, Homo sapiens
atccagtcctgaccctctctttattctcatctgtggcaggcagcgtgccggtagctggggatcagcagtaaacagcccagagagcaacgttccctgcccttgtggagctcacatcctcatggggcggtcagacaggggctgcggcagaagaatcacttgaacccaggagacagagatttcagtgagccgagatcgcgccactgcactccagcctggccgagaagagcgaaactgcgtctcaagaaaaaaatgatagggattcaccaatacagacaagaaatttaaaaaaaaattgtggaaaatggaaatccaagaagattttcatgaagaagcgagtgaacaactgtcaaatgctgctgagaaattaatggcaatatcagctgaaactgttgaccttgacaaggacagtttctctggaggggatgaggcaggaggccgactgcactggatacagcatgaagaagaggaaaaacgaggacaaagaaaaggattttagaagattgatacaaaactgataacgacatctgacaaggattttagaagaaagaaaagctacaagatcaagccaaaatacaagccaagatcacccctgaacttagacacaaaaaattcgaactaaacgtgagcaaataaaatgtactagtacttaaaaaggacatacatcagccatggtggagtatattgtagaaaggcaacattgatttaacattcgaaaatcaataaatgtaattcaccataaaaaaaaaaaaa

SEQ ID NO: 5428 - DNA, 367 bp, Homo sapiens
tttcaaacatgtctgaacacgtttgcgtgaccttgaagccacgtattgaaaatgagggagccatcttcctctggaacagtataggaagagaatggattcctgagtatcccctttaaggaacaacccaaccaagaacaatgcagtggaatttataccaacaagatacaactgtttgttgcattaaaacactgagattgggagggttgttactagagttagcatggtttggctaaatcataaaaacagtgttttttttttttcatttgcatgaaacaccagcaaaatgttaaatgcagataaaatgtgttttgttgcatactttcataatatagacacaattatttttcacccgacaaaaaaaaaaaaa

SEQ ID NO: 5429 - DNA, 382 bp, Homo sapiens
ccttggaattgccatcaaccaaagggtagctatgttgctcatgatgacatcccatccaccgtagcagcctacattcaatgactggttgaagtggaagaaccacagcccagtttgggaaactctgaagatctatgccagcttcagagctccttgtgcaaacagcctctgttttgtcattgcaccagaattcaacttcttatacccactccagcttccctcaatccctcattatttttgctcttagcacaaataccaatatattacttgcatatgcatcggcatctcatgtctatttccagggaacccagcctaagacacgaaagaataccatgattaagtaggcaataaataaatgtactttaaatactcaaaaaaaaaaaaa

SEQ ID NO: 5430 - DNA, 740 bp, Homo sapiens
  misc_feature (1)...(740): n = A,T,C or G
ccattagcagctatgnacttcagtcttcaactgactttgtgctgatggtgtccaactcaagcccacacatgatacttttccttattctcccagaagtctctacactgctgaagtatggggttaaaatagaagattgttgacagatagcatactggatgtaaaggagcacatcttgggacaaaaagaagagctctgaagaataatatttcttgacagataaaaattatctgaaatgcaagtttctgtgtccataaatgttttattgaaacacagtcatgcctcttcatgtctatactgtctgtggttccctctacactacaacatcaagtccagcagttgcaatggagatatctggcctgcaaagttcaaagtatttactattttgtcatgtaagaaaaagttcactgattccttgcctacaatgctcaccaggaaagcattgtttatattgagttgggcatataaaattaacacgtttttattttgcacatagataacaattattgtcaaagaatcctgagggatataaaatataggacagaaatctgggccttgaattacacctcaaaactagcaattattaacaaatgagaacagctaacaactaaaatatgagtattgattttatatgcagtagcgtttaaaataaaggatcagatcaatgttgaaatatacgaggaaaatttcatgcagaggaaatggttgtgcttttaggctgggatcttttgttagatgagagg

SEQ ID NO: 5431 - DNA, 305 bp, Homo sapiens
cagctatgctacatcctgggttaagaaacgatcaacaaaatacgtgatctctaccttcatggagccaatagtcatttgcaaaagatggacctcaattaattaaaatgaaagggaagtataatctgtggaaatcttttgaaaaagtattatggaatatgtaacaagatcatctaatgtagttagattagacaggtgaatgaaaataaaattagattttatttgtgcctaatttttcaataccattatggaaattttctttctggtctaacacagaataaattttaggaaagagaaaaaaaaaaaaa

SEQ ID NO: 5432 - DNA, 354 bp, Homo sapiens
ctagatatacttgagtgatttgctgggattggtgatgtctggagaaatcacaacagccttgtgttgagaatgacagagctggcctgtcggccctggactgcttccctctacatcaagtcggcaaactacagcctgcaagcataatcttgcctgctgcctgtttttgtaaataaagtgttattggaatacagccatgttcatttatttacttattgtctactgctattttcatgctacaacagcagagctgaatatctgtagcagaaaccatatgtcctttagagaaaaactttgctggcctctgctctatattattaaataaaaggaaatacattttgtacaaaaaaaaaaaaa

SEQ ID NO: 5433 - DNA, 816 bp, Homo sapiens
  misc_feature (1)...(816): n = A,T,C or G
tagagatgtggtcttgctgtgttgcccaggctggtcttgaattcctgggctcaagcaatcttcccaccttgacctcctgaagtgctggaattacaggtgtgagcccatgccctgccaggatgccattgttttggactaaactcctatactgggccccaatggacgagattaaaactcaaaatggagttaccccggctcaccaaaccaaaactaagctgttatctggccttttgagaaaacaggagtgagaaggagcctaatttcccaaacaggccaatttcaaccttctatcagcatgagaatgaagtttcctctgttttaatccttacaacaaagagtaacctggagtaacctgttgttaacccatcagttatcttcccattgttctgtcttcctgtccctgacttacaaagaaagtaacttggaaatgaccaatccactttttgttatttgttttgctttcttcagccgttttactgtctattaaaccaacatcctctgcttgagccatgggaacaattattctagcttatggaataaatgttacccaattctagaatcttgataaagccaactgagaccttttaactaaatgtgttgcaacattttttagatagtatgataatgagntttttgtggctgacctcttaatggctttgagattatacattcctgatatattatactatgtcagttttattgctgaaatataattcattgtatgaatatcacaagtttttatccatgaggaatttgggctgccccaactttgattatattaaaaacctccggaaccattcagtaaaaaaaaaaaaa

SEQ ID NO: 5434 - DNA, 1022 bp, Homo sapiens
  misc_feature (1)...(1022): n = A,T,C or G
aaagctggaacatcctgcaccttctgctacaagtggcgcattcactaggagatggtgggctcctccctccactagggacagagggagagcttcctaggcacaatgaataagtggactagactctgagaaccaggtcggggagaggttatggggatccagcttcccgaacacattggagcggcacaggaagacacaccgagaggtcaagaaccacagcccaagctgtgctgcaggagatcgtcaactccaaaagctatttttggtttcacaaggatcaggaagataaagccgcttaccttaatccgtcaatctcaaaatactccagctttaggtcacgtaaggacagttctcacgtccgtccggagcgctgaaaggatatgcattttttcagattgaaagcgcctatatccgacgtgcgcaggattctacaacacacaataaggaccatactaccacaatgccaccttgaaataaaacgcaacaggtgtgggtgcctcagggcggactctgaggtcgctgccttagtgaggggacgcaggatgctggtactgactcttgggtcgccgtcgggtgcgccaccggtccgctccttaagtcgcctacccccntacgatccgccctaccccgccaacctcccgcatcagttccacgccttccgcttagcgccgcgtgcccccccctcgctttttatggcacgccgaccctactcccccccccgcgatcggttgtttttatatccgccccccccgcccgccggcgctttgagaccgcgctcccctgtgcctttcccggcaatggccttatgtatcacgtccccatctccgcgcccattctcccccccccgcttcccctctttatgctggccgcgcgcgtctcgccgacgccgtctcgccctcccccagcccccccgcctcccacctcctcccccgctgtcttccctcgcgtgttcgtccgtctgtttctttggcgccccgccattcttatccgcctagccgccccccccccctttaattttcgttttt

SEQ ID NO: 5435 - DNA, 946 bp, Homo sapiens
ggcgatttgaagcaaatattcaaaagatgaagtttggatgaagagcaacacaagaagagagagagtctcactctgttgcccaggctgctggagtctagtagcagcctcactgtgacctcgaactcctggaatcaaggaatccacctgactcagcttcccaaagcattgagattacaggtgtgagtcatcacacccgatcaaacctgttcttgaagctcacactcaatcatatccattttcaactggagaaatatggaaggaataatggtttgcttcttaaatgtattaacaaacatattgtttgcatttttgtgatatatttaataagttgaggatctggattttatatgaaataattagtgaggaaagagtgcattaatttttaaaaattatttccaaataattgagattgaatagtttgaaagctgtttcctagaatgcttcattgatggtaaggtgaattctcaggatgatttcctactttactgttttacttacacataatcattgttcgttgtcttacagatatggaacaaatagttttatctacctagatatttaagtgatatgttcaaactttaatctcttattttaaaataaacaaatgcagagactctatctgaggaaaagcgaaaacagccaaaacaaacccccacaaacttacctctggtcattagtgtaaattcagttgtctgtacattatggggaattactcactttttagaaagagcctctaattgcttaatctaaataatgcgggcaatggcatacccgctctatctctggggcctatctaccccactagaaaatttatggacctattttcatttggataggtccgcgcacatcctaacacattaaccccctttcaattcatcaggtactaactctgcgtttaaacaagctccctctcgttggacgcaggcatactgagataatttcttag

SEQ ID NO: 5436 - DNA, 455 bp, Homo sapiens
ggacaccttgccggggtcaagatcccactgacagggacaggaagcagggaaattctgggcagaagagggcgggtccctggagagggccccaccctcaagcctggaaccatggcccaaagcaagaacttacatccctgtttccctgctccaatgttgccttttccaaaaccacccatggcctgccccacccccgatcttgtgcccataagaacccaggatcatccagcagggagcaggagaagcagctggacatcagagactacaattggacgtcagagaaaagcgttttgacttagagggacagcttgatggcatagctttggagaggagtccggccaggaacagctgaacttcatgggaagattacgttccctccatgtcctcttttcagctccccttcccactgaaagccactttcattggtaataaattcccccacatttaccatcttcaaa

SEQ ID NO: 5437 - DNA, 337 bp, Homo sapiens
cgtttcagggtaatcttgtgaacaaaccaggcatggagagctagctgtgaaattccagagatgatctcaaggtaattagtctacagcccagccactgctgagatgacaccagcacacgctccaggtggaccatgactcaagacggccaccagaacaaggcatacagaccttacacccagcaccatgcccgcatgcctccctctccaagttcctcttttaagcccctctccccagcctaaagtttgaaatgtttcttgtaaggaatgagcctggccatttccccaaccgctggcttttggaataaagtcactttccttttactgcaaaaaaaaaaaaa

SEQ ID NO: 5438 - DNA, 725 bp, Homo sapiens
  misc_feature (1)...(725): n = A,T,C or G
ccaccaagagtctctctttgtcaccgganctagaatgcagtgccacaatcaaaacccactgcagccacaacctcctgggctcaagcaatccttccacaccagcccttaaagtagcaagggacacagtcatgtgccaccatgcctggctaacaatgaacacctttcaatataaactgcacttccatttttagtataaacttgatttggttgtaatttttaatactttatagtttttactgctaatattctttttgggattttagctactatgttcatgactaagattaacctgaaaacctctttccttctagtgtcagtttatggttttggcataacaattataccaatacaattatttgggaaactttacctcttttactatcatcagaattattctatttaactttttacaccgtaaagttagcttcttaatttttagcccatggtatttcagttatcagtgccagtttgttctttgcatattctaatttctcctaatattttttctttgatttgtgagttacttaaaagtgagtttttaaattcccaaatacatatgactttattagttgttttatttatgatcatcttagatgcaatttggttagaaaatgtattttacatgattatgattctttaatgattattgtaactggctttataactagaaatgtggttgacttttaaaaataagaaagaaaaacatttctggaaaaaaaaaaaaa

SEQ ID NO: 5439 - DNA, 765 bp, Homo sapiens
ttttaaggtagcgtgtgggcacgcttttaaagtgtttgaaggattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcataatcatttaaaataacaccatggaaaactttcaagtctgattatgtggtatttatccctttgcaaggagagatataattaagcttacacattgaaatggaaaaaatgtttggtttggagctcaacacacttaatctcagcacccctatctgttaattaaatattataacatgttcatgttatcctcagcgttggcaaactactactcacttcctttttctgtggagcgagcgctgagtatagttcaatttctgtttgttatatatatttttgatccagtttgttcgaccagacgtaccactcgattctatgatatcccctattgttttgttttgtttacgatgttcgttgttctaattttacagtgttccatatagactcgtatcacgaacttggctcagccaatttcgagccctagggtttccacattaggtctacgaatatccccatctgttctatccgcccgacggccgcctcagactccgtgcctattcctacgctcggcaggtagcgtaggtcttcatctaattcattttgagtcacaatttgtatttagtataatacgtcagcgatgctcatcg

SEQ ID NO: 5440 - DNA, 339 bp, Homo sapiens
cactttttttgtaaaacatcactgccatctgcctcaaaaagcagaattatacatgaaataacaatgagatgcacttcccaactactaagtatttaatcagctgtagagtgtggtaaatttcttttatttcatgaaatttttataccttcattgtggcctctcgaaaatatcttcgcgattcttcctgggattttgaggaactcattaattccagttgccttaactcatcaattttagccaaagcacgccgagcaaatgcctacatgtgattaaaataaatttaattgataaatcagaatatggtgattaaaatgtgtgaagacaagaaaaaaaaaaaaa

SEQ ID NO: 5441 - DNA, 310 bp, Homo sapiens
tcaacaacttttctgtgaatctcttgaccttgcacatctggcatgaaaatatcccaagttatctgcattggcagatggagctgtgctgaacagaagctttatcctggattcggtcctctctcccagcacaagcacctgactcaacttcggaagtgtggagaacgttatggaacttcatcttgccctagtttacctcccccgacttccagtcctacccacttatacttcttcctggtccaaatggattatcccctaatttttccccttaaagatatcaatagaagattgattatccacaaaaaaaaaaaaa

SEQ ID NO: 5442 - DNA, 203 bp, Homo sapiens
ctggtgctgtgtggaagccagttgaagaaaatggagtggaaaggaaaagaagtatcatgaaacctcataagctgaggcacaaatttgcaaaacctcctgatgaacatgagaaatctcctgagctcacatatttctctcagtattttaggaacccacaaatttttcattaaaataaatgcgtaataataataaaaaaaaaaaaa

SEQ ID NO: 5443 - DNA, 380 bp, Homo sapiens
cagtctgcatctgctcctgtatggaaacctctcaaaggctttcagagctgtgactggacaggagagaaggggtggacatcatcttctgggaattcaagagttttgagaaagagtctgatgtgtacttcaggagtcacctagaacagtgttgttcatctttcataaaggagaataaatatatctgcccttgaaggactctcatctgagaagtgaaaattcatgaaacttaaatggtccataggagggtgatttaaattttatcacacgtgggcatcccctgaccccactgaaaagttaaatgaaaactactattgtttgctgcttagtttccctctgaccaaaactagagagtaaactccttaagagtaaaaaaaaaaaaa

SEQ ID NO: 5444 - DNA, 338 bp, Homo sapiens
aaggggaagcagcctgtggcccttaccagatgcagatatccaatcttccagcaaacagaatcgtttgtgtgtcaaagtgatagtcaaaatgcgggtacacagaactcagatatactgctatggtgaagcggctcgacactttcaagtctcttacaattgagtcttctagaaactatggtgatatcaaacctgtaggtcatgaagagtctactacactgagcttgcacaccacatcagaaaatcaaattttctggggaagaacccatcaaaattcacggagtaatattgctgtcttttcctgtatttgaaataaatgttcttctctaaaaaaaaaaaaa

SEQ ID NO: 5445 - DNA, 746 bp, Homo sapiens
tcccaggatgcctcatgggtcagtgtccaccctggttcatcacctgtggctaggggataagtctgtggcttcactgtacactgtcttggatcactcactcttgggaaaccagccaccatgttatgaggacactcaagttctctgtgaagagatccatgtgatgaggaactgagatctcccgccaacagccggaaccaactttccagtcatgagtgagatcttaaaagtagatcctccagcccatagtgaagccttcagttggtttatccccggctgacaccctgactgcaacctcatcagaaaccctgatccagaatttcccagctaagctgtgcctgaattccagactcacagaaactgtgagagataataaaaattgatttaggcctctaagttttacaggaattagttgtgtggcaatagataactaatactgggcgggtgttgagaaaaatacacataccttgtgtgggcccaggtgaaatgtgacaagatcctcaagcagaggaagattagtttttctatacacagaaggtaggtgctcctcctttctatgaaattgacactcacaaggacaggggcttacggttttagcatgcgctgattccacccatatatgtttatttcatcttcggtgtcccactctctactaaatcccgccttaacatatgatactgggcggactgacaatggcgcttatgttgggtcatgattgtgctgtcctcgggtatttgctcaccactgcg

SEQ ID NO: 5446 - DNA, 450 bp, Homo sapiens
cctatcttggagtaaacaaccccttccccagcaggagtcaagaatgagcctcaggcctcttcatctcaagctgaaaaggacagagggagccatagacaatacaactaacaacctccaaaaacgcacagcctcaccaccactatcttgagtcagccaggactaatcacaccctgcccttcattatgtctgtccccataagccccaaactcaaaggttatccttcataacccatacactgatccccataatgctctgcatgctccctaacctgcaccaatctcccatattcctaacccttacactgtgatttctggaatatggagcccaatatcagcgaaacttaagttatattaagttttattaaaatgtaagttttagaacttaaaactttaagtgtatcaaaactcaggttttatttacctaataaaacttaactttaaattggcagaa

SEQ ID NO: 5447 - DNA, 888 bp, Homo sapiens
  misc_feature (1)...(888): n = A,T,C or G
cttcagaatgccgtgacctatccaattcttcctctcatggaaacaccgactcatccatgccctctgtgctgaatcttcgtctcagcctgctggaatcacctgcaccccatgggaactgtagccatatcttcagtcctgtgagcccccgtcatggcctgtcacaggagtaaatgaggagtaaggcccagaatactcagtacctctcaatgaccctcagacgctgtaggaagaggattggttcaccttttaacccagaatttctcacattgaatggacaggatgcattccaagaggccagagtatgtgcatctcagctcctgatggtttccaccaccaccattactttctctatgtcaagatacctgggaagccggtgtttcatttgcattcttggagcccaggaactgtcttctaaaaacttttcttcctagtaccatgtaaacgtacacaggaaacgttcagaaaacatcagccaaatagaagaataaggaaattccttcactgacttgatattggtgtttaatcctgtcctgctttgtactcaatggctattttggggtttccattgcggaaaactatttggaaaattgcaagccacgagacaagcctctaagctactccaggatcattgaggactctccatgggttcttattgttaaagatcttaactcctcaagccactgcatttttactatatgccttngaactacagatgtgttaagaattataggataaggttctcatctctaaaactcatggtctcgttggagaacagtattacacacgtggagaagtgagagacttggatgtggagtataagtgggcgatttgacaagagctctacgaagttcaggagaggaagagcaagtgaggatggagatgactttg

SEQ ID NO: 5448 - DNA, 756 bp, Homo sapiens
ctggcgaacactggctaggttgtaaatgtgtttgccagcctccctccaaccatgcaaggtcactgaactgaattctcgccagtggtgtgctgctgaacggtcatacattccagaaagtcttcaaagaaaaggttagattatggatggaatcgctagagcacagacaaccatcttagaccatgaggtggagaataaagagggaaccagatggaagtaggctggttcctgatgagtctactcttcctgtgctggacttcctgcctttaacgttttttttaacataaataaatttttctttagcagttatattccattctccacccaacaaccaaagtgatgctttcaaaatttaaatgagattatatctgttctctgtttagacccctaaatgatttctagtctcactcagagtaaaatacaaagtcttctggcccttcaaggccctttgtgatttagcctcatctactaactctctccctctttcactgtgttctcttgaaatactattaacctcaaataaccctatagctaactctgtcacttaattcgtatccccactcatttaaagcataaagtgcattctatgatcatcctacaaaaaattacgctccacatattactctgtccagcagtgctcaagtcacttatatgggtacaaaatatcatagtatttgcatattaacctattgcacatatggctgttcactctaaatcatctttagattacttgcaaacctatgttgtgtatagttgcca

SEQ ID NO: 5449 - DNA, 681 bp, Homo sapiens
ccttcagtctcacagataaaaaatgccatttagatgttattcagtggaggcatctgaacctgagtggacccaaccaaccaccccaaatccaactgagatactaaagtggggtggcagcagacggcatcttccaggccaccagctgcaccactcacttcctggaaggaagagggcacagaatggggagcttgaggcctggttcagagtccggtaccagcactgaccagccatgacttggataagtgactgaacctccctgattctgctttctcatgcataaaataaaattctaaaatattctgcttcgaggtaaattgtatttcaatgggtataaagttacgattacacaagatgaggatgttccagagagatgctggacaatgtagtatgtagagtttgaaatgaggtattgtatacttaaaaatgtgttaagaaggtggatttcatgcagtgttaataccataaaaaaaaaagaagggacacaaaaaattgaagaggtgatagacgtatttattatctgcattggggaagagagtaacatgagttgtatacatttgtccaaactcaccaaattagatacattactatgtgcaggctgttgatatactaatcatacttcaataaagcgcaggaacaaattcatgaataataaaaattttccactccacaaaaaaaaaaaaa

SEQ ID NO: 5450 - DNA, 253 bp, Homo sapiens
taaggtccgggggaaacggctgttcacttccacctctggccccctggactctcctgaagtacacaactctgaccacagagctttgcagagtatatggcacctatgaggaactcactcaaggcatcctgcacaaagaatatcattgtgtttcccaaactgtcactggcttcctattgcttatgaaataaaatcgatgcgctttatcccagtggattaaattaaatactaaattgcctttcgaaaaaaaaaaaaa

SEQ ID NO: 5451 - DNA, 639 bp, Homo sapiens
gctttgtgagaactcgctaccttactagaggaaaaccctcgagcatattgtaattggggctgcttgagcctgttcccactctgtggagcgtacttttgctttaatacatctaagctttcatcttctgttgctttgtgcattttgttcagttctttgttcaacacgccgagaacctggacaactcacagtcaagactttccatctggtaacactgggaccacagtcacgagctaccgcaccctgctctggtaactttagagatcataccactgaactaagtaaaaacttccagaaccctaataaagaactgatgcattcatgaagattgtgaacacaacatcaagcagaacgagaattaattacgtaggacagaaccgataggggactaaaatgatttttatgacttttgtttgtttgaaacgttgctgattctttttatattttgttttctagaaacaagaaaactttttcttttgagctatttataactcacagccattgggcaaagtatacttttgtgagcaaaattgaaatatttacctttctctctacctgatttctccaaaatttggacactatttgtgacgattcatattttattgcaatacagttatttgcataagttcaaaaaaaaaaaaa

SEQ ID NO: 5452 - DNA, 508 bp, Homo sapiens
ttgtttaggtaacttccggatgacctggatgagactgactgcagagaagatgccctgcaaaagaaagcaaagatcatgttaaaacatccattttgtaaaagggcattgctggaagttataagagaacaataagaacgtataccaaaaattttacaatatacaattgcagttttcaatgtgatgttggattcttgctgccaattgtgaaatatccaaaactattccataagaaaaaccaatcaatgaagaccaagtctagagataactcagatgttaaaattagcaatattaaaatagctattacaattatgcatcagataacaacaacaaaagctcattaaaaataggtaagttcggcaaaagaaaagaaactattaaaaaaagagcaaaatgaaaattcaagaatttttaatatatttttaaaaattcactgtatagatggaagagtcggtaaacttgaagataaaccaaaagaaatttttgaatctgaaaaacaaaaaaaaaaaaa

SEQ ID NO: 5453 - DNA, 771 bp, Homo sapiens
  misc_feature (1)...(771): n = A,T,C or G
atgggggtcgcacagacatcatcacgagcaaaatcttagcattgtgagagagccctctgaaaatcattctaattcagatgtttctcatgagatttttgaacgccacaattttattttcaaccgagagctcttgtaaatttgcagttgttggctacatgataacatctcatttcaaaacgtctttgtctggctggtttatctacttctctaccaggaaatctgttgaacccatagtggtttctgtacaaatgtttctgcatttctcaataaacagtgatggaagaatgggtccacttcactgcctcacccaggagacagcagcagctgaaacaaaaggagcatagccaaagcagaactggtgtaaagataataaaacacaaaagacttggacttccttctaaattctaagaggaagattctttgttgtaggaggagctgcctctcacaggacagaatatgcatgactccagtccccctcgcactgaaatcctagtcttctaaactagcagatggcctccgcccctgcccctgaggatgtctttgtagttctcattgtggaggaactctggtgagttgnacttctcttgggcactgcctttttgtgcggccccctgtggtttgagagctacttgcaaaattgttttctgcctatctttccaaccttgtgcttccctttgcttctttgttcctttccgnattttttggcccttgttgtcggccccccttttctcttgtccacctttcgggcaacctcaatgaaaaccagtgaaa

SEQ ID NO: 5454 - DNA, 623 bp, Homo sapiens
cttagcgtgacgaaatggagcctctcagactaatcctctggagaccaaaaagctaatcagccaggcatggtggcctgcgcctgtagtcccaactactgaggaggatgaagtgacaagatccctggagcccaggagttcaagaccagcctaagcagcatagcaagactctgtctcttaatcaaaaaagaaaaagaaaagcaagctgatgagatcatttaaaacccagtctgccttaatccaaactctactcttttgcactacataatgtgacttcaaatactttttcatcaaaatgttttcatgtgaaatcaaggtgagataatcgaatgaaaaaattttttaattgtggcaaaatacatataaatattgccatcgtgacatttaatacattcacaatgttgtataactatcaccattatttggatccaaaacattttcatcaccccaacaggaaatcccaaactgatgaaacagtcactccccaccctcagtccctggcaaccactaatctctatattatatatttacctattctggatatttcatataaataagatcttatgatttgtatttgatccactatgtctggcttctctcacttaacatgtgttcaagattcaaaa

SEQ ID NO: 5455 - DNA, 182 bp, Homo sapiens
cttaggcaactggtgacccgcgattggcgcaagtgctgacctggatttgaattaccttttccttctacactgaaaaaagtcatgtattgtaaaaaataaaatgatttcctaaagatatgtaatgaatgcaaatataattaccaaaatgaataaacatttttaaacaattaaaaaaaaaaaaa

SEQ ID NO: 5456 - DNA, 482 bp, Homo sapiens
atgagagaagtttaattcagtcatagttctgcatgcctcgggagaacctttggagacttcaaatcatggtgagaggcacctcttcaaaggatggcaggagagagaagaagcaaacaagaaaggagctgtcaaacacttataaaaccatcatagctcatgagaactcactcactatcatgagaacaggtcgggggggaattgcctccatgatctaaccacctcccaccgggtcttcttgctcaacacctgaggattacaattgaagatgagatttgagcagaaacacaaagcctaaccatatcacgtacacatacctatcacttatctctcaactgaaagccccatattgaaaatgtttttgtgtatttccgtgttgctggtagtatgtttaaaagttatattggattatagctctttttttggttgcttataaaaatccctaagggaaaaataaagatattatatttccaaaaaaaaaaaaa

SEQ ID NO: 5457 - DNA, 623 bp, Homo sapiens
aatctgactctgtcgcccaggctggtgtgcagtggcatgatcttggctcgtgcaaacttcgtctcctgggttcaagcaattctcctgcctcagcctctgagtagctgcgactatgggcgtgccccaccattccctgctaccttttgtacttttagtagagacggggttttgccatgttgcccaggctggtctcgaactcctgaactcaagtgatccacccgccttgccctcccaaagtgctgggattataggcataagccattgcacctggactgttctgaatgtttcctctatacatgcaaaatattctcctgacaccactgttataactacatcacatcttctgagagatagaggctggtatctgctggtataatgtaaaaggacgaagacccctcaacctccaaaaaaggcaaaaactacgtgtgctcacgaacaggagttcagacctgtgatctatgtaactcacaatccaatcttgcataccaccactcctcctgcaaagaactgggatgacctcataaatcttctgttctgcacctgagcaaccccaggtcttactattgtccatattacactatattctaaagtcttcctaccctgctcacactggattaattaca

SEQ ID NO: 5458 - DNA, 615 bp, Homo sapiens
  misc_feature (1)...(615): n = A,T,C or G
cagaatcgaagctgtaaaactacaaatggttcttcaaatggagcccagatacagtccatgactaagatctactgcagacccctggaccagcctactagcccatgctccgatgttgatgacatcaaaggcacccctcctgaggaactctcaactgcacgacccctactacacccaaattcagcaggaagcagagcagtcatcagccaacctccccaacagcacttgggttttcctgttgagagggggactgagagacaggactagctggacttcctaggccaactaagaattcctaagcctagctggagaaggtgatcacacccacctttaagcactgggcttgtaactcagctcacacccgaccaatcaggtagtaaagagggctcactaaaatacaaattagactaaaagcaggaggtaaagaaatagtcaaatcatctatcatctgagagcagggggggcaaaaatgatttggatataaaccccaggtattcgagccaggagtgggcaaccccctttgggtcccctccttttgtatgggagctctgttttcactctattaaatcttgcaactgcanaataaagaatttaaaaagcgccccaaaaaaaaaaaaa

SEQ ID NO: 5459 - DNA, 785 bp, Homo sapiens
ggggtaccctaggacttgacaactgcaacccaaatatgcattttatgctgaggatacaattatcaacagtgtagctggcataataccacagaatgtggacacatgtgtagtaggataccataggcctttctgtagactcatggtcagaggtggagaggagctgtgaaccttcttgtgaaaaaagtcaaggtgaaagctgccccgtggtgatgggcgctgggcctaacctaccacatactgtagcatgccctgggctgctgggctcaatccccaccccactgcttggcactcgactggcggaacctgagtgacgccttcggccctgcctgccctggtctcgtcactggctgtgtctgacccataggatcagcgctcaacatgatactctaccaaaacccaacatctgggctgaacccaattcatgaatccgaacgaaaagccggagaccatctgtcactgaggagattatgaggctgatgaataccacctggactttgaaggaagcccttctgtcatggagagaccagaaccaactggatggatcaacaaagttgaagtccacatactactcatgaccttacagacactatggctatacaactgcttctatatgactggcgagctctggtcggaacccaatgaatctggatctgtaggtgacaggagggaagaaccggccgcacacagcgcatatatggaaaagcccaggctgagttacccaattggtcctgtgaccacaacccacagagggacataccagatggtttggttcctataacacgcgt

SEQ ID NO: 5460 - DNA, 768 bp, Homo sapiens
cttgactacaacaatgatcgtcagactaaaagcaaataacgcaaattcaaaagattttcttatttgagtgcaaaatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacatcgaccaactaagaccaatcatggaagcctgatgctcttacaactacacaagaaggtgccgaagaattttactgttaccattatacagttgtttggtatctgaaccccatcggtctggttatcaaagtgctcctgttggcttctccgccgcgctgctccccccgtcccccccccccccctcccaccccccccccccctctctcctatttgattatgtgccccacgtgtccgcacccggtgaatgctccagccaccgccgtcccaaatcgttattatgatcagctcgccccttttctgttagttatatgtgcctttcgcccacactttctcccttttcaaccccttccattgtgttctcatttttttctttcgccccttaaccagtttattgtcgttacttaaaatgttttcttctccttcctcatccctcctttatcccacgttctttaactacttctttcttttcttccccaccctatttgctcccctttccttcctccctctttcaccctgcaccattattttattattccct

SEQ ID NO: 5461 - DNA, 316 bp, Homo sapiens
ctgagaagggtcttgccatcttgttcaggctggtcttgaactcctggcctcgtgatcctcctacctcagcctccggaatagctgggattacaggcataagctacagtgccagctctttattcctttagatggtttggatacaggtatgttggcaagaactaaatcagccatcttggactatgagagggaacacacaggttcctgaggagagaagagcaaccaacagaagttgagagaggagtcggcctatcagccccagcatgcttatgttctgttaataataaactatcttgtatacattataaaaaaaaaaaaa

SEQ ID NO: 5462 - DNA, 1009 bp, Homo sapiens
cctgggcttacactcctggatcttgaaagggacaccacgttctgttaagtcctaaactctgacaacaattaaagcctcatcctgaggcctggtagaagatgccaatcaaaataaactgtgttcatgagaaacagggccagaaattaaagctattcaactcctcaaggccaatggactactgcagaagaggacatgagacttcacaacctgctaaaaatgagctttcctaataacttggggcctacccatctaagaataaaccatcctagccaggaaagatcagatgaaacctgaaccaaagaatcattttcttctaaaatgctttctccaaaatattttaaaaagaaaagtgggaaatgtgaaaggaaaaacatatcttggggccccttaatcactaaactaaaagagaaaagttaagctgggacctgcttaaggcatacctgtctcccattttattcaaagtcttccctctgttcactgacataaatgcatatctgcactacctccattggaaagtctaatcagaatcaaaagaatgcaaccatttgtctcttacctacctgtgacctggaagcaccctccctgcttcgaattgttctttctggatcaaactaatgtccatcttacatacactgattggtgtctcatgtctccttaaaatttatagaaccaagctgtgccctgaccaccttggacatacgttgtcaagacctcctgagaatatatcataagtatgcatcctcaacattggcaaaataccctttctagataaactgaaacctgtcttagatatttggggtctgcaacttgtatattgttagtgggagtgtaaattgatgcaaccactatggaaaacactatggagttatctcaaaatagaaaaataaaactatcatatgatccagcaaaaaaaatcgtcctcgttggcatcagcggtggagtgttccgaccagcccttttcttttttttttttctttttttttttttaccccttttccctttcttcccc

SEQ ID NO: 5463 - DNA, 333 bp, Homo sapiens
cctaaggcccctgtttcaggggtgctgccccagaccctggaggaaggaatgctgcacagagaggctgagaatctggacaggccttggtaggtttccccactccatgcttcaatcatacctatccaatgaagtctccataaaaagccgaagaggactgggttcagagagcttcagatagctgaacatgtggaggtgcctggagggtggtgcatcccgggaggacatggaagatctgcgccccttcccctaaacctctccctaagcacctcttcgtctgtatcctttgcaatatcctttataataaactggtaaacctgtgtttccatgacaaaa

SEQ ID NO: 5464 - DNA, 798 bp, Homo sapiens
tggcgtttcgttgtctgaagagatacagaagagagaccaatcacttactttcagacagacaaaaccaccgaatcctttcctgcgccatcgaagagctttgataccaaagagaaagctaccaattttcgctaatttataatacgtatttacacagaaaaatttaagattcctcctaattcacacttttagtaattattctactttaaataaaaaataaacaataacaaccagaaacaacgaaaaattgggattgttcagatagttatattccaagaaccaaacaaaatatctttttattcattgtatcataagagtctagcatattgattgtgatggagtgacccttgccatcaataggttttggataaatattgccttagacagaagtctcatgtttaaaagcacctatcagagtaacaccaactgccattacaagtaatttccaatatttccctaacatattagaagctttttttcctcatttgtgtaacagcagactatcctaccatcagcaagtgcatgccctcaattcctttcatcttatggctacggcaccccctagtgctcattgtcctctgcttccatgagccaaaggggaaaaacagggtggaaaggacaccactacttcctagaagccttggcccagaagtgataaacatcgctttctttcatgtccattgctgagtgctaggcatgtgctcacaccccatacccagtgtgctttctggcttggcacctgctttccaagtaaggtacatcgttaggaggactgcacattttcatgaacaaccagacctg

SEQ ID NO: 5465 - DNA, 469 bp, Homo sapiens
catgataccaaccgacaagcattaactttaaaatgaagatcttaaaacacatctatcctcttagaagcctgctaactggagccttcatctcttcatctacatgacaagaaccttggcttccacaagctcccctcttcttaccttagctcaagctaatttcaactcttcaagcagagcttaatctttttaaccaattgccaatcaggaaatctttaaatccacctatgacctggaagctctcctgctttgagacgtgcctcttcaggctgaagaaatgtagaaatgtatcaatacatgtattgatttatgtcattgcctgtaacttctatcttcctaaaatgtacaaaatcaaactgtaaaccactctccttgggcacatgttctcaggacctcctgaggctgtgttctgagtcatgatccttaaccttggcaaaataaacttctaaattgattgagaaaaaaaaaaaaa

SEQ ID NO: 5466 - DNA, 795 bp, Homo sapiens
  misc_feature (1)...(795): n = A,T,C or G
ctgtgaattctacaaactaagcactggggagaatgtcgagatgttacagtgaaaaaggaagctaaatgaggccagattggagagcaaattgttattatttaaaacttatggaccacctcgaatatgccaagttctatttaagaaaatacagaaacatgattcctttcatttaacagctgacattttcaggaagtatacaccacatttttgtatgtgttttactccacatactgccaatatttaaacttgcttagtttgaggaatttgctcttattagttgtgtttttctgaactttttttttagagaggttatatttcttttctacgttatggttttgtgttctttcctgttattaattattcacgtttacactctgatccgcagtaagtaagtagtaagcttttttttggtttccgttttcattttctacggctaggtcaacttaaggcgcgacctatcacggtaacatgtantgtaagaggttgtggtagttagcgggagtcttattgagttatgcagaggatctgtatggtctgaactatgttattttttattgctatatttaaagatattggttgggttctcggtaatattgtagaggtatggtggtgttccgttgatttaattcgttgtttggttgtgatttgtgtatctcgatgtgttgtcttcgcctgctcctcctcatcctcgctccattatatatatatatgataactcatactacactattctgttacacgcgtctnagtattgcgtggttcttggatagtgggcaccgaaacactatctaaaat

SEQ ID NO: 5467 - DNA, 738 bp, Homo sapiens
ctcaggtgacgtgacccagccttgtggcttccactgccatccacacacgtcgctgcctctctccacatcagcatcgcaactatctcctggaagctttccaagtgctgaactacagtaacctcaaccgaactgctgttcattcaccccacaggcttgcccctcctctgcatctttgtgagaacctgagagtcatcctaaactcctccttccacctcactccccacatcaaatcgattaccaacttgtgctgattttatcttcaaatactctccagaattgtcgctgtcatggactgaatatttgtgttcccccaaattcatatgtcctaatccctgatgtgactgtatttagagacgtgacctctaaggagtaattaaggttcagtgaggtcaaaggtggagccctgatctgataggatcagtgtccttataagaagaggctagagctgggcacaggggctcacacctgtaatcccagtattttgggaggctgaggtgggaagatcactcaaggagaggagtctgagaccagcctgggcaacagagtgagactccatctctacaagaaaataaaatagtcagacacagtggtacacacctgtggtcccagctcctcaggaggctgaggcaggaggatggcttgagcccaggaatttgaggctgcagcaagctatgatcacacctctgcactccagcctgggtgacagcatgagacccagtctcttcaaaaaaaaaaaaa

SEQ ID NO: 5468 - DNA, 232 bp, Homo sapiens
cctaggagacccaactgatgaagtgtcactcccaaagaaaagataaagtcaaatctggctggccagttacaacttcagagctctttcataactttctgaggttgtagataaattggaccttcgcagaagaccgtggctgtggacaagtaaacaattcctatcatacatttctcactggagagaaagttaaaagttagattcaataaaagtgaccgccatgacttaactaaaa

SEQ ID NO: 5469 - DNA, 394 bp, Homo sapiens
ctgacaccctcttccttctaagtctaactcagtgggtcagtcatgttcactactatgctgttacggagatggctacgagagagtggaaccacactgtggaagaagcttctgtcttctctgacaaggaagaggagacatgggaagctgggatgtctgttgctttgtgattccatgatagacttgacaacacagaaactaccacaatgtgaggaaggtgcgcaaggggcttctgtaagactttaaaaagactcaaagggaagagcttaagttacttattccaatagcaaaatgtgctgttatccatgttgtttaaagaccttgctctacaagtttgtctttatcatactgtacaattatctatacagtactaaatacagaagagtgttcagtaaaa

SEQ ID NO: 5470 - DNA, 442 bp, Homo sapiens
agccgactggtgtttgagtaactcacaaagaagttcagaagccactgcgccagccacggaggtacacggctcaactctccttccagacagaagctgctgggaggagctccagctaccacagcagtcattctgaggctacgccttccccaggctgcttctagccaataactctgcacagcagggagactggaggtgggacatttctgccaacatgggacccatcgaatggctctcctctcaggcttggctaaaacattctcagaactgtactgtcatctgaggctctttgtacccattcctccttccctcttcctctttttttcccaggtgtcagacttacatcatggcctggggatctcacagccttcacctgctccctctcctctctatgtttcacggacatttccccaataaatctcataaatctcttgtatttctaaaa

SEQ ID NO: 5471 - DNA, 207 bp, Homo sapiens
aaatacaggattcttctgttaccagaaacccagggatggtgaagcctccagattcaaggactgaagtgaatatacggtggaaaaaaaaacacaatgacaacaacaacaacaacaaaaaaaaaaacgcacacacacactttcttccacctgctgcttacctttttactgtgttgtaaattaacagtaaacctgatttaaaacctgaaa

SEQ ID NO: 5472 - DNA, 508 bp, Homo sapiens
ctgtcacataaaatgatagagctatctccgtgacaagcaatacagatgaaggcccagggaccatctgggaagtcgtccctgtcccaggctgggggaaagaaatgactcctcaaagggtggctgtgaaaaacaaccctttcagtctgataggtggcagaaataagcacctaaggaagaagccaacttcagccaggaaagagcggggaggaggaggagagagccctaaaatccagcgagaagagatcagctcaataaatggagtgaagaagtgaatgaaggaacttaccttttgttgcaaagaacatgagactgagtccaagagacctggcatttgaaagataagccctggctctttcagtgatcctgtaaacttaggcaaataacacccctggcctcagtttccttatctataaaaggagctcataaaatggcttcctggcaaaactgttgcaagaattaaaacctgtatatgggagggtgttttattaaccccttaaaaaaaaaaaaa

SEQ ID NO: 5473 - DNA, 484 bp, Homo sapiens
ctgccacaggggtttcaccatgttgcccagctggtctcgaactcctgacctcaagtgatctgcctgcctcggcctcccaaagtgctgagattacagacatgagccaccgtgcccagcccacagatgtcatcttgaacaagagaaaccagatacaaagagtacatcaattctttatgattccatttatacaaaattcagaaacaggcgaaaccaatcctggtggtagaggtcagactaataaattgccttggtacaaataaattgtcctggatatccaccaagacaagccatgagatggggctggaaacattctatggtaacctacaccttcatgtgggtggtgattgcacaggtatatacacagcctgtgtatcacatgtatcaaatttatttggctgtacactcttctttttgcaagttaaatttcaaatcaaattttttaaaatgcaaataaaattgcatatatccttgaaaaaaaaaaaaa

SEQ ID NO: 5474 - DNA, 778 bp, Homo sapiens
tttgcaaggatagggacttctgcacaacacatttcgcttgctgtcttggaccaaattataggaggaaagaagccacgaggatgcagagttcaaacaacttgtctttttatttcacaaatgttggatggagaggagccccactgacatccaaacctgatctagaccatgagacttggataatgatcctgatgctataagtaggacatgagatctggagctccagcagccatcttgatgaccaagagacttcaagcataatatgaaaaacaaggatctccaagaagacagactggaattctggacttctgatggcattgttgaggcctgaactataaccccaatcacctactgcaagatgaggaaataccaccttattgatttagggcctaaatttctggccagtggttctgaaagtttgggactaatttgaacatcaccagcatcacgtagagactcatcagaaaagcacattcatgagccaccgtcatatgtgcatcatcacaaactctgagctatctgaggtttaacatatcccccacaacaataattcaatgcacaagcttccaacaccatccactcactgtggtcctcacttcatggcccattcactccacgcaaagcctgtaaattctggaaactgcctaattgcctatgactgccctgccgccgcgctggaaatacccactagtgcccctctgcggtcaccctaccacaacactgacttcacaaagaccaacgcactcccgccactgacaacacggctgattccaatcaggaa

SEQ ID NO: 5475 - DNA, 545 bp, Homo sapiens
cgccctcctccctgccgcgatctcctttccgtttctctttcccgtttctccccctcctttcacctttcagtcaacaactaaaagcttaactgttttttctgttttgtttacaattgtatcctgaatactgaagcaatgctagacacaagcccatgattcctctttactaagaatcactcatcaaaaataaaataaacagttgcatcattgaagtggattttaaagggccaaagtgacaaatactggaacatcattgatatccccaaccatagtcttctacttctgaaaaaggagtaatttctattgcctgcctgacttctaaattaaaaaaaagaaagaaagaaaaataggaaaggaaaaaaaaatgcttttgtacataacgtttttttttccctgaaattgttactgacatacctggaagttagcaatatcaccgcagcattctaaagctatcctgcttacagtgtttttttttagaaacttgaaataagagttgcatactgacagccaaataaaataattaactgaattcaaaaaaaaaaaaa

SEQ ID NO: 5476 - DNA, 263 bp, Homo sapiens
ttgagcaggctttcatgggcaactaatttaggaaatggtacagaaagaaaggaaggctggaaagaccaaagaaaaacagctacagttttgccaagaaccagccccacgcttcatgagaattgtgatacatttacatttggcttctaatttccgtaacaatttggactgtgtttttgtgaaaatgagataatatatgtgaaagtacctagctgaattcttgggatatggcaaaaacccaataaatataagttttactactgaaa

SEQ ID NO: 5477 - DNA, 307 bp, Homo sapiens
aaaaaaagaggaatctgtcttcctcaccccaggaagcagagcaggtattcatgggcaacaatttaggaaatgatacagaaagaaaggaaggctggaaagaccaaagaaaaacagctacagttttgccaagaaccagccccacgcttcatgagaattgtgatacatttacatttggcttttaatttctgtatcaatttggactgtgtttttgtgaaaatgagataatatatgtgaaagtacctagctgaattcttaggatatggcaaaaacccaataaatataagtttttactacaaaaaaaaaaaaa

SEQ ID NO: 5478 - DNA, 770 bp, Homo sapiens
  misc_feature (1)...(770): n = A,T,C or G
ctgctcagtacatctcaatctcattctagttctgtcgctgtccacatgcatgtgttttggtgttatccagttccatcttctaaggtgtctggaaaatctgattactttctcattctgctgaacagctgcccaaccagattggacaggagcaaggaactagcttttctaaagccaattttggagaagatgtttgtgaaaaggtcctttcgcaatggacttggcacagggatgaaaaaaacttcctttcaaagagcaaaatcatgactaagtgtgcaaaggactcggggaattaatctaactgtagagtgtgactgacctactcaaagtccatcgtctctttatcattgagtgttggcatgctctctatactcaaatatctttcctctcctgactggtacagagtaaattgagtaaaaaaagataaaaaatgtatacatgtctcaaacctgtctcaaacctccacttgcgggagaaaaaacaatttatgtggtccattagtaactttttcctgaatgggatggacactttagctttggttttaactcggccagagaagcatgancatgttgacagagatcaccatagcatgataggttttttgctgcctatgatatcataacacgactactcgggatatttgcttttctttttaataccganctcctcacatgacattacaatgccaatcacttggggagagggggatgctcgttataatataagtaaagggcttcgttctgcaccggtagtctcgggggatggctctaggg

SEQ ID NO: 5479 - DNA, 1199 bp, Homo sapiens
  misc_feature (1)...(1199): n = A,T,C or G
gccccactctgttcccccaggctggagtgcagtggtgagaccatggctcactgtggcctcgacctcccgggctcaagggatcctccaaccttagcctcccaatgtgttggcattacaggcatgcgccatcgcaccaggcaaaactggactcttgttctggagtcatgtgggggaactgggcccctgagcgaggctaggctgtctcaggtctgggccttcttttccgagctccctgacgtctgacatacccttggtgaacagcagagaggcacatcggatctacattcagatgcctgcctatgctgtgggatgcaatcctcccttatggaacagttcctgcagaatttctcggggccgtgcagataagggaagcaggcagccttaggaagctgggcaggtggaacctactgtacagcccacgagcgccagcctgcactgaggccactagcattcgcatctcacctcccgggagcaccagcctgcaccgaggcctctagcattcatgtctcacttcctgcaagcaccagcctgcaccgaggcctctagcgtccatgtctcaccttctgggagcaccagcctgcaccgaggcctctaacggtcatgtttcacttcccgcaagcacaagcctgcaccgaggcctctagcgttcacgtctcacctcctgggagcaccagcctgtaccgaggcctctagcattcatgtctcacctcccgcaagtgccagcctgcaccgaggcctctagcgttcacgtctcacctcctgggagcaccagcctgtaccgaggcctctagcattcacgtctcacctcccgcaagtgccagcctgcaccaaagtctggcattcacgctcacctcccgcaagcaccagcctgcaccgaggcctctggcatccatgtctcacctcccgcaagtaccagcctgcaccgaagcctagcattcatgctcacctcccgcgaacaccngacggcactgaggcctctggcatccatgtctcacctcccgcaagtaccagcctacactgaagcccctagcattcatgcctcacctcccggccacacaaggaaacagaaaactttcttgtcactaatgaccaacagtgaaaaagaacaagccaaccataacaacttttaaagaatgaaaatggtcagatgtttctttgatgcctctctcaaagccaataaagcnctgtttgcgaccagg

SEQ ID NO: 5480 - DNA, 1014 bp, Homo sapiens
  misc_feature (1)...(1014): n = A,T,C or G
cacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatgaaattatttttaattttttgtgattaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcaggatatacatacagnggaatagnatnnagantttaaagggctngaaagaaaatnnctgcnntattntgacaacatggataaactttgaagacattatgctaaggaaaataagccagtntcagagaacaaatactgnntactgtatgatgccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagacacctgatgaataacattatggtataaagataacaaacacagtactgttaaaaactttaaaatatttttaaaaggtagagcctctacttgactcttccttgcaaaaataaaacccgatgctggccag

SEQ ID NO: 5481 - DNA, 1191 bp, Homo sapiens
  misc_feature (1)...(1191): n = A,T,C or G
aattttccacggctacaccgtaacatggaatgctacagacatgatattcattgacttcaaataactatcccaccaactctctcctgagatctctatagctacagtggaactccggaaacagaagactttaaaaaaagaaaggaagaaagaaaaagaaaccaccaactctgcaaagttctctggaatctgagaagtcaagcagggcttctgcctttttcatggtgagcctaaacngcgattccgcctctagacatggcacatcaggcatgcctggatctggtttttctgccaagccttctgacagtaacgcaggcatttgctagtgtatatggaggaaggctgacttgaagtccccagtacatttcacccagtgagaagaggacaacactgactccagaaagccttttgctgacccgctctttgaaaccagtgtgcctgccaggaatcctcgccctgtgccccgcctacactcatccccacctaccttgtccactctgccgccacagcttcggtcaggacctcatccctttcttcacttcattaccactaaagaaagcctcctcctgggtccccatgttccagtctggctcccttccgatgcatctcccctgcagctgtcagtcattgttcaaaaaggcaaatctgaccatgccactctgcttaaaactcttcaatgactatgctaacattaaagatgaagcagattccatagcttagcattccaggttcttggtgacatgactcatgcctttctctccagccccctttcctctccctttcccaccgggttcccttatctcttccccaggctgagcctcacaggggaagtctcatttcaggcctccacaccttcccacaggctgtgctctctagttggaatgctggcccccagcgtcccagccctcatttaactctcactcatccgtcacttctccactgaagggccctctcctctgtgcaggcttcctggattgcccacctgtcactcgcatttgatttaaatgcccctgattctgggctcccctagcaatggtcacacttgccacaatatattgtaattaattcaactttgtctccctcacttacttgtaagttcctctagaacaaggagtattttactttgtattctcaagatttaacatggtgtctggcataaagcaggcttttgatgaataaaaacggatgcggcca

SEQ ID NO: 5482 - DNA, 816 bp, Homo sapiens
ctttgcgaacgttctttattgttgtcttataaatacctccccaatccatgacccccaattcatctacccagcatgaagcaactgcattccaaggcattataatacagaagaaatgcaaggatatgctcacatcaaacgtataatatgtcagtactaagcaagacaacaactttataagatatgctttgttaaaaggaaaacaagattttctaaatttctttatctcttccaactaatatatccaaggaacttatctagtgatacatatagaatgtaataaaagtggtcactgacaaagaagaggaagagaagaacatccgcccttacagacctgaaagtttgaattaacttaaagactgttatttatgtttctacttgaacgacttggtaccagccagaagttattaatgatccataccagtgtttttcaaaggagtattaatgaaggagaaatggacctgatcctcaattcaaatgcttgaattaagtgcttcaaccacagtggatcctgttatattatctcaatactgagattatattgtaactgatttaagccatggaagtccggcttctgtgatgcttctctgccacccgatagctccctattactggtttatgtactcctcgctttgagaaggatcatatgaattcatattaacattcggtgccaatgtccttcttcctctaagtctaatacacgttgctcgtttgccaacatcctcccttactgttgctgtacgcgctcccccctacttatctttatttacttaccttatggccactgttctcgtcatcacattaaagtcattccctact

SEQ ID NO: 5483 - DNA, 518 bp, Homo sapiens
tggtggtgcatgcctataatcccagctcaggaggatcacttgagcccaggaggtcaaggttacagtgagccatgatcatatcactgcattccaactggagccacagaaggcttggccagctggtttcagctcaggctcaggacagagccagtccgtgtgccagaaaatcaagaaacactcagagcctgagaacagaggatcagaactcagataccagagcaccaccaaggaaggaggccacctaaccagctcccctgcctgaggcccaagaatatgcccaaccttctagttacttaagttctctgagccttggttcccccatctgtaaaatggggatggtacaaaattcaaggttttccgtaaaaaatgaaatgaaaccgatgttagtgaaaagttatctgcatactggctggcacctagtaggtgctcagtaaatgtgcattccctcctctttcatctcatgctagtgattgtgatgaactcactgggtcacagtgaggtgtctgagtcagatacaa

SEQ ID NO: 5484 - DNA, 786 bp, Homo sapiens
cgcatacgtgatttattacattggttggctctgaagcaaggatcaaagtcactcagcccgagaaacgatgtgaggtctctgcataccaggtaagtgacatgcttgcttttcaaacagtgtgctcttgataaccttgtccctcaaatcttcacactgtgaagttgcccgagcctttcagaagatcataagatgctagaggagcccaggtgattctgtttggtctatgatagtgttggacattgattcagttgacatagagactctccattttagcagcaggagacatgtttcatctttggatggctcttctcctctcttgttctgtttgctcagctttacttcattgtgccttataatgaactctattccatctgggtgaggggagtttctaacttataatgaactgcattccatgtggcctctgtagatgtaaaatgccctcactgcaaaactcctcatccttggaggaagaatatcaatgctatccaatccgctaggcgatatttcacttgttatgaccgaccaccccgccatgattcttacccatggctctcactactcccgactgtcaggccccccctcaggtctcgtcgcatgtcactgctccctgccatcttatcttctctccacgctttgcgccatttcccccccctccgccccttccctcgctccccctcgtgtcattcgctacgcttcataacgcccatacactgtctccccacctcttagtgttcgcctcgggaccccgcctcctgccctttcacgtactcctccccaggtccccta

SEQ ID NO: 5485 - DNA, 795 bp, Homo sapiens
ctggccgatcatcttttattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatatgggtggagacttggtgggggcagtgtgaccagggtaggtatttcattctgtgtcagacacttaccctcagttcccctgcctttggatgtatggctatgtacctccacgcccactgcacaccagtgagccgacgaggctcaccctcgccgaacgactcctcgctccacctcctcactaccccccccatcttcacgcttcccccacccccctccaccgcctctgccccccaccctcgccaccgcttccccccatctcccctaccccccccccgcttcttctgctttcccgtccctacccttctccgcctaccctctctccttatcccactcgtcgactctcaccctcacccgcatcatacctcccgcgtcccgccctcctctccctccccccccccctcccctcctccctcccctccctccccccacataccaccaccccttccttcctctcctgcatcaccccgccctcctcccacccgccgcctcgcaaccgctcgcctgcgacaagtatttgcccgctctctacctcatgtcacctctatgcgtcacttatccgcacccttcacct

SEQ ID NO: 5486 - DNA, 978 bp, Homo sapiens
ctggcagatctactggtcctatgtttaatgggtaacacagacacaactggtgtatgttttcattaaaccaagtaggagcttgtggcatttctgtctgcacttgagacatgtttatactgctgagtccattatgaatctgtttaatatccttcgaattctccgagtccttccatccctgcagccaggaagtgggtaatgtgcacacagggaagaaatttccaggccctcagacctttaggtaaatgaggactcttttttctttcttttctttaaagaggggaaagcctgttgcaaaaaaattaaattcttcctgttcaaaatgggtttttccaaggatcctttccttggaggagaattggtagggcctaaagagatggggaaggagctaccaactaggggagcctgggactagtgagaatagcatccctttgccctggagagcctgggatggaggccttgggggtgagtgactatctgggggctgaaaaggacatcaggggatctgtagccaggagctcaaggtcaccctgggggctgccttggctactgggggctcctgggaagccagtatcagactaatcctatcggattgggaacaggcttcccactggtgtgctggcaggagtagctccctgcttgctggcagaacagagagatattattttaaggagaaaaatgagattcctgttattgctttattcctcctgcagaaacgttggtgcgtcccagccagggccaagatgagaggcaggtggtgccaagagaaggatgagctcatcgcatgtggggacgtgaggtgattccagcaaggcacagtgtggaaaaaaagctccattcttgggatcccaaatccatttgtttttatctgagttccttcctcaggaaaagaagttcaggcctcccacaacatgaggagtctggtgtgactgcagcgtaggatccacgggcagctggtccgactcagggaggcaatttgtt

SEQ ID NO: 5487 - DNA, 755 bp, Homo sapiens
  misc_feature (1)...(755): n = A,T,C or G
ccttggcggcaacatttttatttgttcatttatttttctattttcttaattacttcattgaccagctggtcatttaagagcatattgcttaatttctatgtgtttgtatagttttcaaaattattattattgttgatctgtgatagtacttcatttttttaatgttttgagaattgttttgcgaactgacataaaatctatcctcaacaatgattcatgtcctgaaaagatttttgagtattctgcacccattggatgaagggttctataaatatctattagatacattctgtctgtagtgcagaccctcttcaatgcctctctcaccggtctgaccttaaaaccaggtactgtgattgttcatctgattttcggctcttatgaggctgcctttctatagtcccatacccgttattctcatgtttttgcgggaggaccatcaccctccgcctctatctctgaaactctaccacccttctgaccgatgactatgcacaacacgccnctttcaagtcttaatgtcaccatgccgcttgatatttcatcctattctattcccgtttcacctccccactttcatgcctgcgccctcctctttctccaaaactccactcaaacccaccacaccacagactccatatccccgtctatccagctcaccacttacaccacctccccccaccagcgtctatctcatgtattgtcgccccgcacccacaaacatcaactactactaccctcgtattacctcattt

SEQ ID NO: 5488 - DNA, 751 bp, Homo sapiens
  misc_feature (1)...(751): n = A,T,C or G
cctacgggcacttccctttattattttttgtttgatacgcatgtgcatgataacattgaaaagcataaacaagaaagaattttctagacaagtgctgcatcataatttgtagttctttagagcaacaattaagaaatctatattactatttatttccttatgtatatctttttgtaaataagatagtttttgtaagatttacacttcaagttctccttcaaagttgaccctcttttttgaattgctattttgcttttcatgaccatgtcttagagaatggtctcatgtaattaaaaaaaattaccttacataattctcattattttattacataccaagaaaaacattttaaaccacgtaaaatcatgtactacatgactaaaatgaacatgatatataatggccaaagattttcatagggcttttaattatctgctgttcctcatcccactccctacgagcctccccttctatacctgctccctcctccctatacttccatacctcctctgttccacattgcccattgcacgccgttttctccccccgccgctcccattccccccccgcccgcgctccagtgcnccgtacgctcgaaccgcccttcgtgcccccctctcttcctctccgcttctcgtctgctttctgttcctccatggcggccccatccccccctcacctctacctcttccaccgtacccgcacaccactatcacaaacgctccggagctcctccactacactccaccct

SEQ ID NO: 5489 - DNA, 821 bp, Homo sapiens
ctgccggatctaggtttattgagttcttagcataatcgcttggcacattacagtcttacttccatcaacttgttgaatcttcacagacaaatttggaggttggttttatatagcccattttccagacgcggtgtagtgatagagttatccgtatgctctatataccacatctaccccaactatgaccttgggcctttgttcatgtttttcaaactaatactatattgaaagttttagtatctggcacaacactgtagacagttgtctttaatagcaatgctcacactctataaacaaacctgcttagaatatttgatggtgctcacacacctgggcattttggcattgaacattatgcttggttgattattggctgggaatcaaacggaacaagggcccctatcccatccttgagccccccgctgggaccctcgctcagccgcactcaatctcgcccctgcccccccgccaccccccacatccctcaccccaacaacctgcattcttggcccgtttttcccccccctattctcatatgtcggaagatcgcttcgtcatagaattaggttctttccttgtagcacgggtgcgagctgcgggcgttgctcttatctctcacggaggaccgcttcttttgttaggtgtagggataatttgcgttatcctaagcggcgctagtctatgtcgcctgcacgaacctcgaccaattctttcaacatcacctccttatctgcccgtacatatcagttaccaactcgtcctccccgccgccctcccactcacttgtacccacgctcccattagcatgacgtcacatacaa

SEQ ID NO: 5490 - DNA, 786 bp, Homo sapiens
  misc_feature (1)...(786): n = A,T,C or G
ctggccgatcatggtttattctttttctgtaagatgtatattaaaaacaccataatttttaaagccacaagatgggataaacatacagtgtaagaaactattgattgacaacatttcattttcctcaaattttcacaatttaaaaagttatactacttttccaatattgtgtttggtatgcatggtgctttggtatgctgagtgctttgaataagaggaaactgaaaggcctcagaaataaacctcgggaccaagctccctctctgagcttcctccactccctgtctctcttgtgccctttctttccagaagtaccaggaggggctttatctgaagttcccttatctgattaaaggaaggtcttgtagaagaattggaatgaggattaatacccattcctaggaattcaattagacagccgacccggactggccgcaggattgacactaactaccctctccgcacccacccccctccccctcatccttgtcctccgtttcctctcattcaccccgtcccgctaattagcctacagtctctctccttcctttatctcaaccccagcacctcacccgctaccactctccctccctcccccgctacttccctcatctatactcttccgcctctccacatctcngcccaaccccatcatattgtcacagacaatataatcacttctccttacccccaccacctcgcaacccgccagccatctcacctctccagacgacccctgtacctccactgaactaaacaatggacatctgatttacgaatcttccg

SEQ ID NO: 5491 - DNA, 774 bp, Homo sapiens
ctggccgcatcggggggttatttcctctagtttttaagttagtcaaggtctacccagacactggctgtccccatggcaggctctggttttgcctcccatcaactttggtgcaggatcgcctttgtggtgaagacaggagggagatctcaatatcaattttcctgaagaaatcttcttcaccaaaatgttttcttgtccatgctcttaatcctttggattaaggaggcaacctccgactactggggtcaagagattctcctacctcatgctgccttgcgtgtgggattacaggtctgtgccgccttgactggatcataccagacacaccactccacaacgcaccccccctctccccgcttcacgcgtcagctccccccaccacaccccccaccaccccgcaacagccaagccaaccccccctcaccctcaaccaccccagaccaccaccctcccctcccctcaacccactcaatcacttcacctcgctaccccaccttcctccgtgtctcccctctttgtttgttttctttttccgccgcgcgtgtagttacttgcatgatcgcccactcaccttaccctcacaacccccctattaccatccgtctgtgcttttctcgcatcatctctaatcgatactcacactcttctccttcctcgcctttcgccccacccacactacccaccgcccacacaccccccctcccccctcgccaccgcctcccccgccacccacacctccacactcccaccctcccccactcgcgggccccgctg

SEQ ID NO: 5492 - DNA, 790 bp, Homo sapiens
cctggccgatccagttttattctcttctgtattctgaagtgcagcattgaatttcaaagttcttatacttgccatctaaggtgcttgccctgtttatttctatcaaagtatcatggaacccaagctgacaatctgaaatcgttaaaaaaaaaaaaaatgagacaaaagtgataatgaaggaatattcatttacaaatcattatttatccctggtgcttttttggcactaacttttttagattaataaatggaccacaaggaattaaaaaatcacacacagctgtagaaacatcggcagcccgcgcctctaatctcaaaaccagtatacatcctcatgctaactcaaacccaccaccactctcacatccacccacacccaccccccccacatatacaccccccaaccaacgtcccccccccctacccaatttcaacaacatatattaatcactacctaacaaacaccctacccatttcccctcgctaccacctttaacatacaacatatgtgacctccaaaaatgctattgattacatctataacataagaatatacaacataatgactcccccacgaaattcaacactcaacacaccctcctccttccccccatccattaccatccaccaaactcaacacccaacgaccttcaacctccacaactaacaccataacacacttacactaagaagcaacatctcacaatgccccacaatataaccttaacaacaaacacacccaagagcaacacaaccaacaccaacgagacaacaacaatagaaataaaac

SEQ ID NO: 5493 - DNA, 766 bp, Homo sapiens
  misc_feature (1)...(766): n = A,T,C or G
tttttcatttgttttgaggacagacacatagagaaataattcaataattataaatctgtgttgatgcatactctatgtataaaaattagtttgtttgccaataacagcacaaaggagaagggaaagaacagagctataggaccaaagtgtttagatgccattaaaatgaagttgatattaatcaaaattagattaatatgttattaattttaaccccccctgnctcattaagaagataatgtttttaaatatagaaggccaggcgcagtggctcatgcctataattccagcactttgggaggctgagacaggtggatcacttgaggccagaagttcaagaccagcctggccaacacaggagatcctgtgtgtactaacacaaaaattaggcaggtgtggtgatacacgcctgtgatcccagctgcttgggttgctgaggctcatgaatcgctggaaccagcgaagtggaggttgcattgagctgttattgtgccactgttctctatgctgctagacaggaatgaacccttctcttttgtttacgttggtaagtctaaagttgagtggggtaatcccttgttttgcttggttgtttgtgtgtcgtttttagtttctttcttttcttacggtctccgcgtcctggccctttttctcggtctctgcgtgcttttcccgcctcggtgcctcgcttggttgcatgcttgtgcgttgcgtctccgcccttgttcttgtttgtggggaactatgcaaatataaaaaaagaagt

SEQ ID NO: 5494 - DNA, 779 bp, Homo sapiens
  misc_feature (1)...(779): n = A,T,C or G
ctggccagcatctggttttattccttttgtagacataggaaaaggaggttttgccagtggttaagctaatactttatttcttaaaaattttcttatttttaaagcaatattttattgtcactagttcttttatctgtttggagtacagaaaaatggtgattaatgatctaagtactagtagagcaaaatagttgatttcttatgttctttaagttttatctaattgcacaggggcagattggtgttgtggatctccacacaaactatggtgctatactgcctgggtttgcatcctgtctcatgattctacatcccccttacttacacacattaatttaagtatatgtgaacgattttacttctccaanatgagtccngggtgagggctactgtgctatgtgtaatttatccctatacctttcctttctatccactcttcaccccttctttcctaacaaccaccacccccccgccgtttccccttatacctctccgtcttccgattgtcttgctgttcactctcccccttcccacttatctatattttgtctttcttctcaatcttattccttccccactccctattctcaccaaattcacctctacttctgagtatctgtcatatagttatgaaacacatacacaccgatatatctcacttatttacataactccttcttcacttcatatctttcatctctaacggtattatgtttgatcccactcccttctcactttattcatgcctatagtttattatttgtctctttgtctcctat

SEQ ID NO: 5495 - DNA, 788 bp, Homo sapiens
ctggccgcatccggggtttatttttttcatttttccaccaaatccaagtgggcaatattttatacttcttaattcagcctactaagaaaccatggtcattaaattgtaaactatttgtagtgaggtctattccgtgatttacaacctcttgttaaaaacagtgtaaaagaaagcaaactgtaccattactacggtgtaatttgatgttgcctttgttactaaactccacatgattaatgcttttagtagaaagaagaaagttttaaaaaataaaaagcagagctgagtggtataatacctgaaatatgagaatgttattattttaagtctttttcacttgtagaggaaatatatatatatatgtatatatatacacaaatacaagtgtaaaatataagtgtgtgcaaaattatgttaattgttaaatgacaccaaaagaaagcttcaattttatacaaaaatgctttacccctatgcattgtgcttaataaggatcctctattttcgtctactctcgaccgataaatcgataaatcgatggaagtattactggttatcatgcttctctccctcactgacagcacacctcgccatcagatgtaagtcgctcatatatgaccagttttatcaattataatcctcaaattatcctattttattttatcagtttttatactacaagcctcttccctcccagaatattattggaatctttagtgcgtatcgttagttacaactctccctctttcataacacatcattcttttaccacaatcttcttccaataa

SEQ ID NO: 5496 - DNA, 808 bp, Homo sapiens
  misc_feature (1)...(808): n = A,T,C or G
ctggccagcatcgtgttttattaatgttttttaaattttatttatttatttaagagacagagtcagagtgttgccctcactggagtgcagtgactattcacaggcactatcgcaactcactacaatctcgaattcctgacctccagtgatccctctatcccaacctcccaaggtggctgacacatgccaccatgcccagcagtttcactaatatctgagagcaatttggatgacaaggtttttattaacactttctacattgctaggatgagtgtaaattggtacaatgtttatggagagcaatagagcaatatgtacaaaatatataaaaatgacatgcgcgcgcatcattcgacttacactgaccttactaccaacaggctgccacagggactcccgccccatgacctaccgacgccacgccgacaagacacaccaacacgccacactcgcacccaccctacgcctcccccactcccccccttactacctacacaccacccaacgccccgacggtactcgccttcctggaaagtcgatcctcagctggaacagaggcgcacatgcgctctgtcctccgtcccccctctgtcactgttcactgtacttactcttgtcttgcatccgcaatgaacagactgcactatcaccggggccaacggctttccacccagagcttcaccctcccctccctgaccttctccttctcaccatcgcacctctcctaagcccacccctccctccccccacaccatccncactcctctccacacttcccccactctcgatcctcgttatgcctacaccg

SEQ ID NO: 5497 - DNA, 783 bp, Homo sapiens
ctggcggaacaggttttattttctttttttattttactgcttatgttactagtgggtgtgcagcttcttggcattttggacaaagaatgggacaacacacacaaacaaagcaaaggaagaatgaagccacaaaagcagagacatattgaaaacagaagcacgctccagagggtgggagtggcccaagcaagcagctcaagggcccggttgcagaattttctggggtttaatcttcctccagaggtttccattggttacttgctgtatgccatatgtagatgaagaggctaaaatgaagttacaaagtcatttacttggtgtatgccctgtgtaaaagaagaggatatttcctgtcatagctgaagtgtttttgtttgatttagttctaggaagtccttacgttctctgactacaggccctattctcctgactcatttccccgttgaaagcgctgatccccatccatctttatgggaggcaaaggcatacatggccttctgcactgcttcatgctgccttggatcatatcccctacctacctggggatcacagaccccttcccctgttttctcttccggcggagggctcccttcttgtctccctctggtgttgcgcttccccttaactccctcaccgccttgccccgtagctctcctcccctctttctcccccctccccctcgatctgtcgccttccgccctcttttcctttccgtcgccttggccggcttctcgtctccactgctgcgggcaccccccttccctccttgtacaccacaaaaca

SEQ ID NO: 5498 - DNA, 232 bp, Homo sapiens
cctttcttgcaatcggggtaggccatgtgactcattctggctcgactggactctgagtggaaatgacatgtgtgacttctgggctgaggcagacacgagctggtatgtgtcatccatcactctcttgctctaccgcagaagcttgcgaaccaccagatccagagggtactgctacagggtgaacgtggtgcccgatcttcaatgaacgacacatcttggaccaataacactc

SEQ ID NO: 5499 - DNA, 400 bp, Homo sapiens
aatttatttaaagaagaaaaaagagagggcaagcactgtggctcatgtttgtaattctagcacttcaagagcctgagatgggaagctcacttgaggccaggtcagcagttagagaccagcttgagcaacatagggagatctcatttccacatttttttttttaattagccaggtgtggtggtgtgtgcctgtaatctcgagtgccaggatcgctttagcccaggagtatgaggcgtgcagtaagctatgaatgtgccacagcatttcagcttgagtgacagagtgagttctgtagctttgttgactacttagtaatctgaggtagatcagagatcaggggttttctcaaactggtctccatcatcacatctctagctgcttggggtacggtcatgtggat

SEQ ID NO: 5500 - DNA, 770 bp, Homo sapiens
gcgatcgacatttattaaacttacaatccccgtggctggggaggcctcacaatcatggcagaaggcaagaaggagcaagtcacagcttaagtggatggcagcagccaaagcttgtgccctgcacaagctgcttttaaaaccagcagatttcatgagcctcattcactatcacaagaacggcacgggaaagatccgcccccataattcattcgtctcccaccaggtccctcccacaacatgtgggaattatggaaactacaagatgagatttgggtggggacgtaaagcccaaccatattaccctctgtcacagagtggaagtggcctctttcccaaagtttgccttaagtttgactctaagcttaggttggttggagaagacctttccatgacgattctgtagaaagtttatcattcgagatggcgccatgatgtgacaagttgcacgatgaggaacttgggccacattcataaaagtgttgtcaatgtgccttaccgactggattatcatgcctttactcccgactcttcaagattctcttccccctaatcctctcatcggacgcgaactgctgttggccataggaccacccgcgtatggtcacaccctacctatcgcgccggacctgaaaacagtagtagaggtaacgcgcaccgcgctcccccgcccgcggctacgctgtgtctacttctcattggtccgtcccctccgctcgccgggcccgccgtgatccgcaccttcgacccgcacccctcgagccccgtcctct

SEQ ID NO: 5501 - DNA, 658 bp, Homo sapiens
ctggacgcatctacctttattaaattttaagctatattagattgctagcattgctgagtgctggtaaaaacatctttagatcaatgtgaatttgtttaacttcagcgtgtttaacttcataaagtcactaattgtgagatgaatcacactctgtgctttctttgattatgtttatcttgttattcagaatattgaaataatttatttttgtcatagcagtcagatgtcaatctcaaaagaccctataatttgataacaacataatggctggccatctcatatatcactaagaatcactgcttttgctgagtattaagtaatacaatgcatgaaaaatacacaggtctgggatggatatgactaacaatgactgattttcctgaatattacgccatcccccgcatccccacacaccaccccggcatgcacccccctccgcttcctacctcactccgccctcctcacgttcctcctctctcttccttaatccctcccccttatctccgctctcccttcccctctctttcctccctcacctctcccaacgcgtcctccctccccatccgccccgcctccctatccgcggctctccccgcccccttttgccgcgcctccgcaccaccccactccctcgctactccccaccgcatcgcgccat

SEQ ID NO: 5502 - DNA, 634 bp, Homo sapiens
  misc_feature (1)...(634): n = A,T,C or G
atccagatgtaacagaaagcatgggctttgatggtcaaacacatgttggatacaattctggtcccttatataccgtgcaacttcagataagtaatttaaactctctaagtctcggatttactattgttggtatggaaataatattcttctcatacatgaagagttaaagaacgaatgaaattacataacgtcccaacatggcacatgcacataatatcccatcttttctctgtgcaggtctttaccataaacagagcaaaatgtgcagccaaaaaatctgtacttcccttgattcctcaatattaatatttccctatgagtctgtggtactcctgattcatgcttataattgtgctctgctcaaagtaacacaagcaagcagctgaaaagtaatttgaaaataactactttccttctgtcttgccccgaatgttatacaattaccaagatttcaaagagcagcaaatgntagtccttctgtccatcctgtccttcttgntcacttctcaaacactatactatnccagagctccagagatgctctaaattccaccctgattgatgctnaaaacattatccctgtaatntcagtcttttgtccncctgcgtgccttatcangctagacttgcncat

SEQ ID NO: 5503 - DNA, 934 bp, Homo sapiens
atctttctttatttctttctttctttctttctttctttctttcttctttcttttctttctctttctttcttttccttctttctttccttatttcctttctttctttctttcatttcttaaaataattttgtgcactgcttgtgtttgaatactggcttcaccacatactaaattagcctagggcaagttactttacctcttggaattgccatttccctctctataaaattagtttaattaatattagaaaatacctcaaagtgttactatgcagatcaaatggttaaacatatataaaatgatagaataatatgtgttattctgtaccttctcaataaataatagttgttatttaactgcaagcatgttgttaattgtgtctataggcaatatcacctgactgacttattttaaatgtccttggcctcaactcccaaaactgtcacagtatccaggtttatagcttctttgagattaggcttcaggcttgatccaaggtcaaagtgagtatatttgaaaccagtctttttcagctatacctctcatatctaaaatccactatcacagaaaggcaaaaaaaattggcagtcaaatgtaatttctcaagaacatttatagtgtataataattcaaaaattcccttttttattattatcatctgtgaataaaatgaacatctcattatggcattaactcaaaagtccacagtccaaagtctcatctgaggaaatgcaaattccttatgtctataagcctcatgaaggagagctccagctggcatctcaggtgtgcccctctgagacgaagcttccagaggaatgaggaggcagcagtctttgctgttctgctgcctctgctggagaaacccaggcaaacagggtctggagtggacttccagcaaactccagcagccctgagcggggataattagaga

SEQ ID NO: 5504 - DNA, 789 bp, Homo sapiens
  misc_feature (1)...(789): n = A,T,C or G
ctgcccgatcgcactttattatctcagagattctctgtcaggagaccaggtacagcacaatcctactgctattctggatgaagttctcatctgaaaccttgactgacgaagaatctgtttccaagctcatgcgggtgttggcaacgtgcatgtccttgtagactgttaaactaagggcttcagtttcttgctggccactggtctcaggtccttgaacccatgggtctctttttgggtagttcacaacatgttccgcgagtctcttctagcgcgtcctccacacctgtggccgcgggctactaccagagacactccccccccagtccaccccccccccccgccactccaccgactgccaaagaacctctccgcggcaaatgtccacctagctttttctatctccagcttgctcctccgcttccttctctcctccgcccctcctcgtcaccgttttctcgctcggtcttttagccgttctctcgtgatatgtgctgtcgatagtgcagtctgtattgtgcgcattacgattaaatcgattgcatacgctatacgttttcttttatcgcagctcccacgtcgcccacttctccccccccccccccccccctttcccccgcattctccccccccctcccccccccccctccccctgccccacccccaccccccccccctttccactccccctccagccctacccctccccctctcatctccacccccctcttgacgcaccacncccgcccccccccgccgccaccccctatgaccgatcatccaagagtggta

SEQ ID NO: 5505 - DNA, 782 bp, Homo sapiens
  misc_feature (1)...(782): n = A,T,C or G
ctgccgatcacctctttattatagataagatagacacaaatgaaatatagtaaataatttccagttgccataaaaacaaaaacaaaagaaaacaagcgtggaggaaaaaaggtcattgtacacaaatatacttcatgtatacaaacaacttcattcaagtataattttaatttgaaagacctagatacagtattatttaagtgataatggcccataagatttattcaaattcactataaaataataaatggagtaaacaaatgtggtataattataaactgtgcccagtgctcgaaaccttggaggaacccatgctataatcaccatgctccccaacagcaactgaacatgaaaaaaacactaaatcacagctagtacttctaacttccatttcgtatttatagaccatacacaataacctctctctcacgctccagacacgctaccaagccaacgagatagatcagtataaggtaagaatctcttgagatgccagatagtgctncggcagagggagagtctatcttattcctgttcatagatatcatagtatcctactttggtcctcttaaaaccatggagtaacgaatccctcaccctcacttacattcctaaacatccacctgcgtctacagagcagacgcacttgacattacctcagtgaagcgctagtcgccgttcttgttgcagatatccaagtaagatgtcggccaaaaggacacaaaacaatccctccacaagattaaacaaccacaaaaagtgtataccatccaacgaaagcg

SEQ ID NO: 5506 - DNA, 1375 bp, Homo sapiens
  misc_feature (1)...(1375): n = A,T,C or G
aaaaaaggaagaaagaaagaagaagagagaagaaaaaaaaaatttaagaaaaaaacaaaacttggccgcatctagttctattatctgggacacgtatataccgtcatgtaaccaccatctcaattaagatacaggatacttccatcacaacaaaaatttcccttgtggtcttttgtagccaactgtttccctccatacccaacctcataaaaccccggggcaattttggctcttggggaaatgggggttttccaacctattataataaaggggttcccccaaaaggggaccttttggggcgggggtttttttttttaaaaccttggggagaaaagttttattgtggggggggggcccttggaaggggtttttcctattttaaaggaaaagggggggggggcacctcgcgggggaaagggccccctttttttntccccaaacagaatgtcattagaagaaagaacttcacagccttaaaaagagaacccttanaaataacaaattgatttcattatctatggctgtgtagtatcccctggtgtggagagatcgcattttctatatcanaggatctgttgaggagtacttaggatggatccatgactatgctattgtgaatagtgctgtgataaacacatgcattcaggtgacttttttacataaagatttcttttcctttagatagatcctctggcagggggattgctgggttccatagtagttctatttttgtttttttgagaaatctccatgctggttttcatagaggttgtattaatttacattcctaccagcagtgtataagcatttgcttttctctgcatctttgccaacatctgttgttttttgacttaataatagcccttcttactggtataacagggtatctcgttgtggttttaatgtgtatttctctgacaattagtgatgttgagcactttttcatgtttgttggctacttgtttgtcttcttttgagaaaagtctgttcatgtcaaactgagtctgatgttctgatttcacaaaatgaagaaatggatgtccagggagaaaaagtaactttacacattgccattaaatctttattagttggttgaaatattcacaagtatagaaaacaaggctccttgaggagcaaagaactgggtacaaaagagtagtagccatggtgaccagaaaccttggaatcatttttcacagttcagcttcccagtcctctacgtaagccccactaggcactatttttcttaccattatttaccagtggggaaacagagatgacttttctcagggttacttgtggattgttgttgtcgagagcaaattggagacttctaacatctggtccagcactttgccaccacttcacttttgtt

SEQ ID NO: 5507 - DNA, 1742 bp, Homo sapiens
  misc_feature (1)...(1742): n = A,T,C or G
atagctgcagtggctctcttaaacttctaaagatgtgaagactgtagtgttttgttccaacaggcatgtcctgttcaggccccaggaaagggccacacttttgtgaagagtccctatctttcatatggaggaaaacggcactggaatagaaaataaacttgacaaacaggcccttacagagactactgtgacctgctccgtgcaacacaattagagggtcattgataatcggaacctatcaagaagaggacgctgaaagaatactgtattatgttgaatgaggaattgaagggaaggaaggcatttagcagactggaaaaaaacagcaagaggaccctaaacctgtctgaatttgcaagggtttaatattaaaaaggtgacggtacttattttatgtgactatatattgtatgcccccaccccccccaaaagcagaaataagacaaacgggtagaagctttaggatggcagattcacagcagtttaatacgagaaagaacttctaacagaactggttggaaagggaacaggttgtttttttgtgtattaatggtggaaatcacagggaattttcaaaatggatgacctttgtggtaatggtggagtttgaattcagtaagggttgaattagatgactttcaagatccttccatttctaaaagttatgattctgtgacccagaaagcctaatagttctccgacaccagaaagcatgaaagctggaaaccagattaaaaaaagagcagtcagccaaacagtcagaaggtaggtcaggtgtacagtaacaaatttaagatctgattatctttcagtctacctatcatcatttaactctggtagaccatgaagtacaacactctcagtgacttaccacatccataggtgctctgacttattacagatgaagatatccattatgcataattagcttgtttatgtgactcaaatctgaagctaaagattattctggacatgatttcctggatagatggccggctaagttgtgtttgatataggaggatcacttaattaactaggcaccacaggtattttagtatattatcacttccctaggtaggcaagttctaaatcacccttttctcctatatgaggacacatggagctactgttttctgttccccgtgttactctttaatctctgtcagtgttgtacttntgaacttccactttgtaacactgcactccactaaacactatatgtagcaagcattctatacgtttgtagaagattttagtaaatatgtactttcaaatgccatataacacatctgcaacttgttttgcaaactgggggtctgaagtctttggacaagtctgcacaaaaaaaggggnnaaaaaaacccggggccaccaattaaaaaaaggtggctttttttttttttatatattctttaagggggcgcgagaaaggggtgggaaaaaaaggggttaacaaaaaaaatgttacaaaaggtttccccaataatctgggggcgccctccccggaaaaaggaagggtgggtccccacacggcgcccaaggacgcacgttaattattttttggttatacttaaaaaaaaaaaatggttttggccagcgtgattctcagggtgactttgttctaaatgctaatatcttattctaaatatcatcaattgtcaaatatcttgaaaataaaattctgcaaaaaaagtacacacttcagaatttctgaataaaaaatatcaaaccccgatcgcgcg

SEQ ID NO: 5508 - DNA, 774 bp, Homo sapiens
tggccagatcatgtgtttattaattttagagtaagaggaaaataactaaaaagtaacaaatataaaaatgaaatgtatgttttcataaataaccaacctattacagtatcgcaataaaaggcatcccctgcaaaggtggctatacctgcacttagtaagactgtcacttactgtgtgatcttcagtaagttaatactcttcctgatctaaacagtgaaggtaactaataactggttttcccatgaagttatgagagaatcaaaatcagagtccaaaatacaactagaaatagttggctaaactattttagagaccatatgaacattaggtatttaatgtgaccttagttagatcacgtaatctttctggatctgttttctcatttgtaaaatgaacctcatatagctcatttataaaatggacctcatctaattgatttataaagtgaacctcatctacctcatctgacaacttttagtattaaaagatgaaatgattcaaattgaagtgtatgaaaatacttactttttcaaagaaatgtctaaagacgatgtaattgttggacaataccatttccacactgggcaaaatctcatggttcacttggcttacgctgccacccatcattctctagcatagcacacaggccaggcacccacacgcctccattcacacccacacttcactcattcgcatactggcccaccacctctctcctacctcacctattgtagatcgtgcggtgttcacaaagtagcaaaatacactcgcttt

SEQ ID NO: 5509 - DNA, 737 bp, Homo sapiens
tttgtgggtgtgtattttggttgcgtcgtcgtattagtatgggagagctttttgttagtcgataagttgtcggctcgagggcatatttgtttaaagattttgtcgtcctgtatcgatgttaatgaagttagtagatggaggtgaatggtgttgttatttgggtgaggttttagtgtgtatcgtggggggttgtttgttgtgttttgatattgtcatatatttagatctagcggttgttggacgagttagttttgctatagtggtttgtgtttgttgatgtattgctgtaggtttgaggttgttttgcatgttaggttcttctgtcttgaagtttggatcctcttagtggggcggcgatgtaggaaagtgttgtaacattcgtttaaatattaacgttgggtcagtgatacacgttagtttggtatatcagtggtaagcggtgatagtagtagaggttaagttttaaagattgctggttaatgttttagtgtatcagcattgctggtttgctatgaacataatggtttacaggtttagtaccttgaaaaatgagtggattcatatagtgtggatctttcttcagatttcttgagtcctagtgtagaaaacagccatctgcaatccagagagtaagtcctcataaggaactgaatcaaacttcaccttgattttgggcttcccagcctttgcttctgtgagaaataaaagtgtctttatgccaaaaaaaaaaaaaaaaa

SEQ ID NO: 5510 - DNA, 753 bp, Homo sapiens
  misc_feature (1)...(753): n = A,T,C or G
cttgggggtgctctcatgcacaagttatcatgcggaaagaatcttcctagctttccctcccacgagaattatgtccacttgacttggcacagaacagacctgaagtaaaaccctgacatggccctaacacctttgaaatttagaagctttaagatatactaacctgagttactaaagatcctaaagaaatttagctcaattgagccctattgatagatgtaataattgttggctcttctaaacattgagccattatttctagaaagttattttgaactttgcaatttttttttgttaaatgatttatagaggtcaacttaattaacctctagactggcttcattgatgtacacaatctttagtccaggagaacttaaatgtgaataccattatagataagtggcttaaaaattcttctaccatgttactggtacaaaaacagacacatagaccaatagaacagaatagagatatcagaaataagacctcacatctacaaccatctgatcttcaacaaacttgacgaaaacaagcaatggggaaaggattccctatttactaaatggtgacgggaaaactggctagctatatgcagaagatcaaaactggaccccttccttacaccttttacagaaattaactcaagatgaattaaagacttanatagtaaatccaagactataaaaatcctagaagaggatttagacaataccattcaggacataggcacgggcaaagatttcaacagaaaac

SEQ ID NO: 5511 - DNA, 771 bp, Homo sapiens
atgggggaagcttactgccatgaagaggcacacatgatgaggaacagaggcctccaaccaacagccagtgaggaattgacatctgctaacaagaagaaacttgttttaagtggtacccgattctttttttttggtttttttttctccctgatatgggtttcactcttgttgcccaggctatagtggtgtgatctcggctcactgcaacctacacctcccggattcgagcgattctcctgcctcagcctcccgagtatctgggattacaggcatgcgccaccatgcttggctgtttttctgttttgttttgtttttatagtagagacagggtttcaccatgttggtcaggatggtttcgaactcctgacctcaggtgatccacccgcctcagcctctcaaagtgctgggattataggcgtgagcctccatacccggccagtgctacctaatttcttatggtcgcttatagtaaaatgtgggagaagaaaaatcagctagagagactatgcaacttgaagaaaccaggacttgatggttttgaaaattctcagacattccaaacagcaaacaattctaaaattaagagatgggtcctcagcaaagagcatatgcaggatggtgccaggaaaactagtctaaagatgatggcaagaatgcgactaaaactatttcataacacctcagaaggatctatggggggcacctcagcattcctttcagtcagactagagatccactaagatatccattgtgtgtcctatagatcctcta

SEQ ID NO: 5512 - DNA, 768 bp, Homo sapiens
ccttaggctatttcctgtgccaaggaattccagcctgagtgtggaaagactacaaaaatgatgtcagacaaaaagcaaataaagcatattcaaaagattttcttatttgagtgcaaaatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacaacgaccaactaagaccaatcatggaagctgatcctcttacaactacacaagaagttgccgaagaactcaatgtcgaccattctacagttgtttgggattcgaagcaaattggaaaggtgaaaaaactcaattaagtgcatgcctcatgagctgagtgaaaattataaaaatcgcaagtttcgaagagtgatcttctcttattttacacaacaataaacaaccatttcttgatcggattgtgacatgtgacgaaaagtggattttatacagcaactggtgacgaccatctgactggctggaccaagatgaagtaagataggacttccccaagccagacttgtcccaaataaagagatggtaactgtttggtggtctactgtcggaatcaaccattacagcttcttgaattccggcagaaccattgtatctagatagtatgaccacgaatagatgcgagccactgcgttcgggaggactggacaataggaacgg

SEQ ID NO: 5513 - DNA, 365 bp, Homo sapiens
tttgccaatttaattcagcttgtgtttactgagtctgttttcactacagaggagtaagtcaggggaccattaacttggctgtccatgtgtccatccggaaggcccctcaggatagatgagacctgggcctatatcccagcccagacctcagggcagggcagataaattggggtcctttccagtccatatttgcacccctggggacaaggcacctggatgttgggccaagtttaaagttgtggttttagtcaagggtgacttctgttctgatgggaaatagcatcttgagttgacctctcttgtgatactttcattttgcagatctctttttacttctttggctcctccactggactgtaagctcc

SEQ ID NO: 5514 - DNA, 654 bp, Homo sapiens
atgtctcctcagcatcggatgaatctgcagacagaatgcacttggctctggcagaattccagctgggaaaaagaaacaaggtcttgctatatttcccaggctggtcttgaacttctggcctcaagtgatcgtcctacctcagcctcccaaagtgctgggattacagttgtgagccattacacccagccagctaattttaattttatacagactttcaataactctgtcttcacttctgcattagatgaattgggagttttatagttaaaacctgggaaaaaattgataattaataaggctgtgtacaaaagtactgactaaatttatgatttattttaccaaatatatttgtatacttgtatatctatatgtgtgtgtatatctgtattttatgtcatataaaatgttatcttgcataattatatgcaagatagcctcagacctgtaaacatatacaggtagaaaagaaatgagaagcttttatggactgattaatgcaaatatatggaatgccaggaaaatagtagtgactgatagcagttacagtagccttcaatggtagctggatatttcaatgaagcaataaaatgtgcataaaaataaaaaaaaaaaaatcggcctcgtggcaacagcggtgtagggtctctgctcagg

SEQ ID NO: 5515 - DNA, 553 bp, Homo sapiens
gagctccccgctgaggccacgaggccattttttttttttttttttggtttgctccctggaaggagataaaatagttaattaaagttttattgcttttgaaacattctccaatttaagaaaaggtttgagatttgttatatatggtgcttacatggaacacatgaaacctttatgagacttttttccctgtttgatagggaatgaaactttggttgaatttccagtgggatggggtgagtctggagataagctttatggtttctcctgctggtgtctccagatagcaaacacagcagcggcttccagtaggggctgatgggtgtgccataagtcatacaatgcaggcagactcattttccatatcagacaggtgctgtacagactaaggaatgtggggtcaaactccgaagtcagaggactgtcgtcaagtctctttttcagtagtaggtatatgacattggttaaatctgacactctgctttttcatcatgacaatggaataatgatttttctgtagctaaaatccagtcttctataattcgtagccatgtta

SEQ ID NO: 5516 - DNA, 758 bp, Homo sapiens
  misc_feature (1)...(758): n = A,T,C or G
ctccaccgctgaggccaacgaggccatttttttttttttttttgttttagaactagttattttattaaatgatattaatacatatttcaaagagatttcattgttgttgcttccaaagcatgtacttgttttgttttccacattgaacccatgagaatatgacttcaacatatctaattttgattttaacaggcatccctgcccatttttgaaaagagggaggaaagtgaggtggcgagggaggcaggggcgggaagtagtaatttacgatgccttaaaacaacaccagccggcagctcttagtgcatcaactgcctcctcatgcaatgactagcgcgtagtagttgcaaatcctgcttacgtgcctgtccatcgctcccgccccccaccccccgggtacgccccaccccaccccctctccccttccaatacttccctccgccccccgctcctatcgtctcatatcatgttgtactgtatcacatttactctaatatatccctagccccaacccacagtcttctcggcccagcccccatcccccattcgtcacgcccccgtccggtagccaacccgcgtccccacaatctataaccatgttctaggccccaccacacccttaaccccccccctacgatcatccccccccccccactaccctccctcatctatctccccacattacctcatacccgcgcganacggagctccggtacagtctcaagataccacacatcggtccgcccactcccagcccc

SEQ ID NO: 5517 - DNA, 643 bp, Homo sapiens
gggtaccactttctcactcggctgcccaagcaagattctatggcttggaataattctcagcgactcactcatcaaaggacatctatctagaagccctgctccttcagggacatctgaggttgatgagctgatccaataagccatcagagctggaatagtagtagttaacaatggctctctgcactctttttaaataactttgcttttcaggccaaggtgagagcctcgtgggaatttcacaaattttatagaagcagaggagtgctatttgagcaaggggcggataacacctacaatccactcaggatttccaagcatagccggatgcagaagtactcatacttcactacagaatcacctggggagcttttaaccttctgattctagtgtttccctctggcagatggagacagaaacttgactgggctcaggaatatgtgtttttaaaattctccagaagattttaatgcagtacaagtaagaagacaggactgcaattcacaagaacagtatatcctggtgattcctcagaacagaacagactcaaaaaaaaaaaaaaaaatgtcctcgttgtcctcagcgggtagttttcgccgggggcagtttttccacccttcctccttttccccccttctcccacccc

SEQ ID NO: 5518 - DNA, 788 bp, Homo sapiens
  misc_feature (1)...(788): n = A,T,C or G
ctagggtatcggaattacaggcttgagccaccgtacccagccggtatttttttattctggagactatctgcctgatgggaaattgtcaacattacctgagtttcctgcaaatgcatcagaaatatgttggattattagaacatnagcaggaactagacaagngaaaaataanggtgtgattgtagagaagaagaagtattgtgttgctaggggtacgggtcgggatatgatggcgggggcgccctgaatcatcaccccccgcctccctcctccccccttcccaccaccccaccgccgccgcgcgggaatttcctcaggtcggcgcctctgtgtctgccagctctatgttctgtcctgacgatccgacttagctgtcctaccccaccttcacctgcctgctagtgctcgcttcttgtagtttatgttgtgtcgttgcatttgttgccctggcggggcgacgtcgcggtatccagagcccgccctctctccgcctagcactgggggtgtgcgggcgtccgccgtcgcccgccgtcgcgttcccccacccgcgggccccccccgtcccctccggtcccgcccctcacgcctctctcggtccctcggcaccgcccccgcccgccggctctttgctcttctaagttacctgctgattcgccgcggtttctcggtgtcccagcggtttacggaagccacgcgcgggtgaggatgcacccggtgcttatgagagcaggacatacgaatgtttagaggccggggggcgcagacgtggcgtcacgtttcggccatgt

SEQ ID NO: 5519 - DNA, 521 bp, Homo sapiens
ctgacaagtacacacgcatggattgctatgtagaccattcgcaagtaagaatgaaaaccactacatctggtaaagacccatccggccacgtgaaatcagcaaacagtaatttctctctcaccactggaatagttgctataagacggactgcaagagaggactagaagaacatgtgaagaagagtgagaccaccacgctggtcctctacttgatgatgaacggattgtggggaggcaactgagggaatctcccttgatcttttgggaaatatgccctcatcaagactgaaaatcagatgtgtcccagatcaagccagagagactaccataagcacaggcagctgcaccatgccagcacgggtcgcacagagctggcagttgaatgcagactaaagtagactagaaaaaaatatgtacttgaaattgaatttttacatgagactatgttctaaaggttttccactgctgaacaagaataagtgcttgtaaaggaattgagatttatgagcaaaaaaaaaaaaa

SEQ ID NO: 5520 - DNA, 767 bp, Homo sapiens
cctttgtgagtactcgctaccttagttgccatccgtgcctctgtagctggcgtcttgggaagcgccagccttgagggccctctcatctctgtgctgtccatctgcattcagcaggttggcattcagctaatatttatagttcaccacgaaaacactgatattctcatagtgccattaaataacagaatccaaacatgcttcgaagtgtatatgaagtggattattttgccatacttctgactcattatttcctgaaatctgaaagaatataacattataaagctcctggcatatctaggggcagcatgaaaaactcagacagcaaatatgcaaatatcctgagatgtacacatttccagaggcttccagacagggctgtaaactacattacttaaatgctattatacttttaggttccttcacccctgataacatctcagcctgacagaagccccaacccaaagctgctagaatgctaagttttgatccaaaaagacccctggcctcacagttggtctggaatttgaacagagaacttgaaagcagaagtttccctggaaaaccaggatgtacacctgccatgagtcgccttttaagctggaacaatatcatgaaacaagaatggtgaccccttgaacttctagaaaaaagtattttctatatgagatggagaaacattatcttctgttcttatggatgcgagaagcaatctgaccaaaatcttctgtgtctaaaaatacataaatagctacgggggcaatatgtat

SEQ ID NO: 5521 - DNA, 758 bp, Homo sapiens
  misc_feature (1)...(758): n = A,T,C or G
tcgggcatctagaagctcacccttgaaatgaatccattgggaacaatttgaccctcaagccctgaaaaagaagctgcttattttttttctgcactatggcctggccccaatattctctctctgatggaaaaaaaatggccacctcagggaagtataaattacagctttcctgcagcttgaccttttctgtaagagggaaggcaaatggagtgaaataccttatgtccaagctttcctttcattgaaggataatccacaactatgcaaagtttgcaatctacatcccacaggaggacctctcagtttaccttcatatcctagcctccctacagctccccttcctgttagtgataagcctcctctaatctcccccacccagaaggaaacaagcaaagaaatctccaagggaccaaaaaaccccctgggctatcggttatgtccccttcaagctgtagggggaggggaatttggcccaacatggatacatgtccctttctccctctctgacttaaagcagatcaaggtagacctggggaagttttcagatcatcctgatagggatatggatgtcctacagggtctagggcaaaccttcgacctcacttggagaggtgtcatgctattattagatcaaaccctggcctttaatgaaagaatgtggctntagctgcagcccgagactttggagatacctggtattctaagtaaatgacagaatgacagccaaagaagggacaactccctactggtcagcagct

SEQ ID NO: 5522 - DNA, 762 bp, Homo sapiens
tccttttattacattgaaacctccatgagagaagaaatactgtcttccttgttgctatatgtccagctccaagaaaagtgcatggaaatggaagatgctcaatatatataactgtggaaaaaaatgaatgacttccaaatagaaggttttatgtatatttttagtgaaaagcatcaggccacacaaaaagcacatggttttatttgttgaaatttctttgtggtggtggcgtggtctaaattctctgccctcttggaacttcagtcatagcgtctgaaacattttattaaatataggtcacttattaaagtcaggtcagggccttgctcatctgtgcatcctcaacatgtaacaatatattagtcagggtcctgtagagggacagagctaataggatagatgcctatataacggggcatttattaaggagtatcgactcccatgatccccacgagaggccccacactatcctcgccgcctgctgatgcgccaggaaccctctctatattccttcacacatcttgcaccgcagtaaccattccaggattgcccactatatcgacagtcctacgagtccgcccgcgggcgctcttatcttttgatgtctcgcatcttttccattctcttcaccatccacattcttgtcgtgacccatacgcaccccacgagcaactcatcccctcatccgccacccatccacctccagcgcccgtcctcgagtagacgtatcacgcttgcgcctctgcaaccacaaaccaccta

SEQ ID NO: 5523 - DNA, 779 bp, Homo sapiens
  misc_feature (1)...(779): n = A,T,C or G
cctagggatcatcttgtaattctgctattacaatgccagtgggaacagaacagaagcattttcaagattaaattggcaatggttgtgactgattggatgaaggaagtaagggggagagattcatcagagaaagaaggcttctttaagcagcagaattgaggaatgagtcagaaaataaaagagcaaacaggtttttgttgttttatttaattttggtcaacctacttgtattggctttcatagcataaagaaaatattttactttgaacaagcataaaacaaaaacacatctttcatacaatacaatgcaatcgatggcttttccccaatgatttatggaaatagctctaaaggagagagatgattttgttgccaggtctcctcagatatcatcagtatttttaatctctcatgacattgctctacaccctcttgctgctatatttctaaatgccctgaggatgctatttctggctgtttctctaccattataggaccatttcctactctccttgatcatagacctttatgacatgctctctgctttacttgtaccttagttgacatactattctctcaggggctcatgcgttgctcttcaacccatctaattcagctgttgancacaaaacaaaccgtttctttctggggccctttgagcatgacccgcttccccctggggtctcgcctccgcgacttcaggcaatcattcttccgtcttcgccgttccgatgaggagggggggaggtgcctccgtccttttcctgcaattatgatag

SEQ ID NO: 5524 - DNA, 763 bp, Homo sapiens
tagaaacaggtgatgggacaactggaaaacagtcatttccaactgacgtgagtctccagacagctgatcctaccacagggctggctgctttattctggaaatgtcatccttctttagtctgttcattaccattgcctgtgtatggagtcaaagaggaatgatgaagagtgaacttgaggagccatcatgaatagaaatactttttccctatacatatccctaacagagttggaatgaaaaattggttcaaggaagtgtttcatagtgattgctcagtgggtcatctagttcagacattcatgaacagcgttctgtcatcacccacagcatattgaaaggttttgagtgtttcctgcatcacgtttttgttagagaacgctttttgttagaaaacaaaggctcttgctttctttcctgataccccgttcctacctcactcatatcttaattggcttacacttttagagggacttttttccattcccctacaacattccattgctgacagaaaggctgacaaggcagctgacacagcggctattactttgagcaggtcgtagacaatattattgtgcttgcccttctgctttctgtgaaattatacgggcgctttcttttgtgtgcaacagtgcgactcagctcccaccctaggcgtcccgagcagattcattatcaccctctgagctttagtattagtgcaatcatcagctgccgcaatccctcccccccctcccgccagacctcacttgggtaccctagtgcg

SEQ ID NO: 5525 - DNA, 758 bp, Homo sapiens
ctgatgtcgctgttgaagtgttctgatgaacagttggagagtaatgtgtcgtccccacctccttatgaacgcccatcatcatcgagggtgaacgcatcctaatacccgagcagagcagttgtcctctgtgagccaggagccctcggggactgtggttctcttcacagctgcacccctgacttgttgtgtgagcttggtgtgccatttagcctgtttgtgtctttttatctctgctctgaactatacatgtcccccatcaatctagaaaacaattcccaaagaattatgacatctttgtcctcgcagacggttcatgagggtttaggaaacactatgttagcagacgtattctctggccctagttccttgtgtcgttggtactcacaccgctcacatgagtggggattgactctcacggctcctgcgtatgtgtgtgtatgggtgtatttgtgtgtgtatgtgcgcatcgctgccatttctcccctcccccgcgcgttctcctctgggggtggtccctgttctcacgcctcagtgtcgctccccccggcgctggtgcgcccgggttcgcacgttcttactcaggctcccgcgtgttctatgatctcatcttcgttactgtgtggctcgctagctttcagtgcccctgagcggccctcctcgccgccattttcgatccttactctcgcgtttatgagctcgttcgcgccgcgcgtggggcctcacctctgcatcaattgcgccccttttcgcgttgcttc

SEQ ID NO: 5526 - DNA, 726 bp, Homo sapiens
atatgaccaaatacaaaagaaaaggaaccactcctgctctgcaaaatcctgtgaagtcttgtgaagtactaactgcactgtgggcaaggtggcctcaaagagcgaggactggctaggaaactgttctctccttaaggggatgggaaaaatggctacttgccattggaaagagggtgtgtgtgtgagagagagagagagagagagagagagaacgtgtgtgtgcatatgcgcctgtatgtgtgcatgagtgtgtgtgtgtgcgcgcgtgtgtgtgcacatatatgtatgatgacagtagttaccctctggacaactggaagaaaaaggtagcaaagtcactgagctataacccacgtgcaggtggggcctcagaggggactgacttggcgtgcctgtgcccaccctgaaggactccagctgtcaaaagccatcttgctgtatttgcaggccaagcgtactgagccagagagagtacatcacacttggggacacatacgctggatttgacagttgagggctataggaaaggacctcctcttggagcaccatcgtggccctgggaacacggcgagagctggccacatggcgtcgccttctcgggcccagctcgcggaactcgtgaaccaccggagactcagaaccatctcgctttcaccctgccccgtatcgcctgcagacgctcggtccccgctcacccttccgcccgtagaaactaacgccatgggg

SEQ ID NO: 5527 - DNA, 751 bp, Homo sapiens
gtagtccttgttggtgatcacgtagctggtgtctatggctgcatctgacatgatggggcatgccggtgatctgatacaggggattaaaaaggaatcgagaattcgaggactctggtgataaagctgctggagtccacggaggaggaaccaaggagccagacgaggaacaatgcaaagatggcttttcagagcagccagtgggggctgttttcatttcaacagtgttcagaggagtagattccatctcaggaaaccctcttggtgcatgcataagaagcaacttctaatctgtagaagtttgatcatgagattgcagcaactcagccacatcttcaggctccacctctaattctgcttctcttgctgtttgcaccacatctgtggtgacttcttctactgaagtcttaagtccctcaaagtcatccaccaaggttggaatcaagcttcttccaaactcgtgttatggtgctattttgacctctgcccatgattcatgaatggtgcttatgcactcttacatgatggaccctttccagaaggttctgaacttactttgcctaaatgcatcaggagaactcactaaggttcccggctatgtgcttagcaaggggacggcttggcgtaaaagagacacgatccggccctgcggggcgctgcgcgagccgctcctcagtcgcttactttactcggggtgcgcgtaacctcccgttgactgaccgattggcgtccgcgccggttgtctcgccttgtt

SEQ ID NO: 5528 - DNA, 429 bp, Homo sapiens
tcgctctgttgccatgctggagtgcagtggcgcaatctcggctcactgcaacctctgcctcctgggttcaagcaattctcctgtctcagcctcccgagtacctgggactacagaggaagaaatcattagagatgcagctgcttacatgcaagagcatgtgcacgaagcctggatacacagatgcatgtgtgcgagagaaggtgtacgggattagagagctctgaatggcctcataatagaatcccaggggagggccggaggtcccaggccagcgatgctcacacgcccatctcctcctgtctgtgccgcacaaagcctgacaaggcctcactcatgtttcaaagcgctttctcttttcagagctatttgttattgtctctgccatcacaagtttaaaaaaggaaagttaattaaatatggaacaagaaa

SEQ ID NO: 5529 - DNA, 475 bp, Homo sapiens
ccttaaacgtgacccttcaccagatggtaaaccagaccactatcatgtagccctaagataagaaggaactgaggactgaacactgacagaagctctttttctaaatttcttcctgcagggcctggcgaatcatgcctacaggccaggcgaaaccttaacattcctttcttctaaccccaagtttttacacaaagccttccttccttaacaaattgcaaatcatagagtctctgaatccacctataacctgtaagctcccacttcaagatatcccacctttttgggagaaaccaatgtataccctctatgtattaatttataattttgcctctaacttctgcttccctgaaatgtacccctgcctttcaaaacctttgcttgtaagacatcagggagtttgggtattaagcattagctttccaatttttcttgcttgttgtcttgcaataaatacctcactttctctgactgcaaa

SEQ ID NO: 5530 - DNA, 616 bp, Homo sapiens
ctggattttaaacctgggagtttctaagagataatctggttcatgcctcttgttttaaagaagagaaaacagaggcaccaatgggtcaactgaataacacaagatcacaaaaagagataccaagtatggacaacagaatgcttgtttcttgattcttccaacttgaagattcatcactatacccacagcctccagtaaaaagaaataattcaacaatttgtcctaccatatttctgtttttaaaaatcaacttatgaacaaaaaggctgactgtcagtattctccttttatgaacttttgagtgaagtcatcctttctctttaggccagtctagaagtagccactcacaaagaatctgttgaaaactatttttaaaatcaataacatttaatctacttgaaaaggccagaccaatcaaaacgtcagaacaaagtcttgattagggagttagtaactttttacagaaaagagaaagtgaagacctaatttgccacgatgtgacttatgcactgggaaaatttggaatttctggctggggtttctaaaagagagtctttggaataaaagcttgaaaaattttctgctaagaaaaaaaaaccgacctcgatggcctcaa

SEQ ID NO: 5531 - DNA, 790 bp, Homo sapiens
atgggcttggagtttcacttcttggtcgtccaggcttggagcacaacggcatgatctcggctcagtgcaacctccatctcccgagttaaagcgattctcctgcctcagccaccagagtggctgagattacaagcacctgccaccaccccctagtagagacagggttccaccatgttgaccaggctggtcttgagctcctgacctcaggtgatccctcccaaagtgctgagattacaggcgtgatccaccacacctggccagagagtgagctttacagcaagatagatgtagtattagaaaagtaatttaacttctcttaggggtaggttttgtctctgtaaatgttgatgataataattcacttccagggtcatataaaacttacaaataatgtctgaaaagagtttgtctccatgcctgacagaatgtcttcagtaaagagtaattattattatgaaaagcaagaaactattaatagcattcttgaaaataatctattgttaatgaagttatacatgcatatagtttaaatggtcaaattaggctgtcggtcttggtatgatagcaccattccttatgttatgcctactttccactccacaggcaatgaaaaactgtgtccaaattagttggagtccctaacactagcatgggggcgggagctcttgggttctgggaatgcataacctgtaagtgaggcgggtggcgtagtgtgaggagtgtagcggcgagacagagggcgcagaagattaacgggacaattggttattggcggagcaaggggacgggt

SEQ ID NO: 5532 - DNA, 770 bp, Homo sapiens
ctgattgagacaagttcagagaggtagatggtaaactggttgagcgaacgcagtgttcttgttccctgctgtatccccaacatccagcctatgggacatctcaacagattttgaacgaaggacgggaggacagaaggaatgccgcctgtagcatcttaccatatgggcacagttggctctccatctcaaacctctcttctgattttcaggtcaatatggccaaacggctgttgttcatcctcactcaggcacctcaaaccccatgaattcaaatttcaccttatgttcttccatcagctgacttttttcctggagaagggcgctgacatccatcctgtagcggcagctacaaatgtgacgaatgtcgctgttgttaatccgccgcacgcgctcatactcttaactgacggcacgttatagggggtgttcaactgttgtgtttaagcacttgggagaggcgtagcttcgcggcgctcttcccgtccccgcacccgctccaagaaacgcgaacgaaaaaccaagatcgacctcggacccaccacccaatcccaatatcctcccatcattgtccttcgacgcatcccatcgtcagtcggattatcacgtattctccaaatctatcttatcttcactcccagttcttcatttcgcgctcgccgtccggatcaatgaatacagactgcatacgatccccagacattctttttcgaactccttcaacaccccccacacgtttcccaaataaccgaacattccgcccacggtaccac

SEQ ID NO: 5533 - DNA, 551 bp, Homo sapiens
tttctaaagtacaacaatgcttccttctatagaaatcacagttttctaaatattgaactggtctttgatcagtgccagttttattgctttcacgtttacttttacaaaagaagttattttagaagcaaaatatttgtgattgattttctttattttgacttctgaggggaaaatgttgtttggaatagtttcctgagatacaccttcaataaaaataagcattccagtcctgtatggaacatattccatttggatagtttctcagttatcaagagtctttataaatggtcagttccctcctgctaggaagtagaagggatttattattttaaattggagacatttaaatttttaaattaattcatcatttttatttggcagagctaaaaaccggctgtacatagagattccagtaaaatttcaatattcttcagctgccaaattccttaagaaaatatacttaaaaccaaatacttgctagagctagtagaagtcaaaaggcagaccctgtggaatatccaggcgtctcaatagttttcggcttaagccat

SEQ ID NO: 5534 - DNA, 376 bp, Homo sapiens
tccaagggcactgctaatgtttcagcaaataaaacacaaacgaatttggcgcaagtgggaggctttctttcttaacggaacctattttatagagagactcttttcctgggcaaagagatatgacatttggggtgtgagacctatcttcagttgtggcttgctgtttctcaagaagaaaatgaaactatgagtgctcagttcccaaacattcaatatttaagaagtagcattgtacaaaaagacactaatcattaaaaagaaattccttggattttaagtttgagaaattatttgcttgtatttgacattattacatttttttcttacaagtctttctaataaaaagttatattctcaatgacacactctaaaaaag

SEQ ID NO: 5535 - DNA, 779 bp, Homo sapiens
aggacaccgtgtttgcggaaacgacagaaggaagagaagtcactggaatctgaaaaacaggatggaaagaataaaagctgtgctaaggagctttcagcaaacatcaggaaatgtggtatctgccactaaattaacctcactttcatgaatgcccctgccacagagggattgactgaagcccaatagacccaaagaaggactcagactcaccagcttgggccatgtttccaccactaactgaagtaactgtggctactagaacatgtagcctgtgctcttagccatagtgcttcagataagcacaataatattagtgatctatcacttacttctatactatgtgccaggtacaattgtaagtaatgtgcatacgtagtatggacttaatctcaccacagccctataaggtcagtattattatgatgacattcatctcatacatgagaaaattgtagcacaaagagtccaagcaagttgctcaatgttttagcaacttgcataactagcaagcgggacagcagaattgcaaactcaggcaatctctgactttgaggtgcatgcgaaagcccaagcgcgaaggggggtttttgcgaccttactatgctatactgtggggttattatatacaggcacttacgtacgccgaaagaattacttcgtggtgcggggaggggtgggggggtgcctcacaccgcacgcgccttgtccccgcattgcccgcacttgcacgccatcaatgccctcaccatcgttcgccatgaaccgcgtggaccgcccgt

SEQ ID NO: 5536 - DNA, 325 bp, Homo sapiens
ctggtaaagcgtaacaaacaactaagggctgggtgccgtggctcccgcctgtaatctcagcactttgggaggccaaggtgggaggattccttgagcccaggaattcaagaccagcctgatcaacatagtgagatcccatctctgcaaaacaacaacaacaaaggaagccttatgcagttatgagtggatcacccagaatatgttatcctctgcatccatttcagagcaacacacagaaacatcaatggcttagaacagcctgcagggctgcgtcaaccatcaacttcaataaaaccccaaggttcgcctcaaaaaaaaaaaaaaa

SEQ ID NO: 5537 - DNA, 161 bp, Homo sapiens
ctagaaacctacgaaaccagctttataaatgtacagcgaagaagcaaactgaaatgttgaactttgtactgaagatgcttttgatatccaagttatgtcctgggtgcaggaaacagtgctatctataattaaagaaatgatgtccatcaaaaaaaaaaaaa

SEQ ID NO: 5538 - DNA, 781 bp, Homo sapiens
ctagcctgtgagctcttgacccaggggctgtattttattaaccactgtggtttgatgcataggataattctggcacataacagctctgtctgttaagaggctgtagaagcaatgatacctcagtaatgataaacacacccagcacccagttcttgctttctacataacattctccactaaaaggaatctgagctgggacaagggacatacaagataagcctggatcatcttgtgttaaaaagtagaggagcactcaagaaataatggagacatgttaaaaggccacaggagccggcttgaagaactcccaccggtcaactctgaaacaatttgagcatgaaagcaaacgctagtattaagagttataatttattgaataaagtgagcacccatgagtccacacttaaatgaacaaacaaacaaacaaacaaattagaagggaaagatcttccttacagtagaaagccaaattataaatgaagaaagaataatggaaatatgacaatcactatttggtggccattgtaataataattgattctggcaggaatcattaatggatgctaaagccagtgagtgaaagtttgagtagtaagaagacatttacggagtcacaaagtatctctctagaaagcatttactaattacaaagggaaaagcagtaactttacagttactgacagttaccaactaagccaaatgatcaaagttaacattatcagtaatggagctaattgatagcatgtgcctcctgatatgaggcactaagaaggactctgca

SEQ ID NO: 5539 - DNA, 793 bp, Homo sapiens
atgctgtttcctgtttcctgtttcctacgaacacttgttgcatttggagtaggaacgacagcccagtcagagtgaagagaccatgtctgttcccacctccaaccaactacctgtgtggacttcagcaagtcacttcacctatgaacctttatcaaaaggatagaactgaatttcctctgaagttcttccgaaactcaaaattcttaaagaagaaataaactttatgtaaatgtccactgaaaaacttttatgtaaatgtccactgaagaacttgattcacctgcagctacctaaatataatgtttcattaatgaatcacacatttcaaaatggaaagaaaaaaattcactgagagtgttttttaaatctattggatgtttaaacccagtgctgattttccagtaaacatccacactcatttgcccacaagactgaactttctcaggtgtccggtgctatgcgtggtttgcccaaagttaccaacagctgcaaagtgttctttcccgtagctttccactcagtgcatatttatcacttcctgtccgcttctgaaaataaaatgtggagttgctaaaagtttcttatgggggatatttaaccagctattaagccaaataaactttatgacaaaataaatgttagaaagtaggaacaaatgatttttttagaacctaactaaatattcaaatattggagcggatgatttatccacaccatgggatctcatataaaccctagaaacctggagattatatttcagtaatgttttaataataaataaatttgactctga

SEQ ID NO: 5540 - DNA, 739 bp, Homo sapiens
tgttaacaacatgtcagtcctttgacagtcacacatgacaactggatttatacctctatggatacttttggacttgcaacagtgtcaaagaaatgcctaggaaaagaaagaatcaaaatccttatgaaacactacaagaaggaaagagaaaatgcagtagaaaccctacccaaaccattcacaaagttgaagaaaatgaaaacacttaatcaatatttaaaatagttaaatgagcatttagacttttcaaaaaatctaatacacagaatttaaaaactctgatatgaaatacatgaaacagtaagaaatactatgagaactaattaaactaaggaagacaaaaaaaaagtcataaatgaagaataaactatgaggtacccaaaataaatatgtttaaaaaagcataacataattttgcaccacactacacaaataaactttaaaacataggttatgtgtattacttcataggaggaaacagttgacaaaaactgacttcaatggagatgaacagtttaagtacataaatttacacagaaaactaagaaaatgtataaaggaacaccctactcaataattaaaaacagaggcggatttgggtgcatatatacacaaagcctcaaattgttttacattccataaagccaaaattttacagacaagaaggtgttattagtacataaattgcggtagagaacagaaaatgaaagaaacttcacatgatattaacggccgctaa

SEQ ID NO: 5541 - DNA, 804 bp, Homo sapiens
atttactggaggagtgagggaagaaaagttcatgtctccagagtgataagaaaactgtaaacatttctttttattggagcatggccaacagttttattttcctagaaattctaaggcctgaggaatcaaaattgatttggctaggaaactctggtgggtatgtgggttttacccaaaatgtaaaggatgtggattctgcctttgatgtgccctcactctcctcctcccttcaaatgtggacaattatgacgtcagcaactgggccacaaatacttccgcagagacaggctctatcagttactctgaccaggaatccacagtccaagatggtgagctagcattctatcagaaaggccgcactcaggcatttcttaccgcacaccttggggcttcttgattagcatcctgaaagcacaacagagttttattgagacacaacggctgctgctgtatgatcatgctctaatgactctgcagttgatgtatatttcagaccgttgattgcctacactttttcgcatccttaaactcccttcctgtacaaagaggacgatgtctaacatcacaaatgcctcctggctcatggggagtctgggcgctcctttaggaggtgattacagcccctcagattccgtgctgctgtcgtaggcgagcggtcattctcttggggttatcattattaacggctactctatactggtcccgtccatcgcacccttatacttttggttcccattctctctcctcacctcccgctccgtccattaccatattcgtcgccgccgctgtctgcttgtcaagttg

SEQ ID NO: 5542 - DNA, 337 bp, Homo sapiens
ttcattttacttgcctgccatgcagaatgaagatgtagaagaacttcagtatggctaaagtggtggcatttccagctgggtaaaactaggaagggatttcagagtggttgcaggaggactagggagtgaatgtggaaccaataggaaatgagcaccaggctcccagaaaaatgtagtgaagctgctgccattctacatttgccccggatggaactccgtgataccacctcgcttcacgatatttcacattgcctgatggaacccaaagaaaccagctttatttctgtgccatttctcagtgattaaacttcaaacttcaaaaccaaaaaaaaaaaaa

SEQ ID NO: 5543 - DNA, 296 bp, Homo sapiens
gttaggacaagcatctgaattggtgaaataaaaccaccgcgtctagaactatgaagtgttggacctggtaaaacgtagtgcctcaaactccttatctgtaacttgagggatgttcctaaggttctttaaagctctaaaacaatttatggtttcctattgttccctatatatttgtggttctttgttatctcagggactttctccacgctagttcctttaaattttgtaagtctccaaaactgcctggttcctttctgatgcaacaataaatacttatatctgcaaaaaaaaaaaaa

SEQ ID NO: 5544 - DNA, 503 bp, Homo sapiens
  misc_feature (1)...(503): n = A,T,C or G
cactttggagnatttcgctcttgttgcccagctggnagtggatggcacaatcttggcgcactgcaacctccacctcccaggttcaagtgattctcctgcctcaccttccagtagctggaattacaggatggagggatttgcaagttgatggcagatggaaggcattattgaggcagaaatggatgaaaatcaaacctgctcttgatatacacagctgatctgggcactgagtgaagtcttatttcctgtctatgaaagcagacacttgaaccaatcactcctttcttcatacaatgtgtgtgcacggaatcaaatttgctgaaatctggaatttgggacttaagttctgattcttttttaatgtaaatggaatgaaggcatttgaagattgatgcaagaatatacatgtaggaataattgcctaagtggccacatttgatttaacatagacaaaaccttctgctttgtattatattaaaacatttaccacaaaaaaaaaaaaa

SEQ ID NO: 5545 - DNA, 566 bp, Homo sapiens
tttccagtagggatttcgctcttgttgcccagctggggtgggaatggcacaatcttggcgcactgcaacctccacctcccaggttcaagtgattctcctgcctcaaccttccaagtagctggaattacaggcatgtgccactacacccaggatggagggatttgcaagttgatggcagatggaaggcattattgaggcagaaatggatgaaaatcaaacctgctcttgatatacacagctgatctgggcactgagtgaagtcttatttcctgtctatgaaagcagacacttgaaccaatcactcctttcttcatacaatgtgtgtgcacagaatcaaatttgctgaaatctggaatttgggacttaagttctgattctttttttaatgtaaatggaatgaaggcatttgaagattgatgcaagaatatacatgtaggaataattgcctaagtggccacatttgatttaacatagacaaaaccttctgctttgtattatattaaaacatttaccacacattgcctcaaggattaaaaataatataactccaaaaaaaaaaaaaaaaa

SEQ ID NO: 5546 - DNA, 177 bp, Homo sapiens
actcggctcactgtagcctcggcctcctaggttcaagtgattcttgtgcttcacccaccgatagctgggattacagaggtactacaaagatgaagtgctgagcttcacaaatgagaggatccaattcaactgttttgtgaattactcctgctctgacatttcgaagaatttatacca

SEQ ID NO: 5547 - DNA, 383 bp, Homo sapiens
gatgcttggcagcatggttctacgcgaaacctgtgtgaaaccggtcaatggaacctgaagggagacatactctttaaaaaaagaaaagaagaaaccatttataaggaaagaaacattgaagggcagaaagtaatgagtcaccattgcaagttggcacaaaaagaaaaattagttcataaaaatgcagttggataaataataggttatttcatcatgtaaatatatcccaaaataactttattgaaatgaaaatatctatcgcagcctaaactattcatcacactaacgtacatctagaatcctaacaaatttatgaaaatgttatattccataatcttcctgatccaatgcaaataaatagatgtgcttcaaaaaaaaaaaaa

SEQ ID NO: 5548 - DNA, 147 bp, Homo sapiens
gaaaggcacatcgcagaaaaacacctagattctgaatactgcttgggaaagacctttaaatcaggaatgcccacgttggactttatgtgaatgagcaataaattacatcttgctaagctattcagatttgctttaaaaaaaaaaaaa

SEQ ID NO: 5549 - DNA, 721 bp, Homo sapiens
agtgtggtgagggatgttatgtgtgatatattaaatttgtaaggaatatatttagatttggtagaaagttaccaagctaatgttaacagcacggctcagcatcacagcaggttagcctgggcatgacttcaggatggcagaggcacaagaaagcaagcaggaagatacaagtgacctcccaaactttttcgggtgttgagacgaacaacggtcaatatccaaagcaagtttcaagtctaaatctggaggcacagtgagaatgaacaacaaagttatgagccgttaattcactcagtataggacatccgaaagccagaaaatgtgcttgtataaatttgaacatttgctttaatgaatttataaaaattaattaaaaatactcaaaaaatgttttaaggtcacaagcaaaaagcatcttttcataaaatgatgataaaatatagaattctacgcagattgcttttacacatatgtggtaaaataattttgtttccatttcaatttaacaaaatatgacccccatattgaatctaatgacaaatttttacatttaaaaatgccttagaatgttcattaatatccataatacatcatgtggatattgaggatcattaacaaacctgaaaatgaaataggacttctccctcctgtctgccgcagaaacaactaaatgtaatatagtactacttacttactaccgacacgcctcgttggcctaagt

SEQ ID NO: 5550 - DNA, 367 bp, Homo sapiens
actgtctgcactattttcccatgagaaaaccctgcctgaaaagaagattagcattgaagagactaagcagaaaaatgaaaaccaagccctggtgaatcctgaatcaagtcatgcttcatggttatatgagcaaacacattccttttattgtaaccagattgagttgtataatctatatcttgcaacctagagagtcctaatatacctatttaaaaattaatatcaatgaaatctaggggaatgcatttctctgatcacctcacctccatcataacaagcatgttcaatgttaacacaagtatcccaaatgatataataaatgctataaaatatatcaactattacatgttacacaaaaaaaaaaaaa

SEQ ID NO: 5551 - DNA, 548 bp, Homo sapiens
aagacacactatgaagaagagatggagtttgagcatcctggcaaatccagactgaagttaaatgacatccaccaaacaactccaggctgtgaagaaacagacagctctcctcccacttctcatcttccttttctaggccattaaactgtgcactgaaaaagatgaagatacctccccaggctttggaattatcaaaataactttggaattcttgatattgattaatatcaatactattcctattctattcaggtcaactaagacaatgttttcaaattttagattatgattcattagttgataacaaaatcaatttaattggctttaaaagagacataaaatagaaaagaaaatataaaagcatgcatcacatgcagtaaggacgagtctatgtatgtaaacattttgtttcaaatatatatgtgtgtttgtttataagatgtacatattgcgatagtttaatgtttcttattgtgagttatagtcaacaaagtgttcaaaaattatttaattaaaatgtaagctccccaaaggcaaaaaaaaaaaaa

SEQ ID NO: 5552 - DNA, 759 bp, Homo sapiens
  misc_feature (1)...(759): n = A,T,C or G
ctggcacccttctaggtggcagatggaagcaacataaaggaaaacaaaagagttggagggaaagaaatagacgattggagcatctggattcaactatacctcaagttagattaacccctggactttttaactgcatgaatcaacaaatcttcttttagtttaagacattttgagttagtttctgccacttgcaacccagagtcctaactaagatcccaccatcatccccagggtctaactgtggcaactggactaaagcctcacctccttgtactgtccgccttgcctgcttccagttatggtcctatccctaagccagttctagcaggcttgtggtccattcctcatcctttctagcatttccaaacttaatttggagtgactctccaaatctaacttagactggtcccaaaatcttggaagaacctattctccaacttcaacatagactggccttttttcctttgaggagaaagaaactgagcagcgtgaatatcctcacataaatacacgcaaatacatcactagaatcagatgtggagctggaggtaccncaccagggcagctcctcctacgtcatatccaatgcagaaatgctgtctcattgtctattgaccatccatcctctggttaaatgccttcagagacagaaagctcactacctcagaagccatcctgttctattgatggacgacttctatatatgagatgcgtctttttataccaaaataaaattactccctttgaaaaaaaaaaaaa

SEQ ID NO: 5553 - DNA, 228 bp, Homo sapiens
gctccgagtgtttaaaatttggtctgctaacaaatgtctgttaagcattaccccaacctgttttaaaagatgtcacagcattcatgactatggaactgtgttcacaccagatgacaagaatctgttagcaacctgttatgtagttttcagcctcttagggtataatgggtataaatactataatgggtataaataataaaagcaattgcatgcttaaaaaaaaaaaaa

SEQ ID NO: 5554 - DNA, 474 bp, Homo sapiens
tacggctagaagacattatctgctcccaacacacccgatgtactgtagcagagaaggaacaggataatcgcagtgaaagttcccatttgagaaagggaagaatggaaaatatgtaaatcatcggttcaaagaagatattaaatcctgctgggctaagttctctggttagccaatctggcagcccttgaatgtgtcctctggaagaatcttctatgtgcattgtcatccaactgcatataaggcctgaatcgttggtctgtagttttgatccatctctcctcactgcttgggaacccatccagagccctgtctgctcagcctgcacctacccagtaccttcaggttcccagcagctgcacatggtgtattcttatcatgaaatattatacataattttaaataaatgaatgagagctacattatcaacataaagatatcccataaatgtaattttgactgacaaaaaaaaaaaaa

SEQ ID NO: 5555 - DNA, 570 bp, Homo sapiens
cttacgggggcaacggttgctctcagaagctgccgactgctaacctcctccggttcctattgctggtcctgattccatgtatctgtgctctcgttctcttgctggtgatcctgctttcctatgttgattcaccagcggaggattctcaagcatgacaattttttttctttaactactgaggcccgaggttatatgttatgtctatagctccctgaaatggtggtctaaagccttgttctcaagtgtggcccatggacgagcagcatcagcatcacttggaagtttgtgtaaaatgcagaatccagaatctcagtccccactccaaacctgctgaatttgaattctaacaagaaccaccccagatgattcctatacctctatcagtccccttctgatcatctctttcacttcttttcatactcctatatctgtacttagcaagcccaccagtgcctttctatccaatgtgctgcattggaaaccaacgtgtatttgaacgagactttgaaatgaagaacctatgtttctctctgaacaaacacaaaaaaaaacatggccccgttggcctca

SEQ ID NO: 5556 - DNA, 1134 bp, Homo sapiens
aggaaaaaaatggattatcgatcatgcatctgcttgggatggtccaggttgcctttgaaaaaatcattctgatgaggcaagaaagcaggtgcatgagcaaaggatatacatgcaatatgcacctctgccactgttccatgccaccctatttgcatacagtgtcattaatggcccataagcacagaattccaatggacctacaacatgtgagagtgcaacaggactaaaagtaaatgcaaggcgtaattctttcaggctccacagacaaagacaagaataaaaactctgaagagtgactgcagcaaaggctgattgagaatacagctatgaatacttttcttactaataagaagaaattcttaccaaattcaaagtcagaatattcggaggactaactgtataccttgcaactagattgctttgcattccttttgctttttggaatggatttatttttatcaaacttggccataatacaaacatgtcaagaaaacctgcttccctctatctatcctatgtctttgaatcctagaagatgaaaattggaaataacagaggttttctagctctgtgtttttaaaactctttctatggatttctgtggatttttttataggtaccaaaacttttggatctgcatttttttaaatgtatttcacttactttaaacaatgtaaacgtaatgtatattaaagatacatgatgattatattaaaaatccaatcgtctggacagacatctgccacaataacatccacagatggcgctcatcgccatcaacagatgcccacgatcatgtttatttacagctctgccaccttctccactcactccacacgcacaccacctcccacaccctgcccccaactgacccacaactttcgacaccctaccttacattgacctaatcatctggcacacctcgcccaacaccccctcgctcccccacctcccgacctatccgttcacccgcggtgcacgatgcctcacttacgccccgtcacccgccatgaacgatacatcacccccagatcgcgaaacaactcatagccgcccacctatccccactatctcacccatccaccgatgccaccgtaccaacttccacgcccgagtgccgtacctaccaacccg

SEQ ID NO: 5557 - DNA, 764 bp, Homo sapiens
agatcagtgggtacacatgcagttttgttacatgggaatactgcatgatgccgaggtttgaagtatggatcccatcacacagatatttggatgccctcatttggtcacttcattgaaatcaagacaagcagcctcaaagttcatagaaaaccagccccaaaggcactgtgttatgttgctcctgtattccaatcatctagcttttcaaataatataaaataatctgtagtatgaaggggattccattttccagtatcagaattatctgaatatttttacaaatttttgggcaagctatttctcaaaagaggatcaaaatgtttgaatttgcacacagaatttttagcagtgtgattaaaacaaatcatctaaactctcaagtttcagtttctcaactgctgcacaggaagcatgactggggaggcttcagaaaacttacaatcatggcaaaaggcaaagaagtaggaggcacgtcttcacatgtccacagcaggaggaagagagagagaaagtggaggtgctacacacttttaaacaaccagatcttgtgagaactctatcacaaaacaaccatctggggattggtgctaaaccattagcaaccaccaccgttattcaatcatctcccaccgtgcccccttctgcaacactgggaattctgatatgatgtgagattcgggtgggaacacatattcaaaccatcttatcttatgtgatatacctatacatgtatacccccagttttagaattaaagtcaaatcca

SEQ ID NO: 5558 - DNA, 759 bp, Homo sapiens
agaagtgccttcctctcctgcctccccttccacctcctccaccttctccacctctgctacctctgagacagcaaggccaacccctcatcttcctctcctcctcagcctacttatgaagacaatgagggatgaagacctttatgatggttgacttctacttaatgaatagaatatggtggtgatatacatggatttttgactgtgcagagggtcggcgtccctagatcctgagttgttcaagggtcaattaattctgtggtcggaaacatatggcgttcctgacataaattaccttaaggaggagcagttgctgatgtagtggagcgggagaaagaggaagaaagagaaagaacaatgcagaaaggcttcactgaaagaaaagcatgcttttgatattacatttctccgtggaattgggacgaagtgctgcacggtggggccttgcccaaggctacgcagctggtagacggggaaatgaggcggttgccggccgcctctcaggcagctttccctgtgaggaaggaggtgcctcgggcctctgaagaggtagctgggatagcctgaaatgagctgctgaaagcccacgcttcagaaagacaaaaagcaagcacaacacactgatgtggttgacactcgctgaggatgcgcgataacacagacagtgcccgggttgaagtgggccttacaaagttccgtggcaaccgtgaaaggaaagtttaatgaataatggccataacattgttaaggaatgcttcagtg

SEQ ID NO: 5559 - DNA, 498 bp, Homo sapiens
caacttatacttgcaagtgaaaaacctctgcctttggctgtggattaaaaagatgttatatgatgaagtttacttcctaaggaaagagatcctggcaaatgggtgtttcttcccagaaagggatttttctccatgactgcagttgaattgcagagttgtagagacatccaggttcttgttagtgtggacgaactatccatgaagatcttaaatgcaggagtctatgagaacaccaattaatcaattgtcaaatatttgagtatctattgtgagcaaggcactgtataaccattatgtcatgtattaatctattggaaaataatttgaccttggttgtatagtattttgtttatttttaccttaaattttgtaactctattataagtgtttacataccaactatttgagggctgtatgcaaggtatagttttattgtactttgcttcttctgttacaataaagtacaagtacagtaaaataatcataaaaaaaaaaaaa

SEQ ID NO: 5560 - DNA, 480 bp, Homo sapiens
tagagccaaccatagcatggagcagaagaaacacgcaggactaaattccaaaagggagcctctcatttcgcttcagttacccatcagccatatgacgttagcaagtcagtctcttccaattccaatttctttctacaactggaacaggacagtctatctgtgcaacctaccaagttccaccaggatcaaacaaagtgaggaaaataatctaaagcctttggttcttgagaagaggaagcagaaatggtgcctttttcaaaccatcctccaccggctggagctggctcacttttcatcctgctgacaaatttctgagttacagtttacaccaacgttgtcacagagttgatcacctgaaaaccagccctcctttccttcccgtggcaagggtatcctgccacactcctctcactcagcccaaagatcacctgcagaaccaaagaatgaatttatttgtagcaacctgcaaaaaaaaaaaaa

SEQ ID NO: 5561 - DNA, 780 bp, Homo sapiens
gaggtatgggggctgccaatgagaagaccccatatgcctaaccttggcaattagtccctgacccagccaagccaaacagaatccttctctgggactctctcgacttgagcttacagggataagactttccagtcaggaacccacaaggacgtaaacatggagtacaaggggtcaacctacgaagagcaagagaagtagagacagagccagccagtctttgctgcttataagtttcccaaggccagatccaaccacccttcctgttcttcagtgataggggccaataaatttccttcttatgtttcagctccttcaagctggatttctgctacttacaatctcctactgctgactgataccggtagttctgcagaagatgcaaattcttcacatgatcattttttgtatcaattctctgtaacagccgaggacaaactgaaattaaaaatgcttgtggcaataacatttatctttaccagttttctaattgctaatgttaaacatatccattgtaaaatacgtttatgaaaaccaggacagtgtagaaagggaatatttcagatgtctgtacatatataaatacatatgatcttattttacaaaaattggatcagaccttgtatagaattctacatagcttgcatttcccaattaataacatcttttggacatcataatatattagttcatataatctgcttggtgcttggtgggttttttgtttctgtttttaggcattaaaatttttttgtatgtttttctcttccaaaaaaaaaaaaa

SEQ ID NO: 5562 - DNA, 731 bp, Homo sapiens
tttaaggcctactctagtgttggtgtctgagcttcctctgtgtggaacagaagatttttaaacctgtatatttatagcaaacaatgaatctctaaatagttcttcagatcttgaagcgttcccacttattaattaactttgagaacggttttgccagcatctgagggagattttcatcattttttcttctcatatggcaaagaagttctcaggcctatgaatttatacaaagaaagcgaaatctggcaagatcatcacagactgctcaattgggatttttgtgctcaagaaaacaagaaaatgaggctcagagatgaaatgacgccttgccaacctactgaaaggaccatccctgctctatattcgcgaaggccttgcgcacatcgacgcccttacggtatcctctcgcctctcatgccacccgcgccgccaaacgtatcggctgcccgcttatccagcgcccccgccgcaaatactccacgcgcccgggcccgtccgcatcccaacctcttaacggagcgtcatccggacgcgagacatgcgcgcggtcgaccccgacggagccccctcgcgagccctgctctcgccccacaaccccgcggccgtgagccccaccgcgtctccccctgccatccatcgcgcgccaagcgcgccgcatgaaccccccgctcggccctgtctgaccgcggcgatccactctttcaccccgtccgccgcctcacgcccccaat

SEQ ID NO: 5563 - DNA, 593 bp, Homo sapiens
tcaaagtccagcatgtcaggaatggtctgtttacatcataagaagaagacagatgaaaaaaaaagctttcatatgagcaagttgtctacaattaaagggaaattacttaaaatggtccttccagagattgggttttgatttttaaaaaaccacttatacactaaagaattggtttgaactacaaaattttcttaaggttattacgtccatataactttctgtgaagggagccgaaggcccatgggacgtgaccaactcagcattccactggaggctatatgatcgaacagcaaactgtttatcatgaatgcaggatgtgagcaaactcacaagtgttcccgccgacagaaggtttgctggaggcaatcactcccgggtgccgaggttatctactgcaacatctagagcctgttgtttgaggaatgcagtcttgcaagcctactctggactaagcagctgaccccttcttccactcccccttctcactgtctcttttgcctaataaatatggagggctgtgtaaagctcagggcccatgtccacaagaggcatgtttcccctgaccccttcttccaaatataaaaaaaaaaaaa

SEQ ID NO: 5564 - DNA, 598 bp, Homo sapiens
ttttgtctgaactgaaatcgcctttgcaaaattatgactgagacagtgaaagaggtccaacttaaacgactccatcttgcctctaacctccaagctgtccttgttcatttctgggcgcaggctgaaaaaactttgggagggacttagtttatagttttaaaaaatgacaataacagccctttcccagaacaaactcccttcttgccggagactagactactaaagttagccacagtattagaaattacggtttaggagtcaagtagttggaggccacaagattccgaccttccctaaattgctcccaagatcagtgcctgagatgttttgcagactctactcttgatggatcaactggcaccacccatatcgagaaaccggcccatctgatcttgtgactcacacccaggaactgactcagcgcaggaagacagggacgcgccgtaatttcacctccgacccaaccaatcaggactctgcaactcactgctgctgcactcccaccacattgtgtttaaaaactttgatccccacatgttcggggagacctggattgagtaaaaataaaactgcggggtgccgctcaaaaaaaaaaaaa

SEQ ID NO: 5565 - DNA, 633 bp, Homo sapiens
ttgttgagacccctatgaagcagtcatcaaaactgcatctactccacgtgcaagaggtttgttaggggaaggagcagaagaaggtagagagagtcctcagatgaagatgcaaacccgacgtctgtggaaggaggaaggaagggaagaaaagagggtagggaggaagtgtgtcaggctgctgcacatttctgagaaaagttcagctgggccaattgagagccctgatgtaaaagtcctgcatctttccagaatgagcctgtctttatagccttgccatgctcagttatggctgcatgcaaccatgggaactgtaggctctgcacgggtttgatggtggatacagaaaagcagcttctggtgctgtcagtcaattatgctttccacagaaggagatctgaatggtccatttccatggctattacaccactccttgaaagaaaccaaggctccttggagaaataactcattgcaggtctgcacagggaaggtatgaagtaagtctttttcttaactctggacttcttcctttcaccatatataaaattaactcaagatggtttaaatacttacatgtaagatctgaaacaataaaaaaccctagaagaaaacctaggaatactaaaaaaaaaaaaa

SEQ ID NO: 5566 - DNA, 378 bp, Homo sapiens
gttttacttttccttggccatgagagcttttcagtgtgtaattgaagtcagagaatgcctgtgattctagtcccccatcctttctgtggccttgggcaaggtgcttaaccgctgggtgcctcagtttccccctctgtaaaatggggataatcatacttaattgcttcaccatgctgaggtaaggattaattagttgatgtttgtaaatggctttgaagccagaaaatgctacaacagagctgggcattattcttaataatacatttcaactgagttgataattgcatttgccgtctcaatttccctggcagtttcagctgatgaacttatttttcaacttcactcattaaaaagaaataaaaagcaaaaaaaaaaaaa

SEQ ID NO: 5567 - DNA, 847 bp, Homo sapiens
  misc_feature (1)...(847): n = A,T,C or G
cgggcccccccccccccaccccaaagtcccactgcccccaacacccaacaaagatttccgcatcacccaaaaaaagtttctcgttgtgcgagccaacaaagcaatgatgttgcacacctggcaccatcctacaaaatccaatggggttattacccattataacatttatctacatggccgtctatacttgagaactcctggaaatgccactaattgcacagtgatgcatttacacccatacactgcctataagtttcaggtataagcctgcacttcacaaggatgctccctttcaccaaacaaccagactgtatggacactcccacccccaccggcaggggaccccacgcccagaggtgcgctctgatactgccacatctgagattatatcttggaaaccccatacccccccgtctgtctcggagacataccaccacccctcccacaacaccacccgcacggggcaaaaaccgtcactgaaccgctataccatgcgttgaaacactgtgatctcacgacccccggccaaccctcccaccgcgccgccgcccacacgcacccacgcccgggataaaatacatccccaccgaccgccgcccgtataaaacacggtnactagcctccgttacccgcaccgccgcgcacccccacccctcaccgcctaagaatcccgctaacacgcgcgcggccgctggtcgcgatctcacgcgcccctcagacacaccccccgcctcaccccccgttacccacccaccccaccgcgccggcgcgtgttgaacggtgtcgacaccccgatagtaagccgctgtacccggttttcctcgcgtccacacctaacgcccgtact

SEQ ID NO: 5568 - DNA, 173 bp, Homo sapiens
ggattgaacgcaaaaaagccaccttaatacctctgtttccaaaacatgatgtcactataatgaagacaagcaacaggaccacagagagatgccttcattcagcctcgagtatccacagaaaattattattatcacccccaccacacacacacataccaccaaaaaaaaaaaaa

SEQ ID NO: 5569 - DNA, 757 bp, Homo sapiens
gtggtgccatcgtattggaaggaaatgtgagactaaatttatgcagcggcagaaggcacaatttgtgggcatgacatgcagttcccaacacaaggaatgtacaagatgagcctcggataccttgctgagtcagaaagctagaagcctgccaaagattcctggctcctgtcaagaggaaactcaagcaacatttccaaaagaaacatatgacattagcatatttttctttatcatttagagaaaagcatcgtggttttcctgtacgatctcaaactcagggtactgagatatttggtgaaggttgttttttcttaaaagaagtaatccagccagccatgaaactgaaaaaagaattagaatatcattagccttgcaacactcaaagatggaaaagatctgcgaaatgactgataatgggtggtaaaaccactacgtggcaagatgacgggcaccttcgccagcgaagctatgttacctgaacactgaggcgtactaacaccaatgctctgggcctcagcaggaattctgtgggcacatccctcatcgcctccgagccggatgatgtgagccgacgcacgtgatcaactatccacaggcgtacacgccatagtcccgtcatcccgcacccacacattcaccccccctctcccctggccacatatcgagccacgcgcggcaatctaaacaaaggcgcgaccacgccgcataacaatgtcgaaccactgacacgcggggacgcattcgctcccccgaacat

SEQ ID NO: 5570 - DNA, 531 bp, Homo sapiens
acagggttttcattttcttctgaatgttaggagggaaggcattttccatccttgaccagcttgtaggtgacacacattcagcaaacgcacatcccagcagcaccgagagaacacacagctgggttgcttacaaatacactacttcaaagtaaactttctctagtagcatatcagaagcaaagtaaaatctatttggagcaagtaaatctgactgctaccccactattttgaagcatacatgggaagctggttcctggacccccgcatataccaaaatctgtgcatactcaagttctacggtcagccctgtggaacccaagcataggacaagccggccctccctatacacacaggtttgacatcctgagaacactgctggttcccttcccatttggttccagaaaatctgcgtataagtggactcagtggtgcaaacctatgttgttcaagggtcaactatatatgatgaattattgctacctacagtgactctaccatgctactaaacactagaactgaaaaaaaaaaaaa

SEQ ID NO: 5571 - DNA, 760 bp, Homo sapiens
cgcgcctttttagaggcctatagcaccccctctaccccctctagagcccactgtaaagctaactttacagtgacacaccagcttttaattctggcttcactacttactcagcaaatctgagcctcagtttccacacctaaaaatacaaaaagcaatctccgacccaaccactgtgcagagccatcaaagaagcaagtcaggtaaccaatgtgacagcgctttgaaacagatacgaattcagcatttgtttaaaaaaatacaaagtctgtaagttcatgaaagatgaattcaaaaccaaatacagatccttttgataaaatacaataataaggaaaaagtgtatgaagaataagattatttaagtgagtatttaactggtattatgtatttgaaaagagactaaatctcccaggtgttccttttaactaagtggtttggtaggtatagaagtaggattaatacaaatatgtgttgggtttgagtgtatggtcgttaaattacgtgaaggaccgtgtggggcagaacaactgagactgtgatggcgggcgttatgttagggcggactatgcgcgccgctggatgcgatgtacgtcacgcgggcgcattggggcatgagcgtattgcgagggacgagaaaaataccacctctgccccctgtgtcaacagtgccgagcgcaactggcgtcgattagcgcgccacatcccacgactgatatcggtcgatggcggaaatgcgcgcacgggaagtaccgcgggaagt

SEQ ID NO: 5572 - DNA, 756 bp, Homo sapiens
tttggctctgtgtccctacccaagtctcccgttgtcttatgatcttcagtgttggagaaagagcctgttgggaagctattggatcacgggggcagattttccccttgctgccctcatgataattctgtgttcagtcaaaataggagatagtttgctgtataatgttaaaattcctgtcttcgttgaatgatgccccaaatgttgatatgaattacatagtgtgtcctgctgtgagcatcagaaggctatataggaaccatgatgctggcacctgctcagattctgggaaggcctcaggaaacttacaatcatggcagaaggcaaagaaaaggaaggcaagtcttacgtggttggagaaggaggaagagggaaagagaagaggtactacacatttttaaacaaccagatctgcgagaactctcatcatgagaatagcaccacagggatggtgttcccccattcctgaaggatttattcccataatccactcaccttctatacggctccatcctcacccaccgtctattcccaccttacatcgacattcgcgccgcccaaacatccccccaacctacatccacccttacccgactaccagattccggtccctctcgccaccttatcgtcatctaccgtactcctccagtcgccttcttctattaataagatcctttttcgtccgctcctttctcaccctcccgtaattatctcgccttctctccatttccccgccccctccacctctccccctctctt

SEQ ID NO: 5573 - DNA, 721 bp, Homo sapiens
ttgtcagaatgagggatacatgcctccttcccataaggccttcatagaagacatccactcagcaccttccctgagggactacatcctgtcctctggacaggaccacttgctgacagcttataaccagtgtgtgcaggccctggcagagctgcagagctatcacatcaccatggtcaccaaatacctcatcacagctgcagccaaggcaaagcatgggaagcctaaccatctcccagggcctcctcaggctttaaaagacaggggcacaggtggaaccgcagttatgagctttcttaagagtgtcagggataagaccttggagtcaatccttcacccacgtggctaggaggctgccctctccccagcaatgcagagcccccatggagggcaggcgggcctggagaatgagggctagggtccctgcctgggatcacccaggaaggatctcacccctattcatgtttctgctctacagagcactatattctccttgatgagagctgccgcctcccaccggagagttgctcgccgcaagcctttagctatctacctgaccactggttaacggtatgaataatgcacgcttcctcacgcagaacctccaaaggagcgcccgattccattatctttggcagcgttatacacccaccctaacctgttcgaagcccataagatcgcctgagcataccttactccccgacgttcccccccccccccggct

SEQ ID NO: 5574 - DNA, 271 bp, Homo sapiens
tttttggcctataccgtcctcactggtttcctagcctccagtctcactcacctcgactggttctcactctgctgatggcgatcctaccaacacacaaaggagacacaccagcctctactccaattgctcaaccagtcctaatctgcttaatgaaagaagactcaagtcgccccaactcctgcatatcctcattttgttatttcttaatacttcccatttgtgaaatgcaacaaagtcacagtgaattgcctaaaaggttctgaacataaaa

SEQ ID NO: 5575 - DNA, 748 bp, Homo sapiens
tggaactagaaagatggtatgctcttcacataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgttgcttctgcttgtaagaacatactgcgctttattccatttgagcctgaagaagatataaaaagaaaattcatgagaaagaaggacaaaaagctatcagacatgcatcaaatagtaaatatagatcttatgctggaaatgtcaacctccctggcagctgtaacgcccatcattgaaagggaaagcggaggacaccattatgttaatatgactttacctgccgatgcacttatatctgccgctccacaagaaacatggggaaaagctcgaaaactcctggctgacgcctttcatcatccgctccctgacatgcgaccatgtatttcgacatatatgataggaacatctattgcggaacctgccaccatgcactttctattcccagggacacaaacccccgacccacccgctactgttgcggcatgcgctccggacacatgcaggactatacgacggacccccccgccactttacccctgcccaaaccccacactcccaaaccccgccccaccacaatcccctccaag

SEQ ID NO: 5576 - DNA, 723 bp, Homo sapiens
ttgtgggggatggctgaggctgggtttgaatcctggctttgctgctgaccagcctgaactccctggtggcctcgggcaagtgtcctcacctctctgagcccactttcctcccaggatgttttttgagagctgctatgtgccaagtgtcatactgggctctggggatccagctgtggacaagacagacaaagccctgtcttcctagatcctggcctcagagaagaagagagacactacacaaaacaattatgccaccaatcatttaaccagcacaggcgtacaccacatcgtggaggctgtcctggtagcagggggaggcaggactggggaccctcctacgcctgatttgaaacaccctagaccagatcaccctatgaagttgagagcgccatccccctaatggacctgatacataggcagacggcacaggcggccatcggcccccgccctatacgcggggtgctgcggttgatttttcctccccccccccatcaccccccccccctcataccccctcttatcgcccccttatcctgcccccccccccccccgaccccccgacttccctccgcgctcccgcccttccgttccgcccccccgcccccccctcgcgcctccccccccgcgcgcccccgccctataccagacaccccacccccgcccaccactcccgccgcataaccccccccttcccattccccccccccctcataccccgccatc

SEQ ID NO: 5577 - DNA, 735 bp, Homo sapiens
taggagctttttgacctgattgaggtctccgtggttttatgggctgttgctctgaccagctggattagtgaccgtctgctttgcagcttctggctgaggattcatttcttctatctgcacaacatctggcatgtgctcatcagcatcaccttcccttatggcatggtcaccatggccttggtggatgccaactatgggatgccaggtgaaaccctcaaagtccgctactggcctcgggacagctggcccgtggggctgccctacgtggaaatccggggcgacgacaaggactgctgagacctgccagcctcctgactatccaaccacccaacaacttgcctgtgtctagagaagatagccccggacaggacttgcacctgcgggacactcgcggctccttcctctgtttacccttccgtgtactacttgcaccgcgctgccctgacctgaggaataagatggactccgcgaccatcctcaaaacaaccccgccgcctgtgcgccccctccccgacgcatccccccctatataacccccgctctccgtccccaccccccccgccatagacccccacaaaccccccccctctcccccatacccactccccccgcccccccccaaccatctcctccccccccacccgcccccccctccaataaatgaattttgccgtcgcgctaaccccctcgaaatatccccccccccctttccccccctccatttcttcctccacg

SEQ ID NO: 5578 - DNA, 671 bp, Homo sapiens
ctactgatgtatcttttgtgatgtggcaactcctgaatatctcctacagactgagaacttctataattaaaggaccagcctgatggaggcagcttaaacaaacacacgaccggagtggcgcaggagttataaagtgccatatgtgaatgaacaaaggggctatactaaagccttttgtggaagctcacaatcgagtctgtggccatcctttagcaattaggagagagggggcggaaggaattcaccgtactctccagtaccccagttgctggctggctaatgaagcattcttctcatcaagctgcctcagttatttaccaagagaatgacaacccattccccacccccagctcgaacacccactgtgatcagctccctcacttcatgacaatgaggcgacatgcgcgcgactggctttcgcataactaccaagccttcaaaaaaaaagcgacaataaatatttacttgcagtgtattccacgcaccacagagggacaaccctccatattacactgccgccatttccaaccacccctaatacgccccccttttcctttcccccccccccccccaaaacccccgtccgtcccctccccaaccccccatcctgtccccccaacccccccgccggagctcctcccccgccgccttccccttcacgaggaaaacaa

SEQ ID NO: 5579 - DNA, 834 bp, Homo sapiens
ttttttttaattttcctgccaacaaaaccgaccccaacaaaagcccctctccccccccccttagggcttacaacctgcctggtttccacagatcagctttctggtacagaggcctttaaactacacacccgtgtcttccctgggtatccagcttacagaaggcagatcatgggacttctcagcttccataattatgtgagtcatcaccttatattaaatttcttttgatctatctgtctgtctatctatctattctattggttttgcttctctggaaaaccctggctaatacagatgacggcaacaggattggctctacaggaatacaattttaaggatgagccctctcaattggctctgcggctctggacccgcctctgtcacctcacccccacccccaccttgctcgcccccttctcacctcccccccctgacaccccctccccaccaatgaacgccacccccccctactccgctcccccctctcccggaccctcacccccagcccccccccccccgcgtagcagctagcacgtttcccacccctagtccctacttctcggtccagatccctcccccgcccccccaaccctgtctacctcgccctgaccctcccctctccccccaccccctgcgccgtatatttcccccacccctgtcccgaccaatcccctcagcacatgagacgccctgggccccgcctggcgtgcccaccacttcattgccccccgcacgcatcgtcactactcccacgccgcattctcggtagcgccccttcccaccgctaatataccgctaacctccctcccgcccctctcatcttcgacccccccg

SEQ ID NO: 5580 - DNA, 351 bp, Homo sapiens
tgccatgctttccaggctgaccctcagagatcctcctgtcgcagcctcctacggtgctggaattacaggtgtgagccaccatgtccagctaaacaaatgccatttcctaaatggttccagtatctgaccatttgcaatccactagactccaggcagacaggcattccatttgcaaatatagaaagttttactgctacagccttcttttgagtactcgattttgtttttctgtctgccttggccagaggctgacacacacccttgactagccaaaaacaacccccggcctcgctggactcaccggaggaactctgagaccgcttccctttaccgagggccacccccccgacc

SEQ ID NO: 5581 - DNA, 732 bp, Homo sapiens
tgcatggttcatggatcccaggctgcttctggacaggctccagactcactggagacctcctgacacataatgcttcgcccagcacaatgcgatgccctttacctagtaaaagggtgagtcccgtaaaggtgctgccttccccccagaacaaacaagggaatgcatcaggagagctcagctgcagacagaatgcacatcatgaagcaggagccaccctgggattcctcagatgaaagccaatttcaatgaacattgtgtttcaaagcccgcttcctcttgctcggttgtctgccaacgctaactggccagctctgacaggaggtgcgtggcccaggaggagccatcaggccagttctctgggatactgctgtgtctccagctctgcagtttgctctgcgtcactcagcggcagacggagaggcagacgcgagccccttgtgagccctcctccttaccgtcatctcacaatgctctgaaataaggaggcaaatggctgaggtcccctcagttgtagatgtgattgagttctatctaccagaagcatatgtctcctggaagcctggttctaacacctcccacaaaatgcttcaagcacttttttctgttccaaggtttgcttatggcggacacagcgaagtgcttcacagccctagagatttgctgaggcatatgaggggccagcacacttttactgccaaggggcatataccacacattctaagcttcgcacaa

SEQ ID NO: 5582 - DNA, 186 bp, Homo sapiens
tgtgatcataattgatgggtctcctgcactgcagcatctgagaatcatttatggcaccaccggctggttcagccatgtcaccattgtacattcattgttttgtggtttaggaaaatcatcagttaattgttatcctcacatgctgtaacttataaatagtatatttgtttggcttttccttgaaaa

SEQ ID NO: 5583 - DNA, 834 bp, Homo sapiens
ggagctttgagcagccacatggaagcatgcttttcaagagccacagctgagcactcaacaaacagccagtcacgtgagtgagccatcgggacgtccagcccagatgagccttccgatgattgcagcaccaaccagcatatgaccacaattgcagaagaaatccaagtgaaaactgcccagatgagcccttcccaaattcttgagccataaagcagtgagcaaaataaagtggttgttttagacatcgcagttttgaagttattatgtggcaataataactggaacaacagccagccactaattgcctgaaaactcaagagggaagctctataatggatgacagagggcacttttaatattatactagactgccgcccacattttcgtgaggaattgccaccattacctggtgtgccaagactatgaagtgtaggccgtctcttaaggtgcctcacagcacccaacatctaataacggttgcttaatggtctgttaaataaacaccgcgtccacccgaatgttcctctggccgcccacacccaggtaggcccaacctattgccacaccacctgtcgaccccttctcactctcccccccgagacgtgatatgtccagactcgacatccaacctcgtcggttcacggttacgcagagtcacgtacagacacatgagcgccaccggtctgagacgcggagtgacggagcttccatgtcattcagttgacgccctcttccaagtgaggcttctaagaactcagggtatgacgcctatcgtccttcatcctctcttccaccattgtcgacgccacctagtagattcgccctccgcttact

SEQ ID NO: 5584 - DNA, 729 bp, Homo sapiens
tgggactggcttagacctgcttcatatttctttgaccagcaaactagccaggtatgttcttcacattgtgaaaaacaagagtgccagagagggaaggagaaacatgaaatacctcttgaggccaggctcagaactgtcactcacttctgcctatcttcctttgaccaaaagcaaatggactgatctaagctcaacatgaacaggatggagaaacatcctatctctactgagaggaactacaaagccgtatttcaaatggcatgcatgcatggagtagtgaaaaattgggaacaataatgttatctaccactgttatccacctgggactttccagcttactgccaatcggcagtgggagagaatttcttctcaacgtggctgacaacagaaattatgcgacttggcaggtgttatctgcccctaacaacaggaatcagtctttgcctctgccggctacctagcatactacgccatgctatcaccacccccaccctattgattattacccccccccttactcgcccccttcccgcgcctggctcccatacctgcccgcctatttaccccgaacccccatccgccgaccacattcccccccgtcgccccgcatccaaaacccccgccccctgtgcatctctcaccgcgaccgccagcacacacacctccccagcaatcctatattacgcctatccccccgcgcggacccctctccccgacagcacaccaccc

SEQ ID NO: 5585 - DNA, 729 bp, Homo sapiens
tctctaagagactgcaagaccacaaattttcttcaacttgataatatactaggaaaattacagagtaatataactgggcatcaatagatttgttaaacatttgcaattatgcatagagcttcaattactcaaaggaaatgtatcgactttttttcagtacagagctctagctccttattttttcctctcaccatagttttaaaaaatacaaaactcatgctaaaatgagaattttcagataacttataaacactgactagtagcactccatacaaatgaaaaagaatcgcaccatcaaacttcctacgatattctacgcattaaaatttgacatcgaactaaaaaagattgcataagacaacgaacaaatcactaaattgccacataatccagcaacaaattttgcaacatggaaatctcaagcaaataacccaactgtgagttccctttgggcatcaaggtcaaactacaaaagtaaatttgtgacttttcaagatctatgcagttttaccaaatgtatttattttttgcgagagaataatttttttctgcccagtactagtacataaaaagtaacggcatctgaagccatcctttaaattcttttttacagccaagaccatgatttggcaaaagatctccaacagcttacgccacggacaactaaactgcatctgcctatgcgtccacaattcatgcgcttacaggaactgcccacccagcctgcgc

SEQ ID NO: 5586 - DNA, 425 bp, Homo sapiens
cccatgaaatgtacgcaaacattacacacagggtggtttccaggaaggagaaggccctccaaccaagcactgtctggccatgcctgagcttttgtgcagcctcttcaggctggaacagtgtctgcgccaggcccagacatggtgtgcactcagcacgtggaagttgctatccctgaccaccatcagggagctgaagtctttagtgacttgaggagggagtcatggacacctgcgcgaagaccacagctccatcacttcttctcaaacaagctcacgctcgcaatacacccatatccgcggacctgcccagaggcccttccctactccctccctccagcctccccccatacctccgagcgccgccccccgcccatccccccatcctacccccccttataaccacgaagagagccccaccgccaacg

SEQ ID NO: 5587 - DNA, 716 bp, Homo sapiens
ttttgaatacagaagctaccaggaaaagggaagactgcgctcggcctggattctggccccaccttagcccctggcatgtacctctctggttctctgtcgttctacaaggctacagtgcgtgggttacaaacccgcagatttaagggattgtgatttatgttctgtaggccttatgggattctaccgtttcagcaagctgcatgcttacatctgcaagggattttttttaaaataatgatgcttattaaggcacttacacttgcattatgttaatccccatgacacctctgagaagtagggaaggactgttaggcttttgttttttgcagacgaaaaaaacaatgccccaagttttgttaaaaaaagccccccccacaaaagccctccacacacacctgctcttgctgctccaatactccaccttctcagatacccctatccccacccaagtatattcctgaccccccaccccattttttcccgggccccacctccctttcttccccccccctgcatctctttctctttcccgaggagcacccgtcgccctccctcctgaccccctgcccctgccccgtttcgttatccccccctccccccatcacctcatccctccccccgaccatcctccgttctcggcccctcccgtcgtaccacccttccctcttcttctctcgttccccatcctcggtcctacacaccttctcctcccaccg

SEQ ID NO: 5588 - DNA, 487 bp, Homo sapiens
gtatacctctaactcctgccactttatggaacaccctcagtgcccaggggtctcttgtccttggtcctggttctccctgggctgccttgagactttgcagtgtgccaataagaggatgtatatgagacccttactcatgtatttttctcttgtgaagccgatcacactggacttttaagtcctttcttcctgacattcagtctttgactctgaattagctgaggcatgagaagttcaccacaggaaggtcctgccctttgtttgctcctaaaggttcctttaaagttcaacttgaccaacacaccattgcaagcactccagaggagaagacagccttgctgtgtcaaatccactttagtttgtgaatttcttgacagacacttttatgcccccactgaataggacagtgtgaagcatggattaagtatgcaataaatgggtggtgaataaatgacaaaattaaatgcgttctgcaaaaaaaaaaaaa

SEQ ID NO: 5589 - DNA, 760 bp, Homo sapiens
cgcctggctgaagaccacatgaagacagagggagaagccactcagctaaaggccaaggaaagagtcctcagaagaaaccaaccctgcaaatacctggatcttgatcttgggcttctagcgtcaagaactataaggaagtcaattcctgctgtttaagccatccagtctatggaaccctgttatggcagccctagaagactaatacacaagtattaaacctcatccctagattccaactgccatgtcttctcccctttattacagactcttctgccagattttcttcctagactaggctcatctcagggcatgctgaagatattaaaaaggctcagctgtaaactatcacgagtgaggtctctcactgttatagaaatgaatgcctcacagcaatgacagacatggagccctttgattcacgcgcagccatccacacatacgacaagcgcacatggcacatatgagagcgagctggatctgacacttggcgaccattccgagctctctgacgaccatgcgctcacgcacagctctacgcgccccgtggacaccatctctgctgacattcgagcagcgcaagcccccgcgcccttcatcacctccgaaagctgcgcggatttcctaccctccccgccgacccgacccgagccccacgcaacgccgccgcgtcataccccccgcttcccgactactaggacatcccgcgtttcctccccaaccccccccagctgttcccagcacaaacctcaaccgagcacct

SEQ ID NO: 5590 - DNA, 739 bp, Homo sapiens
tctagtcctgattctatttcctcaaagaataatgagtgcttcaattcagttttctcacatcttaaaatcatttatctgtcacctgctgcagagggcacatggtctcatgcaagaaaataattacggctgtggaaacattcgtcggacaatgtgaaagatcttttgctattcatctgcattgttccaaaacagtagcagaacaaatttaaataagtagagctgcaattatttattgttatcttttggattattttttacctgggtgacgctgaagattaaacataatcagttccagctggaaacacttctacagtatgtcagggacaataagttcacaaattgactttacttgctattcatgtggtatatgaaaagaattgggcaaaggggaatttaattagtgtgtctcatagtagaaataaataaaaaaaagatagactgctgattgcattgaaaatgagtagcatgcttagctgtcagcaatgaagcagaagtggtttcttagtatttctttggtcacagaaattttgatttctttcgattatctcatgtgaagtctaaagtgtattattttaagtatgaactataaaatgcaattttattatacatatggagagttgttattacttaagatgattcccgtgctagcctttacactggatatctatgcgatgataattgctactgcagactcttttgaatggaaggaacctgagaaatagttccaacgattcgcggt

SEQ ID NO: 5591 - DNA, 616 bp, Homo sapiens
ggaatctcaccctgtcaccctggatggagtgcagtggagcaacctcagctcactgcaacctccgcctcccaggttcaacgtattctcttgcctcagcttcctgagtagctgggattacagcttaataatgaaaagaggcaaataaccaaaggaagctgttacggaccttctgcaaggaaagaagttccagggccactattagggaaatggtctgaagacaatgatatagtgtgattccttgaaatccttcttgggcagtggaagggttcagattttttccctccaacttaatcagatgaagagtgagagtaagcagtatttaagagtacacagacaggcacacatatgcacttgtattttaaccaccagggccgtgtcagtacggaaagcatttaatgaagatttgatagaccgacttttagatgctgaattatgtgttttagtggtaaagatctcaatggctttgtcaaaattctagtgagcttttaagtattttaagatgccaaatacttgctttttatctggaaaatgtttacaaatgtcttatggggatatatttttatttcaaaatttactatgaataaatattttgcaataaacagcaaaaaaaaaaaaa

SEQ ID NO: 5592 - DNA, 831 bp, Homo sapiens
aaaacaaataaaaataaaaaacaaaaatattaattttttataaatttacaatacagacgaggcaagcatgagagaagctaaatatgcatctgctaaactcagactattctgtgtcttagtccaagagaagtcccaaccactatccctcattttgaaatgaaagagccacaaaaggaacggtttatctactgatgccagaccaacattgcacagaattgtgtctcaacccaagcatatctctctacagatgttgaaggaagggtgtctgtgtacccactgattcttctgctgatgaacaatagcatgattgttccaggtgattcttattgatgactttcagaagcagcacagcatgtctcctaatatggaatggtttgctatgctattgcatggctgaaagggttgactggaccaccatgaggatggaaaatttttcctgaacaaataatagtggtgtgggtgcattgtcagtgggtaaccaatgcctatgagaggacatgttagcgagatctaaaggttcccatgattaggtggggggattatacacattataggcgaccttgaccagatataatgtctacagatctaagaggtatgagacccgtggattatgtggctcacttgtccttcgtgctcccatgccatttacacactcccgcattctgataccctgccaataaccagcttcccgctcgtccaatagtcacgactgattttgatccgtcctttcgctctccccatcaaatgcctcaaaattattacctcccaggatcttttatttgcgcatatctttctaggggagctaatggcacagagcggtgcccaaagcgt

SEQ ID NO: 5593 - DNA, 929 bp, Homo sapiens
  misc_feature (1)...(929): n = A,T,C or G
ctgaaagattcctccaggatggtgaagagcaactggaatagccccacgaacagcatccagaaaaaggagaagagcaccttcaccagctccttcgcagtcatctttttcacgttcctgtactgcttcctgaggttcttcagggttgctctcttcaggaagtcggtgacattcctcttcacagaggcacaggccatagcaaatgcagaggccggctcaagagacccgtcttcttcctcttcacccgcaatttctaacacgtaagaagaatcttcatcttcttcctcctcttctggcctgtcagctgaatcggattcagagatctgagatgctaactgcatttcaaagatggtgtcctcacagaagttcacaaacagctccatcttttcctgctccccaccttcattgacaacatctaaaatgaactgtcgcttagattccttcacctggggcttctcccactgagtgcgactggattcactgatctcaaaataaacacgctcaatcttcttggccccacccatgatctcgatgcgtcctaggtagggttcgaagtaatttagcacactttctgctgggtccaacagacacttcaggccggaatcgtttggcatgtgttcagaaagacttgtcataacacagccacattataccctatgtccttggctggctcagggaccggtctacaaatcaacgaattanacatgcattctcatcagcttctgccacgacagggaaagncatctctgactgcggtctggtttgccctcctgcctctgaattcttttggagaaatcttcctctggcatatattgagcgcccgccgttagccttattgagaatgcgagatcaaaactctctgggcaagttcacggagcctggtgcagggcctaccatcctggagggaggacaaaagtaaaacccctctgccg

SEQ ID NO: 5594 - DNA, 747 bp, Homo sapiens
tgtttgatttagaccttgttttctatgctcaatagagttgaagaaaaatgggaagcatcacccttcctttttacacatttcacagaaatcaactgtcagagctggaagggactgtggagatcatctagttaaatctctcattttacagatgaaaaaaccaaggacatacccaacgtgcatagccaagtttaggcaatgtcaggattgattaaaacctgaatttctgacccccagccagcatgcttccactattcttcttcctccacaccatcctaccctgccctttgctcaaatgtcctactttctgaccctttcccactcctcaaagcctttcccatcatcttgctaaatctcccatcttcacagaggaggaggcggggaagtgacacagttctccacagcattcggcattttggtttgctaaagtctgctagctggctgatcttctacatcactcctcttaggcctttggagcttcccaacagaatacgtgaatgttatgaatgtgttttgtaagctgtaaaataccatacaaatatatgctctactattttagaacatgaaataatgcaaccccttttaatcatactctcatttctcttacctctgtgagacaaagagaaggcaggagcacactctaatttaaggaacaagaagttgaggctaaagatctggacaagagttttctctccccacaccatgggcccctttagggcagagcctattttatgctgcttcttatattcg

SEQ ID NO: 5595 - DNA, 720 bp, Homo sapiens
tagtcgctgtactttctagcagccaacaagttgagaaaagcatgattcaacaattcgtaatgttcacacgattcaagtcaaacatgttggaaagaagtgtgaccattcctgaaattgagaccagagagaatttctcccaaatgatcctcacgagaggaatgtgcataattaggcaacaatattttgcatttgaaaatgtcttcacattaaatagaaggagttgttttataggctagttttttaagttatccctaaatattggccaaaggcattatgctaacatggaagtgccagaccttcgctgcccatgtgcagtatgatgagggatgtaccactgggtcccacggcgctgctaccccataggttggcgctgtgcctcccggaacacacccctctggcgcggccctgtcatggaacccccccaactttacccccttccctctccacccctattcccatccccccccaccccccccccccctcccccccccctatttttttccccccccctcccaccgtttccccccccaccttcccccacttctttcccccctccctcctccgcatttttttcctcccccccactccccccccttctatttttcttccccccccctcccccccctccttttccccttcttcccctccccctccctccatctccccctccccgcccccactccccttagtatttccctcaaattccccccccccccccct

SEQ ID NO: 5596 - DNA, 715 bp, Homo sapiens
ttattaggaatgctttgctgcttttgccattttggtgtacgtttgaataaaagggaaagcttgaaaggggacacaaaggtaagaaagaaaagaaggcctagaattaaagagggagaaaaagaagcgtgagtacccggagagctgcgaggacgatagcagccgtctgcggctcggaagaactgattgtagatctacaggaagtgtgctgttgtgctgctggcggaggccgtccctgaggaagtaggagaagaccactacgcctgtgtgtaacccacagtgaaccgccgctccgtgagacctcttgcataatgactctcaggtgcttcccacaccctctcccgccacgcaactgcgactgccatgtcgacagagggtaccacccccaccccccccactcttattgtttccttcttttctcccctcctttttcccccttctcctcccccccccctatcctcccccccccacacccccctccctccccccccctctttttttttcctcccccctcgcccgctttccccccccttttctctcctctcttcccctcccccctccccccttttttttcctacccccctcttccccctttcttttttccttccccccctctccccccccctctttttccccttttccccccccctcctattctcctccccccccccctccctccccgcctgcttcaacctgcctttcccccctccctccgtct

SEQ ID NO: 5597 - DNA, 459 bp, Homo sapiens
cccctcggccccggcccccaccgtccgtaggggtgggataggccggggccccccttagcgcgaaccaggcactggttgccattactctacagcgaactccgtgggaacagaaaatggaataccacctttttccatttataagcaagagctaaacatcggacagcagagggagaggggctacccgagagcagcacatagtcactaaatggcctataacagctctacttcctttcttgaagaatcagaatggcgaaagaaaccagtttgatgtttctcatgccctcaataaggacactaaagcgccttacagacagttgcatctgaacgtcccctgtggccgcgctccacgcccgacatgacaatgttctccctgaataaaacattgaacggcctgacggcctcatcacccccccccccgccccgactcgcccagccgcccgccccggactgcgattcgcg

SEQ ID NO: 5598 - DNA, 725 bp, Homo sapiens
ggcagttcaagcaggctgaagactgacagagaagcatttgcatgtcctccatgagccctgattttcatgggaacagctgtctcagtgactgcatacaaggtcccacttcttagatctgttcccggagacgcaagagaagaagtagaataataagtcaaggctgtcctgctcataaacaaatgtcagactcttgtagctggtgtgtttctgcttcctgagtctttatttcccaaaccccagtgaacataagcaataaagctatatcatgctggggaataaataataaatgattcagcctcgactccaggcatgtgtggagaatagatatggacccagcaaggatttatatacacaaagcgtcacgacactcctggtgagaaacttttcctttcggggagaaactaagaaaacacaagtttgtttcaaagtggaacagggggtgattttggaaacaacatagtgttagtcattcagattaatcttcaattcagccctccaagcctcagttctttcctcgcaatgatgaggcccaaagctaactcctctttcggcaattaaagaagagagtgcaacaccacacttaacatccactaacagatgaggtaccagaagcttcagcgtagcctagagacagcacactaggcatagctattaaggacccaccttcagacatttgcaatcttgtgttgttaaattaaataagcaggagaccattggcctgggac

SEQ ID NO: 5599 - DNA, 300 bp, Homo sapiens
tgggttctcctcggtgcctgatgaatctcaataatgcctgcacaatgctggacacagaggtcttactctatcacccaggctggagtgcacagcagtctcgacctcccaagttcaggcaattctcctatctcagcctcctgagtggctgagactacagaccagcttttgctcaccttgaatacattaggattcttctgctcaccttgaatacataaggattctggtctctgctgtgggtaactcaagtgccaataagtatcatggagtcatgttttaaataaaagcttcacttctataaaa

SEQ ID NO: 5600 - DNA, 717 bp, Homo sapiens
tccagattcccatctccactactgttcattcatgtttgctctgcaaggatctatctgtccatctctgcctaggaaatgactattccgaattcaaggcactcactgaacatgtgctagatgagaactcaccatggaagaagcactgggtactggacaaggggcaagatcagcgaggaggaaaaagctggaagacagaaggcagcgtatcttctgatgaccactccaaatggaaatatcatttccaaaatagactgtaagctccatgagagcagtaacagggtctgacttgtccactgctggatccctagttgtgcttggtacaaagtagcagagcaattattgaactcttccaataattgctactatgtagctcaatagttctttttcagtgcataaatacatgtgacacaccttcttttattcatttttttgagacagagcatcactccgagcacaggttatagcaaaggctgccgcgacctgttattcatacattccccttcatcctgaatcccccccatcatcccccgcgtcattccccccccccccgccacccgttgaatttcctcccccgcttataccccccttattcttcgctctccccccccccttcgccccccgccgcttccccctattccccctctctctcccttgccacctccctcgccccccttctcacctcactcatttccccctcaaaccccccccccccccccg

SEQ ID NO: 5601 - DNA, 466 bp, Homo sapiens
gacacacccagtacttggaaaatgcagcttccttcatggacagagtcaatttcactgacctgccaggaggtcagcatctgctccttgtctgttccattagtgttgaaaggtttgcacaaatctatttacccgccctcctttccctgtgcccgttatgacaaaaaaaaaaccggagctttgccagacagctagccaaacctccactgtcccctggctgtggaactgtgtccggagatggttccttccggtgggttcttggtctcgctcacttcaagaatgaagccgcggaccttcacgacagaaaagttctccaagtccccaccggaccaagaagtccaactggcttcacctcccagaacaagccaccaaggaaaccacctggatcacacagaaatcacacgcatgaccctgaccttagtcccttctcaacagaaaatttaaaataaaataaaacaacctctcaaaa

SEQ ID NO: 5602 - DNA, 749 bp, Homo sapiens
  misc_feature (1)...(749): n = A,T,C or G
tcctggagaccaggcttggagtacagtgacatgatctcagctcactgcaacctctgccgccaggattcaagtggttctcatgcttcagcctcccaagtagctgggatacaggcatgcaccaccatgccctgctaatttttgtatttttagtagagatggggtttctccatgttggccaggctggtcttgaactccagacctcaggtgatccacctgcctcagcctcccaaacagcctgggattacaggtgtgagccaccgtgcctggccaacgctcattgatttttaaagaaaatctttcccaagtttgttcaccgtacatctgatacacactttcacaaccagatttgggtttctaatattaacttctactgaaagccaccatttcctcttggcctataatttctctgtacaggcaccactaatgctcactattacaattaacccttggcctgggctactctgataacaaactgcggagaccacccccttgaggaccaccccccccccccacataccattcccccccccccgttcccctcttttttggtctacgcccctgcccccacaccccgcctcccttgcccgtacccccggcccgtatgcgggggacccccctttaccgcgggccacaaacccgaccccgccttccttcacccgtccgcgatcgacgacgcagactgccgccaaacgcacctaatctcaccgcatgcccgccatccgtnccccgccccgcacaccgcgccaccc

SEQ ID NO: 5603 - DNA, 584 bp, Homo sapiens
aaatttcaaagcctctacgttcaagttgttcagcggcaagatgaaagatgtatgatgaaagaaatataatgtgcaaggttctgccaatagttcatccatgggtcgctgcattgtgtactatcaccaagagacctgcatgtttttaataaagaagatgccagcactccatgtggagcaccacatgaaacccttctcattcccttagtgagagacttctgtgtctctcactgctttttagtattctaagtctacagtggtctctccacaatatggtatgttgacttctttcaacctaggaacttctataactatcagtgttctaatttgtgctaaagtcttcagtatgccctctcgttacatagaatgagtgtcctattctaggtattcaacacccctaaaggatacagaattggaaatattacactagaagagttacttgtttatttctctgtcattaaactaattatttgtttgacttcggtacattaaagttttatatatatctatatacaaaacatgaatgtataaatgtaatattaacaaatcttatcagaacaagctgcttataattaaaaaaaaaaaaa

SEQ ID NO: 5604 - DNA, 761 bp, Homo sapiens
catataaaaatatgatctgatgctgttataagtaagatttacatcttcatcatagcttgtctataacctggaaaacttggaaacaacataaatatctagcaatgaggaactggttaaacaaatgatgacacgattatgcaatgaagtgctatgcagtcatcaggaatgatactggggaagactaataacgagagaagatattcaaaatatattaaatgcactggaaagaataaaactacatttcccaggctcccttgcagctgttctgtgagtattctggatgcagccaaagggatgcacttgtgacaaatctgaaacacaagggaagctatcttcaagtggcagccgcacttgccaaacaagctctgacagtcacctgtgctggcagctctggactccacatcctcctcactgctcaccagcgtcctcagggagaggccgccaggaagtacaagccgcgggggtagcgcacaccacttctataaccactcacttgctcgcctataggcaccccgtcacgccgctcatcacaccgcttgccccctcccttgtattcgctctcgcctctccccctgcgctccctcccagcgtacccaccgccatcttcctctttccttgcccccgcgtcccgccccccgatccccgtgccctcacccccccacctcccatcccccgcctcccgcccgtccccacgcccaccttcctcccatcactgccccctgtgtccgtctctcatccgcctccccccacagacctacact

SEQ ID NO: 5605 - DNA, 800 bp, Homo sapiens
tgactccagtgaatgaatgagactcaatcacagctatttatttggaagtacataaaatgagaatctccctttgtactagaaccactgactataaaatttagggatgtcaggggatactatgcttggggagttgctgtgtgacagtgaaacaaacctaaagaaagcacagacaagagatggaaaaaaaattggccaaatctttgcagcgttgtatgatcttgaacacatggctatgccttgaatcaaacatatccctgagttttgagtttatatgatcaaatgcattcttttatttgtatacgctgatctgagatgaacctatattatatgctcctaccaccaacgctgactatcagcacaaacaaatctgacggccctcactgccattaagaccgaagccaaatgggaaagagtaaccttaagcggggcacaacgccgcaacgagcccactcactgccaccaactgaccccccacctcccggcttcccctcccctgccccgctcggcgcacgccgccccccccctccttctcctccccccctcatccgacacctccaccactccactgtgtccccccggccagtaagcctcctccacgactcccccgcctctcccagcgcatccgtctacatctcctctacacccgcctccctgccacctcagatcccccccccaatccccatcccctccgccgctcagcaccactcccctcctactcctcccaacctcacatcccacctcaaccacccgtctgcccctgttaccagctcgccgctccctccgcctctcacacccttctc

SEQ ID NO: 5606 - DNA, 733 bp, Homo sapiens
tgagaagaaccagaaagtccctggggtgagatgaggagcaaagagaaagctgctatggcctaggaccagcataagaacaaaagagactatttgccgaccttggagcacagagcttcattgcaaggataagagactttccaaaatgggaatggaaaattacaacctgggaatcccacattttatctaaaaaaccaaggagttttttgctctgtcaggagaactcccaagaagtgaatggagagcacctgtctggggcctcccaaaggtgtctgttctcaaaggcaccttctgagcccagagggtgcttggtgatcaccatgggtgtcagtagcactttcactttcctctcttgatcaacaaatagagaagaactgcttcgttcctcagatgaacccatttctgcaattccagcatgtgctcaagctgtccaaagttattgtatcagaatgcaagtcacattttactccaaggctggggctactttcttcttactgatgataacaacaaaacaaagcaaaaaaacaaggatcggagaaagttaccaagatcttatcaaacaccaatgccagcagctccttcacagatctgtgccagtgtcacactgcactcaggggactctttgtcagctggtctaacaaacggtaaaacaaccccacacaaggacaaacattacatcaaagaccgccaaaaaaacaaaaaacacggcctccctggcctcagcggtggacctctg

SEQ ID NO: 5607 - DNA, 416 bp, Homo sapiens
ttgtgactacctttactttctcatgatccagaaggaagactagtcaatacgagtgatcaacatagatgtttgccaagctttataagcccccattttctatacatctgccacaaagttagaaatctgcaaacaaagcttatagcatttgtgattccaatagcaagcaaattcaactaaaaggcatggtttttaaatatgaaaattataattatcctgtaaatatagtaaatattatagctttttttattctccagtgtatattcatatttcaaatttgcatttgcaattacaatagcaaaattagaaactttgaaaatattttcaaaataatgtatgttgaaataaaatcattgtattaccatgttaggtgtttatatttgaaataaaatgtgtttggaattgtaaaaaaaaaaaaa

SEQ ID NO: 5608 - DNA, 786 bp, Homo sapiens
cccccccgtcctcgttgcccccgccgcccggcccgtttttgcgccgcgcaccccacctgctgtttggacaacgtcatgcccagctttaattgggagcaccatcttccttcagtttctagattatgtgactttgttgtgtctgtgactgacctcactccatgacaacagggcagtcacatgtctttggctggccaatcagggaacaccattgccctggccccaagagactggttcagtgatgggcacttggctcaagctggatcattgtagaaatccctgggctgtcaatcactcctcaacaggttgctggatcactcactccaggtgaagccagattccatgtcatgaggcaggtctgtgaagagacccacgtggcaggaacagaggtctgtggcctgcccaaatccacctgcgcggatttgaaagggaattttggtcaagttgtgcgctcaagcgaaattccggtcctgacacccgcccctgtccaatcggccttgaccccaacgcccccacccattctcctcctaacgccccataccccctatacgccccgacatgctccctcgccgcatctcacagcgtccccttttgcgcgcgccgcctgctccctattccctctctacccctcctccccgctgccccgatcgtctctcgtcctcccccgcctccgctgccctccctccgtcggcctatcctcctgtcatctgaccaatctcgtcccccgcgtaccccgtctctccctcctctaacactccctacacgtgccgctcttcacgctatgcctct

SEQ ID NO: 5609 - DNA, 728 bp, Homo sapiens
ttcttgccctgattggaaactcaacttatcctgcagcaaaggtaatctatactgcttggctccaagctgactatatttgctgattggattacatactatcgacttaactacgagtcaaggaaactttctttcaaattagctagagctttaaacaactaagtaaggtatactcctgtgaacaaaatttggaacatgtttgtttctctctgcctggtttctctagaattcagaaactggttagtcaagttcgacttgcagagccagtaaaagcctcctggaaaaccggcctcataccttgtctacacagcccctgcacagggatcctaacctgcgaggccatcacgccccaaatggaaaagaaaatggaaccacacattaaaggcccctttcttctgaggacccttataccacccctcgccaggaacgctacctcctgtccctcccaccatccttccctcccccccctcctcgccccgctgatcaccgtccctccccccttgccccctctcaagtttcccttctcaccccccgactgacgcccccgacgccgaatccccgctgcccccctcgctcccctcgcagtcgtcgtcctcccgtccactccccctcgccctcctcgcgtccggcctacccctctctcgtccaacccccgatcccccccatatgctcccacctctcttcccccccttatcctgtccttctccatccgcctcccaccccgtgacccc

SEQ ID NO: 5610 - DNA, 819 bp, Homo sapiens
cccgaaacccggcggccggcggccgcgagccacccggccggcgtcccggtagcgacggttacggtgacctgctggctccttaggaggactgcttccaccacaagacacagttgaactaaattccactgaactagaagttatgactgccacccaaccactttgggctccttatgcctctgagtcaacaggccaataggggagttatggtgttggctggggtaattgatccagactaccatggggaaatgtgacatacaagacgtaacaaagaatatgtctggaacacaggacatctcttacggtgactcaatattaccatgccctgcgcctaacgacaatggaacactactacccccaccaggcgagactatcaatggccccaacctttacgaatgagaggtggccctacttcccccgcaccctccacaattctcgactcctctccgttaagacgctccatcctcgtgttgccctatccgaacgacaacccgtccctccgcgcgcctctagcccctccccctacgcgcaaccccgttcccctccatacccctccctatcaccctgcttttcacccggcaccacgcgtcacatctgcccggtggtcgtactccccctgttcccccccgcaccacttctcctcctcacgccaacccccttcacctccccagattgtacgctttcctgccctctccccccgcgtcccacccaagatccacccatcccccccctctgcgcgcccccgttcccacattctataaccaccacttacccacacccaaacgctgcctcgcccctttcggcccttcctccgtgtcacgc

SEQ ID NO: 5611 - DNA, 757 bp, Homo sapiens
ctacaagcctcaataggagctaatctcagtttaaattaaaatcccgcattgtttgccattttagggtaccttaaaaggaaacattaaaaccatttcttactagtctagtagggaagatggatgtttgcagtgataaaggatcagttaacataccctcttgcttctaatttaataactcttttttccaaaacgataacaacaaatgtttctggcatttttttttgcatttcatgtaattaaatatatatgtatactacccacaaaattgttatttcttactaaaacggttgcattgtttctttcattgctgttaaggtaccatactttatatctgaaaatctcttaaactttcctgatgcctcttccaaatgagtaaattatattagactagaattattgtaaatgccagtttcacttccttttgaaagattaggcaagaaaactctttttatttaatcattcaattgctaattattctctgttcatatttttctgtattataatacttacaatgaggccttggaaaatgctcatttcaaatattgattattatcaggaaaaatctcgtgttctcagaaagactctccataagacctccaatggaaaaaatatctttctgtgtatgtcatagctgcttagtacttaatacataaaaggaaaaaaatgccgccttttcccttgggtttttttctttcttgacgcccccgaacatgattctgtgcctgaatttctgcctcgcctctcaacgggtctaccc

SEQ ID NO: 5612 - DNA, 570 bp, Homo sapiens
tctgctggatccttagggaggactgcttccccagaagacacagttgaactaaattccattgaactagaagttaagactgccatccaaccactttgggctccttatgcctctgagtcaacaggccaataggggtgttatggtgttggctggggtaattgatccagactaccatggggaaatctgacataaaagaggtaaaaaagaatatgtctggaacacaggagatctcttagggtgtctcagtattaccatgccctgtggttaaagttaatggaaaactacaacccaaaccaggcaagactatgaatggcccagacctttagggatgaaggtttggtttacctcccctccaccctcaaaccaaccttggccttctaggttaagaagcataaccagctgaggttcttgctgaaggcaaagggaatacaggatgggtagttgaagatggtagttgtaagtatgagctgcagccatgtcatcagttacagaacagaagactgtaattgtcatgaatatttcatccctattttttttaaataatgtgtgtatgtacacatatattaaacaaaa

SEQ ID NO: 5613 - DNA, 388 bp, Homo sapiens
ggacgacgtcaacttctcaagcgaataatttcttctatagagcctgctaaacaacaccaacggttctggctctgttacccaggagtgtggtggcacgatcttggctcactggaacctccacctcctgggctcaagtgatcctcccacctcagcctcctgagtagctgggattacaggcgtgagccaccatacccagccctaacagtgaatcttcaccttgaaaactcaatgacaaatctccaaagaggaaatacgttctttaataatcttcatctcagaaatgtacacaatccaatgtcttggaaattgatacaaagaacatgaattactgttcttactgtatttggttcaaaattagagttgttttttataattaaaaaaaaaaaaa

SEQ ID NO: 5614 - DNA, 585 bp, Homo sapiens
cctgctggatcattgggaggactgcttccccagaagaccagttgaactaaattccattgaactagaagttaagactgccatccaaccactttgggctccttatgcctctgagtcaacaggccaataggggagttatggtgttggctggggtaattgatccagactaccatggggaaatctgacataaaagaggtaaaaaagaatatgtctggaacacagaagatctcttagggtgtctcagtattaccatgccctgtggttaaagttaatggaaaactacaacccaaaccaggcaagactatgaatggcccagacctttaggaatgaaggtttggtttacctcccctccaccctcaaaccaaccttggccttctaggttaagaagcataaccagctgaggttcttgctgaaggcaaagggaatacaggatgggtagttgaagatggtagttgtaagtatgagctgcagccatgacatcagttacagaaaagaagactgtaattgtcatgaatatttcatccccattttttttaaataatgtgtgtatgtacacatatattaaacaaatatctttgtttccttaaa

SEQ ID NO: 5615 - DNA, 379 bp, Homo sapiens
caggtgtggccctcttgctcacaaaacagcaaacaacttgaaacaaaacctatggctggtgaggaaaattgacttcctggcaaagtgatatcaggaaacccatttgtctgcaaaaggaaacaactctatctgcatggcaaagatgtctgctgtaaccacaggaaaagagtcaagggaatgtccatgtatgggttctgcaatgctacagaagaatatttccttttgctcttttatttttacctatatctagcttatacattataaaattggttccatgactaaaatgagtcacatctaaattctactacaaaatgagtccattcttgcacatcttctgataccaattataacacttggtggaagtccaaaaaaaaaaaaa

SEQ ID NO: 5616 - DNA, 734 bp, Homo sapiens
gtttagagctgacttcatgaacgctggaaccagccagttgcttcagtgccagcaggagagaactccactcactcagatctactgcgttcctccccttgcagaagtgagcactcggattctgcgttgtgccacccagattcccattcagaaatagaggacttgtagccccagctggacatgagattatcacaaggcctccggttttttcatccacaggaattacctgagctgacaagaactacctcacacaaagccacaccccttaccttgggtggcccatccaaagactgatcaatgtcagagtaataaggacctgcctcatttgccttgattgcaggccactctagacttccatctcaacatcagagctccatctggggtcaactgaagctaaaattaggactgcatcacagctcaacttctttctctgaccagccctatttccttctcttttcctccacaggcggcgatctcaagaacactgcccaatcatccccctgcacaccacaatgcccgcttgtgaagacactcgatgccggtaacaaagaaataccgctctcttattcttacgccgcagcccatactacagaattagtcccccggcaacaatgccgacacattgctcacccgccatgtccccgcagccgacttccctttaccgcaacgagacccgccccggtgacgctatcctatccctccgccacgcgattgtctccccacctttctacgccctc

SEQ ID NO: 5617 - DNA, 619 bp, Homo sapiens
ttggcacagtgacagactcataagaggaaccgagacataaacctgcctaggcccttgcgatatgacgatcatatgatcacgctcaccacggtctcaaggaagcctacatgtggaccagccatacaaaggggaaggaaaggaactgaattgatacctatccctgcttaagccctgaagtgaaggaaatgtgactaatgatctgggaagaactggatcaccgtgcgattttgacccttattgtcttgtcatctaacgaggatcgttatcaagtggaccacgcataaaggctgatggtaattgcacacgctgcttatagatgctcctttatagtctggttgtgactgtcctcatacgcatcacaagacgctctgctttggcatatacttgactacagggagatagatccgtgatattgctataccgcctcgttaacgaatataaaacccatagcgatacacattctcactgccgccgtttcttctcctacacgtatattctctgcactctcgttatttggtataccccgcggttcgctgtgttgacttaattgtctactgatgtaatactctagcccagattcatatatcgctatcgaagcccgttggcttcccgttcctta

SEQ ID NO: 5618 - DNA, 724 bp, Homo sapiens
ctgtcatctgcaaaacagagagatctataaaaaaactatcatagaacaccaggtattccacagctgtttaagctttaaatctaaaagtaaaatgttcatgacacttgcttgaaaagtgagttacagaaataaatttaattcaaatgcctcttttttaaaaattagtttcgaagcctttgttccataatagatggcccgatacatgtgcaattcactagttgcaaacatttggggattctgggttacttctcttgtggaccaaggtacccttgaataaactgaaatactcattcagtaaaatgacaccccagagtcagaagagccaagggagcactgaaaagcacctaaattattattctcaaccagattctatctgaggctaatctatctggttcatacataaaatgagtgtaactgaaatctttgaaagtctgatgatatataatgtggagaatctggcttctaaagcagacttatttcttaattttgaaaataaaacaggttggctcactagtttttatacaaagctattatgcatagtctatccactatgtgctaaataacaaattgatcatagctggacaaacaaactctctaccatcaaggaaggtcttgaaaaatgttctacggggcttcacgagtgtctgaaataaaccactcgaagagaggacgaggcgaatgtgacatgccctctgctctagaaagaagcaggcctcatgagagg

SEQ ID NO: 5619 - DNA, 724 bp, Homo sapiens
tctgaagaaaggaatatccccaaggacagccagaaacaaaggaagcaaggggagacgactagccccagacctggaaactctgctctgtgatttagccaaaggagacatcaaattgaagtggcggttccatagcatcatgctaaaggaggtttgtttcacaggtttcctgaacatgaacccctagacagccttctcatactaccaagatattccctttggtacatcttccattcaggacaagtggccctctgattgtttcctagaacctaggcaaactggggcttattgtgtcatccagtgctgaaaaggaaggagtgacctaatgacggaaaaagatggaaaatcataaggaaaatgttaaacaatctctaggcaaatacatccaattaaaaaaatggaacaagacaggtgttaaaggaaaccaaataaggtacgagaaggactcggttcttctatatttgagtgcttgtagacaaactgcaacctaacttaatagaacccaaagattggatcttctgagaacatcagagaaagactgtctttgccatccacagcgcatcagaacttcacgatcttgaaccttgggttcataatctcataactgacaggggtctatccacactcttgtagctgcgcctatcttggcactcctagaagacaagcccactacggaagcctctccaacaataatgcatcctgtgtgtgaacgacttcccctacgact

SEQ ID NO: 5620 - DNA, 835 bp, Homo sapiens
gtttcgaacagcacacaaaaaaacaacaaaccatctaaactctacgttggcatttcatctcttctatatcccagataacgcccacccacgcctctcagcaagtatcaaagaactgaaactcaccagatcactgcaccaaggcaatgagatgcaaaatccttcattcatcatgattgcttcctggccccaccatagttcctgttttcttacacattgttacattccttctctgtcatgtcaacccctaattttagttggccagggagatggacttgagactgatctcccatctccttgagtgcagtacaggattaaaggcttacttggcacttccttagcattactttacatctcaatcgatggctttatgtgtggcaagcaacaaaacctagagcaaactcctggagttttggtacaaaatgaggaaaaccaaatgattatgactctgacaatattaaaatatactctatttgaaaaaaaaaaatagcgtctcactggactaatcggcggacctctgaggacgcttacctttaaggagggcccaatcatgaacctagctaactgactacatgaactcgaaccaaaagctgtcataagcggcttcacctcactcatacgccgcactactgcccttcgacgttccacgtgcatacctttgaaacaacattccaccggattgccctcccaccgcatcgaaacatataatgccgccctcatgacgaaaatgatatgctccgacccacgacaactttccaaacagtctcatttccattctatgttttctatcccctcgccactgtcatgaaggcgagatccccgacttaaatttatccct

SEQ ID NO: 5621 - DNA, 439 bp, Homo sapiens
gatacaactaagactaatcgtccatgctgcttcattcctcctcgctcttcgccgtactcctcccgttaatccaactggtcacggtggactttactgcctcttgcgggacagcagcaggaatggcagcagaagccgcaactctgcgggtctactttcagtgacacagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcaggcttatgattaaacttccttctctgctgcaaaa

SEQ ID NO: 5622 - DNA, 709 bp, Homo sapiens
aagaggcaaatttgggaaattgaaatggaggaggaagcaacaggccgcagcgagagggcagaggtccttgcggctcttctctagggtccgacgtagatccagacaggaaagtcagtggggcattctggacatgtcgtcgcaccaggctgcagagctggacactgaggaaacccctccagaaagaaagccctacctcccgacccactgcaggtgactagaggactgggcagatgcccttcagaccagacggagaggagcacttctctgcttccaagtaacaacagctgctgttgaggaggtgtaatgaaaaccgcacctaagctcttcacccagcttcgaaagctagcctggatgttttcaatctcagatgctagacgtgttttttctctaaaattgacaatggagagaattttttctcaccatcaagggagagcatctgtggatggtgtctgaagaatgataccacgcttgtgatcttcttattttttcggaagacaggggctttatctgacacccacgctggaatgcggtggtgcataactgactcactgagaactagacctactgggtttgaaagaacctgctctctcggacttccgaatgattgggattacatggatattccaccacacattgtctaatctcagcatatattgtattaatggtgtcttatcacgttaagccgttgaagggaaacatctgtttccac

SEQ ID NO: 5623 - DNA, 804 bp, Homo sapiens
cgtttatcccccttatttctctttccattacttcatcttattctctttagcatgtggcttctctttggggatgaagttgcagagatgtggcaggaaatagcactcgactttgactgagactctcttggatttgtgtcctaactcaatctctctgagttctggtttccttgtctgtaaaatgtgaatagtaacacctgcctgacctacctcaaagtgtttttgagagtagcaaaatcaacccgagttaatggagaataaaagactttgtcaactctaaacacatatattcccagatcctaagtggagaaagaaaaacacagaccccatgacaaagacacaccgtgaaacccagaatctatgaggaagagagttaacatgatgggttaagaaattttgctttgaggcttgggacaatgttttttgttgtttctgaccgaaacccttgttcttttgcgagcttaatattatcctgcccaatggttatcttcagcattgcccttgatgcccgtgcccccatcgtctatgaagtcagaatcagacgtctatcttattattgtcccgctagaatttcccccctttcaccaaccttattaaatattccccttccacgacggtttccgtaattatccccccgcactgacaactttgcactccccccataccctccgcaaccccccccatccctcattttaaaacgacgcgcacttgcccatctacccccgaagtgggctgttgagtccgtaacgatcctgcggttgcccgttccccctcctcttgttcattgccgcctttcttgccgccatc

SEQ ID NO: 5624 - DNA, 743 bp, Homo sapiens
gttttgtacgcataaagagttcattaaaggtctaccaaagtacctcttttcagatgaggcaagagcagcaaacaaatatctatcctcatatcatgaaagaaccaaaaagaaggtctgaattttttttttaataaatgagttttctacctgataagccttgtgactgatgccatatgctaatggatttgctctcatccgtacataaagataagtgtaacttatccacttcactgcttcttccacattagtaactgttcccagagcaatctgcaaatcaaaaagatgacagaaattaatgtattaaagttgaacataaacattacatcaaagtccattctgtcagaggtgaagttttaaaaatacatcattatgcagtatttttaaaaaggtaggcataatgactggacacaacactttgccaattaattaaaatcagtcctgcctcatttaattgagaatgatacatgagaaatgatatctttcagaactgaacttactcaatattatggcagacaattatttttctttatgaggagtgtaattgtacatagcattgaggacattcggtattgttgcttcttatacagtatacaacttattttagtaggattatatgtgactacactgatgaaaaatgtacgtgtaaagtgcatggttgatagaacaccaagacctgggacagggttgcattgctatgataatggggagaacggaaagaaccaaaacaacccgcggtgataatt

SEQ ID NO: 5625 - DNA, 290 bp, Homo sapiens
tgaattacgccagcacgcgccgacgaaaagacacatattttccccacaaaaaaccaacactttctttgctgttgcgctcactcaactgcatagctgccttgtcctgggctctgaaatcaaaaggatgcacaccttttcattatactcttgaacttgagacatgaagagaaacttcagattcatctacgttaagccctatatattacagatgaagagaaacaccccattcaaaatgatttcccattccctctacataataaaatgagattggcaattcaaaaaaaaaaaaa

SEQ ID NO: 5626 - DNA, 762 bp, Homo sapiens
ctgatatgaactggaattcctgtcctctgcattgatggccccacctttcagggtgaaaaataccaaaaccaaaatagaaaaagaaaacagaatagagtaaagaggtaacaacaacagaagaaaaacaatgacaaatcattagagacatatgaagaaggataccaaagaatgcatctgccttcagcaatttgttcatgtctatttcctcagtatctctgcaatctcaacactcctatgccttgaatatcaattctgtgtgtgtcatcagcagcttcatgtacactcttttgtgtcccattacactctttttgttagggacaaccataccttagtcttccaaaataaaatcaacttctgttttttcatcttagttgtctctaatatctaaaatctcacataaattgtgcttctatgcatgaaaatatctggcagattgcttattttccacgctacgaggctgttctcttgctatatgatgactattgttccacgacattcgtctgatcgtgctcttgctcctggcggccgcttccaatctagacccagcaccactgccacttccttgtgctctgccgcaccccccctcccttcctcgactcatctctccttctcttttacgcattcatgtatgaagtctcctcatcccactctccgcccgcgccttctctctgctttctaccacctctccgctccctcacccgcccccccgttgcttccagacttaccccccccccccccatcccaccatatcgccgcctccca

SEQ ID NO: 5627 - DNA, 769 bp, Homo sapiens
tttgtgggcgggaactggagtacacaaatgctggaatcagccggccattctggcacaggcagtggtgaactctactcactggaacctgctgcattccaccccttgtgggagggagcatagaggctcccggtacaagcttaggatcatctgaagagaaattcacaaaaagtctgtttaccaaaggatagacatggtataaaggaaacaaaaagagacaaatctatttctgtggagctgttctcatcctgagccagaagagccagaggaggcagcagctactagttgttggaacccaaaaagacacagatgtagctaggtaagctggtaaagatgcctgggaataaatgcactgacctaccttacttgcttcactccttctgatagagtgcaatgaatgagtacaaagaccaagagagaagcagacagacacttctgtcagaggtgtttcagccagagcaactccatcttgaataggagctgagtaaactaagacttacacctactgggctgcattcccagacattgacaaaagccacaggatgaaataggaggtcagctcaagatgaagatcataaagacctggctgagaaaacaggttacgaagccacctaaaattcaccaaaaccaatatggcattgagggtgacctctggtcatcctcactggtacactgccaccagtgcccatgacgtgttacaaatgccatgacaatgttaggaagttaccctatggcgcctataaggggaaacatgaattatcactcttttttg

SEQ ID NO: 5628 - DNA, 359 bp, Homo sapiens
ctgcacctccacctcccaggttcaagcgattctcctgcctcagcctcctgagtagctgggattacaggaacacttgaccagtaaagggaaaacttcagtgagcagatgcacaacttcagtaaacacactgcacatgtggcccctcccaagttctggcaggccactgtgcatgcagacagcccattccgagggaagaatcggggaagaagaaacaaaaaccctggaatcataccaatgtataaaactgcaagtcaagagtcccttggctctctcaagttgcccacctgggcctcttacaagtgtacttctgtttgttcatgctctaaaacattttaataaactttcacttctaccccaaa

SEQ ID NO: 5629 - DNA, 234 bp, Homo sapiens
ggcaggggttttgaaagatacatagatcaccacatccagacaatgaaatccctgaactcttattccttatgattccttccttacctctccccaattcctattttccttcatttagttatatttcttcccagctatataaaccctcatttttagctgggacaacagagcattttgagacttatctccctttctcttcagcttcagcacctgaataaagacttattccatggcaaa

SEQ ID NO: 5630 - DNA, 734 bp, Homo sapiens
tgttcaaactgtgctgacaactccagttctgttccagaactcacctttgaaggataagaatgagtagatacattcctaactgatattagattgctagctcctctctctgaagacaagtctgtgtcttaatttattttttgatctcttagagcctcattcatgtaacatactgaagtacatgtagagtagaatatgttgaatgaaagggacctttttcttgtgattttccccaccacaatgactaacatatattgagtgcttattgtgtattagaaacagttctaagtgttttacgtgcattaaatcactcaatcctcctaacaacctggtaaagaaaatacctttattactccctatgtatgtgcaaggaaaactaggcacaaagggactacataatttgcaagactacaatacagctaaataaatcacagagctgggattgagtcccaggcatcttgctggctgtagatgctcctgctgacatcactacgctgccctgtctactatctgaaaggggtgtgtgtgtatggtgtgagtgagggtatattctgcctacagattactaataacgtatggggccattatgtatcatatgatcttccctttcctcttggaatctattgaacatattaaactctacttggatatttgggaacccgtgcggtccatagatatgtcatgtccgtgccctccgtccataaagctttgtactttataggaacaaaaaaagtggt

SEQ ID NO: 5631 - DNA, 789 bp, Homo sapiens
tcacacaatttaaagaaagacattgaagtactttttactgttggaaaccttgcagagcaagaatttgtaaccattgcacgttactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaatacattaaaaggctgtgcaaatactgcacattacctttgagcgatgatcttgtagaatgcttattgccaaggtttgaagacagtgcaacacccatagatcgttagcaatttttatccgacctgcaccgttcattgaatcctttgctgtgttttgtcctcccccctttccccctccccaaagatccgcacatcctcctatttgccccgcccccatcctctacccatctccacccaagccgttcatcatcatacccataaccccccaccctcattactttgccgcactatacgtcccacctcccggtcccacccatcccaccccgcctctctttattcccgtcccactccttccccccttcccatttctattgtatattccccactctgtactccatccccccctccactatacaccctccctccgcttcgcctcgtccgctcattgccttcgatattgtcccccctctctctcccctttccccctcttccatacccaccgaattcaagccttctatcatctcacatcatcccccccccaccaccgtgcaccca

SEQ ID NO: 5632 - DNA, 295 bp, Homo sapiens
cgctttttctgtggtatcagagttatactgattttattaaattagagaatcttctttttaaaataacattttcgaagagtttggaagatataggaattaattgctttcttaaaagtattcaattgatcctaaaccatgttggggagaacttgttttctttttacttcttacatggccatgacattttcccccatttgagtcttgtaatttaatttaatttaaaatccatcacagttcttgtttggataacaggaagcaataaatgtggcactttgggcccataaaaaaaaaaaaa

SEQ ID NO: 5633 - DNA, 324 bp, Homo sapiens
cagggatggaaaactgcctcccacaatccctgcagaagtgatcacctaagcaacatggtgacctgcagaagaagagaaagagagggagagaggaaaggagcgtgatgtgcaatatcgggatctgtcctccgcatctgtgacctgcccagacggcccaatgggacacttgaccttgcctcatggtgctgtggtccaatgtatgactccagcgcaagatgagcctgaggaagggtggcacttagctgggtaggatttgtgcctacgtgtgccacatttcttggataaaaattaaaatggttaataacctcctaaaaaaaaaaaaaa

SEQ ID NO: 5634 - DNA, 259 bp, Homo sapiens
cccattacatttcttccctttcacaactttatatattaaggtagcgtgagctggatttcttccacactttaacacaaacagcacatcacgacagacaccgctttaagcagagaggaaaatcagcaatcctttcattaaaccagacactaaagagatttacaaaatatgtaaaacaacgacgttctcagcaaaattttgttttggaaataatgctatttttcataaaaacatgttatgtatgtttgtaaaaaaaaaaaaa

SEQ ID NO: 5635 - DNA, 576 bp, Homo sapiens
agaactgaggcttggccgttgatatgatctgtccatggtcctgaagacagaggtgccaaatgatgacgctttttcatctctgctgtttctgctcctggttcatcccttgttctgcccattccatttgtggacaacacaaaacacctgggatttctctaccctattcttcttatgaacatcgagcgagtacaaccctctggggtctctactgattccctgctcatatcccctttccctccacatcagactgtctgcatctcccaagacagaactcccacatctcccaggagctccagctgcagcttcaactttcagtacctagcagctgggcttactccaggaagacactggtggaatggagagagcagagacttccagttcaaattctgactccatcactccggcaaatagctaattcccctgatcaccagcttcctcaaaggtcaagtgaggacaattgttatacttcgcaggattgctgcgaagatgtgagagtgcatggaaagtatctggttcaggtacctggtgcaatgtgggtgctcaataaatgctcattacccttcaaaaaaaaaaaaa

SEQ ID NO: 5636 - DNA, 805 bp, Homo sapiens
agtgctcgaagcgtcaggacagcacataccaaattcatcattggaatcctcaacatctagcacaatatgcctggcataaggtgaagagaagaagagtatgaactaccacgaaactcatttccctccgtccttcaatcaaatacaatgaccttcagctactctcaccattctctactgaaaacatcccaactatctggaaagaactcacctaaagttccccaacatcaaataaaccacgttccaaaagattcagagccagagagaaacaaaacgcccattgttgatgaagcattaactcatacatacatacaagtgtgtctatatatatacacatatatatatgtgtgtgtgtgtgtgtgtgtgtgtgtgtgtgtgtgtgcgtgacaatacaaaccatccccccccactaatccccaatccttcctccttcgctcttccttgtttccctccgcgccttcctggcgcgtctcccttccaggcggggttctctcatcacctttttcaacatccccccctgccttgttcggtcttgtggggtgggcggattcttcccgcttaaacgcggcatatccctcttctcttataatccgcggatacccgtttgatcaaccacgtgtcacacgccccccatatccgtccgattctgtgctagggttgccgccctgcttgcagacctctcgattctccctcgattccaggttcgagatacccccttttcttcttcccttccgtcaccccccgcctcctttccttcgtttcgcgtctttttattcctactggttcttttttcccgcccctcaccccc

SEQ ID NO: 5637 - DNA, 789 bp, Homo sapiens
atgtccagctaacagactctggggatgccagcggctctagggactctgttgttctcacgggcctggaagtcattttatctctgggttcaggggacagctgtttgtcttctacagttcaagtgctcaggcctcatgctagcaaaagcagcctgctcccatccaaggatgtaaatctccctccacttgatgcctggccacaagttgctggagaaatgacctgactgtcagattctatctgacaatctgcagatggaatccatagccccagcacaagtctaaacactgcaaaggagtgtgacagctggcgcacgggcaagtccaacaagactcaagcagtaagagcttctggacaatgttcaaggacaagtctacacaccaggggccccacctccaacatcattattctcccctgcctagcactgactggccaattttatccagccatgttgggagaacacccacacatggggagaggagggcctcttatttgtcaagcaagacttcctcctccactaacagccacaaagttgagtctttgccaagaaatcttgcacacctcagacaccagagatctcaccctgccctgcttgaaaaggataaagtcatctttggtatgaaaacattctgagaaataaaacctgtgctcctggagaaaagagagcagcacagaccaggtccaatttacagggaacacccatatgtggtaatctatcgcgctcctccttggcgcagatggaattttataactttatggcccctgatccaagtattcacattcgcccactacat

SEQ ID NO: 5638 - DNA, 546 bp, Homo sapiens
ctacttctccgattcttaaatgagaaatacaacactcaagagggaaatttatacgaaaatatggaatcatctgttgctgtttttaccatcaaaactatgtgggttttgttcagccagcagtgacatcaatgcatttgcagctactcttttcaggatatctttggaggatttcccttcatagcactgcagagaatataaatcaaactgccttgaagaaatatttaatctggagcaaaactgttgtgaataaagaacattttctacttaaaagatattgctaggtttcaactatcatgtgaaattcactggattttgataaatcattaatatttgagaatgttctgcgtggataagactgtataagttgcttataatatggaaaagaacaacaatcattcttaaagactcatcatctacagaaaaaagctttatttagctttcacgtagcaagctcatatacttactcaaattcaccagcgcatattgtatatatatgtgtgtaccttattaaaatgggtccttgtaaaactgaaaaaaaaaaaaaaa

SEQ ID NO: 5639 - DNA, 216 bp, Homo sapiens
gagtacattgactgcaactggggaacatacaaggcacttaaacaccacaaagcctggattttcagtgatatcgtccttggaaaaagctctgaagatctctcagctacagttcctgctggagataataactaccatgaccactattcctgatgttcatgagagccaaattcaatgttgtctataaagcattatgtctgtacattaaaaaaaaaaaaa

SEQ ID NO: 5640 - DNA, 482 bp, Homo sapiens
gacgaggccaaagctgaaaccgatgagggaggagagctgaggagaggaaaagcagctgaccaaagttccctcactcttccactgtagacttccaagcctggagcaaaactcaacggggaatgggaagaagttttaaatgagatgagattaacatttggtttattacatcgaactggactcaattacaaaaataaaaagactactacttattacctgagagcaacaacaaaattatcattatttatttatttattacagcaaactcaactcaattactaaaaaaaagactattcatttactacctgaatgcaacaacataactataaaatctccctgagatttgaaaggggtgggagtggagcactatgagctggaacaaatggaaggcgcaggcttgaaggtcagtgggagctttcagcatgcaccctgctcagttcaactcatttaataaagtgctttcaatgctgcgaaaaaaaaaaaaa

SEQ ID NO: 5641 - DNA, 293 bp, Homo sapiens
gcccccccacacccaccacccgaccacatctcccacttctttcctcccttattaagtttccgaggctcactacaaccccagtctctgactctggctctggctctggctctggctccaattccgactgcgtttctggctccagctccagctcgatgtcaagcacacaacagagatgatgatggcggcacctaccaggctaccaatcaaggccccaacaatgattccaacttctggatctgaaggatacaagcagctggttaataaagtggaatatattgtcaaaaaaaaaaaaa

SEQ ID NO: 5642 - DNA, 277 bp, Homo sapiens
accagcaatctttcggaatggctgccatcaaccagtttgaagaccctcacagaagaacccaatcagcatgagaatgtagttcctttatctcccatcccataacttcactttgcactcttcaaccaatcaacagtccccatactttggcccactactctttcaaagtctttaaaatccctagcctcatactccgcggagtggcacatttggggtttcctcccttctcctcatacagctgcttaccattaaacctctttctgtgtgaaaaaaaaaaaaa

SEQ ID NO: 5643 - DNA, 655 bp, Homo sapiens
agctgacaactagtccgagatagttagaggatggaaaagagtagaatggtgcaagaaattataggaactaagattagaaaaagagtcaaggaattcttaatggagcttttatatactatgctacaaaaattgagtttattctggaaataatgacgatgcatcaaaaggttgaaagtggttggaggataaattggatggaacataaaaatattttttaattggaaaatatgaaaatgaggagaatcataaggagggattccaggcaaggaaagcttgtatccaatgcatgttgctgacattatgctctgcagattctcattacaccaagttcttctgtgttcatctgcttcctcaaggccattatccattgcatctgtctcagctcagctgatgctctggcagtggttctctgcgttgagcattgctgccacacacctttggtctttaaacctgaactggaatgaagcttaaactgaaatgtagagggcaaatggtgtgcaaaacaaactttaagtagtagtgattaatctttccaatgaatttttctgtttttagcccattaattttcaataaacattaatgaagtacttatcatgtattagccactatgttacctccaaaaataaagatgatagatcaacgaaaaaaaaaaaaa

SEQ ID NO: 5644 - DNA, 570 bp, Homo sapiens
tgatgtgaggaccatatcactgcatcattatgactgatgatcatttgtggagtaaacaaataacggcatcccaggatgcaccacttccagaatatcttctgtctctgaagccagttgccacattgcaaacatggcaacaaatgaattgatgatagcatctgcttaatctggcttttgtccacatgtcacaactgtaatgttgttaactgagatttttttatttgctctagtctggtttcttcacttcctattctccaaactgagcttaatttaatcaatgttgactgaaaagctgtcagctttaatggtactacatctttttatctttaatgtttaagaaacacacaaatgttgtcttaatctgaaatggttaatttttttgacatcacattaatataccaagattgtgtctgctatttgttaaaaattaagaacttacacttgatgaaattttacaaagtatctaggaagtgtttaatatctgatattcctgacataccgtttttatgctaatggaaaagccaataaagtagtaagattatggctttaaaaaaaaaaaagaaaaacaac

SEQ ID NO: 5645 - DNA, 291 bp, Homo sapiens
ttcccagggctctgcgatcatatcagtaggaagttcaactggttccctgggtgttcattcctggttggagagctgtttgggaggctgggaaggtccattagaagcataattctattccagaggtggcttggcagatggagcatatcatgggttaatttctcagcatgtcacagaaagcaattcctactagacctgaagaaagtggcttctctcttaacagaatgttatcttcttctagagagtaatatgtttttattaaataaaaagcatctaatagtaaaaaaaaaaaaa

SEQ ID NO: 5646 - DNA, 405 bp, Homo sapiens
ggatcatttctttgtgtatatcccattgatgataaacgatcagccttgtatgaagggcctggaattcctttcctctcactagaacatcttgagtaatctcaactgaaatccaggatttgtgactgagaaatgatatgtcaccataagattttaacatatggcaagtccagaatattaacctaagaccaggagtgccttatatggtaataaaaggaaattaaagaagaagaaacacttccaaactcattttatcaagccagcaatgccctgatgctgaaatagacaaaggcatttaagaaaaataaaactacagaccaaaactgcagaccttctaaacagaaaccaagtgtcagcaaattgtagtctatgggctaatcatctataaataaagttttattggaacac

SEQ ID NO: 5647 - DNA, 578 bp, Homo sapiens
ctgctgcatatacaagcagccttaggaaaagaaggctgagaagctgaaggaaatatacaaaaaggaaattactgcataccaagctaaaggaaagcctgccaaaaagggagtcatcaaggctgaagaaagtaagaaaatagaaggaagatgaagaggaggaggaagaagatagaagatgaaaatgatgatgaataaattggttctagtccagttttttttttcttatctataaagcatttaacccctgtgtatacaactcactcattttaagggaaacaattgaaatgtgtaagatttgtatttaaactatacagtgtcttccgtttgtatagccgacccactatcaaatttgtctttagatagccttgatggtattttcaacagactctaaccttgcctggtacagtatgggagttgtaaattggcatggaaatttaaagcaggttctttggtgcacagcacaaatcagttacatgtaggaatgatggtttcttcatcttcagtttgctctgatatggcttgtatgaaataattgtttgttagctgaataacactcagtaatcgcaaaaaaaaaaaaa

SEQ ID NO: 5648 - DNA, 603 bp, Homo sapiens
ggaactgttgtctcactttgggagcccaggcgagcggatcacgaggtcaggagtttgagaccatgcctgaccaacatggtgaaaccccgtctctactaaaaatacaaaaattatctgggcgtggtggtgtgtgcctataatcccagctactcaggaggctgagtcaggacaatcacttgcacccgggagacaacggtttcagtgagctgagattgcgccactgcactccagtctgggtgatagagcaaaactccatgtcaaaaaaaaaaagtttcataatcagttgtaaaatttaacaggtattctcaagggcaaaattctgattagtaactctagagattgtgacattagaatagaggaaaaactttcaaatataaaagtaaatgggtgtttggttttcattggagtatttgtataaatatgttattaatgtgttcaaaaaattatgggacacttctataattctaatatgatttagtatacattattgttaattataattgttatgtaaaattgttgtatgccacagaggtaaccaaaattcctgtcaattgtagccttaatagtgacaatagacatctgtcatccacaaaaaaaaaaaaa

SEQ ID NO: 5649 - DNA, 349 bp, Homo sapiens
agcttggttctacacttgactttgattgcagtatcatccacactccggttagaagacactcccagcatgccgagcccaggagcccacaggagccaaagaaggccccctcccaatctattccaacatccgcattagggataggggattcaaatgtctacagatacgttgggaagaaaagggtctcatgccatcttacttagaaaatgattccctgtttctgataagttactacacaattgtgtgatttatttgttctccttcatgcaataagagaacttggtataaacaaaaaaagttcgatgtcctaatacaattaaagaatatcttaacaatgtgaaaaaaaaaaaaa

SEQ ID NO: 5650 - DNA, 474 bp, Homo sapiens
tgaaataaagagtcatttcatattttcactgacccaagtcatgaggtgaccttggagctccccgtgaatcagccctgagccctgacctgaatggatcacatctccatatgggaagtgaaatagaaagtcattacaatgtttttcctttcaagacatcaaactgaagccaacatttcaatatttttgctttgtcactctacataccattaaagtaagagctggtctgactttatcaatatttcttgtaggacactgaaacaactatcagtcaataacacattttgatcatttcaggcctgggttgaatataaacctgatgtgtaaaacttaccaaataaaactctttatctctatatatttgtgcctatgagctagacagaaaagaatttatttcattctttgaaagaaaaatgaagcaccgcataatcatactaaataaagaatacatttaatttcaaaagaaaaaaaaaaaaa

SEQ ID NO: 5651 - DNA, 472 bp, Homo sapiens
aggtctcccttccttcgacgtgtgcctcttgttgtcctgtaatgaattaatttgaaaagtaatttgttttctgtaaggggaaatgctgtagaagtaaattgattcagggagtccccttactcattggctgtgtggccttattgagctgatattgtctgcttcctaggactgagccaccaggatcaaagaaaggaaatcattgccttcaagaagaacatggttgactcgtgcccatacttgtctctctttcattgagcccatgactatttttcctgataagtcatgccaactggtatcaagtctcatctggatgacatattttgttgttgtcactgttgttttttatctatgggcccaattgcaatttataaataagtactcattttcacacagatattttaagctggttcttttcatgataattgcatcagtaataaagtgaatgaaattcacaatttcaaaaaaaaaaaaa

SEQ ID NO: 5652 - DNA, 444 bp, Homo sapiens
  misc_feature (1)...(444): n = A,T,C or G
gctccgagtctcccttccattttagtgtgcctcttgttgtcctgtaatgaattaatttgaaagtaatttgtcttctgtaggggaaatgctgtagaagtaaattgattcagggagtccccttactcattggctgtgtggccttatgactgagccaccaggatcaaagaaaggaaatcattgccttcaagaagaacatggttgactcgtgcccatacttgtctctctttcattgagcccatgactatttttcctgataagtcatgccaactggtatcaagtctcatctggatgacatattttgttgttgtcactgttgttttttatctatgggcccaattgcaatttataaataagtactcattttcacacagatattttaagctggttcttttcatgataattgcatcagtaataaagtgaatgaaattcanaaaaaaaaaaaaa

SEQ ID NO: 5653 - DNA, 516 bp, Homo sapiens
attattcatttcttttattgagcttgtttccaactccgcatccttcaactgaatctgccccgtttctcagtgtgagttgaaaagacagaactctgcctgtgagctcagcatctcactttctacagaaattcaagttcaaagtgcaaaagtctgaagactttggatcttgttttctcaaacttactgcttcatcactgaaatgttagaccagctgcttttgctggttcagtgtagtcgtttgaaaagtccccagttatgtataattggcatattcacacacattttaatagccagtggcctgtttttccaatgccggtaaggaagtatttatttatacaaccaaagcaaatagtattaggcatatttaccgggcaaatgaatgtattaggttacagtgaagtgagtgtcaagtacacactttaaagagggtgcaaacacttggcaatttaaactgctctatatgaaaccatcaggactgagcaataaacatgctaccagaaaacaaaaaaaaaaaaa

SEQ ID NO: 5654 - DNA, 417 bp, Homo sapiens
cttcttctaagaccaattaaactatacagcatgagaagggataaaaacaccaattaatacagacccatagtcatttgaagaccaagagtactctcacacgtatgttctacagtttaaaaatcaaatgtaaattaaatagtgcatattaaatagtgttttctaaattaatttcttattcaccatttagtctgcaggtttccagttctttaaaacaagtcattttgatatgatttccatgtctgctgtcttttttcccacacacttggctgacttaattgattccagacttcctagcatctcatgtatctgtgttatagactgaaatagaggttttgtttttcattaatatggataaaaaccaatttgtgctcatgtttggcgtatagtaaagaatgagtgttggtaaaaaaaaaaaaa

SEQ ID NO: 5655 - DNA, 281 bp, Homo sapiens
ctgagcatctgaagatatttttggtcatcactgctgaaggtggaaaagtgtatgtgctactggcatctagtgggcagaggccagagatactgctaaacatgctacaatgttcaagacaacccctgaaaacaaagaattctccagcccagaatatcaatagtgctgaagctaagaaaactctgtacttttaaaacatattcttaacaatattaaactattcttatttttactcattttaaataaatttgaatgaattttcttcctaaaaaaaaaaaaaaaaa

SEQ ID NO: 5656 - DNA, 273 bp, Homo sapiens
gagaggctgtattttcttcatatacttcaagtagaattcttcaatcaaaacagcttatcccaatagattaaatgcagaaactaattgtcttctataagccaggtgttaaagagatttgtagaaatagaaaaggatgctactcttctcgttaatttttttgaaaaataatttttaaatcaaaagtacattatttatattaccacataatgggtctattattataattattaaatgggccaataaatgtttcaaaatttctcaaaaaaaaaaaaa

SEQ ID NO: 5657 - DNA, 515 bp, Homo sapiens
tttagggaatatgcagaaaaacttcaatcaatccatctgtatcggcatggagaggaggaaaatgagactgtagatatacgttgctttggatggcaccaatatgggccaggaagcttgcttgaaacaagataaaaatgtgatttggataccaatgaagtgactttctgaatccttgccttcctaaatacaaactgcatgatcctggctctacctcttaaaaatgtagcaatttatttttctcagtggcagatttgaataataatgtttatatgtctataacttaacactattgtgagaatcaaatgaaataatgattagtaaataactttgagaatcattaagtaatttatcaaacatatgttttgtgcaaggcatatgtagattatagtaattattataaacaatttaggcatagttcaaaaccataatgctttttaacaactgacctactttatttcttgcaccaaatacattttcaataaatgttctatatttttctaataaaaaaaaaaaaa

SEQ ID NO: 5658 - DNA, 613 bp, Homo sapiens
aaaatcttcttttatgaaaaaacagcctcaggcaagtccttcaggagtcttcggaagaagcattgttatcataagagacaatggcagcaaggccattgagagtctaaggaagaatatctccaagcaggagtcgctcctcagggcacataacctcaacgacaagagttacacattcctgatttcctctgactatgaatatgtctaacagagggagaacttgtggaagcagcagcagaagtatttcaaaagcttttctctgatgtttgtggagctacagatgttgatcaacatgtctgtcaaacttcagactgctcacaacattctaatgactgtcaacaaagaagatggtgaatctcctgagtattacaggtttctgaatattgtagtccactccaccaccagactaaagcagagcttatgtctgtactgaaccctggagatagatttctattggtgttttgtcaattatatatacttaaaaatttgagaaaggtaatatttcaaataaacaacaaatatattgcctattgaagatgcaacatgcatgcatatacattacttaatataagaaataaaatatattgtgatctttctactcctaaaaaaaaaaaaa

SEQ ID NO: 5659 - DNA, 269 bp, Homo sapiens
aattctcatgttgttacatttcatccttggaattcctctctcctgtgagtgcaacctgatttgagatgtaaataaactgcggagataatgccggagtctcgtcagacgcccagttctcccgccagccgaggatgggagtgatgatgaatggtgccaggcccgctgcataatcttttctgttttaatactcgattatcatgtccctcatcttccctggacccaagactcaacacattaaaatctctttgtttcttccaaaaaaaaaaaaa

SEQ ID NO: 5660 - DNA, 492 bp, Homo sapiens
tctaccttaatgcccagactggagtgcagtgtcaggatcacagctcactgcagcctcaacttaccagactcagagacagggtttcatcatgttacccaggctgatcttgaactcctgggatcaagcaacctgctggccttggcttcccaaagtgctaggattacagtcgtgggccactgcacctgtcctgctatctttaaatgaattaattacgacatttataattttgtcatttttgttttctgaatattaatatatgatcctcataaacaaaagctcttggatgatctatgttttttaaacaatataaagagattctgaaaccaataaatttcagaaccgttggcctttatattttatatgtagtgaaggagtaaatgtgaggagtataaatcaaggagcctgacatatacttaagggtaccatgcatattgcttataatttgaaatatataaaaatgaataaatagaaatttcactaaaaaaaaaaaaa

SEQ ID NO: 5661 - DNA, 305 bp, Homo sapiens
cactgcggagggcagaacccttgtatttgattggcagatcaaaatggcaactatcttgttggaagggcaaaggctgctctgtgtctgtatcttatgatataaacaaggctgcaaagaaaagaacaaagaaggcagaataaaaataaactggaaaaataccacaacaacgaaaaagctcattgcttaattgtaagaatgtaagatatttaattaaattgtctttctgaagcttatgtactagtaattcttcatgtattgttctgagaaaaataattaaaaatgcatcaaaatgaaaaaaaaaaaaa

SEQ ID NO: 5662 - DNA, 209 bp, Homo sapiens
ggagctttctcagctaactgcaacctctgcctcccgagttcaagagattctcctgcctcaccctcccgagtagctgggattacagatactccactttaaggacagtccacattttgtttttccattaaccagctgatggatatctcagttgtttccagttttttaactcttacaaataaagctgctatgaacaaagaaaaaaaaaaaaa

SEQ ID NO: 5663 - DNA, 540 bp, Homo sapiens
tttccagttggagtaatatgtgatgtcatctgaatcccagaaattgaagtcctggttgctatcattaatagttaccaaacatctacctgtgacagaccctgtgttgggtgcgatctactctgatgttccaagcataccacacctcccactaagaatacagcaggggggtttgtacctcagatgctagagccaggctacctattgaatcctgagtctaccacttactgtcactgtttaatctctttgtacctcagttactgtttttgtcaaagtatgctgatatggatatatatcataggactgttatgaagattaaataagtcaatatatgtgctagcatttatatgcttatatattttatctagcattattaacatgaaatgtaaaagataaatatattttgagccctctacaaaacgaaaaacagtttgcaaaaaaaaatctcagatgccaatttattcttaaaaatatgtatgtgaaaatttaataaaattgagattgaataagtaataaaaagtttcacatcgaaaaaaaaaaaaa

SEQ ID NO: 5664 - DNA, 354 bp, Homo sapiens
  misc_feature (1)...(354): n = A,T,C or G
aatatatttcctgactcaagaggagatacgtgnaacactgggaaagcaaagctgctaaatttcctgtcaggaaaaactatctcagttgacattctcacaggcagtatgagtgattctctcatcagtttttattttgatatgtaaaaaatgatacaacactaatttaacttctttttattatttataagggtgatgttttcataattaaactatttcgttcatctttatttccttttgtgaatcaaccattcctgacttgtaaaactgcaatcgttctgctttttaaaaattgacttgtataaactctatgaattaagaaatataatctcatttttgaaaacaaaaaaaaaaaaa

SEQ ID NO: 5665 - DNA, 760 bp, Homo sapiens
tagcagatgatgtcttgctacattgtccaggctggacttcaacttctgggctcaagcagttctcctgctttagcttcctgagcagctagtactacaggcacgagcaaccatgcccaggaaatatccacagagacatcctagaccctcaagaaccttgcatctgtgttcaaacagttgaatttaaacaaacggttgtggaagccggaagttcaaaatcaagatgtcagcagtgtgtgtcagttccttctggagtctcgaggaaggatccgtttgctgcaactcctgaaacctgaagtctgtgactcaccagttctaagccccagagtcctgatggggcacctcaaggagacacttcagccacctaagtcagctggaccaccccatgacacagtcatggaggttccagtctgaattcagagtcaatgataagggaggcttccgtggcagagtgaaaagcacacacctgagaaatgaaaagaaatggcaaaggtcacacgtctcaggatgaattgcactgtgtgtgacaccctagctgaaatcctatcccacaggaccatcatgcggagtgagtcattcattttcctgggctcctccggcatctcatagagacttctgttgtggattacctgctctgggcccaatgatgtgacaccaagtttgcctctcccacactatacactgtgggattctctaatacagagatggcgcaacgaaactttggctggggaggtccggaattgtctcgggcgagtttcgccgg

SEQ ID NO: 5666 - DNA, 387 bp, Homo sapiens
aaagggtcttctgatattaccaaggctggtctcgaacttctgtgctcaagtgattctcctgcctcagcctcctacagtgttaagattgcaggcgtcagccaccacgcctgacctctattgatttttgagtgtatctctatgtattactttttagtggctactctagagatacaatgtatgtaatctactttttcacagtctacttagaggtgatattttatcacttacgtttaccttccccagtttatgtgacagtcatcatagatattgcatctatataaattaaaaccccatcactagttatcatttttattttcaatagtcatatacattttaaagaacataaaagaaacaaaaataaattttatatttacccagaaaaaaaaa

SEQ ID NO: 5667 - DNA, 381 bp, Homo sapiens
tttagtggacacttcgagagaaattcatagcgtatgcatcttgaacagagtatttatcaccagaaaaacagttggagaggattttcagtggcttctttcaacaatgtttactcggcactaaccctgtactgggcaccgaggatacagctgataagaaatattagtccctcatcttatgcagcttatcgtcacttggggttttcaaactatagagtctcacccatagatgggttaataaaatcagtttagtgagctgtgaccagtgtttttcaaaaaagaaatagagtagaccagggttggcaacccacagcctatgagccaaacccagcccaccgcctgcttttataaataaagttttactggaacacaaaaaaaaaaaaa

SEQ ID NO: 5668 - DNA, 286 bp, Homo sapiens
gaatatttctatccttctcatctgcctccctgataccaatgaggcatgggattttctacttcactacctcctccttacggtacagctgtgaactacaaaatggcttagctgatctagagaagacacctcggtgacaaagtaaccactgcccatgttgtctttcatctggcccctttgatttttttattgtcctggaagtcaagtgatgcatgaagctgacaccatgctgatcttgcttttgctctctgtataagtaataaactgtatgaatctaaaaaaaaaaaaa

SEQ ID NO: 5669 - DNA, 299 bp, Homo sapiens
  misc_feature (1)...(299): n = A,T,C or G
ttccgccaacaccctgnattttttcttgtgcaagatccaagaaccctttcttggggtctggatcaggactcctttcctgtaacatctttctggcgaccactgaagggatgatagtgcggaaacccccgacccaaaggctaatttttggtcacaattggagaaactggctattttaccaaggcttcgactggaatggcataccttaaggaatcatgtaaggaatcatgattccttaaggaatcaaatttgacttgtagagccaataaatgccccttggagaaaccggaaaaaaaaaaaaa

SEQ ID NO: 5670 - DNA, 692 bp, Homo sapiens
tgcaactgaacatacagactgaaattttcatctgtcacttattatgcagtcacacagagatgcagatccattcagctcagcatcactagtgctataagaaatggggcaataattctgaccaggctctggaaggactcagagcgggaaggaattggcccttgaagcctcttgacaggtctgttagatcctgacaggtgggtagcaggaaacaggcgagtgagtctaggtgtattcaggaaggaaaagcagagaagtttcccagaagtctgtgagaaagaggcaggaagtagtctgggtgcaagtggactgagttttgccactagtgcagtgagccatgcactgtatgtgtgtcatgcatggcaagtcccctcagactttgacaaggaaagcagtaccatctctggcaacctgggattgggggtgattccagaagcagggaacattttttgaaagctgctataaaaatatgaaagaacagcacaaaaattaaaatatacacctacacacacacacacaaattaattaaaagaatggcatagaggggctgtgcacctcaacattggcagtagggatgatgaaaatgtgcacccagccatccatgcttgaataaatgttccctgtgtacatttcttttagaatggccacctttaagcctttttccaggtaactccatcttctccttttctcttcca

SEQ ID NO: 5671 - DNA, 260 bp, Homo sapiens
aatggaaacagtatcgtatcttgtagctgaaagttcctaaaaacctcagccgctccccacctctcccaacacagcgaagtcaggacttttaagacgaagacctgggatttcgcgccccgggcaaaacgtctcatctgcggacacgcgtgccttgttctggcagcaccctgggaatccttcccgccaaacgggacaggacgatctttttgaaaagtggcttgaaatcctgcaataaaaatcaaatcctaaaaaaaaaaaaa

SEQ ID NO: 5672 - DNA, 370 bp, Homo sapiens
gagttctcatgggcctccagcttgcagagagcagatcatgagactcctcagtttccataattgcatgggccaaaccctcatgataaatctttttctatatatctatatgtcatctattgattctgtagatgagttttgtttttcttgaactttgtatacatggaataatatagtttatattgtcatttgtttgtgaaatttatccatgtctttcacatacaaatagtttcttcattatgactgcatattattgcatgaatattaaataaattatttatccattctctgttagtggacatttggattgtttctagtttggggccattatgaataaagttgctatggacattcttgtggaaaaaaaaaaaaa

SEQ ID NO: 5673 - DNA, 884 bp, Homo sapiens
  misc_feature (1)...(884): n = A,T,C or G
tttccgaataacccgnatactgnaaactgnacancatgtgnnacaatttatttncgtncggcttttgtaatnggatctccattttcagnnttgcgtatctttaaaatcacaagctccagtttttttgtttgtttgttttttgtttttgtttctttgtttgttttgagatggagttttgctcttgtcatccaggctggagggcattggtgtgatcttggctcactgcaacctctgcctcctgagttcaaacaattctcctgcctcaaccttccaagtagctgggattacagtcattcgccacaacgcccagctaattttcgtatttttagtagagatggggtttcaccatgttggccaggctggtctcaaactcctaacctcagctgatccacccacctcggccttccaaagtgctgggattacagacatgagccacactgcctggccacaagctccagttttacggagatcttctattattggaaatgtgaaccttttctaaactttcttctgatttctgcagctggagtgcaatggcacgatctcagctcactgcaacctctgcctccccagttcaagtgattctcctgtctcagcctccccagtagctgggattacaggtgcctgccatctctcccagctaaattttgtatttgaactcctgccctcaggccatccgcccgcctcgcactcccaagactcaacattnntgtgcttcattatatcatattttctatttagtangaattgtttctttaaattttcaattagatcttacatttaaaacaaatatattagacctattatttgagttccctgaaagattatacaagttanaaagatcactaccagtttttaatgaaaaaatagcacactatcagntt

SEQ ID NO: 5674 - DNA, 862 bp, Homo sapiens
  misc_feature (1)...(862): n = A,T,C or G
gttccgactaacccgnattctgnaaactgnacgcatgtgnacatttatttcgtcggcttgtattgatctccatttcagttgcattatcttaaaatcacaagctccagtttttttgtttgtttgttttttgtttttgtttctttgtttgttttgagatggagttttgctcttgtcatccaggctggagggcattggtgtgatcttggctcactgcaacctctgcctccccagttcaagtgattctcctgtctcagcctccccagtagctgggattacaggtgcctgccatctctcccagctaaattttgtatttgaactcctgccctcaggccatccgcccgcctcgcactcccaagactcaacattttgtgcttcattatatcatattttctatttagtagaattgtttctttaaattttcaattaaatcttacatttaaaacaaattatattagacctattatttgagttcctgaaaagattatacaggttaaaaagatcatacagtttttaaatgaaaaaattaacaacactatcagtattatattcaaaaatgtatattttcaattaaaattgagaataatggctggtgtataaaatatattataaatgaatactcatgtatgtatattagagcgtgtcttttaaaatcgtattaaaatatgctgataaatatgcatgatgtttatagatatcttatattgaaattcagacagtaaagtaaatagcatacaattttataatacaatcatatacaaatatgattatatacaacattgatatttgatcgtgccttgtcagtgctacaaaaaggttttcaaatacagactttaaaaatgtgttggatgcatatcatgttggt

SEQ ID NO: 5675 - DNA, 300 bp, Homo sapiens
cttggcgaggaaagtctcatggggttaacgcaggtaagctctcaattcttgaaaacattagtaaatacatcaaattcatccagtgcattttaataacatacatgaagcgtggaggtgaatcactattgctttgcttctgcagttttaacctacataataagcaagagcaataaattctaaaattataaaaatatatttcttatcgtgttgtaaagcatgtaccaaggttttttttttctgttaaatactgtcataaatatggaagtaaagactatttttttctgcataaaaaaaaaaaaa

SEQ ID NO: 5676 - DNA, 297 bp, Homo sapiens
cttggccaggaaatcctttactttaccagatccaccaggtcaaatgtgaaggttttcaaatcacccaacgggtctcttttcgtatgtggaaaagaaaacataaagagagagagatacattttcagcatcttgtgttgctgaaatattcaatttctagtaatttctccattgagcatgtaattttttatttgagtgatgaccatgactattttcactattgacagcttcagtcctactgccaaccgtgttagttactttacttgtttaaatctgagttgttgtaaaaaaaaaaaaaaa

SEQ ID NO: 5677 - DNA, 458 bp, Homo sapiens
actgtctacaataaacatggtccaactggattaccaactgcaccatagacacagtacctgaattaaatagcagaagataagagacttgaatatttgtagcctttgaacatattcttctgagataggacattctttgttccctaaacttgtatgggacattagagtttcctacccagtatgtcccagtgctcaaactattttttattatcttcagagtttttctttctgtcttaattaaaagagtagtttttacagagctacagaataaataaaactctgacgtattttcacattcacacgttgaacatttcatgtacgtttgacagttcaatattaaacctaaattcccttcccccaccataaattatgaagcatatattgccatctagcgtccttctgaaatgacacttctgccaagattatgaaataaaacatgttcagccagaaaaaaaaaaaaa

SEQ ID NO: 5678 - DNA, 360 bp, Homo sapiens
atgggtaacctgtcctggtcatgcaactggtttgaggaaaatcatcaccaaacaccaccttgaacttctagagcactatctggaacgtgtggtgctgacaccgtataatttactgtttcattttagtcttccctgtgttgttttgttctctggctgttttgtgttcaattggagtagatttccttagccttgggtttctagtataattattccaccactgtctcccttaattacgtggttgttgtccttcaactcttattttcatgtacgtttattctgagcttcctccaattcaatccttttttggaagaaaatgaagcataaaagtataagtaaataaaaaaaaaaaaaaaaaaaaaa

SEQ ID NO: 5679 - DNA, 405 bp, Homo sapiens
caagaagctaaattattgcgggaagaacccaacctcttcttttctggcctatggccggtcaagaagcgggtatccgagtgggcaattaagatttggaaacaatcttcatgtatattaatgaaggaattccggcatcaaaatgcaaaggagaaaaatagcaataaaaacaagtaaactaaggattgataatgcatactttgtattattaaagtgattttgatgattttgaacttctgttaaaatataattccatgttttctgacaaaatatttaatcataataacagctggctttgttaagtgtaagtactctttgtgtggtaacttggcattagtatattcattaagtagagaaaatttaaaatatatttgaataaatccattaagataaaaaaaaaaaaaaaaa

SEQ ID NO: 5680 - DNA, 304 bp, Homo sapiens
gatgcggggaaaatcacagcattacaaattaacctttggcaaatctttcctgggttttatgtttgtgtgaaatgcccctttactaaactggaagatgtgtaagatggaagaagaggttctgctggatatggagaaattggaacccttgtacatgtggaaatgtaaaatggtgcattaggaaaacagtttcaacggtcctcaaagtggtaaacatagagttaccatatgactgagaaattttactcccaggtatatacccaagataaataaaaacatgttcatataaaacttaaaaaaaaaaaaa

SEQ ID NO: 5681 - DNA, 225 bp, Homo sapiens
atacactggtgtgatctcagctcactgcagccttgacctctgggttcaagtgatcctcccatcttggcctcccatgtgctggaattacaggcaggaaccactgatttacagtcttctaataagagtctttatcttaaagatatttgtttcctgtgtttgagaattaaaatgctggctttttgctgaataaaaacaagttggcaataatagtcaaaaaaaaaaaaa

SEQ ID NO: 5682 - DNA, 499 bp, Homo sapiens
atacagtggcgccatctcagctcaccgcaacctctgcctcccggattcaagcgattctcctgcttccgcttcctgagtagctgggactacaggcgcccgccaccatgcccagctaatttttgtacttttagtagagacggggtttcaccacgataaccaggctggtctggaactcctaacctcatgtgatcctcctgcctcggcctcccaagtgctgggattataggcatgagccaccgtgcctggcctgttgtttctgttttttaagatactgagcttgtttaagtagattttatgcattttaactttatctaacttgactgataaagcagtctttcaaatatttaaaaataattataacatatcttcttaattttctattctctagcttaagtaattccattatctctaacatttctttgtttgaaatgttgtccaaactgataatattttctattttagtggcaataaaactttttaactaccaaaaaaaaaaaaa

SEQ ID NO: 5683 - DNA, 456 bp, Homo sapiens
acaactgtggagctaaatcctaatttaagatactacatttctgtattttgtggacagggttggcagtttgagataacttacaagattcctgtttcaagaatactttcttctgtcaatataatggaacacaactcctttactggatcttttttaaatgttggaggaagactgtctgcttattttgaggaccagtctgaaaatatttggcaaaagacagtatgtacacatcctgtggctgataatattttatagaaaaaatacgtatacacaaggacacatgaatgaaaatatttaccacagcactctttgtaaaaggaagagttcaaaactacctggggtttcccaatagtaaatagaaatcaaaatatggtatatacaagtgatggggtaataatactgaatgtaaaaagaaagtaataagcagaataaatgtttaacatgacaaaaaaaaaaaaa

SEQ ID NO: 5684 - DNA, 303 bp, Homo sapiens
ataatggtgagaatgtacacccctgtcttgttcctgatctcagaggaaaagcttttagcttctcactattgacaataatattggctgtgggcttgccaaacatgacctttctcatactgagcaacagcaacaacaacaacaacaaaaagatgaaaataaaagtagagatgcatggggaagagtccaggaaagttccacacatggaattgtcctctcccagagaatttgcatacaatgctacctttcctgtcaatgttgtgttacaatgaacatgaagagtattgccaactaaaaaaaaaaaaa

SEQ ID NO: 5685 - DNA, 392 bp, Homo sapiens
  misc_feature (1)...(392): n = A,T,C or G
cagtgcagtctgctggtgtcactagnaaagaaggagacgcagaagaacagtggccggggggatctagagatggaaagggtcctgaaaaattctaatctggataatctctggatactggacaatgaagcccaggtgtgctctaaaaaaatggagcaaaatttggtccaactcatgccaattgtgttcaacagtttataggataagtagatcctttcaggctgtcatagttcaagctcttggaatgaccagtaatatatacttaaacatatgacaaaacttaagggaaaagagggcccaaggcatgcaggggaactgagcataaaggccattgtatttcatgtatgacttgactgtgtttcagtaaagaaattttagctctaaaaaaaaaaaaa

SEQ ID NO: 5686 - DNA, 419 bp, Homo sapiens
agaagaggaggaagaagatgactgtaaaggaaggagcagtactgttttcatgaggacctactatgtgccagacattattctaggtgctggggctaccatgggaaacttgcagctacttgggaggctaaggtgggaagatcgcttgagcccaggaggtcgaggctgcggtgaaccaagattgtgacactgcactccagcctgggcaacagatgctgtgtgaagatgaaggcagagatcaggctgatgcttatggaaagccagagattgccaacaaaccaccaaaagctaggagagaggcctggaagattctctctgagtcctcagaaggaaccaaccctgccaaaactgtgatcttggacttctaaaccccagaactgtgaaataataaatgtctgatgtctaagccaaaaaaaaaaaaa

SEQ ID NO: 5687 - DNA, 842 bp, Homo sapiens
  misc_feature (1)...(842): n = A,T,C or G
tctactcggctgtttgggacactggnacattctgcctgatgaacgacagcaaccttaaattccagatgcttcaaaccgaatactacatccgaacacatttgctgaaatttggaattacaccattgctatggtctaattctcccctactcaagtattggaaacttaatctccaatgtatcagtgttagaaggtagggcctttgcagaggtgtttaagtcattagggttctgcccttaaaatacattaatagagagagtccgtcacttttgcacttcttccttccaccatgtaaggatgaggcaagaaggccttcactaaacaccagatgccagcagcaccttgatcttggacttcccagctccacaactgtgataaataagtttctgttctttataaattatccattctcagatattctgttacatcagtgcaaatggactaagatatttactctaattatcttggcttatggtagtcaatccactcaatcataacagcaagaaacttcagtaacagttaattttccccttttctcattttatttagccacggaatcttgtcagtcttactatcaaaatatctcctgaaatacaccattctcgtctctatttctattggttttggcttagtttacctgccacatttacagaatttgttatagtattttttttgccatcactaatttaattttaaatttcttggaaacgatgactgtactttgtctttttatcttccccttgattatagtaaatacttaactgattttataagtcaaaataaatcagtaaataattctattgcttaaatatacagcgaagggcatattacaaataagaactaat

SEQ ID NO: 5688 - DNA, 722 bp, Homo sapiens
aggaacctcacttgctgctcaaggtggtctcaaactcctcggcttaagtgatccctctgcctcagcttcctaagtgctgtcattacagttaacaaaacccgcacaaagaagactctcaggaaatgctggctgaatgacagaatgaacattgataaatgaagacttcttcaaataactgatgctagacatctctaaatatatcagaaataacatgtgaccatgacatcattcatcatttttccatcaaaacatttgaaaataacttggattcatttattagagctttattttcccacatcttgcagtaccctagagttctacagtaattaaccttatgctgaatggcagaggacatgcactaagctcctatttaaaatctattcatgatgcattttaaatattcagtagagacttcttaaacatgcagccatagtctattgaaaatggatttcctaaagccaggagattggatattaatatctggcattcgtataaagacaggtttttgttaacctattataaaaaggactgatgatgtgattatatattggttactagctcacttatatttctgtgctaataattactgtaacccatttggttaggttttttattttattttcattaagcattggttttaaaattttcttatcttagcttatggttgaattatgtttttgattgaataaaggttgcttggtaatattagaaaaaaaaaaaaa

SEQ ID NO: 5689 - DNA, 313 bp, Homo sapiens
cttgcaacagaactgaaatctccttgtgtcccagaataaatagatgttttcatgaagcttgggaggtgtcggccaaagaaaatcttctcccaaacagatcctgaaatatatgcagtctcactaaatgtggccttttctttgaatggacagaatctatggaatttttaaaggaacgaatacaaggaaaatagaggaaaattatcccagccctggacagaaagtagaattcagaatatatttttgagagttgttttactccttttttgttgtttttggaaaatatatatatatgttaagatcaaaaaaaaaaaaa

SEQ ID NO: 5690 - DNA, 949 bp, Homo sapiens
acctagcgagttgcctactgtactcatctctgtaactaacgactggttgaaactggctcttctctgtgtggttactttgaattattccagatctagcaatggtgacggcctggagtctcagccagatgaagtaacacacccggggcatttgccaaaaatatatcacaacaaggatggaaatccaggccacttggttgcatttagtcactctgctattttatattactgctatgcctcttcacttatttttttatattaatgggtttttaaaatttaaatacattcattttcacaagaagctttatatcgttagccaaaatggaaaacgtataggatttaccaaaaatagagagtgcttgtaaacataaattcaacacacatgaagcaatatttcttaatgcgagcttgatactgtcacctggctttgagcccagagcctccttttgtttgtttgttgtttaaaggagattaacaagtgtttttaaaagtttcagagacacactaaacttaatcttagacatttttcttgatttaactgcaagatttaaaagaaaactagaaaaggagaaatgtagctctatatcattcaggggaaatttaaccatgagtctgtgctgtctgaaattatatttatcctttatacatggaccatatattggggaacaatgtatcagtgaaccaactaaaaaaaccacaagcaaaataaaaaatatagtaagtatgtgtcttacaattgggtcaaaggaccactattcacggcctgaaagccaataaaataaatcacccaccttggcaatttctttgattacaaaaaatttttaatagcatttaccttcaataagagaatggagataagccgacaacaaaatcagaagacaattgccaaatatggtacagactaaatgttaccatcttcctatagaatgtatgcatacaaacgtttaaaatc

SEQ ID NO: 5691 - DNA, 484 bp, Homo sapiens
ccctaagtagtgaagccatattataaaacgctgtgccttaaaaattcaatttccgtttattttccacctggagagctttagaaacttaaaaaaatccactaattttagaaaacataagcattgttccattggatagttttttttttcctactgtagttttgtaaaatacatattctaaaaaaggactcaaggacaaggaagcattatagcgtcttcaaacaaatcctttttgaggaatagagagtaatgacttaaagaattttgtggagggttctgtctgcaaattgcagctaaagttgaacatgactctggaaataattttagtctctgctggaaattggaaaatacaagattttcttacttcctatgctcatcagaataaagcatctgcacaaactacattcttaatcttttcttataatatggctgcgttgcttttatacgacattaatgactgattcaccttgccacaaaaaaaaaaaaa

SEQ ID NO: 5692 - DNA, 373 bp, Homo sapiens
cagtgtaaaactggcgataacaacctcaaagctacaggacaaggcaggaattaaaagccaggaagtgcacaagagagctggaagtggtaaagcctgcaaaaccggagactgcattcctcaaccaaagatgttcaatttaaaatatttttaaaactgctggccaggaaatacaacataactcacattctatcttaggttcaaactaatgagcatgccaaagtccaaacaacatcttcaaattctgtaatgttctccaatttaacctaatacttgggaaatatgttgtattctcatgatggactatgttattatgtcacaaaagttaaataacttataataaaatttaaataaaaatcaaagaaaaaaaaaaaaa

SEQ ID NO: 5693 - DNA, 298 bp, Homo sapiens
  misc_feature (1)...(298): n = A,T,C or G
agaacattatgttaagtgaaataagccaggcatggnaaaggaagaggttgtttaccaaaggaggcaaacccttgaccttcctgcaataggcatcgaacgtggacaaaattagctgctgcccttgtttcctgcatgtgttgtaaaccagtctcatcaaatgtttaactaaatgtcaatccagtctacctcactgcagtatatgttcagcctaaattttgcgagttgaaatggatgacaacgaggctgtaagaactgtgcagagcaaataaaccatccagtttgacgaaaaaaaaaaaaa

SEQ ID NO: 5694 - DNA, 943 bp, Homo sapiens
  misc_feature (1)...(943): n = A,T,C or G
cctgggccagttcacctcttccctatttaaaaaacaacctctgcaaagaaagatatgtctgccatgtgcctgaatgtcaaaatatttgaataaaattgaaaagttgacactgaaatccgatatgacttcttcgacatataaagccagagggagatggccccaagaacaccaggcaccacctgcatttacatcgtcgaaatgaaaaagtgaaaaaggaacaaatgtggtctcattactttccataaagggaaagctctttaccacaacaatgcctattataccagattatcaaacacagaatcacattgtaacttctggaaagtatggaatatgtatacacagaacagagccaaaagaactccagacaggtatgcctcaccctcagggactcatgtgttacagaaaatgttgggaaaactgaataatagggacaaaagaaactcgccatgttaaggttttctaaactgaaattattcttacttgttttaatttacttttcttacaatgcttaattctcatattttttaagtaagttgcatttatacctttgttaaatgtaggccttttgatataagaagtcagtttggcagaattgcattgatacatatttgatgacattcgttcaaatattttcaattattcccaataggggggaggatttcataataccccctgctttataaaaaattctaggctcacagccgtggatgagaatgagtgagagtacctaaaacctactattttcaaaatccatggaatacctggttttgtgtattgaacacccccaggggggttcgaaacgcttcgcaccgggctttagtctgcgtgacgcagcacgatcccgagtagcggcggttggaccaggtaagatcgcgcgggatataccgaaacgagtgagctccgacagntcgatcggccgaggaagaagctctaggtggcgcag

SEQ ID NO: 5695 - DNA, 396 bp, Homo sapiens
  misc_feature (1)...(396): n = A,T,C or G
ctgctncaagggtggtctcaaactcctcggcttaagtgatccctctgcctcagcttcctaagtgctgtcattacagttgtaagccaccacacctagtcctcaactttgtttagtcatagcattgcctatatctattttgaatattactcttctagaatctaccatatctgtgactcttgggtatggtaaaataaactattgtgaattaatctcctatactggaaatttatgtggcatagtcataaactattttgttttctttgttttcctgtctattttgcttagcctattaaagaaataacttggttttccttatttggtattcctatcagctaatagatatcttgtatttttcctcctaacttatttgttcttcctattagaaaaaaaaaaaaa

SEQ ID NO: 5696 - DNA, 289 bp, Homo sapiens
aacctcacacaagcagaatatgatacgaccattaaagagacaagttaaaatggagtgctcagggtgggtcctaatcaaatatggctggcatccttataagaggatgttaggacacagatcacatagaaagattaataataccatgtgaagacaccagaaaaagaacactatctacaagccaaggagagagacttcagaacaaacaacctgtctgacaccttgatttctggctcccagcttcctgaaatgtgagaaaataaatttctattgtttaggaaaaaaaaaaaaa

SEQ ID NO: 5697 - DNA, 510 bp, Homo sapiens
  misc_feature (1)...(510): n = A,T,C or G
cttgccttcaaatncacggtggcatgaaaaagtgacaagacagagaggctgtgagttgtgattctacgcctgctgaaatcctgaagcattaaggagaaaatcaaaaccatggactgaaaaggtcaaaacccctgaaacaagaaaatatgactgttgtgcagaataattattgctttactatcagcagagtagcccacatataatgcagttcttagataaatattgtttttacattacaaaaatgctaatcaaaaacctgctatcatgcctaccactgaactaaacaactaaaatttaaactctttactatcatttgtttgaagtcaataagcttaccaaaatatatatatcattcaaaattatgggcttttaaaaaaactgttaatttaatctttctacagaatattttcatctcatctaatttcaaataaaagagcaatgaattcttatttaatagagtttggaggcaaaataaaatttactgaaaactgactgagaaaaaaaaaaaaa

SEQ ID NO: 5698 - DNA, 378 bp, Homo sapiens
cacattgaagcgcatctgcgtaatgaaaaatgcacaagaaaagagaacacatcattttccacaatcacagctacctatgtgacagtgagataacagtgatttttgaaagcctctgttgtttttccggctacaagacatctaaggcggcatggacttcctagaaagttctttttacagaccattttcatctcagagctgcctcaatcgccaaagataagcgggagctatttgcgtctggtgatgctctaactccaagtgatttctcttcataggaaatgttcatgatgtcaccctcaaagataaaagcttgttggaattgttaacaattgactttctcatttataaaggcaataccttgcttagtaaaaaaaaaaaaaa

SEQ ID NO: 5699 - DNA, 279 bp, Homo sapiens
aaccaccaacttttggctaatatagcaagttatctcctaagcatcagtttctttgcattgaaaatggacaacaataaacaaaaaataaaatgaatttattcaagcacgcagaggcaaaggcagaagatcccaattacccagtgtaatctgatgtcaactacatagtgcttctcatgccataatttttttatttgacatcaattgcaacaatataacacctattaaatctaagaaaaacaaaatacaaaatcaaaatcaaaaaaaaaaaaaaaaaaaaaa

SEQ ID NO: 5700 - DNA, 482 bp, Homo sapiens
  misc_feature (1)...(482): n = A,T,C or G
atccagcaaatcctggctaatagnagcaagttatctcctaaagcatcagtttctttgcattgaaaatggacaacaataaacaaaaaataaaatgaatttattcaagcacgcagaggcaaaggcagaagatcccaattacccagtgtaatctgatgtcaactacatagtgcttctcatgccataatttttttatttgacatcaattgcaacaatataacacctattaaatctaagaaaaacaaaatacaaaatcaaaatcattcaaagtagaagccctattttatatttttgtgtatttgttttgttaactttttcttgtatatttatggaaaacaatgcaatattttcacctatgtgtacattgcaaaatgattcaatcacattaacatatctatttctgttatcagactcaatacatatacaattacattttaataaagataatcataataaacataatgaagaagtcaaaaaaaaaaaaa

SEQ ID NO: 5701 - DNA, 243 bp, Homo sapiens
  misc_feature (1)...(243): n = A,T,C or G
ttttcatgtgnagctggaatctctccactggnctcctggnatctcaaanaatatttatgtctatggaaggcgatcaaaattggtgtttctgtggagttatgaaggccagaataatctaatccaccacgtaaatgatgtcactccgtttgtcttgggttttaattgtaaagttgttatacaaattaaagatattttgaaaaacagtctaaaataaataagatcagactctgaaaaaaaaaaaaa

SEQ ID NO: 5702 - DNA, 205 bp, Homo sapiens
  misc_feature (1)...(205): n = A,T,C or G
atctcaaanaatatttatgtctatggaaggcgatcaaaattggtgtttctgtggagttatgaaggccagaataatctaatccaccacgtaaatgatgtcactccgtttgtcttgggttttaattgtaaagttgttatacaaattaaagatattttgaaaaacagtctaaaataaataaaagtctagaccttgaaaaaaaaaaaaa

SEQ ID NO: 5703 - DNA, 561 bp, Homo sapiens
aaaaaacatcaaatatgaatgagatcaaaatgaacaatcaataaaaaagaacccagacaggacgaggaaatacaaacagtagagaaagtatcaaagaatatatcattggtgctttcaaagattaagagactgcatcaatggaagaaacacagacactggaaacagggaggggagtgcaatagaggatgagataaagcaccagaaaattaaaaataagataactgtaatttaaagtttagtacaactttggaagataaagtcaatgaaattctccagacagtagttttttaaaaaggattttaaaaaagagttagagaatcgatccagaaagttcaaaagcttatttcagaatgagtttccagaaagaagaatacagaaaatagtgaagaaaaaattaacattgtatggagaagtttcaacaactgaaggacgtgagtctccgaacataaagaatcaaaaggacctggaaaatatatatattttaaacccaggcacattatgaaattttagaataccaagagtaaaaagaaaatgctaagaacttccagaaaaaaaaaaaaa

SEQ ID NO: 5704 - DNA, 406 bp, Homo sapiens
caatttggatttcatgcaaataaaacacaccaacttaatgggatgtgaaagagttggcttcaaaataaatccttgttgaaggcactggaattacatttgaaatggaagtgaaacaaagttgaattttatggcactggcttacaggctctgtcttgcactgtttacagattgacccaaataaagtgaagaagaccagaatcaggacccatcctggcatatacctttcacctgataacatctgttggttcctatgtatttaatatatgtattttcatgtttatttctttatttttattaacttttccaataagatttctcccccaaaatactaatgtcaattaacatttaaatatagaactgtaagtttaaatatagaactgtgttgggctagacaaaaaaaaaaaaa

SEQ ID NO: 5705 - DNA, 229 bp, Homo sapiens
acaattcggtggcttaggttgagaactgttgctatggcagcaggaagaaaatgatggaaaagaagaaaacaaaaagcaagaaaaagtgagaaatcaaaggacaacattttcaaggatgaagagtgctacatctattcattatacattgtagatatagataataacaatagtaataatatggtcaaattttaataaataaaaaattgagttaagcttaaaaaaaaaaaaa

SEQ ID NO: 5706 - DNA, 459 bp, Homo sapiens
aaattttgacccagcagaggttagaaaaatttgacccagctacaagacaagggaagggatcacattgaagacaccataaagttttccgttttattgttctttgcaaagatccagcttctgtttcattgattagttctaatgctttgggggaaattttgattgtttcttgtaggtttttgtttatattttggctttgtttttttaattgattaaattaaataagggatctttgatcctcaatatcactttgggcacatcacagaatgttttgtcaaattttaccatgatttattttagtctgcacttggtttttattactgtttttacacaaagctattcaggagtgtgtttgtacttcattttaagctttcagatgaaaacacggaaagggaactatctttttgatgttactgtctagctttattcaaataaactcatttaattagaaaaaaaaaaaaa

SEQ ID NO: 5707 - DNA, 483 bp, Homo sapiens
cttgccgctaaactgtttcaaatggcaaatttcccctaaaattggaaaaaggctaatacggactggggttggagagcccgggattctgattaaacatggaatctgagaactggcagaaagcctggaactgatggaagagagggctctagggcctccatactaaatggtgaactaggaactataaaagagataatgtggtgaagagcttcagccatcaagttattctaaaaatgaagtagggcattttatatgtggagagaagggcactgattattatctgactattgctaatatgtcccatagaacttatttggaataattttttactattaatttgaacaacagcagtgagactctttatatgtataaataagctaattttacatttaatagagatgattttattttttaatgttagtaaaatcagaatcttattaaattgtaaaagtgaataaaacttttataactttaaaaaaaaaaaaa

SEQ ID NO: 5708 - DNA, 451 bp, Homo sapiens
  misc_feature (1)...(451): n = A,T,C or G
aaaaatggnaaaaaggcaaatacggactggggttggagagcccgggattctgattaaacatggaatctgagaactggcagaaagcctggaactgatggaagagagggctctagggcctccatactaaatggtgaactaggaactataaaagagataatgtggtgaagagcttcagccatcaagttattctaaaaatgaagtagggcattttatatgtggagagaagggcactgattattatctgactattgctaatatgtcccatagaacttatttggaataatttttttactattaatttgaacaacagcagtgagactctttatatgtataataaagctaattttacatttaatagagatgattttattttttaatgttagtaaaatcagaatcttattaaattgtaaaagtgaataaaacttttataacttttggaaaaaaaaaaaaa

SEQ ID NO: 5709 - DNA, 243 bp, Homo sapiens
cttgcccaagagaaaaaactgtaacaccaaaggttaaaagactgttcaaaacagccttgcaattttgaccaaggaagaaagctgaagagtgctagggcaagagaggaactacgtccagaacaattcataattccaaattctcacttccatgatttcaatgctgaatgtgtacttctctagctaaaaatacaattgcttaagtaaaatcatcattatttacagtcttgctgaaaaaaaaaaaaa

SEQ ID NO: 5710 - DNA, 381 bp, Homo sapiens
atgcatgtcatgatctccactcaccgcaaactctgccccccagttcaagtgattctccagcctcagcctcccaatagctgggattacagtcctgggaacttggagcagaagaaaggaaagggagacattaggagggaagccctgagcctcacaggagcagagaagtaagaaactgtggatgaaaagggagaacatgctgagaggtatgagggagacaccaagaataagcagcagaggtataatttcagagaacctgtaagaaacctcttcaagctattgcaagaaacactcacttctaaaaataaagagaaatctgttttccctacttgtatttcaagttatctaaaagtaaaaccaattacacagtgaaaaaaaaaaaaa

SEQ ID NO: 5711 - DNA, 165 bp, Homo sapiens
ataacccttgttcaccatcaggtgatctgaacgatagaagacacaaaaaaggtagaacaagacagaggaaatctgagttctgataccacaccagccctaagctatctacctctagactgtgacatgaaaataaatgtatttccctcttgtctaaaaaaaaaaaaa

SEQ ID NO: 5712 - DNA, 863 bp, Homo sapiens
aggcaaatctatgaggccacaaatctaagagtacaacaaatctacaagatttacattttacagatgaaaaaattgagacttaacatccaacatcacacgctaacacaactggaatttcaacttgaatctgctgattgcaaaaccctagctcttttcttcacgccgtacataccagtataccatatcgctctactgcatctcagagatgtttgttttgccaacataaagccttttcatttatagtgcagattatgattatatcattctgtagcaaatgggttttcatgctttaaaagacagtataccaacatgaatttaatcttgaaaatctgagccattatcataaaccaaatgctgcttgacattctaaaagaaataggactggccagagaaattttagattcattataattcctcatagatattcatacttttgtgactgtcattggatacagaaatgataggtttgggttttggttgtatcttctctaattttaggaagaatttctagtctacctgttatcaagctatgcatgtcatgaccgcaatttagatattatcactggcctaagtgtcaaatttcaaatgcaggcttaacacgctgctatgttttataggacaggataaatgccgagacatgtttctcatcccaaaaccctgaatgcttctgcctgaggctgttgactcctgaacccgaacctcttgcttcaaaagaccaagtctctcgtgtccctccctttgcgaggccacatgaacatttcgtgacgactcgggaggcgctcccgtctccctcgctcgcaaaaccattcaagggctttgatggcagcctgacgaagacttaaccctgcctttgggataggccg

SEQ ID NO: 5713 - DNA, 303 bp, Homo sapiens
atattacatgcacaccttggaatgtgactgtttggagataaggcctgctgagaggtaattaaggtaaaatgaggtcatgtgggtgagccatctttataggaagaggagattaggacacccagaggaaagaccttgtgaagacacagagagaagacagccattcaaaaggacatcggccctgccttcaccttgatcttggacttctagcttccagaactataaaaaatcaatttgttgtctaaggcacccaaagggaagctctcagaaactaataaacacagtatgcccggaaaaaaaaaaaaa

SEQ ID NO: 5714 - DNA, 437 bp, Homo sapiens
  misc_feature (1)...(437): n = A,T,C or G
agcgcggtagggcccgccccgggagactagaaaaagtcccngtnttttggnnngggnnttttccgagtatacactagttgaaatcccttactcctncaccttgggatgtgactgtttggcagataagcctgcagtatagtaattaaggtaaaatgaggtcatgtgggtgagcctaaatccaagactggtatctttataggaagaggagattaggacacccagaggaaagaccttgtggaagacacagtagagaagacagccattcaaaaggagaaaggcctcagaagacatcggccctgccaacaccttgatcttggacttctagcttccagaactataaaaaatcaatttgttgtctaaggcacccagtctgtagtattttgttagggaagctctcataaactaataaacacagtatgcccggaaaaaaaaaaaaa

SEQ ID NO: 5715 - DNA, 585 bp, Homo sapiens
atgaaggatttcaaagcatggaaaacacaaaaaaagaaaatacatctggacaacttctgcaaatcaataaagacatcataatttaagagatggataaaaaattgggggaacatttgagacacatattacaaatgttaatatctttaacatatgaagaacaattccagcttaataagaaaaacatgtaccatgaattggaaaaaaagataaaatagatgttgtgtggaaaataattttttaaacctgataaagtaataagtaagcatatgacagttgtaccaggatattcatcagagttttgtttgtaatattttaaaaatgaggaccaatcttaacatgtaataaaagaatactaagtgggctattatttgaatactataataatgtagggatattatagaaaatgtatcaaaagggatattgtagaaaatgtatcaaaaatagtagtagtgcttatcacttgatagtaagattattgtcattttaattgttttcttatactgtccttattgtttttctaaaaggagtgtgtggtattattttataatgagaaaaaaagaaacatttattttaaaaaaaaaaaaa

SEQ ID NO: 5716 - DNA, 261 bp, Homo sapiens
atctgcaagttcctgcgatgggattcatctcaccacggaggcttaacccccttctgtcgactcagagctctccttctgctgcctcactcccccaggagtcgactcccttcctcattctattcgagtctttttatttataagagcatttgcattgttagggaaaaaaagaattccttcttctttttccctcattgttaaatagcactgcatctactctgtagacctgtcaaaagtagaccattttccctaaaaaaaaaaaaa

SEQ ID NO: 5717 - DNA, 302 bp, Homo sapiens
tacctgaaacctccaaagaaaggagatgcttttgcgagacacatatcccaaggctccccctactccagtgctaccagatgtaagagaagacccctttcctgcctggacctatgccacaggctgtatctgttcaccacactcatcacccaaagctggagaagcagcaaggagcaatcacagatgtggggtgatgtgtccccaccattgtcatgatcctttggacgtatcttcctcctgtacacttgagcagatttggagacagtctatgaacatgtttttttcccctgtgaaaaaaaaaaaaa

SEQ ID NO: 5718 - DNA, 584 bp, Homo sapiens
aggcaaatgaggaaagaagcattcaaagcctccagccccaggaccctgggggtgaaggcacatcattaaaggaagccctgccgcattctgactctagagcatcacaaacagcacagcagcctccacttacaaacatgtgttctttagcgagctgtttggttggttatctggagaaaagtatacttaaagtgacttactgatgatgtctcttgttgtattacttgagggaaatatagataattgacagaagaaaagcaaaactccctcatcctacaactcagaaataaatattgatatcatatgtctagacaaatatattgtgtcataacaaaaaatgggagaatcctgtataattatttgtaatggcagcatgttgaatagcattaaaatattcattcctcccagttttttaatttggctatgatctattggcctatcttccaggttgataattctgtgtccaactgctattaaattcatctattgggttaatgatttcagatattgtgtcttttaattctggaatttctatgcaattttttaaaaataaattcaaacactcttaaaattcaaaaaaaaaaaaa

SEQ ID NO: 5719 - DNA, 260 bp, Homo sapiens
  misc_feature (1)...(260): n = A,T,C or G
acaggtgtgccgttagctgcaataccaacagganatcatatcaaccttgtaaaagctattggaccaagctcttctgccacngaaaaacaaaaaagatgattaattttatttgctttactgtttgcatttccctaagacacaatgaactgattaaaatacttttgtactcattcattaggcttttttgtatattaaggtgcattattttgacgtacttaccacataattataattgtgtaatgatttcaaaaaaaaaaaaa

SEQ ID NO: 5720 - DNA, 331 bp, Homo sapiens
  misc_feature (1)...(331): n = A,T,C or G
gccggagggggcccgctagggcgangaccangatttagtttttnggannnggncnctggtcngnctactgngatnctttccatcgnaatgcagttgtagcatgcaacattttgagacanaaagaaaacagattacagcgcaaacttggagctgagggtatctgttttccagtagaagaaaaacattatttatcattttgaaaaaaataatgattgagtgacacggtgttttttaatataaagtgggggttggcaatgtacagcccaccaaacaaacctggcccttgccagtttttcttttaaataaagtctcaatggcaaaaaaaaaaaaa

SEQ ID NO: 5721 - DNA, 280 bp, Homo sapiens
  misc_feature (1)...(280): n = A,T,C or G
cactttcgtttactgaactcttcctatcgaatgcagttgtagcatgcaacattttgaagacagaaagaaaacanatttacagcgcaaacttggagctgagggtatctgttttccagtagaagaaaaacattatttatcattttgaaaaaaataatgattgagtgacacggtgttttttaatataaagtgggggttggcaatgtacagcccaccaaacaaacctggcccttgccagtttttcttttaaataaagtcttaatggcacacaaaaaaaaaaaaa

SEQ ID NO: 5722 - DNA, 216 bp, Homo sapiens
  misc_feature (1)...(216): n = A,T,C or G
ccgttcgagttttgagcagcacanagccatgtcaccaccagcacaatcaagatacagaacagttccatcacctcaaaatactctcttgtgctactcctttgtggtcaaaacagcccccatctccaatcccagaaaccacctatcagttttctgtttctatgttttgccttttccaggatgtcatataaatggaatcatatagcaaaaaaaaaaaaa

SEQ ID NO: 5723 - DNA, 906 bp, Homo sapiens
  misc_feature (1)...(906): n = A,T,C or G
atcattctacaacggtgngaatatattggagtctgccagaaaacccatggcctcgtttctcaatatcaattgagtcgtaatggaaacttgcttttcctgggtggcagtgaggagcagaatttcactgatagaaacctggagcccaatagcagatacacttacaagttagaagtcaaaactggaggtggcagcagtgctagtgatgattacattgttcaaacacctatgtcaacatcagaagaaatctatcctccatataatatcacagtaattgggccttattctatatttgtagcttggataccaccaggatactctggatggacatctctatcagcatatcctcctgctgaaggtcaaattgcaaactgagagggtcccccgactccttcttcactctctcttaccacctcgagcaccacccctgcaaaaaatactttttgcggagaggaagacgaaccctggttatattacctttttattttaccttctggcccaggacttaaaatcttttctcatcccttcactgaactggagcctccaatggtgttctgcaatcaattgctgcctatccccgctgctcagatttcgtttttaatccttccgccccctcgtggacagccgcggtacactgcccacccctgccgcgcgcggggcgcgcactcgcgccttgttgccctcccccggcgcgcctctcccgccgctgtccttttgccggggcttaatctttcctccccgcctactgacttccttcgtttcgggcgtatcgctcccgcttggcgccctgcgcgccttccgcgcgcgcttcccggcccgccaggcattcgccggtcccgctgccaggcccggtggtggtcagctccgcgcaggcccgaatctgaaatagtaacatatatacataaaaaa

SEQ ID NO: 5724 - DNA, 297 bp, Homo sapiens
  misc_feature (1)...(297): n = A,T,C or G
tttcgatcaaagttgccttttcctaactaccctgngccccaccccacctcatcctgtgcctataaagaccccanactcaatcagcagagaggagaagcagctgaatgttggagagaagggacttgacttcagagggacagcttgatggagtaaccggagaaaatccagccggacttcaggggaagatcacctacccctcctctgtccccttttcagctcccctctcttcccactgagagccactttcatcggcaataaaatcattcctgcctttaccatccttcaaaaaaaaaaaaa

SEQ ID NO: 5725 - DNA, 293 bp, Homo sapiens
cagctcaatgttgccttttcctaaactacccatggccccaccccacctcatcctgtgcctataaagaccccagactcaatcagcagagaggagaagcagctgaatgttggagagaagggacttgacttcagagggacagcttgatggagtaaccggagaaaatccagccggacttcaggggaagatcacctacccctcctctgtccccttttcagctcccctctcttcccactgagagccactttcatcggcaataaaatcattcctgcatttaccattaaaaaaaaaaaaaa

SEQ ID NO: 5726 - DNA, 256 bp, Homo sapiens
tttccagggatgtctcattaaatgacatcaaagcctgattctgcaattaaaaaacatttatattaactggattttgaaaaggggaaaagaacaataaaaccaccccccaattcttcaaacaacaaaagaggaaacacagcaacccccttccccaaattttggcatttgttcacctcttttaacccttgcttttttgtaaaataacttatggagaaattgttgtgagcaaaaggtcttaattgcaaaaaaaaaaaaa

SEQ ID NO: 5727 - DNA, 486 bp, Homo sapiens
  misc_feature (1)...(486): n = A,T,C or G
gattttgctcttgtcgcccagctggnatgcagtggcatgacctcggctcactgcaacctccgcctcccgggatcaagcgattctcctgcctcagccccccaagtagctgggattacagctctctgcatgtgacacgctgactccccttctgccatgattgtaagtttcgtcactagaagcagatgccgacactatgcttcatgtacagcctgcagaactgtgagccaagaactatgtactgaagatttgggggcaaaagaggaccacatctgcaactaactggagatggttcagaagatgatgcacacacactcaagcatatcgagagagaaaggggcagaggacacagaaggccctgagtttaatgtgcatgttttggggaatttggaagaagagcccctgataattcatccttcattattcttgcaacttttctctaaatctgaaattatattaaaatataaagttagaagaaaaaaaaaaaaa

SEQ ID NO: 5728 - DNA, 318 bp, Homo sapiens
  misc_feature (1)...(318): n = A,T,C or G
agttttgaaaaaactgggcccaagtttaaacaactagnagaatgatggtagagacatttgaacccaatcttcattgtatgaattcaaaatccaagccctttccattctaagattctgttttatgacagtaaagtcaaactagtttcaattatatagttataaattacacatgtcatgaatccttaaattttatggaaccagaattatcctgaaaaatatatgatttcattaatatgataaagaaaagctcttgcttcacagaaaaataaaataatttaataaaaagaatccagaatatgactcccaaaaaaaaaaaaa

SEQ ID NO: 5729 - DNA, 395 bp, Homo sapiens
ctttggtctcaaattcctgggcccaagtgattctaccgcttcagcctcccaagtgctgggatcataggagcaagccatagctcccagccctgcatttctactgttttcaagaacttgggctctggttggactgagaagttcacaaaattccacttttccggagaggttgcaaaattcttacccccacccctttgaactgcaaaagtacattctttatcttcccatctctccaggaaaagctttccttgcaccctttacccccattcctagtctgttcccacactgggtctttattctctcccaaacaagtttgccctgttgtacttggagattcaaaccctgtctacgatgccacttaataaaagttattttttaaacctagaaaaaaaaaaaaa

SEQ ID NO: 5730 - DNA, 389 bp, Homo sapiens
  misc_feature (1)...(389): n = A,T,C or G
gggttctggtgngggaaaacctcccttttcttcttgnaccctggncgacaaatccacccagnaccttctgagccctgcatgggacccctccccanatcccctttctgtgaagcccgtgactccagactgctctgcccacggtttcactgttgccagcctgagaagagctttaccctgtgtgggtctggagctttctgctcttcccacagaatgccctggaatgcgcagagattttcccatgggaggaatgaagtcttttgcgttactaccctttagtctacatgaattaggcaagtctaaccctgattatgtgaataaatccattccagaatattccgtcctgaactccaaaaataaatggctgtttttttcctgcaaaaaaaaaaaaa

SEQ ID NO: 5731 - DNA, 384 bp, Homo sapiens
  misc_feature (1)...(384): n = A,T,C or G
aactccagtngggaaaccctcctcctggtgncctggacgacaaatccacccagnaccttctgagccctgcatgggacccctccccanatcccctttctgtgaagcccgtgactccagactgctctgcccacggtttcactgttgccagcctgagaagagctttgccctgtgtgggtctggagctttctgctcttcccacagaatgccctggaatgcgcagagattttcccatgggaggaatgaagtcttttgcgttactaccctttagtctacatgaattaggcaagtctaaccctgattatgtgaataaatccattccagaatattccgtcctgaactccaaaaataaatggctgtttttttcctgccccaaaaaaaaaaaaa

SEQ ID NO: 5732 - DNA, 736 bp, Homo sapiens
  misc_feature (1)...(736): n = A,T,C or G
ccaggcagcatatttgctgtcactgggtttctgcaggactgggngaggttgggcagtaaggtgcccagtgtcttcgattgatggtacattatttctcacctgctgcatttatttctgaaaggctctaccccaggaaagaagacatatttaaatgtactcttataaagaactatttggtcacagtcttcctacttcagattatttttactgtatgttatcaatttaatccaatgacaggcaatgatatttgaggaaaccttaaatattagaattctggataacttcctaggaacaatggtactatgtattacataattgtttgttgaaaatatatgttgacagtgaaatatttacaaataaaacatttatgctaacccagattattccagtcttttgtcagaaatgaattagttgatatgttttcatttgttattattatcataacagggatattctctgttgtggggaatgtatttattatttatgcaaaagctctgttttcaaaaccagtctaaccaaacataacgtgggtctaatgaacactgtgtacatagacaggtcccacttggtttctttgctcttctttccatgttgttttatgatgttgactgggaacctttaaatgttggtttattctgttttgtcaccatataaacacattttaaataccaatagattggacatattttaattatgttattcaataaagcatgcagttgattcaaaaaaaaaaaaa

SEQ ID NO: 5733 - DNA, 1008 bp, Homo sapiens
ctggacttggactgacagttcctaaaacctcagccgctgccccacctcgtcccaacacagggggggtcggacttttaagacgaagacctgggatttcgcgccccgggcaaaacgtctcatctgcggacacgcgtgccttgttctggcagcaccctgggaatccttcccgccaaacgggacaggacgatctttttgaaaagtggcttgaaattctgcgatagaaatcagatcctaggggagaaaaaggaaaagggaagaaaagaaaaaaaacgaaagaaaagaaaaaaaaagaaaaaaaccacaaaaaaaaaagacataaaagaccaaacccccgaccctgtgttgacctcctgagcccaactcatgcggctccctccttccttcagggggccccgcagctatcatattcaccccgctctcgttcgcacccacaaagccacccctagcgtagcgcgcatgtccgcctcccccccctatagtgagtgtcgcccgcggtcaccaggccccccgccggagcgcatagctacccaccaagagtgagggtagcgctcggtgccgcatcttaatcagtatgagtggggggatggagagaagggggggagtggaaggggcggctgtgtcggaggcgaggagggtgggacgaggaggataaggcagcgggagcagcagagaggggaggggagaggaagggagggccggagcaaggggagaggagcagggcatctttagaagagcggagggaggagtgagagggggcgtagtaacgcatcagatgttaccactagacggctgttaggaccgccgaggcccacaagcagtgcccccccaccaaatgtcgcattgcgcggcgatactgtgtcacccacgagagacgggatgctgtccgctgccccccatagtttgttcagtcctccgtgctgcagatatcgcccgttgcctattcggtgggacgatgccgcgtggcgcccgcgtggtccaccatatgactccgtggttaactccgatccg

SEQ ID NO: 5734 - DNA, 576 bp, Homo sapiens
  misc_feature (1)...(576): n = A,T,C or G
ccagtttaccctgccaggnattcctcttggcaagnaacgccaactcgcattttgcattaagacactggnaaaaccttctcgtcattggtcctggcatagcacctcccgtgtccggggtagatcttgtaccctctgaaactgcaaacctcgacattcatggcagcagctccacgggaggagaaaagatggcaaagagaactccatttattcttatatctgatatatcggatcttattttctcctgcttattttgtgttttccatttaccaaacgctcttcattttcttctttgctgcctactcttgaattgattgagttaaaatctatttctatattccccctctccttatatgaaagttacacgctctattttatttcactcttttcccttaaaaacgtgagtgtgcattattaaagggctagagttaagtgatactttagtgatacatctctatggctctcagttaaagtgcttctgtttgacaatccctactatctgttcctggatttaaatactttatataatgaataatggaagcacaccattaaaaaagctttactgtaaaaaaaaaaaaa

SEQ ID NO: 5735 - DNA, 422 bp, Homo sapiens
cctgggccgaggctattgcaaattctggtccctgaagaatcaaactgcactacagaaggatcaaaaactgaagtgatatttctccattggggcccaactttacagtcagaaacaatcagcctctgaaagtaaaaatggatttttttctaactttaatgttaatagttactgttaaatttagcaacaaattgtataacattgagctattttttattttaattttgccagttactataggcaaaattacttaataatagctcttcataaaaagctatagttttataaaaagctattttttattatatagcatcatggaaaacacatttttggagggtctcctatacaatctttctataaactaaaaactattaatttaacttcttgtttcagtaataaaaattataaatccaaaaaaaaaaaaa

SEQ ID NO: 5736 - DNA, 292 bp, Homo sapiens
acttctttatgctttggaattgcatcttctggccagcccctatgtaaatgaactattcttcctctttctcaagaggtcaagtttgttaccagcaatcacaagagccctgagttcttccacaccaacaaacatggtgccactggggaatctgagacatacagaaaggaggaggtgaaaagaggtgaggaggaaacagaaatgaaaaatgaaaagaataagggaaaatgagaaaaaggaaaaatagggctattaaagaacttatatgacaataaaaaaaacaaaaaaaaaaaaa

SEQ ID NO: 5737 - DNA, 372 bp, Homo sapiens
gtccgagtctctttctttttgcctctgctctgggctctgggggttgaccctgaatggaccacacagccatggtgtctcctgtcctccaccttcactggtgaagactgggagtgaggaagaagagtgagattgcaccctctctgcaggaccatgggcagaccctgccccttacctcttctcaggggtctctcttctctcctgttaacttcttcccattccctcatcaggcctttgcttggtttctggacatgccgcccacacctttgtaaattgtccctttaatctcttcaaataacccagtttaagggtgccatttgtatcctgccaggatcctgtctcaaccactaaacaatattcacaaaaaaaaaaaaa

SEQ ID NO: 5738 - DNA, 253 bp, Homo sapiens
aaaattttttatctttctctgaattaggagctgtgtttaacaaaggtcgtcgggggagtgattatgccccagagtccaccatgagagtgctgaagagccaaaggtgatggacccctctgatgcttccctgccatcagtgagagaagcctcatgtttatgtattttctatgctgagatttcactcaatatttaatgtagaggagggatttggctgtctgaaataaatactattattattttaaaaaaaaaaaaa

SEQ ID NO: 5739 - DNA, 370 bp, Homo sapiens
tgaggtgaaggcaaaacacaaagctcacatatgtgaataccttatgaaagtcactggctcataagaggaacgggatgcagactgcagacttctgactctcagctagcgtccctgctcattcccaaggaaatggaaagacacaatgctactgttatttgaatgtttaggagaagggtgggtggtggtaaaaggaaatgtctcacaagccccactggcacttgatttgttgaaactgtaataatcacactattaatgggtctctttggaataatgcttttaggagggcttttattggcattatttgtttgacaaaataacattgtgcacttgatgtcattaaacccattttacagattgaaaaaaaaaaaaa

SEQ ID NO: 5740 - DNA, 599 bp, Homo sapiens
tttccgaggaaaacctgccaactcccagctaataatgtttcacagccgtgaccacagcctctgcctgctggcacaccacaccacttccaccctgctctcatgccaggcaccattcagtccccagcatggcatcagctacccacagtaaagaacaacaggtggtttggaaaaatccagccaaatgcttacaactccctctgggcattgtaatggctatttaatggtgaacaaactgaggcttagagatttggcactcttgtgtggactggtcaaagatgttcctaaaacaacattgctgtcaccaagcctcccatgaattaggctggctcctcccatgtggatatctgcttctgcatagttggtgaagaggaagcatcctcagtcaaagctaccagctgaggaacccttaggaaaccccgctggtacctggcctgtcttttgtaagtatacatcaggccagggggctgcttgccaagcaacatcattgactgcatactgtttagtgcatgcattaccaggcctcaaacatccaagtgatgctacctgaataagtcgagaatttttgataataaacataagccaaatcaaaaaaaaaaaaa

SEQ ID NO: 5741 - DNA, 572 bp, Homo sapiens
  misc_feature (1)...(572): n = A,T,C or G
ccgagtcagcactatttctgnaagattcattccttttttttcctcagggnattctaagtcacaagnaaaacttacacactttggtcaactttcagaacagaaaaatcttcaaagcttgtggacactcacaccaacatgttcactaaggtcattttttattattgatggtaacttgattccattgcttgagaatgcaatataaaaccagttctttgaaatttatagatattataaacccagtaaattttgtaaacatgttaagtacattttcattgcagcgttctttatatgtccatatatggaagagttctgatcaagttgctaattgtatagtttaaatcttttatatcattaactataatttttggtttcctgatctttcagttatatagagatgtgtgttgtgtgttgaaatttatcaaagcatttttcttgtatttactgtcatcttgtattaatcattttgttatcttctgtaggctaataatgcagcggattgtgttgaatcatccttgcaactgcaatctccttgcagttgagataaactaaatctgaccagaaaaaaaaaaaaa

SEQ ID NO: 5742 - DNA, 538 bp, Homo sapiens
aaagcgttcctccccagaatgctttcagctgcaaggaaaagaaaaacaattaaaacaagattggattttatcagcaatattattaactcaagacacctggggggccagaagtagccacaacatcgtccagccaattctattactttggttcttcagactcaaagatcttgatgtttgtggactcgaaggactgcacttcaaaacactttacttcgggctaatgtgcaagacatttcacgagctgccctttgccacactccggggtcatggctttgacaactccatcagcactctactatttagtctgcaatttccttaggattctctacttcacgtcacttcagtgtatctgcctataaagtttcctctgcctgaaatgccctttcctacctggtctatctttgggacttatcctgagatttactcctctggtcatagcttaccagataccccaaaacagaattagacacccttttttctgagttcctccaaccatgtttcattaaagcttgatttgtttggtttaaaaaaaaaaaaa

SEQ ID NO: 5743 - DNA, 423 bp, Homo sapiens
aaattcaattagaagaaacacagtctaatacctactctatatataccaggctgccttcagttctcaaaatcgttaactgactacaatcaacataccacacagacctcagtaaaatataagcaatggctaactgcttctatgtccccaaatagctgggaataagcctcctattaagacttctcagccaagcaaaaggagataaacagcctggcgaagatgatcaggctaaagatgcctccttcccatccaaacctatggcttcagatgtcttcacagttggcactatcaaaataaagtagagaggggtgatccagaacataggaccaactaaaaacaactaaactaaaagactactaagtttctgagaaaattgtattaccaaagaaataaaaaatctaacttaaaaacacaaaaaaaaaaaaa

SEQ ID NO: 5744 - DNA, 562 bp, Homo sapiens
cagtattcctgcattttgctgaactctccctttggctgtctgcccacagtgtcttctccctgaagctgacttgcagagaactggggaaggaaaggattgttggggccattgttcccatgataactcacctttgaacacttcttgagaattgtcaatagttctgcattcactattttatttttcattgaaatgaggacttttaaggtttatcaaatgccaatgcctctatgtttattttaaaagttatacctagctacttaaaaaattatatatgctcaatgagaaaaatctggaaaacacaataagtataaagaaaaaagtgaaataatttgtcagtatcatgaatcatataacctatttttcattctttttcctacaatatactaggttttttgtttgtttttttttttttggaaagtcaggattgtattttataccctacattgtatactataccctacattgattgtatactctccagtcattctcacagagactcacagtgatgggtgtcatcatctctgtttcataaaagaggaaactattttcaaaaaaaaaaaaa

SEQ ID NO: 5745 - DNA, 722 bp, Homo sapiens
actcgagtgaaatttggtgccgtgactcggatcaggggacctcccttgggagatcaatcccctgttctcctgctcttttctccatgagaaagatccacctacgtcctcaggtcctcagaccgaccagcccaagaaacatctcaccaatttcaaatctgcagctgaagactgacgctgcccgatcacctcaaaagccctgtagaccatcacagacgccgagcttcgagtaactctcacagtggaagattatttatgaaaactgcggcagtcatcatttaaagttatggaaccgccattgcaaaattataactgagacagttgaaaagatctgacctaactgactccatcttgctcctaacctccaagctgtccttgttcattcctgagcacaggccaaactaagtttgggaggaattcaatttacagtttgactttgagacaaagatggtaacagtcccttctgaaaacaaaccttactgcctgtgggctggactgcataaagccagaagattagaagttatggcaatcttactaaattcaagatgttgctattttcattaaactaatatcaatgtcttatttattaaagattacatgacaaagatcattctgttttgggctaggtttatggttttgtaacccctatgccaaattttgacaccttgtagtatttggcagggataagtatgaaattgcttgattaataaatgcagatcggccag

SEQ ID NO: 5746 - DNA, 307 bp, Homo sapiens
attgttgtgtacaaacccaatttatgggtcttcttcctcctccatatcataaaatgagggatgccgataagggaaatgggactatggtcatgtaggaaccaccacctgaacagctcggccccctatcactttcttttctcctgtgagaattcacccccttcactaattggacccatacctctccccagcgatcgtacgatgtgcttgtaatctcaatatagagatgcattaactaataaaaggcttccaccataacatctccaatgaataaatgagtttcagattttttttggcaaaaaaaaaaaaa

SEQ ID NO: 5747 - DNA, 331 bp, Homo sapiens
ttttcaccatattgggccaggctggtcacgatttcctgacctccatgatcctccggcctcgggctcccaaaacctaaggaatttgtataaaaccttccagataactcagaagctgaggacttattaggcaaatctacttatatgtaattaactattagaggtccactgtattttttttgctgatgaaaaatacaaagattttctttcctactagaaatttttacctgatattatgtcactatcatttctttgaatttgttagatatacgatagattaaatcaatatgtttccgcaataaaagaactgattctgacatcaaaaaaaaaaaaa

SEQ ID NO: 5748 - DNA, 508 bp, Homo sapiens
ccgagtggccaaatctttttgtgtgagaaaaagtggctgttgggaagatcaagtaattgaatgacgtgaatttcctggagtttccataagttcctgtaaatttagcctccaactgaaataaaccaactggtactcttgtgaaattcaaaattgtgctatcatcagctaagctgaatgaaaagaaattacacatgaaagtcataggcagccctttttaaaattgtatcttttatagaaacatcattatatggaacaattggaagaagcaaatttatttaaatgtgcatttttaaggcatttcaacaaaagcataactagcagaagtacaaaaaattctgaatcagttaaaagactatcctcagaatatgcgattaaaatccacatacaagccatgaaataaaattcagaagtatgaactatagcataacatacaactgatattccaacccattaaaataatatctaagactaataaaatactactttaaacaacttaaaaaaaaaaaaa

SEQ ID NO: 5749 - DNA, 389 bp, Homo sapiens
aaagggaaaaaaagaattttattttcaacccctacagaagcaaaagtctactgccatcaaacctaacactggaattgatatgattccaatgcagccctggctttgatggtattttcagaatagattagcatttgaattggcgactgagtacagtggattgccttcctcaatatgagtggcagcagtcaacccattgaggacgtgactagaaccagaaagtggagaaagggaggactccacccctctctgcctaactggccttcaccctacaccaccggttttcctgggtctccagctttctgatggcagattttgagacttcttggcttccataatctcaggaggcaacacttcataataaatcagttttatatacaaaaaaaaaaaaa

SEQ ID NO: 5750 - DNA, 282 bp, Homo sapiens
  misc_feature (1)...(282): n = A,T,C or G
cgggtgcaaggcatccaanagaattgcttgtttgacctttatccccacttcctaaaaacaatgacagaaaaggaaagaaaagtgaaactctactcttagtagattccccatactacaaaaacaagatgatatacaaactaacttttgaaacatcacacaaataaagctgaattttatgtcaattacttaattcttaaaatggtatttgccaactaaaataatgaggctgtacagaaaatggattaaaaataaaatttttgtcttttatgaaaaaaaaaaaaa

SEQ ID NO: 5751 - DNA, 392 bp, Homo sapiens
gggcctcttttgttggccaagctggtctcaaactcctggattcaagcaatccgcccgcctcggcctcccaagtgctgggattacaggcatgaactaccacgtccagccagtgtgaacttgttaaagcagcttttgtgtggattgatacagaaacagcagaactctgttgccctggcaatagcaacatcagtgggaagtcctgtccacgtggcttttgaggaaatgccttgcaaagctgggaaaggtaaaattaaacctcaatgacactaccaattgtattactaaaaatagcaatactatgaaaatctatcttctgtattcagcacactaatgggtcactaataattcaatcctaaataaatttgccaacatagactagaaaaaaaaaaaaa

SEQ ID NO: 5752 - DNA, 220 bp, Homo sapiens
gaggtccgctccaaaccctgtttgcctgggtatcaccagtggagactcagttggaaatgcagaaatcacccaccttctgggttgatctcgctttggagctgcacaccggagctgttcttattcggtcatctttcctagtctcccacatagtaattttctagtggactagaagaaaaatgctttattaaaaactcttcagatttagctaaaaaaaaaaaaa

SEQ ID NO: 5753 - DNA, 394 bp, Homo sapiens
tccttttggttccagtccatatggcaactctaaaaaaccggtttcttgcccagcgccgccaaccgcaaggaacatggccgccgcgcaccagactaacatcagcggtaacgagattaactccagttgcagagcgataagacctaaaatcgaacccaacaccgtaccgccaatacgctcaaaggcgcgagggacaacgttactccagaacgagattggccccataatcaccaccatggtgaccagcggccaggtgctttccgggatagtaaacaggcggataatgagaaaagctgcacatttttcactttgattttataaaagaggtcagtaatcgctgaaatctagctgagccctgaagtaaagttctgagcaaagaggtacaaaaaaaaaaaaa

SEQ ID NO: 5754 - DNA, 415 bp, Homo sapiens
gaactggagtgcttgcaaccatcttcccttgattgacctgaagaaagctcatctcaggagaagtaaggccaagaggcaaaggaaaacagagctgagaaaacaggatcaaagtaaaagcccctgaaggtcattcttgcccctaaatctgtgctatatcagatcctggcaaccatcattctaccagactgtttctgaatttgacttttcaagactccacttataagtgaaatcatggagtatttgtctgtcttttctttttttttgcttatgcatttcttcatttgaaacaaaaaataacatttcacattcttttattctttcatgtttatattcagaataaaagtcaatattagcacccggcaatctttgttttttaataaagccacattgtctttctgtgccaaaaaaaaaaaaa

SEQ ID NO: 5755 - DNA, 805 bp, Homo sapiens
aagaaacacaatgatgtgttgtgcgagttgcaaagaagagttaactgtgttagcaggagagacaaacatagcagctttctccggggacttcctgctcttcttatgctgtcattcagtgtaaaatagcattctgatcaggcatcctatgacagtgaggaactttcccctgggcctccttcaggggttggagtgggtctttgccaggaaatgttagaagactgacactgcttaaacttaaatgtataagagactagaatgtgggcagcataaacatgctcttaacgtttctaattataacagctgaaacatttctttggaatcttccatttcattccctcctgaatgaagaagcgccaatgtaccctgaaacagttacatgagcccatataccactgtatcctagagactctaaagaagctggtcttttcactatttataatttttttgtgtatttctataagaaataactaaggtaacatgtaacttttacataactaaggttaatgtaacttttgccttgtggaatttattgaaagaatatacactatggcaccgacatttggaaaattactttcctctatgagagaatttataacctgtagaaaatagtagggatcttaacgttttcttttagtttcttagtttttcactttttttaaaaaattgcattaaggaggtccagtacatgctaagcttctaaggtaaacagctgtgtatttttcaaacagcttctatagagtagactgagatacagtactgagctatacccactgaacctgattagcctcatgttgttcaaggagag

SEQ ID NO: 5756 - DNA, 804 bp, Homo sapiens
aagtgatttcatttacattgcaaagggaaacagaaaacaaacaaaaaacccagaggccacgacttcccgggagtgctccagagtgtgtgtattgctagtagaagctatgtgcacctccacaccccggaactatttttgaagctttgatgtagaaacgcacaatacctacagcgaccttaaatttctgtaaaacaaatatagcatgcattgatgcaattgccatatatttatagaattcaacaattgccttccaccaactttatcaaatatctgctgcatgggggcggtgctaggacagaaacataaacagctctgattggtccattatgcagacgaagcacatgcttcaaggaccaaaaaagcagagagaacaccgtgctcctgccttactggccaaatgatgcaacaagaaaattcaggaaagttaatttaagtttcaacatacagatttttttgtcccttggaagacacagttttaagttttagttgagttttgttttcatttttatttgggtacaggtcttgggatagttcggatttgtgttcagaaaatttttactcctccacactttggaggaatacccttccctgacttagggatgttggacttggccatgtgactattggccagtaagatgttagcaagcatgatgccatcaaggtcactgtggatttgcacagtgggcctggctctcctgcacttccaacattgccttgagatgcatacacatgcctgcgtccaaggaagacggaagacacctggagcaaacttggactcagcccataacttgaaagccagcccgg

SEQ ID NO: 5757 - DNA, 615 bp, Homo sapiens
cacttgaaaatccaagtttcaggagaagaagaacagaaaacatgtttcttcatcttaatgtacctctgtataagttcttgcattcaattacacataatcaatgtacagaatgttcctcatacaatgggcattccaccttgtatgtgcacacacggataaaaaatataacttctgtacaaattacattggcagcttctgtgtcttacctttaaagacatgtacacgcttgcatatccatttttggaggatggacatttaattacaattttagatttatggtccaacataagggaaataatatagctaaaaatgaaagaaaaagattctgagcttaatttctgggtgatgttatgtacaacaacccccccatgacatgtgtttatctatataacaaaccttcgcatgtacccgcaaacctaaaatataaactttttaaaaagattgattccaacattaggaagtcaatgtttctttaaactgcaatctagagaaagatgctactatagttttgccttattattatatttgtattttaatattttactataaaatgtattttattatgattgattattttaattaaaaatctcaataacaaagtcaaaaaaaaaaaaa

SEQ ID NO: 5758 - DNA, 428 bp, Homo sapiens
  misc_feature (1)...(428): n = A,T,C or G
tttcggctggnatgcatggcacgatctcggctcactgcaacctcagtttcccaggttcaagtgattctccagcctcagcctcctgattaactggaattacaggcctgtgccaccacacccggctaattttgtatttttagtagaaacaggtttcaccatgttggccagggtcccacagactcctgatctcagatgttccacccgccttggcctcccaaattgttgggattacagaggctgtcttaccagtgcaaagaagaaacccattcattgagaatgaagacaaccaagagaagacagtcaagagatggagagagactgacatctgctgattttatttgagcacctgggtccatccacgcctaatacccttggccttttcagttacatgagccaataaatctcgtttttactcaaaaaaaaaaaaa

SEQ ID NO: 5759 - DNA, 738 bp, Homo sapiens
attgaattttagcctttcatattatcatgaggcagagcaagattacagaagagagagcttcaccaaacatcttccatgcaaagacaccaagttaacaactatctacacagaaagaaacaccttgtaagaaccaaaaatcaggtgctgaaccagaagaacttggcttgcagaaccagcgtgagacttgagaaccctgagactgtgccgtgccctgatccacaaagctgtcaatgcgtagagttttcagatctcagcaaaagttcaccgtaaggtgtcaagcactaggtgtttgaaatgtattatttctaatataagcgcctaattaagttttcaaaaacaaagtcatttgcagttctcatagtgtgtacatacatagtttattaaaatttgctttgtgcaataatgtttttaatttggtgaaaatatctgaacatatttaggatattcattatgactgaaacaatatttccatttaataataaaatacatattcgtatattaaacctaatttgggtaacgatatgtacaataatccatacttgttttactaattcattatgaatcatataagtattttaggaattgtttatcatctgtgatagcctcaccctccatgataatcacaaagacgtggtgctttgcatataatcacgatgaaacttttttagatgagaatattgactatttgtaaatacaccagcaataaaatgtttttcagaatccttaaaaaaaaaaaaa

SEQ ID NO: 5760 - DNA, 372 bp, Homo sapiens
aagggaacagcccttgctacattcaagatgctcagtgaaccccaagcagacaaatataaagaaaattacacatagttaaactactgtacatccaaaataatgggaaaatctcaaactgtcagaaaaaaagacacattacattcaggggaacagcaataagaataacagtgacttttcaacaacaacgacaaaaaaatggaagccagagacaatggaactatttctttaaagtgcctaaaggggaaagaaataaaataaaagctagcctgtaattctatctccaatgaaagcatattctataaaacaaagtggaataaagacattcttcaacaaaaaaaacaacaagaatttctccccccaaaaaaaaaaaaa

SEQ ID NO: 5761 - DNA, 554 bp, Homo sapiens
aaaacaaccctaacaattttaaggcaataaggactccttccccattcaaaaagagcaaggagtgtgcaaggagcacctgtgggggctttagaaatcctcttctcttcatccagggcagcagtactggtgcagtttacgtaggaggcataaacccagacagaggaatctcgcccgggtcaagcttgccctttcccaactcgcagcatggtctgtcttgtagcctctctctagatcttatggttggaagtggaaatttactaaaggaagagaagggaagctggccatgcattggttcaaggagtaaaagaaatctctgcactcttagactgaatctctgcatttcctagtaggaaacatttccattgaatataaacatataatagctctcagtggcaaatatttttgtcaaaacaattgtaagagaggatcagattcaaaaatatttataataagatgttacaagtgttattctatgaaatctcagattctatgagattctatgaaatctcagataaaaaataaataatgcctgaattgggccaaaaaaaaaaaaa

SEQ ID NO: 5762 - DNA, 266 bp, Homo sapiens
  misc_feature (1)...(266): n = A,T,C or G
acaaacacattttcaatggaaaaaaccaccacaccaccttcaggaaaagctccttacaatgacttngctgaaaccaatgacaaaaccacatcgtgcccttgtggataatcatcttttgggcaatggacttagaataacttcatcacacttaactgggatgtaaatttaatacatacatataataagtgcatataaatgtaatttatcttgaaaagaattccaaggtcttaataaatattatgctgggttatataaaaaaaaaaaaa

SEQ ID NO: 5763 - DNA, 319 bp, Homo sapiens
  misc_feature (1)...(319): n = A,T,C or G
ttctcaggtgaaaaacgtgcttttcgcctcccacctgattctgagacctccctatnatgtggaaccatgttctttggttttgccaatgagatttactcacgcaatattgggaaagtaaaaatgagatggagacaatcttactgtggcttccacagggattactgttcaactgtcctttgttcacaagaaggttctaactgagagaaaaagaagatgaaagcctattatgctattcatatatttggaaattttccctctggtaatttatacaacatagatttgtcacattaaatgaaaatgtcattgaaaaaaaaaaaaa

SEQ ID NO: 5764 - DNA, 316 bp, Homo sapiens
ttttcgagggaggttaaaaaattgctgaaaactataaagcccccaaacctgaacaatgtgaagaagggcaagaatgaccccagcccgaccagtctgcctgctgctgcattcctgcatccatagcatatgtcctgccgcatcactgccatgcccaagaaaaagctgaaggggatgctacaggcgatagagccaaggtgaagaacaagccagagaagatccgtaaggttgtctgcttaacctgctcctccaaagccagagcccaaccctaaaaagtcccctgcaaaggagagagaggaggtacccaaaaaaaaaaaaa

SEQ ID NO: 5765 - DNA, 450 bp, Homo sapiens
  misc_feature (1)...(450): n = A,T,C or G
gctcggggataaaatcttcctttgctgcccagctggtctggnattccttgcttcaagcgatcctcccacctcgacttcctaaagaactgggattacaggcacaagcctgccccactctgcaacccggtgtagagaccgctacatcaaaagcacatagtaggagggaagaaaaaacccacagagttacaataatgaaagtctggaggcaaatagagtagaagtctacttgaataggtatccctccgtaggatagttcatcacatattagaactagaaaggtccttgaagtttatatagtggctgggctaatctgttagattttcaaagtccaccaagatcagttaaacaattgctgagctaaagaaaagagcttacaattcattgagtatctttgacatcccatgcagttattgaaataaatatttgtatgctacttcaaaaaaaaaaaaa

SEQ ID NO: 5766 - DNA, 768 bp, Homo sapiens
cgtttttaggacaaaagggggatggattccccaaattgtgctgactcttgggaaaaactgccgagccaaaatgtgtctacatgaaagttgctgactctacagaggcttaaggacttcttaaaaccgaaaagacacaaatactctcatttcacagaagaagcttctgagatttctcgtaagagccttgcttcagtaatcacttacaccaggatttcatgtcaagcactgcttcaagagatcctagcccaggacatccacccctcaaaagactgcgtctctcagacttaacaaataaataatcatactttgtgtagtaaagaaatattttaacaaatgaatacagagtgtttggaaatgaagtaatgcacaaagatataccacgcaaatatgaacaaaaaagatgcttttgtaacaattttaagcccaagtaaaaagccaatagataccaatgaagaaatgaatagtgttatgtttatacaaggttcattgagcaataaaatactagtcacgttgaagtgtctctgaatgaggaatcaggttaataatagctgattctatgtttttcaaatgtcattgatgctaattattttatttcacagacattatattcttcactcccactttcaaatttgaggatttccacagatctctaagagcaattggtaaaagcaaattgtgtatcaagtccttctcagtgattcaggaagtttagacaactgttttcttccaaattaaagtgtgaaacttgcacagctaaaaaaaaaaaaa

SEQ ID NO: 5767 - DNA, 518 bp, Homo sapiens
  misc_feature (1)...(518): n = A,T,C or G
ttccgaaactcaaganaacattaagctggcagtactgaaacagagaactgtttgtggaaaacattggtgcataacaggacatgcatagcaggacaagaatcagattgtgtctgtgtaatgccaagaagagttgccagaagtacttatcatctttgaaattatccactttgttatcccctttgctgtttttgcctttttataccccatctcttagaggatggggcatttttgttttgagtttttattttatgttaattatagccgactgtaacctgttcaaaataataatttaggagctcttctagagttgggaatgctgagaatttttaaaaattactaaaacttggaatagctttttcaaatgccaaagcagatttgtcttgaatattgattttgatatcagttttatgtgactttttgcctatacattagttttgtttaaataatttcatgccttttgtatctaggaaactttttcacataaattaaatacagattaaatttgaaaaaaaaaaaaa

SEQ ID NO: 5768 - DNA, 560 bp, Homo sapiens
atacacccaaaacaaaatggacagaaattccagtctcataaatgtgagagatccagaagatacttctacaatttcccttcagttacatatggacactttaataaaagaatattatttttaagtgaaaaaacttaagcttattcctcaaggttctaaaatttcaatcaactatggaagtgaaaatttcctgatattttctatgcatatgaatttagtcccactctctttggtttatacaaaaggaacttgtatcagtttgttaaatcacagccttagaaattaagaattaatgttcaggattagagagctatagggtctcatattttggttttattttgtaagaaagtaataaaggtcattgtagtaaaagctgccaattaaggctaattctagaagtgaggacctcagttttattttctatagtatcgtatgcttcttccctttctacttgtaaatttatttttatttcctaatgcataattttctaaaacattagtaatcattaaaattcttatagcatgaaataaaaaagttctctttcacaacgaaaaaaaaaaaaa

SEQ ID NO: 5769 - DNA, 575 bp, Homo sapiens
caggtaagaactcattggacacttgactcctgatgttcagacctatgtttgagttgttccgctaatcctaggagagtgattaaaggtccacatgtagtataaaaggaccaatgtttagactgtttcttagagctgaaaattctggattgaagagtacaaacattttaaaattcttatatacatgccaaatagattttcagaaaatatgtacctattcttatttacaccgatatcttattaaactgcttgtcattctcagcaaattttagcatttttatttttaaaatcttaattaattggtgtataaaaatagtatcccattattgttttaatccccactttgttgattactagtaagcttaaacaattgtttatgcctgtattttttatttgtatttcttttgtgcattggctgttcatgttccttttaggcaattttattgaaatgaacataaaagcagcatcaaaacaacgtggttgccatataactaccaaccagtttgaagccagcttaactctttttgttaggaatatgaataatgtacaaagaattccgcaaaagaaaaaaaaaaaaa

SEQ ID NO: 5770 - DNA, 625 bp, Homo sapiens
cttccgaggaagaggtgcacttcaaggcatagctgttatcttcaccaaggaaaagctggcagtattggataaagcccagataaacctgtaccaagacgtgatgctggaaaacttcaggaacttcatctcagtggggtcttgctctgtcacccaggtggctggagtacagtggcctgatcgtggctcgctgctgaagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagtcttattctggtttcaagcaatcctcctacctcagcttcccaaagtgcagggattacaagtgtgggccactgcactcagcccacaatgtcttttattttttcttcaaaaacaatgtccttttctgttttaattgacttataagtttcttcatttggatcatggtttattcctagtttttcttgcattatattttcctgccagttatagtttgtaaacagaacagccattcaagtgcaaataaaaccatccctgaagtgtcattttcttactgaaaaaaaaaaaaa

SEQ ID NO: 5771 - DNA, 461 bp, Homo sapiens
aaccctaactgccctccaaacaaagttgctagtattggaaggaggtttgaggatactcatctagtgcaagagatccctcatcaatttcacttcatcttttcacagagcttccggttgtataattctgcggtgtaattcagttactaccaaagaatctcatgtcattttttaacacttttcactgcttgaaaggtccataggttaaatatggaatttacaactttaccttttccactatccttttgtacatctttaaccaatcaacaaacatctctcaatttattttccttaaatgtaataagtaaaaagtgtggttgagtggaagattaccaaagtcctctgatttagatgtattgtattgtgttgttttggttttttcctcccggaagttcactgttgttgtatattctctttattattaaaataaaatatgttcttttgaaggttgaaaaaaaaaaaaa

SEQ ID NO: 5772 - DNA, 764 bp, Homo sapiens
aagagggtcactaaaagagatgtgagatgcaagcactaggggactgaagaccagagaaaggcaaaaggaatcctcaggttgtctgtgcagagaccccaggatagagctatgtcccaggcatggaacaaccagcagtatgagtagctcagaagacttcgggagaaaatgtggaagatgaaattaaatggcaatctaatgatcctgaatttttaaagaaaagattgacacaatgaatacagtattttgggttgaattagtgataagtacatatataataaagtaaatttaaagacaaaaatatattaattgtggggaaaatacaaagatgtacaggaaaggaaaagtaaccatattttatatgactcagctgggaatacagttttcatagccacagtaacagaatattagctttaaccaaaaacaccacattattatatcgggaggatgaagaaggaaaggatgcatgtgtatggaaaaaaaaaggagctaaatggtcatcttccataagggaaaggcaatagataaagcctaaaactggaaaattaagaaatagcaatataaccatgccatgcacagacatggaaatgaatagtacgataaccacctaaaaaaagtgacaatgactgttcctggagaaagagacactgtgtgacaagagctgccaaaagctgggctttttaaaaaatttataaatctttccgaaatgtgtgggaggggaccttatatgaagggtaacattggtgcccaaaaaataatgtgagggg

SEQ ID NO: 5773 - DNA, 895 bp, Homo sapiens
tcttcggggtatgaagcaaggtttttaaatgcgctgtcaagaaatcaatcctacaaacaaaatgaagatggcaggtacaagaaagggtgctcgactggtgaattaattcgtagcatacaattaaaacgttgtaatgcctcgagaactgaatcagtgaacagtcggtactataaatctttcagtgcaccattgtaaacaggatataaagttctaatacagcatcagtacctatgtgataatgatttataatatgatgaggaaggagtaaaatgtttgacaagcgactttgcccaaattaactaactttttgtgtttaacacaagaaaatcctaagtttacaccaactagatggacacaaatggcctccttggcctccgcggcggatctatgaggacgattgccttatacgagggcgattgcatgatcctcgctgactgactcattgaggtcgagaagtcagctgctgagagcgccgtcaaccctctcgcagcgttactgcggttatccaccgaatcacgtgctacgcagggaccgtcagcgcgccgacctcctctcacgccccccacccgcccgactgccgtccgctcaccgcactcactaggtctcacccctcgccgccgccctccgtcgttcggcgtcggcagtcgtcgtccacccggcgcccttctcccccccccccttccccctgtcctcccccccccccccaccacaggccacggcccaccgccccgcctccgccccttctctcgcgctgggccctggcgtgagccgcctcggtgttattctttccccgactttgcccagccaggcccctgcgccaccgtttgccgcgcgacaaccactttttcccctcgaatctaacacccccccccccccttctccccctgtccccacc

SEQ ID NO: 5774 - DNA, 223 bp, Homo sapiens
  misc_feature (1)...(223): n = A,T,C or G
cagtatggtggtgtgcacctggnaattccagctacttgggagactgaagcagaaggacacttgaggccaggagtttgagaccagcctggacaacatagtgagattcctgtctcaaaattttaaaaaacccacaaaattttgttcttaacaagatgcagccatttttgttgagtgaataaatgatgtctgaattgctacaaaaaaaaaaacaaaaaaaaaaaaa

SEQ ID NO: 5775 - DNA, 372 bp, Homo sapiens
actcgggggactgaaacatcattacagcagcctgtcctggctgccgtggtcatcctctacattgacatcacacggaggtggaactccatgaccctggaccagcgggactcagccggccagaccttccttctgccgttataagactttggtgcccactgaaggggttaaccagatccctgatgcttgagacctttaagaacaaaaataacctgcaaaaggagaccttgctattgaaatggagaagaaaaaatggtgcttaaaataattaggaaaaaaataaaaactagtgagaaaaagcatgcacatgatgaaatctaaaactcaaataatccgtttaaataaatttgcttttgattgttaaaaaaaaaaaaa

SEQ ID NO: 5776 - DNA, 295 bp, Homo sapiens
  misc_feature (1)...(295): n = A,T,C or G
gggagtcttatgcaagaccttggggaataaccaggaaaagcaagcaagccctccaccactgnagtttcagggcaaaggggaaaaaacaagataaagtagaaccgtcagtacaagtggaattattaatgacgtccaaatgcagtcattaaatactatcagacttatttattgactcctgatattaagagtgaacaaacccctggccaagtgggaacttgctcggtagcctttatctttctatcactcattcagtcaattcattaaagcctgtttgtctctcccaaaaaaaaaaaaa

SEQ ID NO: 5777 - DNA, 372 bp, Homo sapiens
tttcccagggcaccggcgacttggtaagtacagacgcaagcaagcaaggcccataagaagaccagggcaactgctcttcaggaaactggtcagacatcagaaaatggcctgatggtgaaactgtggctctattactttgacttggggcgcagcatgcagacatatctgcagcatgaagctcctccagaaccagacaacctgaatctacaaggcaaggacttgttcaaaccaacaaatcaatcttccatgtgaagctctggggctttgcctttgtaagcccctcccttgccttggccagacagtcttcaccagagctgctcctttttgtatattatgaataaattcccatgttttaagtcaaaaaaaaaaaaa

SEQ ID NO: 5778 - DNA, 761 bp, Homo sapiens
gtcttttggtagggatctcgctctgtcacccagctggaatgcatggcgtgatctcggctcactgcaacctctgcctcccggattcaagcaattctcctgcctcaacctcctgagtagctgggattacaggcacctgccatcatgcccagctaatttttgtatttttgtagagatggggtttcaccatgttggccagactggtctcaaactcctgacctcaggtgatctgcccgcctcagcctcccaaactgctgggattacagatgtgagctaccgtgcctggcctacttttacattttttaagatagtcattctaagaattattacatcattaatgccaacttgcatttgccatttactaaaccactttaatttttttttaaaaaaaggctaagaaattgactagcatttgtaagtttctaaataatatttaagataaacaaagcttatatccaatgatgagggaatttatgccattaacaaaatagttcatttttactaagtgtttgacaacctatttcattagaagtaaccaaatttacacgcaaatctacccttaatattagaagttgcaatgattgatattgttcactcttcacatagcttgatgttcttaccttttctacgtggaaataaggggcacttggttggtgacttgctattctgcaaaaatctacatgcctaaatactttttaatctcagaaaaagcaaactttctttaggtttcttaaattaaagaataaaatataaaaaaaaaaaaa

SEQ ID NO: 5779 - DNA, 473 bp, Homo sapiens
agcccctcctggtccagaggtgcagtcacaaaacatggagtctctgctagcctggctcgctgaaaagccatgtagagcagagaccctgccaacctgtgttggaaaagcatcatgagcaggaatgaatctttgttttattaagccactgagaatccagagttaatttattgccacagtaaaacttagttaacatgagcaacgtgctattttattaaataaaatcacaacaaatgtggtgtgtgaatacacgcacgtgtgtatgtttgcgtttgcttagtataatatctggaaaattatattccaggatgtaggtggaatatggatattcataattttaattttactctatattctttttcctgaactttatgtaataaatatgtatttcaaaatcagaaacagcagaactatttccattttggtaaataaaaagcacattgataatatcttaggtaagaacaaaaaaaaaaaaa

SEQ ID NO: 5780 - DNA, 597 bp, Homo sapiens
  misc_feature (1)...(597): n = A,T,C or G
ctcaaancaccagttggccttcaatgagaaaaaatttttaattagctccaaggaagaagaattaatggaaaagcagtttctagggagagaaaaaaaaatcatttctatatgttgttttatcaaaagcaaaattaaagttcaaacagtcgcatttaagaaagataaatttgcataaatgttcctcaccagagaagccaggcacgcccatgcccacaaaagacagaacaaacaaacaacgtcctggttcaagaatgccagaatgtaaatatacagctaatttagctgtggtcagaagcctacagtgtggactaaaaacttaaagcctcctgcaataacagagaaggaaagaaccactaacccaaggacgaatttgacttgcaagtcctgaatttattccttttgtgttaaaaaaaagatctcagctcttctagcaaataatgttacctcataaaaactcacttaaattatgaaaaagaaaaacctgttatgtgttcctaaaatactaaaaggcacaaacagaagatatcacacgatactcaatttttgagaccttgtagcttcattaaaaatttttatcatttttgaaaaaaaaaaaaa

SEQ ID NO: 5781 - DNA, 506 bp, Homo sapiens
ttccgatttttttataggtgtttattgctataaacttcattcttagaactgctgttgctgtatcccataggtttggctacgacaactatgaaaaaagaaaactcaaataaagtcagaaattgaaaaggagatattgtgactgataccacaaaaatataaagtaccataacagattactacaattacacacaataaattgggaaacagaagaaattgataaatgtttgacacatacaacttaccaagatggaatcatgaagaaacataaaattcaaacagatcaataatgaataatgatatcaaagtagtaataaaatgtctcctaacaaagaaaatctcaggacatgatggcttcactgctgaattttaccaaagatttaaagaacaaatagagacactactggaactatttcaaaaaattgaagaggacggaacacttccaaactaattcaatgagatcaatgtttcccccagtaccagtcaaggacataataaaaaaaaaaaaa

SEQ ID NO: 5782 - DNA, 420 bp, Homo sapiens
caaacttcatgcaggcaactactgatgtgctacagaaagtcctgacaccattttgaccatcagaagcaagctggctgtctcaagacatcctactcagcatgtgagaatctgtgcagcagccaatgagctatgaggaacgggaagaaattaaacctactaataggtagcattggaataaagtccattcctttattaatatccttgatttatataatctctacatacccagtgcctagagctagcaaaattcctatatggcatcagtaaatatttgtttaaaaagctaagagatttctccattcatttaaaaaagttaagtgaaaaaaaaaagatcatgttctagggaatagccaggcatccaagaatttatatcaacttttcttttgggaaataaaaagagtacaaccaaaaaaaaaaaaa

SEQ ID NO: 5783 - DNA, 573 bp, Homo sapiens
caacaccctggaaagaagtgaagtgaagagctgcagtcatccccagtgcacagtgctgacaatgccagtcattaatgcagcagcttctgcctgctcagatctccctcgctcctctctggtcttgtttccctccagtagcagccacagagctcactcacagagatccagagacttgctgttaatgatttgtcacttgtttagaacacctcaggatggcagacaacaaggaagttctggcagatgaatggaagctaagctctcctggatggagagtgttagaagagacactggaaactcagtcccaagatgctcagtttagtgttcctattgttacaacctgtgacttcacacagaatgagtgaacaatgaacatctcagcaattgataaaatgatccttcaccagccaggaccttttaaaagaattgtcttataacttcatcttaaagagcatcttctgacatttgttcgctgaaacatacattacacttctgctatctcattccttttccacatatgcttcctaagcctggctttatattaaaatatgaaagttactgggaaaaaaaaaaaaa

SEQ ID NO: 5784 - DNA, 486 bp, Homo sapiens
aggacagaatccaaaagatacgaaggccaacttgtgtctaaagaagagaaacctgaaggctaggaattcccagagatgcctgtcatcacacagctggttaggagaaatgtcataataaaaatgtgagcttctgaatctcttattttaaaaatgtacatatatgactgaaaatgtactaaaagaaatatttataggcatatttttctaataagagggggaataccttgtaatctttttactctgtaatcaatactgtatatttcctgggtgggcattacaaacaaaaagttaattttgttttcaaaagcaataatacaatgaattgtcactaggttttttattcagaaaggcctggggaagttgaaagtattttaagttccattatttgagcataacagcaagaaatattccagtagcaaaactgtgcaagagtagcataatgttttgtttcacataaaatgatttttggtactaaaaaaaaaaaaa

SEQ ID NO: 5785 - DNA, 370 bp, Homo sapiens
aggacctgggttcctttaccgaagccagcactagtattgatctgtgggtgttaggattatactaagaagtagctttggttaaaagttgctgctgctgccgctgacagagatggaaaatacattttgagttcacatttatttttccagtttattatatactcttgtattcccacagcttccagtgtatagagatgcactgcactggtgttctattataatgaccctgctgttcagtaatcaacactatagtgccatttaagagacaatcaaataacttgttaaatttaggtttttttccttcttcttactggctaataatggcatctgtaatttgtttgcaaataaatgttgcaacagaaaaaaaaaaaaa

SEQ ID NO: 5786 - DNA, 380 bp, Homo sapiens
atttcgaactgtcctgtacaacaccagaagagtccaacagtgctgtagctgaaacctgggagatggggactaagctgggaagctggactgccctgattgagtgttgatcttcacccttgatggagagagccatattcttagttggccctcagcttcatggctaaacactgtgggttaagcatccagggtttgttaaggagaaatgctttgtacctgtttttgatatttccttccatgtgatgtgtggctttcctgatttgcatttcctcacaggagggtttcttggggtacttttccacagactcacattttccaccacattttccaacctagtctttgtgaataataaatgtggagttttgatttcaaaaaaaaaaaaa

SEQ ID NO: 5787 - DNA, 459 bp, Homo sapiens
  misc_feature (1)...(459): n = A,T,C or G
cttttggcattgnaagagaattcgaacgaaatgaaatgtcctacatcctaaatctcaaagtgaagattacaacaaggcctttcaagaactggagccacaggatagagggagactttttttttgcctaattcacccatggagaaaatctgccagtggttcaggaactccggcaggggatgactacatgatttaggagtacacgtctattgcaatttagctattgcttaattttagatttatttgtgaaaacacctaatactatattaatgcaagcttgtttttatgttttccttgttttctttccccaaattgcataatgtattctataagagacacctgattcttttcctgctgatgtaaattagaagctatagttttctatttgctattacagtaaatgttgatcttattatcttccatccaataaactttctgcaatttctggcaaaaaaaaaaaaa

SEQ ID NO: 5788 - DNA, 550 bp, Homo sapiens
accaaaccacaaacaaagcaccccaaagtgttctactctattatctgaagtaaatgaaaatcaaccctgaggtagagaacctccttctactaccatcaaagtccttgatctgtttcccaacatgaattaacctttccatgttttcgttacatttgaacatcaggaatgtgtagacggaagcagttcatcctgggaggtgagaatgagcattgaaagagccatccgtgaaaccgtaaggctgggaaagagaagtgaaggggcacatggaagtgttcatctctggggcagggaaaaacaatccggagaagatgagtcacacctcatttgtaacccatgaatgaaaatcaatactgttacttatcataaattacactgaacatagtgcttacacttgagtatcaatgcagtaaaaccactatgagccaattgattgacttttctagatcccaattctatcattcatcttctggtattcatcttctggcttagctactatttcctggcacagattcttaataaagatcctttctccttggcaaaaaaaaaaaaa

SEQ ID NO: 5789 - DNA, 459 bp, Homo sapiens
tttggaggtctcactctgttgtcccagctggtatgtggtgcaatcttcgctcactgcaatctccgcctcccaagctcaagcacttctgccacctcagcctcccgagtagcctggattacaggtgtaaaactttttttgatgacaggcttcaacaaagaggacacacatccttaactatttaattaaaactcatccttaactattttcatattataatgcttcaattaaaagcattaagaaaaaacaaaacttaaaatgctatagtaatgccttcattgaaaaagcaatgcatcaatttgaccaggaggatttttaggaccataaaagtatgtatatcaacaaaatatataaggcaacttatattgcaaataaatatttatataaaaaattatgttatgagattatttctaaacaatgtattttaagaaattaaacaagatggatacaaaaaaaaaaaaa

SEQ ID NO: 5790 - DNA, 591 bp, Homo sapiens
  misc_feature (1)...(591): n = A,T,C or G
atatctgtgaaaatgcagaatactgtgctctatccctacccactgnaatcctaatctccactggatggtccaagaacctccacatctcatgaacaatccagatgattctcacatatttgaatatggaaaactactacctgagggcaactattcaacttgtattcatataaaaaggcaatgtcacactaaaggcatttcttctaacgtaaactttttctaagattgtgtttttctttagtatgttatttctatgtattctttttgaagtgtactgtttagtgcaggaatattgttactaataatcctctcttgattaaaaaaataaaagaaagaagtccctcactgggttggttttataatggaaaaatgatgtcactggcagctcttttagcatctctgatctcaatatgtaatggaaatcaaattactgaaaacaaaagccatgaaagggattataaattaattttctcttcacttaaataaacagcaagagaaaaatttgtcctgtgattaaaaatgacatcatgctatcttctacaaaataatatcccccaaagtaattatatttttaaaaaattaaaaaaaaaaaaa

SEQ ID NO: 5791 - DNA, 560 bp, Homo sapiens
cttctgcaaccaccactctcatcagtcagcggtcatcaacgtggagacaaaatctgccaacagcaaaaagattatgactctctaaaggctcagatgatctttagcatttttagcagtgtttttaattaatgtatgtaacttgtcttttttaggcataatgctattgatcacttaatagactacagtataatgtaaatgcaacttttatatacactggaaaaccaaaacatttgggtgacttgctttagtgctctattaaatttattgtggtggtatgaaacctgtaatgtctctgagatatgcctccatattaattttaaaatagacacgaagtaatcctcaacatttagaacatttattttggactgatgcttggttattaagctaaaataatcaagtaattcactttattaaattataaaaattattaaatctactatttgtttaagtttccattacaaatttgtgtgcttcatgtttgaagttgtatgataatctatttatatgatatagcagagaggaaaataaaggcataatgtttattttcaaaaaaaaaaaaa

SEQ ID NO: 5792 - DNA, 463 bp, Homo sapiens
attctggctcactatcctggggaaaagcttttacctcgttcttcagctccaaaaaacaagagaaagattccatttgtcctggttgaaccaagtgcccattcctaaaagcatcatggtattcaggaagaactgtttccacaatgtatggattatctctggataatgctccaatcagagattactactaattataataccgactttcctcacaagcgaaatattgggcattcctttttaaatgctgcttacttcaagtttgattttaagaaacactaggaatgaagctttattttatttctgttgaatttctttgattattcatcaggtctgcctgtataaaaacaaattttatttatcttgattgaatttcatttttcaacttctcaaagaagtaaaatcctacgatgtcaacattgtttcctaataaagggataaaattgttatagaagtaaaaaaaaaaaaa

SEQ ID NO: 5793 - DNA, 517 bp, Homo sapiens
tggtctgggagcaagaccttattctacccagtaaaagcctctgcattgctgctgatgctgtgtggcttactttgttgaaacatgaagtgattcccaaagtctccaaatggctacctgtggaagtcttccagtagacagctagcttctattgcccacacagaaatattcactactgagcttcctactggttctcaaatctgcattggaaattgtctgctcatagagaagtgggtttatcttgaagttattgaagcttaagtttttaggctcaccacctgtctgggctgcttctaagaccccagcaatacgattagagtgttgtgaattcaaagaattctttactttagtccttgccaagaaaacttgaattttcctgaaatcttacagctgatttatgataaaagctcaatattttccaaatttgataacggtcctaaaatgtggaaaaagcattacagattatgttttaaaattaattagtaaaatattatgttatttttctggaaaaaaaaaaaaa

SEQ ID NO: 5794 - DNA, 571 bp, Homo sapiens
gagactccatacttgttgcttacattattgaggtggaatgaaatatgaagatgcagtacaatttataagacaaaaccagcatgaagcatttaacagcaagaaacttttgtagttggagaagtatcctcctaaaatacagctgctcttcaaaaactccaaaggtttctgcccctttgttttagaaaattcagagactgcaccaggaattcatttttttttttgtctttttggacagttaatgttagtaatttagtttataagaaaaattcctttgcaatacctaagtgcctagcattcatttgttcccctcatgatctccttggcaattcttatatttttatgagggaaatctatgaaatgcaatcaatctgtgtgggttttatatatgcactcccaacttgctcagcttgctcagatgtgcagaaaacatccgggatcaaaacaaggaggagaggaaactgaagtccatcaggataaacaagaataaaatgcatttaatttattaatcaaaccacaagtcagtattttcaaaatagataataaagcattcttaaaacgaaaaaaaaaaaaa

SEQ ID NO: 5795 - DNA, 477 bp, Homo sapiens
actgacattcaggtttgcaaatgaacatttttctgaagatgccacctacttttgttaaacttcctcatggatacattacagatcatctactggaagaaatatttgctgtcttgagactgtcaggattcccagacagcctgtatcatcagtatcacagggaggaaaaaataaataatttgtaaaaccaccctgtgtccataaacctgatctcaacaaagtagcaagactgtcaacagagtttagcaaaaaatgtctatctcaccactatgatatttgagataatactcaagaaaatatcttacctttattacaagttaaagctacaataatgcgacttatatttcactagttccacatagttcaccttctaaatgtgtattagaaatgttaaataattatttatgatcctaggaaattgactctttgactctatttggatcaataaaatcagaaaaaaaccaaagaaaaaaaaaaaaa

SEQ ID NO: 5796 - DNA, 375 bp, Homo sapiens
caggaaagaaatgggcaaatcaatacattactcaaacgaagaacataagagaatttgtcaccagtagacctgcagaagaagaatgactaaaggatggtatctaaacaaaaacaagccaaaagagaagaaaccttggaagggagaaagaacactgttagcaaaactatatgtaactacaatagatttttcttctcctcttgaattttctaaagtatgatttctaaattatgctggttgaagcaaaaattataaaactctctgctgtggttctaaatgtatacaaaggaaatatttaaggaaattattttataaattggggaattaaaggtaaataaaggtataatttcacaggatgtaaaatgaaaaaaaaaaaaa

SEQ ID NO: 5797 - DNA, 616 bp, Homo sapiens
  misc_feature (1)...(616): n = A,T,C or G
caggcacctggagttctgtggtaaaacctgggcactgccagtcagttgcattgctttcatctggggactacaaagcttgatccagtgaaacaatggctcacagtcaactaaggattattcaagatgcctctaaaattgttgagaatccagaagtagagtgataattttccaaggcgactgaatggtgatggtgccagtgggggtgtcctaagaaggcataagctggtctgggctatgttatttgtggttctccacaagtctgactctccagctttcctgacaactttttgaactgttgaattcctttaatataattcatctctgcctgaattaaccaaatttgtttctgttgtttgctaccaagaatcacccatgaattgagacagctctaaaataatgtttactgtttgttaacattggttatttatgggtagtgggatttagtggatgttgtttttctgtattacatanatttttaaattagcattcataatttttgcaaaatcaaatgaatcatgagaagattgaaatatccaaggaaagtatgtaaattgcattttaatttataaacgagttataataaaacagggtcccacaaactacaaaaaaaaaaaaa

SEQ ID NO: 5798 - DNA, 475 bp, Homo sapiens
aactggtaacctcattctcacaactatcgcagaaacaaaaaaccaaacaccgcacgttctcactcataggtgggaattgaacaatgcaacacactttcaaactaaagacttagttcaattgacttctgcaaatcgtatttgaagatgtacgatggaggctctttaaactattgctgtgtggtgaatccttccctatcttcaagttcagcaatgtttcaagtaactgcagtttttctagtaatagtttcttaaatttaactaccttttttatttccaagttttttgttagctatttttcataccacttgttcttgtttcatttctgctaattatgtgacccaattttatgaaccagtttttcattattgttcatgcattttacaaatattgatataaattattttgtcacctatttcataaaattaattgcatctggaataaatatatgttcagtattgtttgaaaaaaaaaaaaa

SEQ ID NO: 5799 - DNA, 299 bp, Homo sapiens
tctcgaaatgagtaggccacccatcactactaactacagatgacttgccatttcatttacaaagttacagatgatgtggtgcagaagcatagcaagtctaagaagaaacagtagtcatcattgtgaccattgtaatggccctttgcagtttaccagtacatccccaagcatcttatttgtccctgctacatggcctctccgactccaatgcccctggttaatcggtttatgtgacctttgttaaacatcactctacaggaaaaataaatgaataactcttgaatctaaaaaaaaaaaaa

SEQ ID NO: 5800 - DNA, 307 bp, Homo sapiens
tccaagacagggtttcacctttagccagaaggtctcgatctcctgaccttgcgatccacccgcctcggcctcccaaatgctgggattacagatgtgagccaccgcgcccggccgtaaatgtttcatacatgcttaagaggatatatattctgcagtgttctacatatgtttattaacataagcttgttaattgtgttaaacattttttatatctgtaactacttcatttctagcttattgaaagatatatgttaaaatcttcaactaagataattaaattgttaaattctcctcaaaaaaaaaaaaa

SEQ ID NO: 5801 - DNA, 285 bp, Homo sapiens
cggtctgccgcgggttgtgttgcccagaacaaagtctacgtgctgcttcctccagagccactgatctctagcaggatggggatctggactgtcttctccaagccatggaaagtcactgaaggaggatattgggcttcctccttgagggtcctaaagcttcttccagtctccagaagccagcagaattatgctcttctcaccagaaggattatttccaattaacgttacattagaattaatgcacaataaaatgcttatccatgttgaaaaggaaaaaaaaaaaaa

SEQ ID NO: 5802 - DNA, 246 bp, Homo sapiens
catttcactcataatgagtcagattctgtacagcaaacaaatgaatttggcttaatttctacttaatcgatcacttggtatatctattgtggagaatccgtcttgtaaagtaacacacaggaactgttgcctctaaaatacgttcaaaagactttgtacttcaatgggattataatccattgtgtgtctattaatctaggcgatgatctcttaataaaacaagttcagatatcaaaaaaaaaaaaa

SEQ ID NO: 5803 - DNA, 282 bp, Homo sapiens
gacagtctgcacctttgcctgcttcctgttgactctgaatgaggagaaggttgctcaagcacgcactcccactagtgaagctcagcagagagctggtgattggggacttaatgagatggcacctgtgaaacccaagtacatgcgtgaaagcttattgctattttggtttttgtaagattgaaagtcaggggcactcagcatggtcatatttatcaagcagaaagacataattctcttgtgtattagaagtaaaggtcccattcaaaaaaaaaaaaaaaaaaa

SEQ ID NO: 5804 - DNA, 256 bp, Homo sapiens
aaaccccttcatcagttggtactccatcctccagtgtttcccgaatgggctgccgaggacccttctccagagaattgcctcagctgatgggaactctctcagtggagcactggagggtggatctgctcaccctggagccgctgcaggcaacgcttagatggtgggggtgccatcagacctgacaccccttcttgtgtgtgtggagactcaataaatgttcactgcatgtgtttattattagtcaaaaaaaaaaaaa

SEQ ID NO: 5805 - DNA, 441 bp, Homo sapiens
tttcggattgacatcacctcaacccctccattaagtcaagatgtgaactgcacgcttaaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaaaaaaaaaa

SEQ ID NO: 5806 - DNA, 185 bp, Homo sapiens
  misc_feature (1)...(185): n = A,T,C or G
ctgcttggtccacggnaagcctgaagcctggtgcctaaagtgaatatggtcttggcgacatcagaactgctgagagccaaggtttccttattgactaaattaaatcacaatcctcccccggctaacctagaactctgggaatcaaatataccaataaaatgtctgtaaaagcaaaaaaaaaaaaa

SEQ ID NO: 5807 - DNA, 308 bp, Homo sapiens
  misc_feature (1)...(308): n = A,T,C or G
atttcgagctttaagacttatttacaaaagnagtaagaatgtggaaanaattacatagctgcaaagaatgtttgtcatagctgcaatgggagtaagaagacattgaaggacattgaatagaaagtagaaacactttacatcaaaaggaaagaaactcatactatacttttaacaattttatcaacccacttattgattgtattagtttgctaggactgccatgataaaatacaatagtctaggtggcttaaataacagaaataaattttcttacagttgtggaggctatacatccaaaaaaaaaaaaa

SEQ ID NO: 5808 - DNA, 384 bp, Homo sapiens
ccaagggaccgtcccatcgtctgtgacattttccaaacgccatgcctcatacaccctacgctctcttcaccgcagaggatcctccgccagggcatgtgttgaggacatttcagaggtttcagaataaagtttaatagatgtggactggctggtgaactgatctctctgaaaatcacaactgctgaagaagatcagaatttttctttgcatctactttcatatatttaattactcttcagtttgaattgcattttcttttgcagtaaatctaaacagtggctgctggtacatagtcacacatatgatcatctttgctgtgtaaaaataaatgcttaatttaataaataattcaatcattctttcttcgaaaaaaaaaaaaaaaaa

SEQ ID NO: 5809 - DNA, 363 bp, Homo sapiens
aaaaaggagcaacaggacgaggaggaaaaatggcaaaaaaagaagaatggagaaaaagcaacagcagcaaagaaaacaactgtgtgggaattttcattggaattgcattaaaatacagattggaagagaaattacattttaagatattgagcctacctatttaggaatatggcatatttttcatttgcttaggtgatctttcatgattctcgttaaagttttatcctttgtctccataaaggggacttgaatattagatttgttcctaggcattttacctttctgttgctagtacaaatcttttttaaaattaccttttataaccgattaaagtaggtatgtagaaatgcaaaaaaaaaaaaa

SEQ ID NO: 5810 - DNA, 266 bp, Homo sapiens
cggcctgcccctgccatgagaaaggaaagacacgtggagtggtcacatataaatgttccagccaccagcctcagcagaggtcccagcccacagtcagcaacaactccagacacgtgagtggcagcaagatgatgccagccgcagttaccatctgattacaacttcataagaaaccctgagcaagggctgcccagctgagttcaagcaacgccccagacctgtgggtgatgataataaaattattgttgttttgaaaaaaaaaaaaa

SEQ ID NO: 5811 - DNA, 317 bp, Homo sapiens
cagggtccttaaaagtcactctccaaaattcaagtttcactgcagaatcccgaacaccacagcatcacattggaaggcaagacgctaaaagactggccccacattccttccacgtggcttcagcaaaagcacacctcatcggttccttgaccatctgaggtcatgctcatcactgatatctgccgaagctctctccctcactttccagtttgggcacttgtgattcctgttcatcttttaaggcccaacataaatactcctttattcaatgaatacagacaccattaaaatttgggaaaaggacaaaaaaaaaaaaa

SEQ ID NO: 5812 - DNA, 328 bp, Homo sapiens
caaaaaagggaaattttagaccaatatccctgagaacattgatgcaaaaatcctcaataaaatactggcaaaccgaatccagcagcacatcaaaaagcttatccaccatgatcaagtgggcttcatccctgacataaaatttttattgatattcttggtgaagaagagagcaaaactcattagctatctctacatgattgtggaagttaatagttataattataataaacatccatagccgtgagaggagttgaaagtctgccatttggtgggcagtgttcttgaatgttaataaaagtgttcattaatatttaaaaaaaaaaaaaaa

SEQ ID NO: 5813 - DNA, 258 bp, Homo sapiens
tcaggttaagaggagccacgcacaccatccaatcccattggctttccagcccacctgtctcgcccgccctccggactcagcacctgtccctcagtcctgccaaggctacggagtcaagcagatcacagtgaccttgggcaaggtcaaactgataaacctctctgagcctcaatttcctcatttgcaagataaggtcacctaggttgctggactaataattgaatgaaatataattccgtaatttcaaaaaaaaaaaaa

SEQ ID NO: 5814 - DNA, 385 bp, Homo sapiens
aaaattgaacaaatgaaggatctgctagctaagatgaaaagcaggggagagatgacttttacgtaggcaagaaagagggcgtctaccacagtcagtcttgactccaacttcactccaattttctaaatctctgtgcatacatctccagtaacattaaatctaattatattatgaccattattgccatcatacaaagatctcaaatcacatacttaaaaaatagggaaataatacacttaaaagataaatgcgttaaaatcatggaatcctggaaaatcgcatcaatttctttgttatgtctggaagagttgacacataccaagcttagagtcacctaaaatcctggtcttttaaaataaaagttttgatgacaaaaaaaaaaaaa

SEQ ID NO: 5815 - DNA, 274 bp, Homo sapiens
  misc_feature (1)...(274): n = A,T,C or G
tgtcggagtctcaaccanatttcagatttgaagacattgcagaaacacttttttctcacatgctcgttgaagacaaacaacagaaaacactaatatattgatgctgatcactgaaaaggctctctttcacacttttaacttctgccatgggaagatgcagcaggaaggccctctacagatgccagttcctcagtcttggacttcccagactccagaaccataagccaataaaccataagccaataaatttatgtttattataaaaaaaaaaaaa

SEQ ID NO: 5816 - DNA, 489 bp, Homo sapiens
  misc_feature (1)...(489): n = A,T,C or G
cggtctcaaccanatacagatttgaagacattgcagaaacacttttttctcacatgctcgttgaagacaaacaacagnaaaacactaatatattgatgctgatcactgaaaaggttttccaggaagggctctttggagacgtgaagatggcaggatggggcagaggaagaaagtgaccaacaacttggttataactgaggcctcagctcacccagaggaaacttcaatggttctttgaagtgagcccacattgaagcatagggaacttcgctagcgcctctcagctctccccaccccaccttatgtgggacagcatggttagagttggctaaggctctctttcacacttttaacttctgccatgggaagatgcagcaggaaggccctctacagatgccagttcctcagtcttggacttcccagactccagaaccataagccaataaaccataagccaataaatttatgtttattataaaaaaaaaaaaa

SEQ ID NO: 5817 - DNA, 455 bp, Homo sapiens
aaaaaaccaaaacagaaatgggacctgtggccagaatgaagaccatgcagctgcgtgaaagtcagaatgtggtccaagaggcactggtgaacaaacctgccacatgtggggcactcctggacgccactgctggtgctgggtcaagtttacagcaaagatcaccatttttcaaaagcacatgcactggtgttccccaactgattctgcaaccagtacacagtgtgctttggttttctaaaaacaaatgtgtataattttttattgatatataactgatgtactttttttggtaaatgtaatatttcgatacattcatataatgtgtaataatcaaatcaaggtcattgggagatccattactttaaaaatttctttatgctgggaacattcaaattattctctactagctatttggaaatacaaaataatgattgcttactacaaaaaaaaaaaaa

SEQ ID NO: 5818 - DNA, 571 bp, Homo sapiens
cagtgttgtgtgaggattaattaaaggatgtggttgctagaagtcacctctatcatctaagttctcagacatctgatagccacaaaggtaaatatagctgccttccttgctgtgtggatcagcagagtcaaacataaacagggaacctgccaacacccgccacaaacatgccttcgagccataaaaggtaccatgttttgaaaatacctgaagaatgaaaaagagaggaagagaaaaaagaaaaaagaaggaagggaaggggaaggggaagggaggaaatctaccattctctcacaggagctcaatctcaaacaagtaaaatggaaatgtaattagctggctgatcacatttatgatttccaaaaagcagtgagaatcatgtgattctctattttgctacatatcctgggcacaatatttgatgacccatctctgtggggtaaatagtattttccaagttgagaaaaaaaaaattgatgctgaaaagaattctcataacagaagttcaaaattctggcttgggtgggggtaaaaataaataaataaatgctttttttgaaaaaaaaaaaaa

SEQ ID NO: 5819 - DNA, 559 bp, Homo sapiens
  misc_feature (1)...(559): n = A,T,C or G
ctgaagccttgggnaacttgaaaattcaaatcttccgtctttgtttatggtctgtagcaggcaaacaacttcgaacttctcaaggttgcttggctaaacacgaacgagtggatgaagagaacacctcagcaataaatataatgcctggaaaagaattttactaagaacaatgttttttatgccactttttaatttttttaaaaatttctcattacctctgaagatttgtgacactattgtttgagccattattttttaaatgatacatataactgcttgtctaggatggtttctctttctttctctttctctcaattatcttcagttttctaatctagaccacaaagttctccattaataaagttggcaaacaaagtgtctgaaaacattttgttacagggaatgatgtcctgctaagttttactgaagatggaattttcatcagtactgctaatgaaccattcttattccttttgggaactatgatttattaaaagaattgcccgttttttaaaaacaaaaacaaaaaaaaaaatggccctcgttggcctcagacgtg

SEQ ID NO: 5820 - DNA, 640 bp, Homo sapiens
  misc_feature (1)...(640): n = A,T,C or G
accaanaattaggttgtagtgttctgtcattgtgcttgtgaatagccacttcactcggcctggaagaacacagccatatgatgagggaaacaaagattggagtgacatatctgcaagctaaggaattcttgggactgccagaaactagaagacacaagtaaagatcctctcctaaaatttttggagcaagcatggccctgccaactactttgatattggatttctagcctccagaactgtgtgagaataaacttatattgttttaaggtaattaggttatggtaattgttagaacagccctcagaaactaaaacagtgatattacatggaaagtggaaatattttatatctgttttatcataactagaaaaatgaatgcaacaactatttatttatctactttgtttttcttggatcccatgagtatttgactatacaatctccctccttaattccaatgtgcttcaccccagagttcaaatttatacttctctctttgagacatgggttttaccagtaagaaacaatgaaaaccagtttactgaaaataaaagttttatttattgagtaagaggtatcattcaagaaacagaatttataaacaatacatatcaacttacatctaagaaaaaaaaaaaaa

SEQ ID NO: 5821 - DNA, 610 bp, Homo sapiens
  misc_feature (1)...(610): n = A,T,C or G
aggattgggcttttccggaataccatccttcttttttttttcaaagcttcaccagnactggagtccccaacccccgggctgtggacaggtacaagtctgttgcctgttaggaaccaggtcacacagcaggaggacattttcaagagcgatttatggaagagagaagttaccatcaggaaaggaagaaatttagccatccccagtgggtcaaggaagacccacaaaggaaacaactgatcatcttgatcacttcaactttggatacatttctcagtgggtcaattcttatgatgcttttctttatcttatactgtatctctatattctattatctccaaagcatcatcatcagctataattttttaataatttgcaatgaatttttaaccaattgatgcaattaataattacgaagaaaatctactcattctgtttagtactaaatgtatctatctatattaatttatgcaaaaaatatgtaaggatactgtgcatataaaagtctatttcataaatgctatcgataactgccttgttagtaacccattttttatgagatgacaaagaatcctcagaataaattctgatggtttccttaaaaaaaaaaaaa

SEQ ID NO: 5822 - DNA, 380 bp, Homo sapiens
cgctatttcaggcaagaagctgatttatttggagaatgaaaaaagaagagcacctagacaaaggcacatcaggccactgtgcagaagaacaagcatgctctagaagtgtatgtgctgctgtggaaacacctctaagaaataccgtagaaacccaatgtgcagaatgctccaagaatgccaccgtctgtgcaagaaaaagtatacacacatcagtgcacaggtgtctgaatgtctgtgtaacactgctggcctctgtggggtagctggagcatgagggtgctctctctgttacagctttggaatttttaactatgtgaatgtggtaccaatataaaaataagtaaatcaataaaaaaaggaggagaataaaaaaaaaaaaa

SEQ ID NO: 5823 - DNA, 929 bp, Homo sapiens
  misc_feature (1)...(929): n = A,T,C or G
aggtagtggtgctaatgatactaattcaacccttgtgcctgggcaagagctttcccagaagccaccaaaaaagattgtgttcctgtaccaagatatctatcacaggacaggtctccattgcaagaaaatctgacagaaattatatttcagaattttgacctttctggatttcaacgttcaaaattatggtgttcaggattatggcatttgggattgtgattggctcccatgacccctggagagagttttccaagagaaaggaaatggaagctgtcagtctttttaggcgtcaggggaacctgataagaaacaatctcaggataatgcagtgctagcccactaacaagggatggattcgaaaattaatccctggtctacatataccaaagtcaaaactcttctcataacacatgaccacccccatgaggagatggattgctacacaccagggaaacaaacacagtgccctcaatggaataacagcttaataaatatttgctgaataaaagaataaagaagtttgctaaaaaatataatgcctacatgaacattgttttatattttggttcttggtggggatatttttccacctttaggtatatctctatatggctgtgggacataggaatgcgttggaatattggaaatcccacttcctgctaccatgggaaatttaggcaatatgctgaaataaccaatgttgacttgaaaaaaaanaaaaaaatggacctcggtggccccaaccgggggaacttttacgggcggttaccttttaggaaggattaattggtgaatcctcgctaacctgacctagttgaactcgagataatcggctgcgagggagcggagtcaggttaactcgaaggcgggtgtgcggagtatgcaccgatcgggggaataaccggggaaagaaactgtttacagaaggc

SEQ ID NO: 5824 - DNA, 569 bp, Homo sapiens
aaacttcgtccgttgtgatgccaatgggaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgaaaaaaaaaaaaa

SEQ ID NO: 5825 - DNA, 684 bp, Homo sapiens
  misc_feature (1)...(684): n = A,T,C or G
tattaagaggctgaaatcagcaatcctggcagtctgtctgattagccaatagaataatgatttgacctgactgccaagcactgaggattcctatctggggattcaccacagaggtccttctgggcatctggtcaagtgtggcatgatggagtctgacaggctggattgccctggtctaaatggagctctactccaggtggggtcgctttgggactctgagattctcacgcaggaagtttactggagcatgttcttaggaacaacacctgtctctaatgtgagaggagaaagaagaaggcaaagggagagtctgaaccttgatgcagtcacagcacagacctgagctgaccctgcagggagctctggggctgagatggttctgcagagtccagtgggtgccaggccagcttgcatgggcttgggcagagctggtggtgcgcacttcttcccaacttcacattcaatgacatcatgttgatatcttgaaactggtggcacatacgtttataacacaaaaataggcaatgctggaaaccaggggttctcccacttcccttgcctagaaagctggtttgccagaaaagccacagtgaagaaagattgcttncatatctatctctgtgcccaaatttcatgcatanatncttcgctgntgntngttgntgtttttgaaaaaaaaaaaaa

SEQ ID NO: 5826 - DNA, 549 bp, Homo sapiens
tttcgcctgagtgcttgctgcattaaaaggccactttgcatgtaaggactttttataaaacagcaaggaaatgaattttcctcaaagagcctccagactgaaatggaagaagaaaccctgtcaacaccttgatgttaggacttctgtactgcagaacttttacggaatgtttacattatttagtcttcttcaatcaattctacagatgaaatacctccctccaggatttctgcatttaaaattcaaaggattttttgactttataaagtaccttatatactttgttctttaaaacgaatttgtctatataatggaatttatgtgaattatgttcaaatgtaataatcaatgatctaatagagtttgaaaaactttttctgtaaaagactgaacagtcactgtttcagctttgcatgtcttaacggtctctgccacaactattcatcttagccaatgtagcacaaaagcagccaattgccgatacataaaccaatggacgcagatagtagatgtgttccaataaaactttattcacgaaaaaaaaaaaaa

SEQ ID NO: 5827 - DNA, 695 bp, Homo sapiens
cgtttcctcatcttttatagaagggtggattttgaaaatttcttctgacattctgaagagcttcttctgtggtcacttttttatgaagtaattagaaactgagatacttctccagaataaattgttggcttttggggtagtggaatggaagaatggaagaatccattacagcaagtgattcctgaggatgccagaacctcccttttatgaagccttcttcttcttccatctgactttatctctacaaggatagaacagatgagctaaactggtaggcttttttccctacgatttagtttaataaaattacttatacattagaattggatagaactaagttgatattataatctcactacttattaagtattcttaaacaaatagtttaacattcattaattttaattctttcatctaaaacttggaggctgtcctggaaaatcatgagatacagtaaacaccgtaaaaatgttagcaattttaaataataattaaatctaagagcatgcttttcttcagttagagtggcagatgctttgatgtctttcttatagaagttcagcaaatatttaaaattactacagacaatcactgtttttggttcagaatgggcatcatgacttgataaaggatatactttctgtaaatggtgaatttatttattaaaatgtttttaagtgtcaaaaaaaaaaaaa

SEQ ID NO: 5828 - DNA, 451 bp, Homo sapiens
  misc_feature (1)...(451): n = A,T,C or G
cagaatatcagtacaatgtggnatgtggcacagtcatcttttgactatgagggtgagaaccacgttaaggaagaaagagcagaaagataaaaggaggctgggtgcttgatgacgtctttgactacctacgcttggtctgccttccctgggacttcttgttatttggaaaagaaaatgaacatctctttgttaagccgcttagttttgttttagtcacatgcagctgaatgctatcaagattgatacatacttttggtcatttcactcctcactaatattcctaactaaagggtgggcagaaaaagtaaagataaaactcatatgtgtataaatactatctatatctatacccatatctatgtatatatgagtatattataacttgttccaagttatgatttgcatagtatctttaaacaataaaatccacagaaaatcaaaaaaaaaaaaa

SEQ ID NO: 5829 - DNA, 524 bp, Homo sapiens
ccggtacctggcctagcacgtaccgcgctagcagaaccctaccttggattcgaagtaatactactcactctgtggcgtagcaccacctgacggagtaaggaccagaccaccacctctactgaagtgacgggtgctggcctccgttgggtaacaccagcgtagactgtcttcctatccaacccaaattttccgcagaagagtgctgaacttgcttgggaagattctaatggacactgatttgctatgccatgcaaaatagtgcgcgatatattagctgtctagttctgtgaagaagatattattagtatcacctatttgtaaatgtcttatgtaatacagaaggatctattatatgtctagttactacgtatggagtgatagattcaatcgaggcaatttatgtattctatatgacgacttcatacattgatatttgttaatatgggttattaatggaatcgttacaataaaatgtatacttcataaaacaaaatacataaatggcctcgatggcctcatcggta

SEQ ID NO: 5830 - DNA, 477 bp, Homo sapiens
tctagtttggctcacgaaataagccctattgatgctgtggatctaaacgttggtgatcccccacccaaattcatatgttggcacctaaaaggaaccaaatatgttcactccaacctcttgaatggaattagtacttttataaaaggggcctgagagagctcccttgccccttccatcatgtgaggatgcagcagcaagatgccatctatggagcagacagcaagcccttaccatacactcaatctgccagtgccttgatcttggacttcacagcctccagaactgtgagcaataaatatctgttgtttatttacccagcttaatgtattttgttgtagtaatctgaatgggctaagataccctattttaccaatactctgagaattaaataaaagaataaatgcagaattacttaaaaatacaaataaacacttagaagcaagccattattagtaagtgattagaaaaaaaaaaaaa

SEQ ID NO: 5831 - DNA, 693 bp, Homo sapiens
cgtgattgtaaagacaaaaagaacaaagcatataggatttgtggagaagaaatactaaagtcctccggtccccccaaaaggaactttttttgttaacatgaccttacattgtcccactgaataatgcaaaatttgtttggttgtaccctgcagggctcccaggcccggaagccaggggcagcagcggtaccaagttggcacaaagtagcagaaatgtcattttttaattatgtggttctgaggggaatctattatccaccgctgtgatgctgaaatcagacaatttatctccaaggcagctctctctaccatctagaatatatatcttttgtcactgcaggaaacagaacgagaggatgtttttatttctggtgccttatgtttataagtttattcttttaaattttgccaatgaaaagaaatgacaccctaacatatttcttgggtcccctctgcccgcttctcctttgtgaagggtgttcaagtaacccaggctcttttttttcctgagttggtatcaaatcttctaggtctcaagttcaagaagtctttgcatagcctccagatcatgttccgaatgcccatttccaagataaatagaaataatttgttgagaagtcccaagaaaaccagaggcatccacctaaattaatataaatataaactgctcttttgcatttaaaaaaaaaaaaa

SEQ ID NO: 5832 - DNA, 327 bp, Homo sapiens
gggtttcggtcctaactaaattaaaacgaacgcagaacaggaaatgactcgcctgcaccacataattaatggtgttacataatgtattcttccctcagaaaatatcccaaaataaaactgtgcccacaaaactcctgattggctcaatgttataaagaatacacgatgaaattttccagaggctacacaatatatgatttcacagcaggttgaataaagaagcggatatgagaatctagttatcttctattatgccagacattaatttgcaaaaatataaaactcctctcaataaattttttgttttggaaaacaaaaaaaaaaaaa

SEQ ID NO: 5833 - DNA, 655 bp, Homo sapiens
ccagcaccttgcctgcagaccaaactgctctaagccacaggaccctgacctgtgcaccacactcgcctcaggaaagatgcatggggtatacacacgtattaatcaagaaagagctctttaatggagtacttaatggataagccaacttcactctcaccaggggcacaggttgccctaaagtgctctggcaaggctgcacctataaagctgctcatggattccctgaataacctttccacatactaatatgtacctctttgactctgaggcattaagacgtgtgttttatatataaaacccccacaggatgacttgaacactcctatgtgactatcaattgtggcaacggctgtatttgatcatgtacatcagatgggtgaatttatctctaagaagcagtgtctcaatctctcttaaaccgtattgactgaatcttgtgagggaggttgcatagcatgaagctatctgcctcctgcaaaatgctgttaatgatgtctactgccgtaaggaaatgcttgtggttaactcctaagctaaaaaatgatgtctcccagttgaataaaatatgctactgcaaccggtttattcaaacatactttaactgccccgaaggaacaaaaaagaatggccctcgcgggccctacccgtgggagta

SEQ ID NO: 5834 - DNA, 293 bp, Homo sapiens
  misc_feature (1)...(293): n = A,T,C or G
caggtgttctcagaacagcagcctcatttggcaaaggnacctagnagttacctgaaaattcaactgaagaggacattcaatgtggctttctaaagattgtaaattgacaatttgtaattgtataaacttatggagtacaatgtgatgttgtaatttatgatccaatgtgaaataattaaatcaaactattaacatatccatcatctcaaatatttgagtatagtcaccatagaaaacaatatgcagatttctcaaaaaataaaaaatacaattactatataaaaaaaaaaaaa

SEQ ID NO: 5835 - DNA, 528 bp, Homo sapiens
cgtcattcgacctgaaagcaaagtagccacgattttgcatctactgtataatatgtactatggctttgcaggaaggtgctggcatctgcttctgatgaggccttgggaagcttacaaacatgacagaagttgaaatgagagcccacacatcacatggcaagagcaggatcaagagaaagaggaggtggtgccacacacttttaaacaaccagatcgcaggagaactcactcactataatgaggatagcaccaagcaattcatgagggatgaggcatctgcccccatgacccaaacacttcctaccaggccacacctccaacactggggattacatttcaacatgagatttggagaggacaaacatccaaaccatatcagaaatcttcttgcaaaggtagtctataaagatataacatttatgctattatataaattgaataaaatatttaccaattgataagattttcaattaattttaaccctttatctaataatggaaataaattatttcattaaaaaaaaaaaaa

SEQ ID NO: 5836 - DNA, 310 bp, Homo sapiens
aacgcgcctacaactcattggcaagctagctggagatgatggaatgaccagctgcagagagaagtaccttctcttctgagagctgcagagatgacctgctggcagagaggagctaccctatctgctaagagcttcagagacctgcagagacatcagaatgacttgcctgaggagagcagccacctcctccaggacctcctgtctgctaagagctaacacttgacaacctgcctacagagaggagctacccactcttctgagctgttctaacactaaataaaactctttttcttcaccaaaaaaaaaaaaa

SEQ ID NO: 5837 - DNA, 207 bp, Homo sapiens
  misc_feature (1)...(207): n = A,T,C or G
ccagggaaacagncttcagctaaccttttggaacagagacgactattccagtggagtccaccctagacctgccagctcccattaatcctcacatgcatgagcccaaaagtgaagagaagaacctctcagctgagcccagcctcaatttgtaactcatagaattatgacatacataaatgattttgctttaagctaaaaaaaaaaaaa

SEQ ID NO: 5838 - DNA, 270 bp, Homo sapiens
catctgggcgccgggctcagcctgtaatcccgcactttgggaggccaggcgggtggatggcctgaggtcaggagttcgagaccagcctgaccaacatggtgaaaacccattggtggcgtggtggccgggcacctatattcccagctactcgggaggctgaggcaggagaatcgcttgaatccgggaggcagaggttgcagtgagccaagatcacaccattgcactccagcctgggcgacagcgcaagactccatctcaaaaaaaaaaaaa

SEQ ID NO: 5839 - DNA, 919 bp, Homo sapiens
caggtttcccagaagaacaaaagcggttccactcaggttctaagttcgaagttgccctcatctcaaccatcatcaacaaaacgccagaatgattttcttcttcttttcgttaatggtaaaaataagattttgccatttgttgggagcatacgtattgagcacgtttggggagcttgtgactctgggtcacaaaataagactgggtttttggaaatgtgggtggataaggtggagtgagaggggcgggataagctcatggctggatgataaaccctataaatggattgtggtacttatcaggtcagttacaccgcttggcggaggtggcaggtcctgctgctagtgcccaacctcccctcacgccttgtgtggtgcccagtcaacctatgtatgccgtcctctttgtactctactgtcccttcttcccctgtttcaccgctgcctactcaggccaccccgccaccccacggtgcttacaagtacactaccatgagttttcgattcggttgaacacctctcacccaccgtctgcgccgtcgcggcgtccccatcgccggtcttcattacaatacggataccggcaatcactgtaagacgcagtccgcttgtccctttctctccgcctcggttcactcttgcccccgcagcctggctgccctcctttaccccacccgcaccctagtatgcacgcatcatacactatttatatttcgaggcagcaccccttctttatctttcacgaccactccattccgaattatcacccttctccttcttgcccgcacttagtagaacttgaaccacacatccatagccggtcttcgctgattgtgtttcctactccgggagaacctcttacgaacaattgtctactacttgtcattattcactcgcatgatttttattcccctgagcccat

SEQ ID NO: 5840 - DNA, 203 bp, Homo sapiens
agcaacacagtgaaagaaactgtgctaaaggccagaaagggccctcactagagaccaactctggtggcacctggaacttggacttctaacctccagaactgtgacaaaataattttctgttgttgaaggcatccaatctgtggtactttgttatggcaggacacactaatacaacagtgttcaacccttgaaaaaaaaaaaaa

SEQ ID NO: 5841 - DNA, 440 bp, Homo sapiens
  misc_feature (1)...(440): n = A,T,C or G
cagggatcttctgtccgcccagnctagaatgcagtggtgcgatctctgctcactacaacctctgcctcccgggttcaagtgattatcctgcctcagcctcccgagtagctgggattacaggtatgtgccaccatgaccagccattttttgtattttcagtaggaacagggtttcacaatgttggccaggctggtctcaaactcctgacctttaagtgatccacccgcctcagcttcctagagtgctgggatacaagcatgagccactatgcccagcctttttcatccacttttgcaggcacatgaccttctgcccaggtacatcatccagcagagtctatcccataaagaccctcaaaggaagaagaaaacccttggcccctgttggtgtatgaaaatctgaattattaaagcttactggtcatctgaaaaaaaaaaaaa

SEQ ID NO: 5842 - DNA, 237 bp, Homo sapiens
cacctactacaggcaaccatgcacgacaattttattttaaaaggttcttttaagagtcgaaagccatcatgatcataggagatggagacactgcccgatcaatgtcatcaaagatgttgttttacaaagtgtccagtgccgcactctatatatccatgaaaaagcttttttcagaacaaatttcttcctgccaatatgatttattttatacttgttgtatttggaaaaaaaaaaaaa

SEQ ID NO: 5843 - DNA, 269 bp, Homo sapiens
ccagtgaagacacagttaagagctcgtgctctggaatccgaccccatgggttcaaaatcccttctctaccacttattagtcatgtggctatggcaagttacctaaccatcatctgtgaaaccaagataataacagaatggagctgggaatattaaatgcaatcatctatgctgcaacacaggagacaagtgttttccattgtaatccattatttaccctttatggagaataaaactttcaacactatattttccataaaaaaaaaaaaa

SEQ ID NO: 5844 - DNA, 211 bp, Homo sapiens
acagcctgcagaaaccatgagccaattaaacctcttttcttaataaattacccagtctctggtattgccttatagcagtatggaaatagaaaaatacccctaactttactttcagaactaaacacaacttgaataattgatatattttgctatattttgtttgctttgttaagattttaaaattaatttgtgaacgtgaaaaaaaaaaaaa

SEQ ID NO: 5845 - DNA, 229 bp, Homo sapiens
ggattcgtcaacatggcaccattgacctagtactgaaacccagaagtgaaactgcaggatgagagaacacgtgaaacatttaagagtttatgttgacatgagaaagtattcttgaaatatccacctcgacttcttcaaagtcttccctttgctctacgttctattgcctaaaatagttgtttaaatgatgcctaataaaaataaaaagaataccttaaaaaaaaaaaaa

SEQ ID NO: 5846 - DNA, 258 bp, Homo sapiens
caggcaggcagtgtacctttggtatcataatttgctagtgtgggagcagttgatttcagcagtgccctggtcgtcctgtgagaatgctgcagaagttatagcacccatctgttatgttcttatagaacctggcctgtcatacccctggctcctctttttaccattcttgctctgcctactcagacattcttggtctttcttgaaaaagtagaatgcaaatatatctttcttagcctttctctgccaaaaaaaaaaaaa

SEQ ID NO: 5847 - DNA, 122 bp, Homo sapiens
agcatgctgaggagggaggactgcttaagtacaggagactgaggctgcagagagccatgatcacacatctgcactccagcctgggcaatagacagtgagaccctgtctcaaaaaaaaaaaaa

SEQ ID NO: 5848 - DNA, 242 bp, Homo sapiens
gctactaattatgatatctatctttggagaagagaaaggagaggaagatagccttgtgaccagaaatctttgctttttaaaaccaccaatgacctggtctaattatctctgcaaaaaactcatctgtgatgacatggggtgaaaccacagtgcaattttcaagaaacattttatgcaaatatatctgctccaactgcatataaattaaaatagtaataaatcaaatcctaaaaaaaaaaaaa

SEQ ID NO: 5849 - DNA, 286 bp, Homo sapiens
catcgggcacccacaaaggctggtcatcaaggatagcatgtcagaagaggagcacgcgggctgctggatgtcgagaggaatgtaccgatagtccctggcatgatggcaggccatcgaccatcgaccagctgaaccagcagagtttggctgaggcagagtttggctgggaagtcagaggagagtggcccaactgcaggggaaaaccatcccccttctggctcccccatctgctgagggctacttccactcaataaaaccttgcactcattctccaaaaaaaaaaaaa

SEQ ID NO: 5850 - DNA, 211 bp, Homo sapiens
ggttcacacactggctgtgtgaaagatgtggtgcctctccaccctgcttgctctcgttcatcatgtgatgcgctggctccccttcaccttctgccatgactgaaagcttcctggggtcctcaccagaagcagatgatggtgctatgcttcatgtacagcctcccggatcatgtgacaaaataaacgtactttctttataaaaaaaaaaaaa

SEQ ID NO: 5851 - DNA, 480 bp, Homo sapiens
cgaagggcttccgagtttgcattttctagcaacaggcttactaagtacactgggcacagctaattctaagtgagcagattacagcactgcatttttccagctaaaggactcacagatccaaaaatcccagaaaggtgactggacatttggtgggtgtagccttagcaatgctgggcaccctccatcttgccaaactgctgtgagggagctgccagcacctgcaattccactgttttatcaggcatgtgagaatgaaacatacttctggattgaacccaagttttatacagagatgtttgctcattttcattagatgtttgtagaattatgggcaccttatgaatcaagagttgcttttttttaatttgcatttaagtgtagtgaatgttgagtttagggtctaaaatgaggtgatagcaaaatcttggatagaggaaaaaagtgggataataaaggcactaacagggaaaaaaaaaaaaa

SEQ ID NO: 5852 - DNA, 144 bp, Homo sapiens
cagcaagcaaaaccaaggacaaaaaaaactggttctggaatcccctcttggaagtgagctgcctgctgattaataatacttgttgttttggattttatgtaagctcaaaatatactttatgggtgtgacccaaaaaaaaaaaaa

SEQ ID NO: 5853 - DNA, 462 bp, Homo sapiens
agtacgtctaagaaaaacacaagcactgggtccagggtcaaggtactgatgaaagaactatatacaccaccaagaatcagtgtgaaagcaaagttgaaggagagtcaacagaagagcaattgaaaaagatgactagaatggacagagaacacaaacaagccaaccttctccatcaaagagaaattttctttaatggagtcatcaagaaaacagtgatgtccatttatgtcattacattttgctagcactctaaagagaaaaatgtctaagaaaacttttaaagaggggtttccatataacaaaggaatctcaattctgagatgcttgttacccaattacaataaactttcctaatgaaattatcttaaataatgtaataatactctcattttaaaaaaaatcagggtgtacttctagggcagttttattcaataaaaacactaacaattaaaaaaaaaaaaa

SEQ ID NO: 5854 - DNA, 115 bp, Homo sapiens
agtttttcttcaactctgcacagctattgactctatattttctgaagcaaaaagcatgtttgttagaatggaaacagaaaaacattaaaaagttcattccttaaaaaaaaaaaaa

SEQ ID NO: 5855 - DNA, 173 bp, Homo sapiens
ccaggtaaacacaacaattggaatcctacttcgtgcatgatattacggagtttatgatgttgacatgtcttcatactgatgatcttgatcacccccctctgcctagttttttaccataaagagaaatatttttctttataaataataaatgtcatgggcgaaaaaaaaaaaaa

SEQ ID NO: 5856 - DNA, 119 bp, Homo sapiens
aggagtttttcttcaactctgcacagctattgactctattattttctgaagcaaaaagcatgtttgttagaatggaaacagaaaaacattaaaaagttcattccttaaaaaaaaaaaaa

SEQ ID NO: 5857 - DNA, 297 bp, Homo sapiens
  misc_feature (1)...(297): n = A,T,C or G
cacaaggttttcgagtcttgccctgnagatgtggaanagggcacagatgccagcagtaaactttatctgtgttagttacagtgggagtgggttcctgataagactttctgaggaatacaacaatgaacacactgacttggacacagatgttataattaaaataagtaactgccattaagtgataaattcaatgttaacaatggctacaatttcaattaacatttcccccttcttagggtagaattcataaaaattaaagtggaccatatatccatggaacgagcaaaaaaaaaaaaa

SEQ ID NO: 5858 - DNA, 839 bp, Homo sapiens
  misc_feature (1)...(839): n = A,T,C or G
aaaggtgcccaggggttcaggtcttcacctgttggcctgttgaccttactccggtctcaatgatcccgtacctcagcctcccaagtgctgggcattacagttctggaggctgggaagttcaagatcaaggtgcaggcttctggcaaggaccttcttgctccatcataacatggtataccctggtagtctatcttggctttaatgctgagtaacttcaagagacaatgaccactggaattgccaccactcagacatcatcaagaagacatatgttttattcttaattgagtgggatggattatttttcttttcagnattactggaaaggggtacgagtggattttccagaatggtgtaataaaaatgaaatctgattgattaaaaacaaaacacacccacacctcttgctctccgttcactttcatacctccccctcctcaaccacaccttcatcaggccctactccccccccgctcacctcctcccacactcactccccccctacccgcgcctcacctacacacccctctccctttccccactctctcttctctccaccccctccccctcctcccctctcctaccccccccccactcctctctcccgaaccccaccttcgcccttagttattctcccaacccattaccctctctctttccccccctaccttccttgttcaccctcaccttccctattcccccttattcctacacctcctctctaccccgcccccccccccccactaaccccacattttacctcccgagtctgccctcattcactcccctcccccgcccccccccccccccccatcccaaccctctactacattgtccac

SEQ ID NO: 5859 - DNA, 395 bp, Homo sapiens
ccgggaatatccggggagatcccgcgatagttacggaagcgggaaagggagaggtgcttttcccttcccgtttgtttgctgttcctgtcagtgcagcccagcagtggcagctggtccagtctccagcgtccttcagcatcccggtgccagccctcctctgcctgctcagaaagaagaaccctcggagctggccagcactgctcttagtgcccaagctccacccttccaagctcctagtttcctgttttcttccctttcatccccccagccttaaaggtgatggctgctttctatagttattttctctgggttttcctcagtattctgttttttctcttcctgccaggtgtaaccaaatcctcatattaaatttcccctgttgagatcctgaaaag

SEQ ID NO: 5860 - DNA, 379 bp, Homo sapiens
ctaagtagccatgggacaagccgctcaggtggtccaggtagccctcgggttcggctgctgctgctgctgctgctgctgctggtggtgccctggggcgtccgcactgcctcgggagtcgccctgcccccggtcggggtcctcagcctccgccccccaggacgggcctgggcggatcccgccacccccaggccgaggaggagcctggcgctggcggacgacgcggccttccgggagcgcgcgcggttgctggccgccctcgagcgccgccactggctgaactcgtacatgcacaagctgctggtgttggatgcgccctgagcgcgctgcccgtccccatcttaataaagaccatgccctgcgctccggaaaaaaaaaaaaa

SEQ ID NO: 5861 - DNA, 321 bp, Homo sapiens
ctggccgtgacaatgattcattgtacaatctcttcccactgcctctgttattcaagagtttgtttctatggtggagctaatgagtctcatccttgcagctaatcaaatgtacaaaagcatcaacagaattaagatggttagcgaggtgaggccttgaaatcaacatctccgcctccttgcataaacccttcattgagactcctcttccatttgggcaacttgatgtggttcaagagcatggagaattgatctcttaagactcataaaatatttgcttcttcaaaaagaataaaggaactgaaacaaaaaaaaaaaaaaaaa

SEQ ID NO: 5862 - DNA, 413 bp, Homo sapiens
ctagtagctcttgctatgagctaatcctgtgctgtggtctgactaggactgagaagaggtctccattctggatgtcataaggaacagaaatggcaagcaattcaccaatctgtgtgctcctacttccttactatagatttgtccatagaaggcaggaactgtatttcctcatctctcttgctaatgaaatgtgaggagaaatgacgtgtatcctctctactctttctttcctcacctttaagctaaatgcaaatgacaatgaggccaatgcttagaggactgctgagccatgagatggaaggaactcaggacatggaagaaaacaacatatgagacaagatatatctatctgagtctgacagttaaatgaaaaagaattaaatttcaattatgttatgccaaaaaaaaaaaaa

SEQ ID NO: 5863 - DNA, 528 bp, Homo sapiens
tacacacagttaacacacatggagaagggaagcataagctaaagcgatgcagctacaagccaaggaacaccaaggacagccagaaaccacccgaagctgggaagaggcaggaatgaagtcttccttagagccttcagagggggcatgggctgccgagaccttgatcttggacctctagcctctagaactaactgctgtcactcatcctgatttcagccatgtgcctcctgcctctctttccctcccctggagctttgagagacaacttttggattggcggctgacaccaggatgcctccggacaccctggaggctggagaaagacagtgtgctgcacagcctcacacagcctgccaaggacaaacttcctctgcgcgacttggacctagacaatcgttctctgacaaaggaatccccaagcctgcgccttcgtggaattgacttttgagtccctttattactgagactgacatctgacgcacatgtatgtttttctttcataaaagccctaccctaaaaaaaaaaaaa

SEQ ID NO: 5864 - DNA, 486 bp, Homo sapiens
acacgtggggaccatggcttaaccaccatcaattctcagaatctcagatgcagtgatcaatacttccaagccagaggcagtgactttactgtcaaacaaagaatggcactcccagcgtcattttctgacagcttctgacactcatcactgtaatatggaactctgcaataggacagtaagagcactttgggatgccaaggtgggagaattgcttgagttcaggagttcaagaccagcctgggcaacacagcaagaccccacctctacaaaaatgaacacagcaagatcccacctctacaaaaatgaaacaaaactagcctgctgtggtgctgcaggtctgtgatcccagctacttgggaggctgaggctggaggattgcttgagcctgggaggtcaaagctgcagtgagccgtgatggagccactgcactccaatctgggtgactgtctcaaaaaataaataaatacataaataaaaaaaaaaaaa

SEQ ID NO: 5865 - DNA, 347 bp, Homo sapiens
acccagctatgccctgctgtattccaagacaaaacagatttcacaatatgtggccggcacaaagtgctaaaccaaagacatctatggtggcagactgaaccagagaattcgttatgcaaaactgcatgttgcatggtctgagcttgatggcttataaatgggaaacaaccactgccttcaaacatgctcctccctgccccgccatgccatcttggggagaactcagagctttcttctcacttgcagtcatgagaatgttctctgttgaggtagttaaaacttacttccatgtattaaaaaggccaaagtatccaaataaaaattgcccaaattgaaaaaaaaaaaaa

SEQ ID NO: 5866 - DNA, 364 bp, Homo sapiens
  misc_feature (1)...(364): n = A,T,C or G
gatccgtataaaaatgggagtgaagttacaaagcctcaggntaacccacaanaaaccatggttcaacgttactggactatggcctggattggtattctgatgtaggctgccagctggctctgactgtgtgatcctgggttggttgaaacatgctctgcaagaccaccctcctgctctggaacactgaggacatccctggtaaattaacaaagagtaggctacttgctttgcttgcagccccacttgacatcagacagtttaccctatgcttcaatatcaataaacaatttgctattccgcacatatggtgtttctcatccctgaattttaataaaattgaagaaaatctacaaaaaaaaaaaaa

SEQ ID NO: 5867 - DNA, 285 bp, Homo sapiens
cgcgggattttccgagctattagtactattttctccattttttaaacttctgttttcaatttatgatgcattttcatcccattatgtttgcttttctgatttagcaatacttttatgattttgtaccaaattgctcaaaccgacctagtctaaatctgttttaattagtcatttgctcttttgtaacaattgtgtgttccaaggaatctgcagaattaaagatgtgatgtgacaaaagatgattctgaagaataaagttactggatatcgttaaaaaaaaaaaaa

SEQ ID NO: 5868 - DNA, 366 bp, Homo sapiens
caggcatcaacagcattgatgctacatgactactgttttctctgctgggacactcattttggaggactgagttatcacttaagagtctgattgccctgtaaggtcacatggatgaactatgtaaaagaactctgaacaccagtctcagttggaaacattttttattcatctcaacacaggcactaaacatatgggtgaaatgcctcttgatgatcatagcctcctccacttcttgagtcactccctgccaagtcttcagagaattgtagcattgataagataggcctcctctgtttgacagttcctggccagcagagtccatgagccagtgtaataaaatggttgttttatccaaaaaaaaaaaaa

SEQ ID NO: 5869 - DNA, 253 bp, Homo sapiens
ctcttactctctcggagtcctcagcatctcaggaatgagctgcaataccacattgtgccagtagatgacgacaccatctaacatgtgaggactccttacccgaaatcccttaaatttcaagcatcgaattagaaattattttctgttatcaagtatgttagtttgacttcctaccagttgattttagaaatgagaaacatatattgaaatagtaacattaaatatcagaatttggtgtgtaaaaaaaaaaaaa

SEQ ID NO: 5870 - DNA, 868 bp, Homo sapiens
ataaagccgctcctgctgtttcccagacacggtggactctgggatgatggagggccatcctcactcctgcctggaaaagactgaagtcatccacagggaagaatgagtccttcctcaacttgattttctccaagaaaacttaaggaatggagcagcgaggaacttagagaaaccgcttacccagtggaagaaaattaggctgtgtccccatccccttctcctgaggggagaatgctttgttgggctaacagttatgttggactaacagctatgacaatatgcaattaatagtaagtttctttgtaacagataatagtcaaaacatcttgaagcccattcacagagacaactttgggggaagcctcggctgtccacacacacatcgaacactgtcattaagccctcctggaatgacagtagctatagttcattatcccgggtggtggctgtggggggaaccacctcccctttcccccctcctccaaccccctccctcctccctccctctcttcccccccccccccccttcccccttttcccctccaccctccttcccccttcctcttacccctttcccttccctcacccttcccctcccctgcgttccctccccccccaccccttcccccctttccctcccccctccccccccccttctccccccttccccccccccttgcgacctacctgcccccccccccccccctcctcctttcctttttttttccccccccccccccccccactggttcccctccttccctccctcccgccccccccttccccccctttttctccacccgccccctccccaactttccccccttccgaccattaccctttgattattcccccccttttctcttcc

SEQ ID NO: 5871 - DNA, 462 bp, Homo sapiens
ctgaatgcagtggaacgatcacgatcacggttcgctgcagcttcaaactcctgagctcaaacgatcctccccgctcagcctcccaagtagctgggactactggcacatgccaccacccctggctgaaaatcactcatctttaatgagaaaatgaagcgggaaaggaagctactcacaacagcaacaagatccgtactataaccaagaatgaaaccagaatatagagtttttgtgattagaacgggtaaataaaagaacaaagctgagtggagagtccagaattctcagccactccactcctaagaatctgccgtttttaaaaagtggacatgtgcacaaaggtatacgtacaaagaggctcagaaataacatttgcaagggcaaaaacattgagaccaatgcgagtttttatcaacaggagaatggttaaatgaataatgttgtatcacaaaaaaaaaaaaa

SEQ ID NO: 5872 - DNA, 597 bp, Homo sapiens
cgatgattccaggatactggcctttgtaccaacagtcctatcacaacaccagcagaaaggcagctccctgccaagtgcctccccaaaatccatccaagtggacccctcaggctcctgcttcatgtccagctccatgcccccctccagctccctcctgctgtgtttccagttgctgtatttctggctttggaggccactgctctctagtttcactccggtttccacgattctacctgcgtcagccccagcattctgactgctgtgagcacgagtcttctagatgttccacttgctatagctctggagactgcagctgacctgtgacctttgaggaaccaaagaaccacagccaaggacccgccctgagttgatgtcttccctcactcttaccctcctccttccttctcctcctgaactcagctgcctagctccataggtgatgggctcccccttttgctgagaacctcaggcctcttggccttggcctgtgttcctagatcaaggagacctgcatgcaaaagaaaaacctgctttttgaagcctgatctgtgtgctaaaataaagcttatctttcctggtgccctaaaaaaaaaaaaa

SEQ ID NO: 5873 - DNA, 335 bp, Homo sapiens
  misc_feature (1)...(335): n = A,T,C or G
cactattttacgacttacaatnactagnanattaattcctgtgataatccaaggcaggccaaggtgagaagattgcttgacaccaggagagaccagcctcggcagcaaaagacgaccctgtctctacaaaaaataaaagtaaacatagtcaagtgcagtggtgcatacctgtagttccagctacttcggaggctgagatgggaggatcatttgagcccaggagatcgaggctgcagtgagctatgattgcaccactgcactgtagcctgtacaacagagagaccctgtctaacatgaaatgaaataaaataattttaaaaataaaaaaaaaaaaa

SEQ ID NO: 5874 - DNA, 376 bp, Homo sapiens
  misc_feature (1)...(376): n = A,T,C or G
gctgttatccgacttacattnactattanaataattcctgtgataatccaaaggcaggccaaggtgagaggattgcttgacaccaggagagaccagcctcggcagcagaagacgaccctgtctctacaaaaaataaaagtaaacatagtcaagtgcagtggtgcatacctgtagttccagctacttcggaggctgagatgggaggatcatttgagcccaggagatcgaggctgcagtgagctatgattgaaccactgcaccgtagcctggacaacagagagaccctgtctaacatgaaatgaaataaaataattttaaaaataataaaaataaaataaaattatttctcttctttccaacgtcaaaaaaaaaaaaa

SEQ ID NO: 5875 - DNA, 529 bp, Homo sapiens
gcaatttttcggatttcgtcttgttgcccagctgggatgcaatggcgagaacttggctcactgcacctccactcccagtttaagtgattctcctgcctcagcctcccagtagctgggattacaggttgcattttcacattcttgaaggtatttttgaagaaagaaatattttaattataaattatgatgaagtttcatttgttgcttgtgcttttcatgtcatatctaagaaatcactgcctaatccaagggatggcagctgtaccctctcggcccactggggtggcagccccaaacctctcagtccaaggaggcgctgttggatagggctctgcatctgtggctctttcttcagggaagaaaaatggaactaaaaagggaaaacaatagcaacaaagatcaaaataaataacaaggaagcggagagaacaaagaacatggtgaagagagtgaaacgcattgtcatttggggtgaattgcacaaagaaaaaattattgttcttatatataagcgagaaaaaaaaaaaaa

SEQ ID NO: 5876 - DNA, 365 bp, Homo sapiens
agcttttgtttaagattgcttaagagttcttcagatcctgaattccagcagaacagctgacatccacaaccagtttgaggatccccacagaagagctgaatcaacatgagaatgcagtttcttcatctctccagtccatgacttcaccctgcaatccccacagaagagctgaatcaacatgagaatgcagtttcttcatctctccagtccatgacttcaccctgcaatccccacatctcagcccactccaaaccccttacaaactcctcagggaggcaaatctgaggtttccttccatctccttgttcagatgccctatgattattaaaccctttctctgctgcaatccttgaaaaaaaaaaaaa

SEQ ID NO: 5877 - DNA, 226 bp, Homo sapiens
  misc_feature (1)...(226): n = A,T,C or G
cgatgctgtggtctttctttcatgcagccgcgggnaacagcccctccatggttacatattgatgaagaccattacaaacattcatccacagagcccgccactagaatggaaagaatatcaaggccacattgtaaaatggtgtgtgatattggtgtggacatcttcagaaaatacaagctgctactagagaatattaaactttgattacaaatgaaaaaaaaaaaaa

SEQ ID NO: 5878 - DNA, 213 bp, Homo sapiens
accagccacacagcgggcaatgacccctccatggttacatattagatgaataccattacaaacatacatccacacagcccgccactagaatggaaagaatatcaaggccacattgtaaaatggtgtgtgatattggtgtggacatcttcagaaaatacaagctgctactagagaatattaaactttgattacaaatgtttaaaaaaaaaaaaa

SEQ ID NO: 5879 - DNA, 230 bp, Homo sapiens
gagtcgaggatagagtcttactatgttgcccagctgatctcgaacccctgagctcaagcaattctctgacttcagcctcccaggtgctgggattacagacgtgagccactgcctcgggcccatattttctttatccattcatcattgatggacatttaggttgtttctgtgttacagttattgtgaatactactgcaataaacatttgagtgtaaacaaaaaaaaaaaaa

SEQ ID NO: 5880 - DNA, 331 bp, Homo sapiens
caggtcagtatgccagtagcagtaagattgttcttgaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacgagttggaaaaatgtgtaatgaatcaggcggctcataatttcccttagaatatgtatgcacaacttattaaatgacataaaaagcaaaaaaaaaaaaa

SEQ ID NO: 5881 - DNA, 320 bp, Homo sapiens
gggtccggctgcatactcgtcactgtggggaagtcagactgaaagaaatctagaaccaaagagcagaagttgaagagtttgagataaattgtgtcaataaacccagatgaaattctgtctgtttaaaatagcaccatgaaccaccctagcacatttaaagggtattggctcaaatcactgcttctatttgttagctgccaatttggtcaaaaacaatttgcctaaaaccaaactagtaaaaatgataaaacgtgactattcttctataattggttattcatatattattaatgtggaaataatgtggaaggtgctcccat

SEQ ID NO: 5882 - DNA, 164 bp, Homo sapiens
aactgtgaagtgccctcattagagggctgagaaaacaggatcccagagcaagctcttcaagcctcagacagagagcctgccaaaccaggtctgaatatttttagcagtaaacaatcattaataaatatgagctacatttatactcacaaaaaaaaaaaaaaaaa

SEQ ID NO: 5883 - DNA, 290 bp, Homo sapiens
cagcaggttccccacccatgagaatctgattcttccacaccgtcctcaccgtctacagtgactgccagttttcaggctctacacacagggcaaaggaacagtttcagacccgtgcaagcttgtctagactcagctcttcataattatgatttcgtttctatggacagagggaaaaagaaaaacaatttctactttctatatatctgaacttgaggactaccagtaaatacagaatattcataattcatacaataaaacctaactccattttgcataaaaaaaaaaaaaaa

SEQ ID NO: 5884 - DNA, 208 bp, Homo sapiens
aaggaagaggaaaatcaggatgacataacaggaagagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaatacttttaaaaaaaaaaaaa

SEQ ID NO: 5885 - DNA, 153 bp, Homo sapiens
aaacagcaagacagcgaggacagtggccacttacatgtacaaaccaggaagaggatcctcaccaggaaacgaatccactgtcaccttgaccctggacttccggcctccagaactgtgagaaataaatagttttttaagccaaaaaaaaaaaaa

SEQ ID NO: 5886 - DNA, 189 bp, Homo sapiens
ccaagaggccaatggggtctcctgtgttgaccagctgttctcaactactcagtgatcctcgttccttggcctctcagttgctgggattataggcatgagccaccacacctggctagaagatactttcattaagttctcttccacccaataaattatgatgactcctattgctttccaaaaaaaaaaaaa

SEQ ID NO: 5887 - DNA, 247 bp, Homo sapiens
gaggaatttaagagcagtcaggcaaaccccttgtagcttggctttattgcagcaagtgtcaaagaggaggacctgaacttccaaggccaacttgactggaaaccctctagtctttaatccatagaaacctgacttctgtgccccccatgcctagaaaactacttttaaaaagaacattagtggtcaccacgttggtaaagtattaataaataaacatgttttagttctaatcaaaaaaaaaaaaaaa

SEQ ID NO: 5888 - DNA, 233 bp, Homo sapiens
gagggtcctgaggtctcgctctgtcgcccaactggaatgcagcggcgcggatcatggctcactgcagcctcgaattcctgggctcaagatcctctcttctcaaccttcccgagcagctgggactacaggcgtgcgccgctgaactcggctaatattgtagtatttactaagtatctgtaaatcctaatcaatataaggaaaataaagttttttaaatgttaaaaaaaaaaaaa

SEQ ID NO: 5889 - DNA, 249 bp, Homo sapiens
caggacgtgtcttgcttgttgcccagtctgctcttgaactcctagcatcaagtgatcctcctgccttggcctccgaagtgtcgaggttactcgcatgagccaccatgcctggcctacgaatgtttctaactgatgatttctgctgacctgtgggcagaaaataaggaatggtagcaaagtggctttaagttttcaactgtaatcaaaaggccacagaataaaaaactacttaacagaaaaaaaaaaaaa

SEQ ID NO: 5890 - DNA, 185 bp, Homo sapiens
tcgagtattcagtggaagaaaacataaaacgcttgtgaccttgcaggtttcaaaagaagacaaacaaaaagggcagataaggagacgccagtgagactctatggcctgtcattagggatgggcttcccagctatcaaatgtttgctcacataataaaatggtggcagagcccaaaaaaaaaaaaa

SEQ ID NO: 5891 - DNA, 195 bp, Homo sapiens
ccatgcagaaataggattacgtgcttgagttgttgactgaattcatttctccatgtgaaaaaagaatgtacatttcacattgttttgaatattgaatggcaaaaaggaaaagaaaataaaccatacaaaaataactgcatgacattaatgctaaggacttaaactcgcccaaacaaggaaataaaaaaaaaaaaa

SEQ ID NO: 5892 - DNA, 1081 bp, Homo sapiens
  misc_feature (1)...(1081): n = A,T,C or G
gaagtagaaatnatatnnnnnatnnnaatttaagtataattttntgagtttatggttatatgtgnagtttnntatatnnatatttnttttttnttttatattntttttgtttatttatttatataatatntttttatttatttttataatttatgtatggttatttttaattttgatgtttgaattggattgntnattcaagnaaagtcaacagaatcccggacagttatccatccgaaccggcataaacccccatacatagcaatatgatgacaatactcccctataaaacgtcagggaaaatgttcaagattaaatattaagtaaagtaattcatacagtttaattgtgttnattgtattattttttattatttatatattgtagatatanccagtagaccaaagttaatgnatatacgagattataaaacactagtattattaaaaatttcgaacactaaggacgactcaccgggcgtaaggtgttgtcgttgnatcagactcaccaatntcatagacgaacacaccaacaccacccagaccatctcccgcttccgtccttcacacactctcgctgtcctcaagcagatgcttgttaggctgcggtcggtaacgcggatagtctatgtctcccaaagcaccctgtaaaatggaggcgaagtgatcgctaaccctctgtgtaataatagtgttaatagaggtacttatggttagagggaaaataagagaatagttgatgtatatgtaaaggaaaaaagtgaagaaatagaagagacggcaagaaggtagaggcagagtgcgtacagtgttgtgtgtcctagaaatattaactattcaccgttgaatcctcacgagattaacgagggagtgtttagatttaggtgtctcggccccgggagagagactggtgtcagttcaacaccatccacaccatctcaggccacacccacctactatgttgaatactatactagtactagttacagtaatcctataattagtttatctaataaaagactgaagaatctgaaaatacatcccgcccagaaacaaaaatccacaccacgattacccccatc

SEQ ID NO: 5893 - DNA, 1706 bp, Homo sapiens
  misc_feature (1)...(1706): n = A,T,C or G
cgggactcgggcgncgccccnattatncctanagacacacctcatagaaattattgacgcatcgcggtcgttcggcccacccaaccggtcgcggccgaagtgataacacgaatcaacaaaaccacaaatttttttgttgtattttctaatatctattatatacatatgtcacacaatgtaataattttagattagatacactcacaccantctcgcaccaggactagagtgacaacatgatgtaccacgcgataagagtgtagagtgagtatgggggagagaggcgtcgccagcaagntncaccgcacatgaacacaacaagacgtccgtatacgtgcgaagcacagaccgcgcgccgccggtcacacatacgtgcgagatggtatctttgtcatgagtttattgtttttgtattcgagttcggcgttntcacacctcatcatcacataaagacccacacgcgccgcaccgcacccgcccagcgaatactattataacgggacaccgtgggcggaggtgatgagtgtagaggtctcgccctctctctctatcctacgcttttgtcttgttcttttatatttgtcatntttcttgttttgttttcgtgtagtcgaagcctaaatagttgtgcaccaattttacttttcgccgccgctcctccgccttatcgtttctcgatactctttcgtctctcctatgataagtattttccatccaccaacgccctcttagtccaccccaccctcatatcatcgtatgagattcgcactctatataccgagcacgcgttctccgttcgtagcgatattaatcacaggtgtgtgagagacgcctgtacgtctgattatattaaatttcctttcgtacgtcacctgtatctaccatactcagagctctagcattctatcgcgtattnatattatttgtagactatacactaatcttatccgttaagctgacatactcgcacaatgaaacagtattaagccgagcggacagtgaggactatttcctactcgcaccatatgacgatgcgtagtacacaggtgagggcgaggaggctctgtgctcgcggaccccttccccgccagcaacaacacgccaatcattcattagcgccgcagcgtcgataagaacataaataacttgcacatttattctccgcgaacacagcgaggcgcatacgtaagcaacataacagcaccgcgatcattatactaatactccattcgtaatatcattagcanagtanacgacgacgatctaaacacgtcactgccttcttcttcatcgtcacagagccgtcctctgtgcttctcgagactctantatatatcgatttacaagtgagctagagagagaagtcgctgttgtataatgtcaacctacactgtaagttatctagtctactgtactaactacaccagaagcgctactgttattggnggagtcattcgagaacaggccagagtgagaataatcgagacggtcacaatatgtagtactcacatgtatacttgcgtatcattacataattaatatcttatactctatgtattcaacgatttgattcaccgcgcatacacagctcagttactagatgtaccgagcgcgcgtcacacacnaaatatattntgtagtgtcgttaaactagaatcgtgcattttatttntgngttagtgantntatttngccacacagatgac

SEQ ID NO: 5894 - DNA, 1364 bp, Homo sapiens
  misc_feature (1)...(1364): n = A,T,C or G
ggggnnnnnnnttttnnnnnnttggggnnnngnntagggcgnnntgttggnagnnntnnntatttangntntnnnnnntntnnnnnnnncnnnttnnnnnnannannnnannannttaattgctnncgtnntcntagnnnttatttctganacgtttgtcagcgtagaccggtatntatgtaatgtggacnngatnagatggtgcaggctggattggaaacgagagccgatacatgcgaggataattttgtgacatatcgtatatagctatcaagaagtgtgcagagcgcgcgtgggccacgggccggtatgcggacatgacgcggtggatcccggacgtgacgagttcgacgcgcngagggccgaccacatagataggtgagcgcgttgtgatgagggttgnccgtattgaatcgtctgtagtatacaggttcgatgatttatactattattgctttgtgactatatgaacatcttatgtgtctcttaacgtaccctagcaccgatgcattaggctccgccgtccgcaatttattaagagaggggaggagggnagcgaaagtaatggtgagagtagtgtcggaaaggacagggctataccctgacagcgctcgaagcgcacctgcgtctgcccgttatcgcgccatcagtcccgcgttctcaaggcaggcgagggagggggaggagcctgctagcatttcaatatattgcccttctcaccctacactcttatccctctctctacggcgaggcatcgatcaggcgcagtgtagagacgtggcgtgagcaggttatgaaaggaggaagtcatnagcgaagtattgtntgtctgtcattagtgacttgtacatgaatattagtgntatattcgagtattgatgattgttacaatgatagtatataatagtaataagacagatcgctgacagttaagcttnaggacgaggcgccgcagtagtagatgaattacggnagagcattcgatgataattcatagatagtgctagcagncgcaatctgngcgcctatgtcgcgagcagcgttgttgtcgttgtcggcgagaactcgagcagtcgcgagcgcagcanccgcggcggttcgaggtcgtcgtgcagtcgcgatgctgttatnatcgtntatcgtatacgacgcgtacactgctaagcgctgaatcagaagtacgcactcaatcgagactaacggagtcgattattcagttgccagagctggctgcggtaggcgtaggcgcatgcagagtgaactgtacctgcatgaacagttatatntatctgtcgattcagtggactcgagacgcctatggcgaagtgggtatgacgggccagcgtctttattctcatagtctg

SEQ ID NO: 5895 - DNA, 1160 bp, Homo sapiens
  misc_feature (1)...(1160): n = A,T,C or G
ggcggccggtntacccgccctccggtgntgggatttncnnnatnantggngacnnncaccgggtcaggggggngncggcgcgntnactcgccccgcccgccgggnncgnnaggtgctngagagtattgatccccgcgggcgngngcagggccaggagggcgctgtcgccagcgccacgggcgggcgaggtctggccacggcccgggggggggggagcagagagggccagggggctgnaacaaacagcncaataataataacgccgaatgtatgagtcgtattatattgccacactaagctccaacaagtcgtagctagtantctcgttcctctcattcgtggaggggagtgtgtgacgccagtttgtttagtacctcgcccacccacgttccttatatgatggtttcgttttctaggtttnagtcattaaatacccgacaccatactctctctatcactatcctttttcttttttctccctaatataataaattatcttttatagcaacctcccaacattactaacagctcgataccacccgatcacgatatgttcgatggtaaagctaatccatccattgcaggctctaacataaactatgcaatatatcaccgtatgcncgttccttcccatgcgacagataagctgacccgacgcgctactatnatatcgctcgcgcaccttcctcgcgtccgccccctctctcgcatatttgtcggctctattttcctcatcgctcgggggcgattatttcccgcgtcgcctgataattacgcgcagcacgaacagtaacaaggattgagacccaccgattataattttctcataacccccctttccccactttttattttcgcccccccccgcgcgcaagattttgagattttaccccgcccttctctttcttgttttttttttattcttattatattaacctcacaatctatccagtaggtagcagctcttagttcccgcgttagcggtttatggtatgtttcgcacgggatctcgggctagtagctcgtatgtcattcgccccacgagtcattagactaagtagtgtatcgcatatttggaatcgataacgtcagatcgaaacgacagatcacatatgtcacagggaatagatatactcaattaaagaaaatatcttagaagt

SEQ ID NO: 5896 - DNA, 1465 bp, Homo sapiens
  misc_feature (1)...(1465): n = A,T,C or G
gggtctctgctgatatagtcagatatccgagcngagcagacgaggagcggcggnagggagngttcctttgtttggtngggacctagagagcgacagcagcgccgcctcnccgagnggcgcaagcaaaacccgangcagacggagcgacnagagcgcccgcaacgaggagcagnagnagcagagaacacgttttgaaggcgcggcggcgttgagcatcgaatctccatatcttattcgcaactcctcgatagcgggctcttcatattcagtaaggntactatgancgcacatgtatgcttgcgctacgctggctacggacaccagtacatgtatcgcgcatgcatcttgatgtcgagtgagtgtgggtgtggaggagccgatttgatggtgattgtaatgagtgagntgcgatgtgtgattagatgccatcctaacgtcacgcacacgacacgagcacgncgagccgacttgttgttttcgtatggagcgcggtgcgataaganagactgctcctgattatatatccgcnggcgagtgagtgatgatatntgttactagatctcgacgtctngttatatacaccgcantcatagatcgcatatgntgttgtttatactcgcgtgaccgcgcntgatcgatggaatcagacatgtcactctggcgtccattgtatcatcgtgatgttccgcattcggcgcttgtgtctncacgttggntatttcagtcgaatgcttgatcgccgatgacgtgcatgattattgtgatcgttgtctctgccgatcggcgcaatatacatccatcntatcacgctgcgatgaatgtgatagcagctaacactcatggaacaattctgagacgtgatgtagtgtcacataagatttcgtgcgccgtgtcgctgctacacacctatagacgcantgaacatactcacttattcaccagatgatcagtgtcgtctgctacttctcgctcgtgcgctagtgtgctctagagttgatatatatantgtacagcagagcagcacgtttcgcgcgtatcgatagaaatatacgaatagtaatgttacatttaccgcgaatatttccgccgcacatcaccgcgcgtttcgcgtttatttgagtagtttgtatgtcctacatattccgctgatgcgcattatccatatgttatctctctgtgtactaccggtccaatgtatcgaagatgcgtactaggacgcgggcgtattagttgttagaattagcatatgagagccgagtacgagattatgagtctttgtgtactgcggtacttcgcggcggagagtcatccgtgtaacagcgatcgatgtacgcgaacacncaagccgacgaccgtacacactaatgtacgtctatttgtggagtttcgtgatgcgcgtcgtacgaacgggagcggggtgccgtatcgtataatgtatatacgaagcncgcgttaacacttacat

SEQ ID NO: 5897 - DNA, 802 bp, Homo sapiens
  misc_feature (1)...(802): n = A,T,C or G
gcnnncntttnatncnaaaggnatttttnngganganttncaaggtttccccnangtnanagganaaaaaattccnanggcgcnatgcnntggggttantgggccangggtnnnggggnaaaaaagnaanagggntggggatggnnatntttgaaaaattcaaaaangnnngtntccgataagtgggcnatannccatttangaacctaaaggntggnaaatgggnnaaataaaacccccagcctnggnaaccntaaagggnccccttagggnttnggggggtnntggnaaanccattaaagaanntttttcaaaagaaaaanaatnggggggnnttccnnnantaaaggnccancncaggaaatcncnaggcagncancacagaaacccaaagcccccnatcctnnccataatgcctgggngaataattgatgtgggttcctcaccttttcggtttgcagtggcagcatgagacccactctanattgctgtggcacaggnagaggttngatggtcttcattacatattgtctgccntgcaaaaatcatctgctttgcttggaattgatttcaaaaccagattcatgcagngcctgttacaccncgatanncaaataaattagctgctncnatanggaaatanncatgattcagtgtanttnannagctgttcnnnaagaaaaaaaaaatgaaagcnnnagnncaanaatnngcacgtcgttnngtaaaaaagnnncnnttcttgntgngannttggtaaggcaanggaagttccaaggnttccnaagttntcnanccggng

SEQ ID NO: 5898 - DNA, 433 bp, Homo sapiens
  misc_feature (1)...(433): n = A,T,C or G
ggggggtggggggggggatggttggnggggggttggcaggggngggggnnagattccccccccccctgcggcccttgtattctctggccgtttatggaggagagagggggtgggctcaanatgtctgcggggctacccgggggggggggggggtanaaaanaatttttcttccttcttccaggttttggggactccggggggccttggcttggggctgcggtactccaaggttgggggtcctccgtccagggggcttggcggtgctggtggggcgtggggcttcctctttcgggggggggggggacccatacctttaaattaaaaaaaaatcacatacaacctctaaattcccaaacctttagctccccgaaaacccctttactccctttactcatttttaactcttaaatccaccctcttctttaccggttt

SEQ ID NO: 5899 - DNA, 1422 bp, Homo sapiens
  misc_feature (1)...(1422): n = A,T,C or G
attagcagtacgacaatggttantaaattnnnnnnnnnnntttccacannannnnnnnnngnggnnnnggggtgtanttgcacacggaaaagacacggcgtgcaacacacgttcaccttcgggcgtgtgggtttctcgggggatccttggggcgccaggcggaccataattacagagaggtattcaccgcgggcgccgttcattaggtgccacaccccncgacacttatagaggcggcatactcgcccaccaccccgaggcgctctttaagacacagcacgatggtgtgtgagtgtttttattgagcgcgttcggtgtagagcgtctctattaatataaaataacacaccgagagtgctgtactcgcgctacacctgcggcgacgattaagttctatcgacttgttattttgtgctgttccgcgcgccgatatctcttaagagacgaagacataaactcttctttcacggaggcgggtgtgggaggattacctgcttacgcgcgcgatagcagttgcaataatccagaaacaccacaccgcatatgcaaatcgcgctgntgacaagataaatatgaacaaagccgccccggccataatctcgcggnagagacgtcgagctggtcgatgacttttcatttcccgctgcgtcgcgcagcaccactgtagcctatagccctctggtggtatctgaactatcaatgagtgtcgatatgagaacagcctatactgattttgttggatgacatagaaaatactcgaattattataacgccggtgtcgcgtcccgttcattggaggagcctatcggactttggtacgtggtgattaagaaatactttctcgaggcgtttaaacacgatacttccattctgaagtaataatacgccctgtatctcgttctatctctcgttacggatctgttcttctgatatgaatgacgtgtctaatagacgactttttgttagaacatcccgagtccacatgctcctctatctattatgtgatgtaaacctgtcgaggacgagcaatagtgtcgctgtactatataatgnttgtgatgcanacaggctgagctactaatctcccgtgcgagccctactattcttcaccaccgtgtctgtatgatatattgtttggctcactcaccactcagcgaggcgtctgttcgtcgatgtgtagagacacaagtcacaagtgcatgtgcggatagatatagctgtaccttactatgctacatactcttcctccgccgctcgttatgtccgatatgtggacctcaccgcacagatacgccttnttatatatgtagtagtttatacgaggacagtcgtagtctgttgtgtgtgattgttattcncttgcagcataaatatggcaaggtgatagcggcgnctactcagttgtatattggtgtgtaattg

SEQ ID NO: 5900 - DNA, 1766 bp, Homo sapiens
  misc_feature (1)...(1766): n = A,T,C or G
gcacgtggtgtgtgtgtgctactgtgataatgcatgtcggttagtgtttacttatgtaccacantagcgtctgctgggggttttatagtgcgtcactacctctcatctctcttatcgnttgtgcgactcttcttacctcgcttggtgtcgacattacatagatcggtctaagctcangcgtacttaaaacgcacgtatttcgtatctgtacacactcgnctgtggcgttcgcgtcgtacatcgtgcgctagcttcgcgcatgatgcgtctntnatctcattctcacatganatgggaatgtgtatctaatagatgtgagcttggtctgtgantgcgntgtnagtgtgtgtacgacactgtcagtagatacgnacgtcngccgcgtgntgagtcgacgcgantcgactctcgancctttggtacgagagcacacttcgttgcatgagtcgtcaagtganttaannatgctctatcagtcgcgcgcgcagcatnacgattagagtacgaactatattanantgtctgtgatgatgtagtagttaagatgataattaacgtgtgtnctaactaacacncatgtatagngatgtaatactttcgaacngncgagnttgntgcatactgctcgtcgantcaagatcgcgancganatcgaactcatntgcagangtatgatatantganangtgtgctatacgtatgtgtgattagtncgacgcgtagatgganantgtatcgctgtcgctcntcctgctcgncntgtcgnttctatgatgactcgtcacgncctcgcgctgcgcgcgtgtaatgtgtgtagtctgttatttagtncactcggcgactcgtgatatctgatacgatgctgncacatcagtgtacncgtgatctgattaatgtgtatcatatatactacganctatattacacactaataattcaccacacgacgaaggagtngagagatctagtggggagtgatagtgagttgtntactatcgagtatgttgagtgctcatctcacgtataccacctgagtgagggatagtagttataggatgtctgagtagatgattaantttgtgtgtcgttgtgctagtgnaatgttttatcgcttgtctactgtgtgtaatgatgtatagattatgtgtaataatgtagtaatattgagtgtattagataagaattgctggtttacaacttagngngtatgatttgattcgtgtataggtagttggcgcgaaagagggggaatgcagagtgtatgtatatatatttgatggtttgttcgtgtgagagagatgaattaagatgaagcatacttaatgcagctggatgggtagcagtgtcatgttgaaccgattaaatcgtggtaggagttattagtagtagatgtatgcgtgccctgatcgagtcggcagtagatctatagaatctcttagtggcacacctcgctcctcgtcgtgccgcgcgtcgtgcacattgtctgacactgcgcgcctgagctacattatcgtgtatgtgcttgcgcgctgcttganacacactctcttgtagngcgatagttagnacggcgtgttaggcgggggagtgnggttatgtcactaatctanngntgagaaggtgtgnggntgtcacntcgaggttatcacaccacngnngncagccccgcgcncgtcgggtgcttncttgtnttatactcttgaatctgtgcgatctgttcgagctgtcctcttctatattgatactagtagcatttatgatacttg

SEQ ID NO: 5901 - DNA, 638 bp, Homo sapiens
  misc_feature (1)...(638): n = A,T,C or G
aggaaatgatgccacaccagttcaggatttaccctttaaaaggattgagagctttcagctcaggctcttggagccctgagctagcttacaaaaaggctgactattcctatggaagacaccacacataaacctaaaatactgagagagaggacgaggggcctcatctgtagccaactcttccagcctacatacagcagaggtggcaagtatgagatgtgaagattatctgtgcagcctcaagcaaccctggtctatccaaatagcctatccagccacaatgttgacctactgaagcactctanaaatgtgggagcaatcctcgctatgatttctataagcactcgaacaaggttgtctgaccacagcagacatgacttctggacccctgccggccgcatggatgctgtagctttcccgttagtacctatttatctatccacctcgcgccaagctccggatatttaattcccttcacgtcaatatcccacttcattccctcctcattccccgaattaacacagctactatcgcggtttgtgattattatggtcattctcccatatgcggcggcgtttttgtcacgcgatttattcccaattcatgcgctttcgtttgttatatctgcggcgcgcgcggta

SEQ ID NO: 5902 - DNA, 753 bp, Homo sapiens
  misc_feature (1)...(753): n = A,T,C or G
tgcggtggcgcggttgtgtgtgtccccggtcgctggtgtgtttttgcgcgccctctccgcttgtggcggtgggcttcttggtggtcggatgttgcgttcgggcgggcgggcggcgctcgtcttatctttttgtcggtgttttggttctgggctggtctctcccattggtagtgggcgcggtggggtattggtagggggataagggcttgttgccgtgcctacttagcttgtcttgtggctccgtcttggattttacgggcggtgatcgctatgccatatttggcgcgtgcggcggtgtcctttgttcgccttactgaccctgcctctgggtgtttcttatcccctggtcgttgtgtagtcggcggcgggcggctcttcaggtgcctctgcggttctttttggtctctttgtggtcggggtttcgcgggcagttggttggtctcccctccagtggcgcctngttggttgggagagggactttgggggttttttgcctgtcgcgggtgttgtggggggttttggtccccgcgcgcccgatgttcgggcgcgcgcttcgggggccgggggtgtggtgggcacccggttgtgttttccccggcccctgtggggtgcccctgctttctccccgggctcgtcctttgtgtattcgttttttttttggccgcgcggcggtttgggtgcgcttttatcggctaaatttacttttgggggttcttttttttctccttttcgcgtcccctagtaaaaaagcct

SEQ ID NO: 5903 - DNA, 867 bp, Homo sapiens
  misc_feature (1)...(867): n = A,T,C or G
ggcgggggggcgggtttgcctcgtggtgccgtgctctcgctcgggtgtgtggccctccggcgcctgggtggctgcgttggggggcgggggcgcgtgcgctggggtttcgggtctttttgcggggggtggtcctcgtggggtcgctggcgtgtttccgtcgcttttccttgggctccttggttgttcccccctcgtgggcgttggcgcgcttcctttcgtggtcgttggctggcgcgcgcgtgtgcgcgttggtgttggggttggcgtgtcgttcttttcgtttgcgttctctctgcgcgtgggctgccgtggtctggcgtctccttcgctgtttcctcggccggtgtggggtgtggtggttcggtcgcgctcctgcggttgtcttttccccctgttttccctcccgggccccgttcgtgtgtgtccctgtgttttgtcgctgcgggtgggctcggggggatttgtggtttgtgttgggtgtggttggtcgtgcgcgcttggttttgtggtgtgttttgtgggggtttgggttttgtgttgtgtggtgttggtttgttggtgtgtgtttttgtttggctttttgtttttctttaaagagtgggggggtggtggtgtgttgccgtgtggtctgcgttggggggggggttgggtgggtgtttgctttttgtggttggtttgtgttttctgtgtgtggggcgttggtcgctttttcgctgtggtgggggccgtcccgcgtcgtgtgcttgtttttgtgggggctcttgtggccgcggctgcggttgttggttccccntggaggggggggttgtttccnttacnttttgtttttttttggttcggcgttgtctgtctgtcgtgcggttggtc

SEQ ID NO: 5904 - DNA, 1107 bp, Homo sapiens
  misc_feature (1)...(1107): n = A,T,C or G
caatccccaatataccccaaaaatnatacatatcgcagacccagtggtataggggaaaacaccgcgggaaaaggttcgacgggtgattctcgtagagaagttctgtggcaatctacacaattgccacggatttaacacggagtgggtgggaggcgtcctatggatcatatgggcgtgtatgcaacgcagaaagtattattgccacccgcggcgcggtcggattccaatatgaacggcgagtgatattccccgtcaaaaacacccaccattaatgggcagcgattggttgtcgcacacacctcacttgagagagagagagcccctaaagagagaagaaaaccgaattactcgacaaggggtggtgattattacaatattcatctccaacatacgagccccatttagcgagggtcgctctagcacacagctgccctcggccagtggttagctgtgtagtctcgttgttgaggcacaaagacaaataagtagggtcattagtaatgaactccacaccacgggcggccaagacgcttggtttaatattacaacgactttgtcagggactgttgtttgatctaagcacgggttatccgcggtggttatatgcgcccgcaccggcactattaaacatctcctattgtatctctctgtagtgctactataccattgccaccatcccgcataaaaactgtgctagtacagtgtggggtgcggtagaaatgatcccaccattcgtataatactgctggttcatatgagaccaagaataaaaccatcattgaagtattaggacttaggtccgtgcaccaccaaccatttgacctagtcggacgatcctaggaggtctattgaggtaataaactaccatgagagttcagaggcagaggatagtacagtgcgaaagagagagagtgagatagacgaacaaaaaggtgtatataacatggatacaagtagttgagaagccacaagctggcgttgcgcgctccgatatagcataattataatttcgtgaagcctatatggacctggtttcgtccactcctcatcaatgtacgcgcgtcgtagttagccgcagacaattccaccaatatgttcgcccagcac

SEQ ID NO: 5905 - DNA, 905 bp, Homo sapiens
  misc_feature (1)...(905): n = A,T,C or G
cgcggctacggacaaagnnngnnnnnnnnnaccannggaagctcatgatcgggtaacaggttctttgccttgtccccgggatcttgggcattgctcacaaccaggtattcccccaacgggggggggccgcggtacattaaggagttcccaaatccgggttttccccacacccgggttttactccaatcctttggggattcccaaaactcatggaatcccccccccgttcatatttccctgatttcccggcggccttataaaccttaaaccccacggggggggggggtttcccacctttcgccttgtccccatagggcccctctcccccctttttgttgttttctgagtaatacacccacctccaattgccctccctccacaatttcttagtttttaatttatccgagacacatatatattgcgctaccgcgtacccttttcttttttactatgtgtggggggcaccccattttatcggtaaaagcaccaactttctcttttggtgctagagcaaaaaacacacgtctactctgactggcagctgtgtttatatatattttactttactccgtgtccattttacaccggggtcccaactggtgttatcttttagtctacgaacgaacccgcacaaccaataggtgtcgacgcttgttttattccaggagggggggcgcccacagggcgtaagattaattattgcgtccacgattggtagatgtgcagggggtaattataggcctttcaactcttaagaagggggtataattttcgttgtgtttggaaattctcctgcctctggcctcaagcgatgaccgcaaccatcacgggcggggcaagggcaacccctggccaagcactcgaactcgacgaccgctttcgctgtcggtgcgtagtgctcatga

SEQ ID NO: 5906 - DNA, 766 bp, Homo sapiens
  misc_feature (1)...(766): n = A,T,C or G
agagaagaaagaatcaggtttggaaaggacaataataatcagaaccaaacaccctcacggaggttaaccctgttttcaaggggtacctggggcgtcccgggagctgctatgtgtgtacatgggcagatgaggctgactaggggagtgagtaacccccgtcatactaatgagtatatactagccccactctttcggattacgattcgtgctatggtgtggagctgcgctagctcgtcatctggtacggaattgaaccgcgatagaggcacagagatcatgcgggatcttcctatgctctgtgtgcngccgtacgtcagtggcggctcgcgtaataatattaatagcataacgaattaattatagagctaactcacaagtaaagccgcctgatagcgtgcccgccctttccttattagtggagagagttaaattcgatagaatgctctgcttacactgacctccgattgcgactaccggccgcggttcgagcgcgcggctccggcgcgcgcctaggctcgattctcgacgggcggtgttgcgggcgtttttcgcgcccacgccgccgcggcgatccgcgatagttgagatacgcccatatcgtatataacggctgctattacacgctcccaacccacccagatgtgagacgctacatcggccgtaagggcatgacgatgggattcagtcgctggcgctgtcgctatctcgccgcataatacgagaatcgaggcgcgtccgcatctgttttgtggacacccgtaggtat

SEQ ID NO: 5907 - DNA, 1104 bp, Homo sapiens
agttgaccgagttccacaataatggcaaaaaacacaaagcaaaccttacttggcaaacaacgcgcaaaaaatgttttccgcgcggatcgaccattggagagtaaataacagaggagtgtgtcagcacagcggctctcttttggggctttgcgggaccccacctcgagactaaaaatgggaggagggcgcgttacgccgctgttgtatactcctccggcagcgcgcccacacctctagacccatgaatatggccacacgtattagtccccctggccttgtcacacgtgttatctcgacaaacgcccgttgtaggcgagaatttaatgagagcggggcgggggagagaagtgccgaccttatagtgcatcgacgtggtcttcgaatattatatggtagggcgacaaactcacccagggggggttcgcccttatggacgttcatcatcagtgagtggggagagggggcccacacaacaggggaggtgatttgtcctccggctcgggtcccacgcgtgagtgtgggtttccccccaggtgatgccagatgaatacatatgccgggagacatcacttgtgagtggacgcaggggattgtgggagagatagtgtgtttgtataaggagtgtcgtcgatccccacccacccgtgccatatatgtaatgaatagataaaggcgaggcctccgtggtagatggggcccctagttgacaaaattgataggtctgggagaaataatccacgtcaccctcgacgggcggcgaaatagaggtgccagccccacggtgcgccctctgtgctggccgggcggggtcttttcggatgagaaaaactcgattatagctcatgacctatgttgggtaggttcgcacactggatggccgtgtcctccggcagaaaacggaggagtgtgtgattatgagtagacgtaatagtataggaggcgaagtaatccaacgttatgttcctgcacgagttgggatgatatgctatgtcgatgctacccgcaggtgtacacatatattacagcccgcgcgaccgcgatattgagcaaaatcggttaagatgtcagagcagcataaagtgagtgttatatcaacgccatatg

SEQ ID NO: 5908 - DNA, 1264 bp, Homo sapiens
  misc_feature (1)...(1264): n = A,T,C or G
ccaggaccaccggggtagaggtggaangcaggttttttttggccccgccgccgattaagctgaaccgctacaccaagccgagctactgaccgcacagtagtcgatcttacgctgatggtgactctcactaattactcacaccggatgcaggtgctgatgcatgatgtgngagtaaaatagatcaaaatgagagctctgagatatgatctccagagtggagngagacaagacgatgatgaaacacagggtagagagcacttcggtagagtgctactcacttttggggtggggagagaacacaattcgtgcgtgcgataagctgtgacatgcgagggttgtgcttacaaccactcttccttaaatatggactggtgtgttgttaagcggctcacaagtattctgtctctgaattaaatcagtaaggaatatacgacttccctcgatttcttcttgtgctancaacacactgactggattcgtaagtcccgtaacagataacctccctattcaacatgttgcaaccaaggggggattctttgccttgcgtatttatgtgtcctagacagcgagtgtcaccagttcactcgtggcgaagatgcaccagcgcggtgtcacaggataagggcccttgttgctagaatacaattcatctcaacctccaacagagatcttaactcacctccgggagacactcttgtataattgggacagttgtagaccattcatctccgttccgaacaaggcgaggcggtctttcttgaagagttatataacgatcgaatccaccctcgagaggtgtaaatgtgtgttattaccgtaactggcgagaaaagaagaagagccacttttctctcttctctttccctgcgcacagtgagcgagagattnctttanaggagttntgtcgcgccctgtggtntggtctgaatcatatcaacttgatatgagcagcctccagcagaacacantcaatgtgtctatgtgccactgtgatattacgccacgctatctgctgtgttgctgttatgatctagtcaggtgctatccaccagctgtgttccgaactatagtgattattgcagtgtctgcatctcctcgtggcgtgtatagagtgatactgcagatgcaactctcttttctctcgtattgggcaatcttcagtttatgccacgcgaacgattgtggatagtcggaagaatgtttttcctgcagattgtgggggtacagtgatcgttgggcattcgagaagtaagattagctaccg

SEQ ID NO: 5909 - DNA, 632 bp, Homo sapiens
ccccgctccttgaagctagagaacaataatttctaggatattcttcaatatagaacaaagccccccggatttattcttattattgttatccgccgtacttactattcctgttttttttccgcttttatacatttatattaccccttccccatctatttgcatcaataacctaccgctactcttctccctattcccctctttgattaccatttgattatgcgccataatcgattgagctccctccttctcttatctttcttgtatccccttttatcattctttgacccctatttacacacattccgtagcattgatctattccacctctctatatagttttacacttcaccattttttatttccaccttcttttctacccctacgtttcacctctcatttcatgatattatgttcccgcccccgctcatttctgattacaaataagagcccccccggctttccaaatgtagttcgcgatatgtctttttttccccgcccttccccctctttcccctccttcatccaccctgcacgtcccctttatattttattctctcccttattaatcccattcttccccatttatcgcctctcatttacatctattcacccaatcctgtcggactttatgg

SEQ ID NO: 5910 - DNA, 190 bp, Homo sapiens
acctccacattttttatgtcgtaaccacccggcgaaaaaaagtctcaaaaaacacaaaacttatagaggacggcgccgaacggtccttagactatacaaatgctgacgctaccagatcactatgggattcttgatagccgattcttaattaaacaaatgcaattgcctgattccaccaaaaaaaaaaaaa

SEQ ID NO: 5911 - DNA, 1449 bp, Homo sapiens
  misc_feature (1)...(1449): n = A,T,C or G
gggnccagcgtatgggccgaagaagggagaatagaagttttttagggncaaaggnccgtccccgttcggnnaannnannccanaaatttttgggggggcggcgngcgggggcgcccggccgcgcgcccccgggggggcgccggggcggngggggggggcgccgcgccgcgccccnccccccccggcgcgggcgccgnccccccccccacccggcccggggggccgcagggcgcnngcgcgggccccgccccgaggagaagggaccccggccnccgcggggcccacacccggggggncgggggcggccggcggggcgcgggggggggcgccgcggcccggcgggacggcccggcccggcccccgagcgagannccccccgggggcccccgacgcgggcgccgccgcccccgccggccggacgccaaaagagccggacgcagccaaggaggagcggcgaacgggggcgacgnngnccgccgggggcgcagcggggaggcaggcgccgcggcggcgcccgcccgcacgggggaagcgccccgcccaccccgccagcgcccaacaggggaacgagggcgggccgccgcgcgcgggacagcaaggggacgggccacggcggccggcggaagcgcgcgcaccccggcggcgcgcggggggacgaacggcgggggaggcgacagacccggggcccacccgcccggcgccagcgagccaacggaaacgcgggagccagaagaggggggggcgcacgagaaagaacgaccgagagggcagcgcaagggacgcgcgaggcacggacgagggcgaggacgcagagagcaggagcgggaagggagggggcggcggcacgcgcacccggcgaagcggagcgggcgcgcgcgggcgggagacggcgccacacagagcacgncgccgaacgagagaggcgcngcgaggggngcggcgccggacgagaaagcatcgaggaaagcagatacgaacaagtgacaagaatatgagagagccgcctaacagagccccgcaggcanccnacagagggagcgcacgcacacgagcagcccaggacgcacacgaggaaagtccgagagaacgccggaggcgcgcgagacgcagaggagaaagcgacgccggaagtgctgagcgcaacaccgagagaantggcgcgagcaggacgcacgcgacancncagagtcacaacggcacgagacacaccgcgaggatactgaggcagcagcccgcgtcatacaccacgggcacgcccggcancaccgagggcgaccaccgcntcgacgatgaagcgcgcacaccacacagaccgaccgagcgcacacgcagtagaggcaccacccgccacacaaacacacgacntcacgcataacgacccccgttctgngacggacatgagtcacaagcgagagaatgcaagacgcgcacagcagcgggtgaggcggg

SEQ ID NO: 5912 - DNA, 508 bp, Homo sapiens
cagggctttgctttgttgcccaggctggagtgcaatggtgtaatcatggctcactgcagctttgacctctctggcccaaatgatcctccccactcagcctcccaagtggttaggactacaggattcatgactacaaccccaaaatacggaccttctgcctgtgagaaaacaacacaagcaggaagattacttgcatttttctctggcctttttatcttgaagcacactattaccaataatctgactttcctctgataagaactctgcttcaaacgtacccctcctatatccaaagaacatctttatcttctaagactcagagatgtcaagaaaaatttgttcaaataggcttgccaaatatcgacatgttctaacttcatagcagaattgtcgatttgcattctacgtacagttatcggcactatatccaaccactaaccattccttttgggtatttattcccgaaagcttctgtgtcatgtaaaacttacattaaaataaacaccga

SEQ ID NO: 5913 - DNA, 1460 bp, Homo sapiens
  misc_feature (1)...(1460): n = A,T,C or G
tgtatgttgnaagatgtatattangtgaagaaatatnaaaggnnaaaaaaatgaaaataaaatttaattgannnnanaatagtggtgtatgtgagtgaaacaggtaaaagataatttatttatttaggagaaaaaccnnaaatgtgtatgtatatatgtttataattaagatgagaagatattgtttgttatagtggaagagtaatngaaggataggggagagagtgaagatgnnaaataagaggtgagacagagaggaaagggnnccaacaaacggacactcgcgaatcacntcncacacactacacacaacaattgtctacaataatcagaacactataggtatcaacgcatatacgcttctagacgtagtttttcatagtgantaatataatctattnacttgcattcatatacttcagtgtatagatggacgtaccaattgtganaataattaatgnncacagtaactgaaaagcagcgataaccaaaagaaagatctcaaggancccacgacccnanacacagggagaccgccgatgctcacaattnacagatnatannataatgatattatatttcctcctactcagcgcctgcggcacagagagntagccaacactacataatggngcgtcaataattannanacacancatagtagagagagatataagagagactcgcgtgttgtagatagtccagagaagcccgccgacagggccnaccagggnaaagagcaagtggatntgtcgacaatgaagagtatagcagttctatttgacgtaagtnntcnnnccagatagtgtttncttattgtgttagtgtttnnntggttatagttgcggcatcaagtagtataatnaataataaatccataccaaagatatcacacatatatgtcaagttaaaatgtatatatnnntagtagtcatcgctacagcnatacatgagacaattatagaagaagtnataagtgnngntcagtagaatctacgtatgntnncttatcactgactcccaagatatgttattattgtacgncagtcaccntcagataatacagacanactactcaagagatgagactaacaccatcaatacacacatactcaacactcttaccacatatctcatngtaccgtccccacatctcctgtctcatacgcatcncgccgcagcnccctccaaacacatacacattctagacaaatacctgtctctcacagtcaccacatacactggnatacgacacgctctctgtatgtttctcntttatctgcntcgaatgtgcgcncttcgtattatgtntcntntnattgtntcttcctaagatcgagtgtacatctcncacgatgcacagacgtctcactcancgccctgacccacagcgatgcnncatcgcagagtagcaatgagtctatcnccacagtagttgantncataaccacgacagcntc

SEQ ID NO: 5914 - DNA, 1718 bp, Homo sapiens
  misc_feature (1)...(1718): n = A,T,C or G
aatgattagctagcacaatcgtcgacgtattgtctacgaaggtaataatatgcggcacagagacgctccncaccanggcgtgtatcntacctcgtctcatcntatactacacatgctcggtatgcgcgtggagcagctgatgtcgtgttgcgcgtcgaggtactaatatagagaatatactgcatatctgcagcagctccgacgtancgtatgacagntagaatgatactgcgcgcgacctactgcgtgtgagcttaagtcacatcgtgtatgcatactgcaatcgtgtgnacacaatgagatatcctctgtcatgatctacgtagtagtgtgtgtctaccatgatcanttgtacagcagcgacatggtcgcacaanatcgctacgtgtgcgcacgtcgatctcgtcgcacagtgctcacctgaccgtatcggnggcaggagcgcgcgcattatatgttcgagtggcctcagacagcgagcctcagcgtagagnacatgcgtacgcagtacgagcggcagantnagcacactgtactntcacgatcgntgttctgtcagatgcgccggagatcactatctactataaacgcaggagaacacgcagaagcctcgtgtcacatagcattatcacggctcagatgtaccataagtacggcacgaatatagtgantatgcacatgactgcntcacgtctcgcgtcatcattctcagtcctagctctgtntcatgtgaatcggaccaggtgctgagtagatctctatccatcatcagctacctcatgcgtaaacatcgtatcatancacctcancgattcatctgtagantctgaactcgaaactcagtctatcatgctgtactnccgctccgactgactcgagcacaccgcacatgatactcgatgcgagcacatacggatcccgcagtacgttcactacgcgacattagtcgactagcggacagcatgtcacatctagattccggccatcgnanacatcacgacgcatacagtcgagtgacgtcacgcgcaacgtgtgcgctgacgcctaaatcgcgcntcatggagtagtcagctgcntcgcgagtcagctatctnatgtgtcgangtgtagggtaanataagtacgtagaccgtntgcaacgtcgagtctactgcngtgncnacactcgcntgctgatcgcgctcagctgagtgatcaantgcacggtcgagatcgagaaaccacgagacacgtggctatnagtcctcgtgaccacgtctactatacctgtatgatggatgctatanctgacnctgtcnctcagngccgagcagcttcgncaccgcactgcgaagtgatgctnccgacgactgcgactataatgctccagcatcntcnagatgtcacggagcggacgcatgctcgcgcagcgacatacatgtgatctacnatcagtgcgtgagacagagactaccgggcgtacgcgcagtggtgacaacctatgcngnagagaccggcacacacagtctatccctctnaatcgaagtgctctacaatagtgttaggctatgantggatcggtatggcgcatcggtgggtcctgcantncctgtgatactgacgaggtctgcgacgggacacaacaacacatanaaacagcgatagtcagtgcntcgcctgcgttcttcactgctcggacgtcctgcgttactatgtcacactaagcagtacgcagtcag

SEQ ID NO: 5915 - DNA, 550 bp, Homo sapiens
taatcataagtagattgtatagtttagttaaaaagagatatttatatattaaatggttgtatttataataaacttatgtttaataatattttaatttcttttatattagatatgttgctattatttttctatataaaatttattaatataattgttattactttatgcatttattatttagttatgtttagttgtttttttcatattttatagagatatatttattattaaatatttaattagttttgtttttatatgttattattttaaattattatttttattattgtttatagtttttagaatattataaaattaatagggcggggggggtttttttataaaataattaaaagtaaactatttttgttgattagaattggtatattttttagtttttatatatgaatagcaaactaaaaggcaattatcgtagtggtgttggaagtgaagatattttttatattcccctatatgagaaaaaaaagtgattgaagattatgtatgtgaaaggaaaaggagagggagaggaagaagttaattatttttt

SEQ ID NO: 5916 - DNA, 1177 bp, Homo sapiens
  misc_feature (1)...(1177): n = A,T,C or G
aggaaggaggggacaacgggagagggggggagagggggcccttgttgtggactgagcagggggggnctcngggggcagaacanggggggggagaggaggaggaagagggagagatttttgggagggagggggaaaaaccccggggaggaagggggggagggggagggcagagagggcaaagaggaaggaaagacaaagaaggagaaagagaagagagaagcgggnaagagggaggagaaaagaaggcgagaggggggggaagagggaggagaggcaagcagggagaaaggaggaaagagaaagagaggaaaggacaaaaagggcagagagtttttttttagaggcgagaaagggaagggggagaacagagcgggcgaagagggggacancgaggaagaccaaaaaacacgaaagagaggaggaaagaggcagcaagagagggacaagacgggagaaggaaggaaggaggcgagaggagacgagaggaggagacacaggggagaaaggagagggaagagagaaaagggcgaaaaaaagaggggaggagaacagaaagnaggggagaaagaaggaggaaaaagagagagagaggaaagggagaaaaggagaaagaagaggagagcgagcggaaaaacaaaagggagacaaaaggaggcagagaaagaagagggaggcgggacagaggcgcaggaaaggggcagggcgaggggacggcgaaaggccggacgacagaggaggggagagggggggagacgaaacgaggggagggggagacaaagacacagaggaggggcgaggacacgagccagcccacgggggaggggggcgacgaacaagcacaagaagaaagaacacaaaacacaagaagggaggaggagggaagagctcgagcgaaggagggagaagaaagagcggagagagagaccggaggaaaaagaaggaagagaggaagaaacagagaaacgagaggaagaacaaagagaacagaacaggacggagagggggagaacaaggaggtcaggagaagcaaacaagacagacagcggaggacacagaccaagaaacngaaaggagcatagagaggggggcagaggcgaggagaagcgggcgagacagggaaggaagcggaggcgagggagcggacaagaagccagggagagaggagcgagagcggggg

SEQ ID NO: 5917 - DNA, 757 bp, Homo sapiens
  misc_feature (1)...(757): n = A,T,C or G
taaaaaaaatactcctcnatncnaaacagaattgggtgaacntccattcntcnnannnaaanactaaccccctcataccananatntnttttatttatantnaaaaaaatataaaatattctccacccaataccttccttaaaaacaataaaacaantctccttatttcctgtncaaaatgctgcgtacggggttcatacaangttnttataaacttaacttatcataanatctntgatcgcatcgctctgtgccccggtacaaaaaaaatgcgtaaacagcaaaatcctatctctccaatttaaaagaaggtactcttaagcaaaccaaaaacaatacctgggcccatgtcatgtacgcccctaccatcccaaaaattcaattcactaatgtcccaaaaaaagacccaaatacatctaagccacaatccctttaccgaggttaaaattaaaatccatcttctccaaacaccccattaaaaagttctctaaaacctacatcccaatttccctacagcactaccccacctccttacctttaactttatgcccatacctatcaaaatcctaatcaaaccttaatcattagaccttatcaacaaaaaccattcaatacttttacaacataaagccaaaccccaacatttctcacaaccccaaagtaaaccctcaacaactaacactcccttccttactctacttctgcatctactacacgtagctccaatctcttttaaactccaccccaacaccagact

SEQ ID NO: 5918 - DNA, 1010 bp, Homo sapiens
  misc_feature (1)...(1010): n = A,T,C or G
gcgcgagagagatagggtgtttagccaaccgaaaaaacaggacccttcagtgttaacacattacgaagacctttaaagcgagagaacaaggcgcggcggaggcacgttgaggaagaggagctccgcctcgcacacaattcgaggcgccggatcgcgcaaatgcgccgctatgcgaagcgcgacgagctggccgctaatgaggccgaggaacaggagaagacgtgcgatataagctacgcgagactagtaataggtacaggcacgtaacggatgtgcgccgacgtggactcgcgcacggtctcggcccgcgagcaaaggctttattggaaagatcgagacagtaatagcacgcggagacaggtcgtggatacagcggagtgcacatcgcgagccgaacagcagcggaccgcgctacagcgcgaagatcgtaggacgcattcacgtcacaaactggaagtaggtgaaaaggacgtgcgacaagcacatcacaatcacgccgcgatcgaagagacggccgacgtgtgggagtgcaggagtcagcagccgtgatacgaattaacactggcacgctaacaactcagagaggaactgcgagggactgccatcaaaaccatggtgtagcgccaccagacgacgagcaaacagaatccactaaccatgggagcacgcgtgtggttgacagaaggcgagcacagcgtcggacacgcacgaagtacaacacgagtagtgagtaggcgattggataacagcgtcacacctaccactcaaccctacacgacacgcacgtggcggcgcggcacagacggagggactcgaaccgcccgctatacggtacccgagccaaccgagcgccacctagaagacagcatagactaccnctaagtcccgagcgtactaggagtgtggtgtaattggaagtgcaataggtacgggggaggcgagggagacgcaaagaagtgaaaggacgctagcccaagagcgacgagtgccttgcccatagaacaatgaag

SEQ ID NO: 5919 - DNA, 891 bp, Homo sapiens
  misc_feature (1)...(891): n = A,T,C or G
tgacgtaccagagaacagagagaggaactctcttaatctccaccgctccacggggagtgaacagcagcctccaaaagatgatacagctcttttaccgcaagcgaggaggcgagggcagcgcactcccaggatgccgacatgacactcgcataagttacagagacacgccgacctccctacacccaaggcaacagagaccagaggcaccacgggtccgtgacgcaaccggacgcgacagacacctatttttttccaccagagggtggtgccagcctcctcccgccaagcgtcagctagtcgagcaaaagcgccctaattatttacgccgcggcctcgccatacagtgaagacggcacgtgagcccaccggagcacccgcgtagcgcaagcacgccgacgagcgcggtatctgcgtccgcgatactaaaactgcacatcagacctccgcctgctatcttctccatgcacgcgacgatggctgatagacgngtaatatcccactcccctgaagaccagaactacactcctcagcagagcatacacaactctacctgagctagcgccggtgcgactaagcggcaccacacgacgcgaccgcatctgagcatacacncgtagtaatagacacgcgccatgaagctagacgggcgacgcgactgcacaagtgacgcgctacgataagagacgccagccatgctgttgagcgaacgacgcagagtagaatacccaacgagccgtagttagccacaatgagacacacaccgtgacgtcacagtagagggtaacaagagagcgcatcttcgaggcgccgcgccgagccacaccgagctcgaagacatccccgtcctcgccaacagccgcgccacgtcgggctacagtagtaacacgaaag

SEQ ID NO: 5920 - DNA, 660 bp, Homo sapiens
  misc_feature (1)...(660): n = A,T,C or G
gtggtgntcttaaacggnctttattcgactgctaactgtaaagctgctttctcattttcccatcttttacatttgctattacttaagacaaatgaaataagaatccctaattacaaagtttgcaaaaccaagaatcaagcccagggatcaccatcaaaattgctcactgtctgtgttagaaacatagcgtactgctaacctatcaagagttcactgacgggtataattccagttgtgcttactttcaatatttacattgctctatcaacacttgcaatagcataattctatgatacaagcttaagttcagtgtcattcttgttcacaactataaccccagagtctagaacagtgcatggtacgtaaaaaagcactcatatagttttttttaatcttttaaaattattttaacagccttattttgagagagataacttttaaagaaaataaatgttccattatttttcattttcccataattaaataccaaggnaagtaatacatcactcctagacttatgggacccacactattacagncttcagagccttatactcagatttnaattaatttaacctaacctaatttntcaaatncctccccaatnttttgaaattaagtccaccnantggaaattctaaattgggaaaaaaatttttt

SEQ ID NO: 5921 - DNA, 823 bp, Homo sapiens
cgtgtgcgtggttctcggtactttgagcattgcacagaaagggatataacggggcgtaggaggccttcgggataatgggcggcggcctatccagggtttatatcaggccatagaagagcctatctcttgttaaagaggctaacagaataaccaccgctgtttgacgcaaacaaacgcgaacttcactctggggtgactctcaaaaaaacccaccctttttgggcgaaaaacacccatcctcctgtcaaacaccacacccatccttgggggtttagggaaacaaagccatccgtttttattggagaaacatggcgaccccttaacatgccggtgaccccgcggcgtccacaattaattcgaaaacctgggcacctggtgacaaatttttcccccggaaaagcgaaaaccacaacagagctttaggggaagccccctgccagagggacagacagcaaaaaaaccctcttgaggcgcggccttgggaaaaaccgcttttgtgacaaaaaaacccacaaggaccgggattaacaaaaggggggtcccttggtgaagaggcccctacaggggcggagcacttagggcgaatagaccaaaaacactggggcgagcgggaaaaaactgccgggtggcggcgcccctccccccgggaagaggacaagaaacccgcccccttttgggggaaaccaccttccccggaacgacctcaaaatcccccgtcaagtaaaagaaacgggccgaattaaaaaaccgggttgttttgtaagaaagttttaaacaaaaaaaaaatcttttgtttcagaaaaaccaataaggcggggggggg

SEQ ID NO: 5922 - DNA, 1411 bp, Homo sapiens
  misc_feature (1)...(1411): n = A,T,C or G
gggtgagtaaaaatacgngcgcaccattaaatatcgagaggcacggcgacaacttagcggggcagacgaaccgccctgaagaattggatcttgacacaagcacatacgggnanattatcatacacgcggagctgctatccgagttgcattttagtctggggcactatggagctctactcctacactataatgggaataccggcacagcatctgcgattttgtatacataaataatccataaacactcacttagcattgggcnaatgcaagtcatcttatatatgataatcgccctcgtcgttcaaattggcctagatattgtctcttatttacaactaaagtctgcgcgtagtatcacgctcaccaggcgtagtcgtcgcgatancatcgttgtttttagtatggaggactatacgcacgactgatcctctctctctttttgtcttgtatgtataacanaagagcaagatagacatcctgagggagntctcctattgttgcacctatcgtagaacgactccccctattattttttctgtcttgtgagagactcctcgcggtgacggcgaaactcaaatctggagtttgcgctgacgcccctctctgagagaaagagtctcttttaatctacttgacacaattgatctctggtggggttgttatatcttttgtttctttgcgcgcaaacaccacctgttcgngagtgatgaagcacatatgatggtgacttctttcattagtgataattagcctcgcgaggttgatacgacacggtggataagtgttacagtacgtataaagtgactctccnctccacattgtggatatcagttggtatgtatttagtgttactctacctcntctccgcgctgctggaaggggaagaaagtcgtgcgccancacagaagtcgtnggagaangcgttatgacccacagattagttgtcgttgagctcttcactcctagccgcatccgtctcttttgcttntctatgtatcactatagaacgtctttgtgncncgctgtgtacacatacagataaatattctcgtgtagacgtcttctcttcttatagtgcggcgcgtagagtagtcttactcgtatattcgtcaggagtaggtgttgctccacgtaatagacggatgagtcgcactggttgtgtgtggccgagtcctcgttatgccgtctgtcatcgcatctctctgagttgagatncncgcactaactntctcagagtacataccactagcgcagactacactcatacagcatatgtgttctatgtgagatattgtgatagataacacatcttactctctcttctattctctgtgtatatggntcgtgtctgtgctaataggagcgcgacacaatgcnatatatatnanctgtgatagctacgctttgttat

SEQ ID NO: 5923 - DNA, 721 bp, Homo sapiens
gtaagtacggtttgggtagaaaagtgggtcccaagttggaacaaatatagatccccacattctggattcctcggaatattattcttcgagagcgctctccctttgttttgtaaagggagaaaatttcaccccaagccaagaccgcttggacgaatttttaaggccaagaataggggccccggtgcccccgctggggccaactctcccttttctggaagggggcggggaaagagcagggggggccctcaagaacagaaaaagggggccctggaggaaggttttttctgtgccttgcgggggttaggccttacctccgcccttgcgcggggaggaacggccgctcagacataaacgatacttcctcgttgttggggagacccttatccagtgggtaaccccgggtggcgcgggtggtttggggtgccttcgccccaacttgaggagagaggtgtgaacacagaaggtggtgtttggaaatgatcgaaaaaatagacaacccgtggcagccctgttaggggcgaaggagctgttttttgagaggagagagagagagcgtgtgcgccgcgtggaggttgcctcaagataaaaacgtccgggctcgcgcgagcggaagagggttggggtccttgtgctttaaacaaggataggagagcgcggtggggcatagtagctagatgtatatgcctaccactttgtgcggtgggggatgtgtgtatatgag

SEQ ID NO: 5924 - DNA, 846 bp, Homo sapiens
  misc_feature (1)...(846): n = A,T,C or G
cgctcagagatgctcttagtgatcttgcattacactttctgaataaaatgaggatcatggtgattatggatattganagagaagatactgaattcatttgtgagacaattggaatcaagccagttgctcatattgacccatttactgctgacatgctgggttctgctgagttagctgaggatgtcaatttatatggttttgtgtaactgctcaagattacatgcttctgccagaccatggaatgatactaactattagttgttacgttgtataataaattaataattagaattatgcgtatctcttcatattcgtacgccttttctttttattctccgcattttaaaaatagtatgctttaatcacagatacgtcgtcatctccatactagattttaccctataattaatgaaatcttttgattaattatgcggagagcgtagcatcctccgtgccgtgcgtgtcttgtgccgatgcctatggaggtcattccctcccccgctacgctgatgacggccggccttgaattcccatatataataaataacataaactaggagggccggcggggcccnnnggngcacnaccctcgccggcatctattcggccgaaaggctattattntctaatatcacgagaaataactggcacgcccacctctttccttgttattaatacaagagatctttctactcactaatacccatcccttcattgcatataattacattactttccgcattaactatctgctacatcttcctacccatgaaaaccgtctattccacccacatattcacatattcgtagcctaatcgtttaattcttacgcaccgcccccacatt

SEQ ID NO: 5925 - DNA, 357 bp, Homo sapiens
  misc_feature (1)...(357): n = A,T,C or G
ctatttcaccagtgttctcccaatcgattggtcagtgcggcgcgagacgcgagnggaccttctcgggggtaacgacgcggtggnaagaatgtgtcgccacgacnaataacccgccntggggtcattaatcgcacagcacagatagacgtatctttcgcgacgttcgatttttgttgctttgagcgcgatcactggagcgcgcagggtcactcgtaattgaagatgtgtataacactggcgccgcgaattgtagttgtgtatgcgatcatacagacgtcagtcaccacaaacaacaattagtattcctacgcgacggatggatgagcgtgaccttttaatatgtaatacccacgcgta

SEQ ID NO: 5926 - DNA, 1038 bp, Homo sapiens
  misc_feature (1)...(1038): n = A,T,C or G
cgcccaaccccacgcacaaaaaccccccatnnaanncannngggaatgcccaatgaacggattaaaagtccctggggttgcctacgggatctttgagaccgggcaaatccagtgattaacccagggggggggggctcaccctaactaaagggaaaacacaaaatggggttttaccccaacctttttattcttttgcttcgagggaatctcttaaattagcgcgccccctaccccgccctgcggggtaagccattcttttggcgaccacaatggccgggtaacctcccacccgggggggtggttatacaactccgtaataaaacaaatcacctaaaataaacaatgacttttgtttaaacttcatgggtgcctataatttaatagggagaagccttagtaccacataaataacctcgagagaaccccccgctggattttttgcaccagagccggttattcgatcaacatttaagaaggcgagtttaccgcgccgtatcccccacaaaaaattgtaccaacacacccccgaccgggtggggtttgttcctttgttattcgggagacataccccaaaataacctattgaaccaacccaacggttgtggtttgttccaagatgtatttgaggctaacgaccaaaacaaccaggagagccccccgccggtgtcgttcatctccctggtgactcggtggacatacccagagcgatcacatagacaacacctgattgttctatgttttctctgaactcctcagaggatccgcaccgcaaatgcgccggagaccgccgccgcggtgtgtgcattatcgcttcataatgaacagcacctcaacaacacttattgaanaacctccggtgcgtgttctctagtgctggttgtaaagagagatatatagacacggaagtaccacccggnaggtttgttattctnttgcgaaatagagtatgcagaccataatagtacaaaatcaagagagcaccagagtgtgagacgctgtgccttcgtgagcccgccgatcacgaccgtcacacgctct

SEQ ID NO: 5927 - DNA, 750 bp, Homo sapiens
  misc_feature (1)...(750): n = A,T,C or G
attagcggtctggtgattaggatattgaaagagaagacattgaattcatttgtaagacaatttggaaccaatgccatgttgcttcatattagatcaactttacttgcgtgtaatgctaggtgttctgctgagttagcctgaggaggtcaatttatatggctctggctatttgctcaagattacatggctgtgccaacccttggaaaaactagttacaaattgttgttcagtggctctaacaaacttggtgattgtatatagttgatcgcttccattcatgacgctctattgttttatttgtcgtttaatgaaagataggattattactgtaggcggtgtatgtttctcgttcatgactatgtcctatcatcttctcatcagttaatactccttaatctgaatgtacgtctgcctgcgctccgtgcttttgccgatgctggggaggtcattccatctacactagctgaaaatggccggcctgaattccatttatacaataacagaactaagaagccggggtgcccagngagaacatactgccggcattattgtccgaaagtgttgtatcttcatctttttgatgaactgtctgcccaccctctctattttcattctcattttaaccttgtcgtatccacacattcgcctttgttgattctattatctatttacatccgtccttttcccacctacccacctatgttcgtcctttttttgtcgtaccatatctattttttataccgcttcatt

SEQ ID NO: 5928 - DNA, 830 bp, Homo sapiens
tagaacttttgcagcggagtgtagaggaggggggggggcctgcgggtgaaaaggccaaggaatttacgagagcagacctggggatctataaaagggggcgcatccagtgatttttcggggcttataagccaaccccaactaaagggaagccgccgcctgtgtttttatcacaacaaactctaacttaagctgaaacgtctctttatgtcccccacccctacaagttacgacagatactcctttatcggaccaagttaacatcctgatattgttttaggggccgcgtaaaattgtcacaaaccagctactctccagggtggaacacgaggatggcagaggaacaacccggactgccactatggatctagcttgcatggaccgaggctctaaagccgcccattttgtatttgagcacccctacagaccgtaagcacggatgagtggggacatggtctctcctgaaagacccgctgaccctgtccgcaggaggatgtgatctcggcgtacagacgattcgtagctcacagggccaatacccgtgataggaacgttcgtgtcaacctttttgtgatgactaggaacccattctgggaaaaacgatgtgctgccaaattcagggagtgctatttaaattgaaataccccccttgaagggtatggaaaaggcggcccttgtgttgtctggggaaaagaaagggtatctgttctatatttccggaaccgtgggtaccaaaaaaggcaaagagctaacttacaggtacctccccccatggacccgtcatatcggggaaccggtcaagcctgtttggaaaaataggaaccaagcccccc

SEQ ID NO: 5929 - DNA, 599 bp, Homo sapiens
aaggactatcactctcgactgcacgctggaaagcgatgtagctgactggcctatctcgacagttacttactgaaggacaggacttcgcgaggcttaatctcctgagaacttgatagagaacctttgacctagggtccttgaagagcacactttggacgacatgctaccgctggaattctgagaaggttaatcaaagatgctcgctcactgaccccatgctctatgtacgagcactgggacctagctgtgtaaggttgctcatggcagtgactacagtctgcacataatagctgcatactgtaagacacaagatgcggcacgagggcaggcaagagtcggatactcgaaaggatgcatggtactagctgttttctataggctacccctcccggctagcatgaccaattgcacacttagaggaaatgtggcaactcctattggacatttcgtaacaatccgttctcccctggaattccgtcgtgccctttagtgagggatattgacggttccggatccctgctcccttctctcttcggaagctggcgctactgataatcacactgaaggatgtaatctggagtcagaaatcgtggatatgg

SEQ ID NO: 5930 - DNA, 1816 bp, Homo sapiens
  misc_feature (1)...(1816): n = A,T,C or G
gctgatagtgacaatacatgaggagtatatagccgtgtgccctcggtctacgtgcgtgtctggcataagtcgtgcgagcgagtggtatgattgcggcgtctgtcggtcggattcaggagatctgatgaacccagtatggagtgcatgaggacacgtagagcgtatcgccgttgtactgcgccatgtatcgcgcgctgagcgacagtgcagagtcgccgagatgtgcgcgtcgccacatcgacaggacagtggagtcacctacggaggacctcatgagacaatcacatctaccacgtgcactgctacaagcctgaccgacggaatgagcacgtcgtcgcgtcgagatagaagatgtgtagcgatgacgtatgaaatgtggagtgtcagtgcagtagtacgtagtgatgatcctcacatctccacctgtctgcatgtgcagtacacggtatctcgacgactgctnagcaggtcctcacacatgcgnatcgaagcgtaagacgcagcatcagcacaccgacaagactcttnacttttcacgtncgacgtgtgtaatatacccgcacacngngtcgcacagnacgcgatcacgctngacgacgacgtcgaagcggcatgtagtgtacacttagcacgcgacggcgcggaatgaagccagcgaagncgacgcagnctatgccgtctgagtacatggagacgcgtgcttgacgacgcatagtgtgagtaagattgattaattcgacataaancgactattggtgtatagcgagagctcagagacacgcagactctcngatgtgtgctcggcatctcgcggacatctcacacggagagtgcactatcgcgtaacactactncgtaatactgnnacagctcatatntntcacctatgagtatctacgctnantctatgactgatctatcactgnancncagcgtgctagttaatgacgtagccatggatntncgcactcgacgacgatgatcatagctcactcgctgccatcgctctacgcaccggtgtatgtcatntaccaagtcngntncgacanctattatggtgtacgtcgcatcacgngcatgcactgccgagacagagnagtatgnctgactatctcgcancatctatgatcgcgnatacgcatgacgagtntgttctatgcgtgtgctccngacgtctaccacgtcacatatgcactnagtctgtgtcgatgtgtgtatgatgatctatacgtatacagtagcagtggattatgtgggncatgcgngtgtgtagatagcacgtcangtatactatgtggcacgatatcagagtacgatattctagtgtgtgtgtgatgctggtatagagtgtnagtgcgtgtnctgntagtgcttagaggttgacggatgncggttatacgtgtgcatagntntaatgcatgcacgacatagtattgnctggatagagtgancnacgctcntcgctgcgcgtatcgtatgtgatatgtgtntatgagctnaggagattaatgtatgataatctgattagtgtgtngtatgtagcactacaccatcacncatcctacntcacacgcatgctagtcttttattatacgatggnatgatgtgtgcgagtgatcatagaacgatcgangtgagagtcgctcagcgtcgagagatnagtatgtgcaggcacctctgcatcgacttcgtnccgtcatcgccnantcgcanctttctctagatcaagagactagtgtgacaggcgtgtgcacagatctacggacagtagagaatnattgncagcgangactcgnacacatgtgagtagagcgac

SEQ ID NO: 5931 - DNA, 1033 bp, Homo sapiens
  misc_feature (1)...(1033): n = A,T,C or G
gggaaagggaagaagggnggaagagaagaaaggaaggggaaagaggaagggagaaaggaatagaaaagaaaatttatgaaataacaaagaagaaaaattttaaagacaaaagccnagtgaagtgtgagttagtcttataatataataagatgaagaggaaaagatnaagtaagaggaagaaaagggnacatggagtatcatagctaagtttaattaagacaaaacacaaacaacaacaacaagagaaggacgacaatgtctgagggcgtcacgaacccagagggatggatcgcatgtagtaacagatatgtaggtccaacggggctgaatgccaagacatgttcgggatagnaagagatcacgaaagacacacgccgagtcagtaggaaaggtatggaagaggtttgtagctagagcaaccggcatgtttattaagcacagaggccccatcatactaaccgaatagagatagatgtagctcccgcgcatgaagcgatataagaaaagaatgagtggagcgctgaggagaccgacccaatttatagtaatgtcatataaaatagtatgatactattaaaaagtnctagagcaaatatggaaatagagaatnaacaagaacctagtgtgaggtatttcagactacgcggcccgcgacttctgcggcgcatgggagaattnnttaggtactgggtccgaagtaatgcctattttattaagtgntagaggaaaagagtgncaaaaaaaatgatgtnaccctgagtgcttaagagtacttcagaagccctctcttaggtctagtcanccacccacaacatcaaacagatccaagagcagcgttccccctttctcccagaaattgaactaagaccacagaagactagttgcctcaccaagacaggacactacctcaaacgagacataaccgaaagaaaactaattataccaaaatcccaaaaatagaagcacaagtgaagactatagcgagtagttatgcnncaatgggtaaagaggncaggatgaagacaagaacact

SEQ ID NO: 5932 - DNA, 978 bp, Homo sapiens
ggaaggagaagagagcgggaagcgcacgggagggaaagacctatcggcaagcactctcttatctaccaccgctacacgtgcctagaggaagtctctcatagatgctcactttctctcgacgggatattcggggaggacccctggctactgtcactgctgccatgcctgccaggaggaggcaccttcctgacactgcactggtgctgatcaccatgcctgccaagtggttctgctgtgttctaagagaaacaggaaaaacgcctctcccttttttttggactgtgctatgtcacccgggccctaaaacaccatgggctggccgtggctgccccaacggctcgctgtacctatctgagggctgggctaggagagactatgcacctacaccattgacattagcccgttaatcttgttagcatcctgcgcttacgtaagctgcatggctgcgagactgagcaacgggacacccggtgtcatgaagctcgctagcgaagccagacgctagagacagaccccgtccagagtgggtggtggcgggagacgacacggcgcgtttgataagatagagcaggccaggtggagaggtaaaccacccgggtcgcacaccaggccctcgcagagtcaagggtcactgcgtggcgcgcggggtgaagagggtgctgagagtgttaagttcgtgctggcgaggggtggaagtggaggacgcaggatagggcagagggagcgcaagagaggagaggggggggagcgcggctcaagagagggatagtcgtgctggaaagcagagaatgggtagtccagggtcgtagtaggtgtgcagtacgctgtgctacgcgactgtgtcacgtcgagctcagcgcagggacgcagcttcgtctcagtgcaaagcgctggggctggctcgagcaagccgcgcgcgacagagagataagtctaaggcagtcagcagggcaggaaggtgcagtagtgagagccgaa

SEQ ID NO: 5933 - DNA, 1316 bp, Homo sapiens
  misc_feature (1)...(1316): n = A,T,C or G
tcgtagttaagctgatacagcagtgtcggcagtatcaagatactcacaacgtacgccaacacgactaatttaatatgcgtattnatagcgtgctgatctcctcacgaaggtagtcattatgtacagcggttactattcgtnacttatctaatatcacttgagttcccatttacaagaatactaatgatcangtagtggtgtgagtcgatattacacataagnacctcatcagaatgcgctacctaatcagctcacacgcttataaggtgtcagatggatccactgtggttcacgacgcacatagtagcgtatcacacctgtagatctgatacatcgcgtcgtaaacaggatacacatgacaaccgtcgcatcaaagcactagaatgacagaagtagggaactgagtataagaaagtgggaagaagatagtaattgatatgacgcgagggcaggcccgtcagtagactaagaatacaacgaaaaattgtgtgtaacaaaattcaccaccatactaggatgtattgtattagacgtgtctctatatagcgcccgtctcgccgacatcccgcaggtgctgcagagcttcgcagagagagtgagcgcgagcgacggaacaagatcaactagccgcatgatgcgataccatatactcgtctctggatcatccacattagagtagagacgatatgagtacgccagcgagagcgtagtcgatgataaacacgcacgcacgctcgctccgactcacgtgatgctagaacgatgaatcatcgttctgcgcacggccgagcaccggtctacaactagataccctttatacgatattggtcgctgccctctcactctctactaagcgagtgagagtgacatcatgaatctgacaaatataaccacgcctctttcctatctttatgtcttatcggcctcttcgatgctgacaagtcgcgtatgagtttcaaacattatagctatgaactgagttaagatagtaagagacaatagttgaagataggaatagagagggacgtagtctatgtataatgcagtgagggagatagccagacagctgtcgcctctgtatgtaagcgtaatagaatagaatggtgagttgtgagttggtagagtaatcgcgtcgccgccggcacaatgatagccggcctctggtctacccacactactcctactcgttcatctacggatatagtctgtcccaaacgctaggagtggacacccgtaggtacgcaacgacatgcctaactcacaccctcccaatattgtcggttgaaggagcagagatttactaggcgcgacgctag

SEQ ID NO: 5934 - DNA, 1251 bp, Homo sapiens
aacgaaagaaaacaaaaaccaaaacagccccaaccaaaaaaaaacaaacaaaagaaaagccctgagaggggaaacaaaaggaaaaaacacctgcgagagaaaaaaacaccgaccagacgccggcggacaggccagccgcaccaccgccaacctctacaaaaggaacgccagagaagagcacacgaagagaagagagggagagaacgggcggcaacgaggagagcggaccccgcgccacggaggacggacgaaacgaacagagccggagagaaagagagaagcagcgggaacggaaaaccacgcgaggacgaccagcggccccacagaagagacgaggcaaggcgacagagaaggaaaaagaagaacgacgaagcgcgggcaacgggctcggggcggagaaaagcgcagcgcgcaccaaagacaacacgggaccaaaaacctgacacgaaccgcccgaacacgacagcacaggacaaagagagacaacaagaaggcaacacacaaacgccaaccgacggaaaccgaagagcaggaaccacacaacgacgaacgcaaaaggacgaagcgcgggcgacacgaacgatacgcggagaggaactaggcggatcgcacaaacaaacacggaagtggagaagcagaaggcgccgaacgcgacgcgggaagaaacaaacgacacgccaaagcgcaaaagcgcaaaagagaagaaaaccgcaccgccgcacccccagagcacggcgcgcgcccgataatacaccgcaaacggtcccccaacagacaaagacaacacaacccaccacacgcgacacccccacagaaccatgtatagaaaacacacaacacaaaaacaacaaacaaacgaacgatagccaaaggcccaaagaccacatacgcccgccacaccaaaggccggcggtagagaagcgcgaccagaagaacgccacgcgagcacccaaggcgcggagagaagaaaaggatgcgagcgagcaccgcgcacgcaacaagacagagcacccccacccacaccaccacaaacaacagcgccaacaacgacccaccgcgaaaacaaaccacacacaacgaaccgcagaacaacccgcgccaccccagatacctcaaagccaccgcacaaaccaagaacgcagcaacaactcgcgcacccacacaaagagagcgcgccgcgaaccggagaggaccagagacacacacgcagcgccagcggcacgcaacgccgcgcgcacgacgaaccacgat

SEQ ID NO: 5935 - DNA, 1470 bp, Homo sapiens
  misc_feature (1)...(1470): n = A,T,C or G
catgtaggaatagcattgantaagatacggaaggagcagtcggacgaagtaggcgacgcaagagagagaagatgacttgtggtgagcggtgcggttgtggtacgggacgtgtgtggggacgtacacgacgtcgcgttgaatagtcaaaatactaactaatagagtagcgngtggcggtcgcgtgcatgctgccctacgtggtgagcgccgcgcggngtgtcgcagtaatcgagcagagcgtatgagtgantgtangaagtagcaagagacgacagtaacagcgactacactcgaacattgcganagtgcagtgcatgtcataacgacagacaatcaactcgcatgcactaccacacactcgcgtcgacgagatgagtagaggacgacaatacaagtgactagagcataccagtatacataactagagtgtgtatagcggacgactctacttataataatactatcgatgtgcatagaccgtcgagtgctcatagaaacacttgctgctcgatccaccgatttggctgtcaggcgcgacatgcgccgctacatcgttcgaggatcgagctgtgtgccggtaccgtgaaggtgcgatagacagtcgtcgagtagaatgaatatatacacgcaccagagcagattattagtgtacgtactgagaacgatgcgaagggatgtgtagctagattaattagcactgttatntaataagagatagtcgcggcgtgctgtgtctgcgtgggacaagatcaggtgtagagaaaattatatctagttctcctgtcaccgacgtctgcgcacctctgaccagaacnantgattatatcggtggctcaacgacgatgatgatgcagcgcctcacttcggtgtacagggcgcacacggatcacatatngaggatgagtgacgcgaacaggagatcatgttcgcttgattgtatgagtgacgcgcggaactagtggtcggacgagatacgacanacgagcggnatgagaagtcgtaacggagctatggatgcaataatcgttctactagtctaatatcacttgcggaagcataacgcacgtagacactagcacagacgagtagcggcgtgtggcgcgccgcgacgcgctcgtagcgacgccgatacggcgcatgagtacgctctgaggtatatattgtgtcgacgagcgtacgacgggctgacgcgtggatgtcgcactgagtatagccgcgttgtaccacgatggcgcttatctgatcacttatgcggtaacacgaaagtcgctattagactgcacaaacgcacaaggaagaaaaggtccgccggcaagtgggcgatatgggcagctatcgcctcaaatcgtcatgaaggcacccgcttgnacataaagagtaaaggagaatactgctagagaacaggnacgtagggacagtcggattggtgtgacggcaaaccagagagaggcaacgcgagtagtgtgtgcc

SEQ ID NO: 5936 - DNA, 1555 bp, Homo sapiens
  misc_feature (1)...(1555): n = A,T,C or G
gggcgagacgcgaacatgaggcgaggcctccgagacgcgacgaaacaagaagaggagggaggaccgatcgtatgtgacacacagtaccacccaactgcgcagtatncagacgagnaataccgcaagaaggctccatgcagcgggngncaatgagagagaggcacnacacacacccacgaaagagaagagagcgcacgaagcagacaacaggacggacagcggagagaatgcacaaacgaacnatggtagagatgaagaaccgagagagcacaagagaggaaagaacagancgagtagggacaaggaggctcgaccaacgggagacggagaagacgaagcgccacgagagtaggagaagagaagagagagagcgacgaacgcgggaacgaagagagcggagacatgaggagcgcagagagcgccacgagaggcatagaggaggaccgaggcgaaggagcaggagagaagtcggataagggaggagcagacacgcgaggagagcaacgcgagcagggaagaagagagcgagcaggcgaaggagacgagagagcgggacacagacagaggttagcgagagagagagtagagagagagcaagagagacagtatagcgcgcgcacgacggttganacacagaggcagagggagcgcagcgcgtggagataagagagggaggaagccgaggagagagcagtgaagagtgacgatgacagagaacgacgcaggagagatagactatacgaggagtcagcgaagagcgaaggactgcaagcagcaagataggacgacgaacgagaggcaacagtcaacgcatagcatcgacacgacacgacggcgcgagcggagcaatcatggagaggagtgaagcagagcagcaggcggagaggaagcacagagcgagaggcaaccagagagaataganagagatgcagagagcagcgcgacgggngngncagcaccgagaanacagtgtcngtgacgnagctacagngcagtcgacgagaggaacagaggagagacgaanatatagcaacggtgatcgggagggcagtaggacggtccaagaccaccagcacaccagacggctcgcgagcgaagagcgggaaagagtacagaatacgaagcgagatcagagagagagaggcaggggagactaagaagacgcgtgaggacgtggagcagatggagcgaggggagaggagagacgcgcacgcgaagtagcgagagacgacgcgagagagcgacaggancgtgtagcgcagcagacggacataagnagcgacagatcgaaagtacaantgaggcagagagcgcacgagcgcgaggacatgtcgagagacagggaagacagaggncgcgcgcggacgagagagcggagatagcagagacacagaacagagctaagagcagaaatagcgcgcgcacggaggacgacgaagcgagaatacggaangagnagagagagntgantaccagataatacagagaagcagggagggaagcagcggatcagatagaagagggcgagacgaagaggagagacagacaagtgagg

SEQ ID NO: 5937 - DNA, 339 bp, Homo sapiens
tactataaaactgaagacatgtcaatctgctcatgtaaatcttccactcagtaaccttttgtgtgcagcatttattgaggctgatggcaaaaattgaaaccaacatcatggtattctgaagaccagagatatgaatctccctcatttgacatcctactgggcctgaatctgtttcactgctaaagctctgctgccaaacctatgcaagctgcctccctctaggcccaggggctatcatggaagaggtgggcacaaaagattttaagggctggtttcaagggataaaatcaggtcaacattaaaccctctgaatcaagaaagggatacaataaatactga

SEQ ID NO: 5938 - DNA, 1289 bp, Homo sapiens
  misc_feature (1)...(1289): n = A,T,C or G
tggataaggtatagagtagaatggagatatattatatatagacggnnagttaagacatagacttagcagattgtagnnataggggcttttagttaggtcccgttatacagtacgtctcgtntcattggtcagaccctnaatggcaagtaattatattaatnactaataatgaaagtttaactgtataagtgtntcanggagtnnaaagcgtggtaagcgtattcaagcttncacaccgtagtatactcgcagtcgccgcgcgcgncacactacgtgacgacgctctgcacgctcgctctcctcactcaggtgcagagcgcncagagaggagcccacaactctcgcacgcagcacacacaangagatgatgcgtcacggtctttacgtgtcatgttctcgtctcgttacatcgccatgtaccctcgctttgctntatgtatccacgacgagagtnatagcactaccgcagttgcgatatatgattagtgtgtgagganaagccatanntgcaagtaagcgtatatagcatangatgataagcacaccgtattatatattagtacgtcctcttcccgcgctccggatacgcgtcgcgacggcagagtgcgacgcgctggcnaaccgctatacgagacatacactcctcacaacactatacataaaccacatcccacaccgcactcagcgcccccgncgacgtacagncgcagtacggtgtacggcgattggtctacaagagttcnntctataaatagnacagattagtcgtcgtgtnncngcaggtcggttccatatcagatttatatgctnntaagtcagccgcgccgccactctctccttncgctcctattgttcgtgtatgttcnntacggagccacagcgctctctacatgacccatcacataatagtctcatatactactgttgcaggagtgggntncatacgtgtgcgccgatatgatagcatcactcgtcacacgcctcctctatagtctcacccccgccccgccacaatgacttctctacgtcatcacctcgtatctagtcgctatagtttatagatgtttttcgtgtagctcccacttgtcactgcctaccagctgctgctctcgtcctgttctcacttcatacaggaggttacctcgcctctgaagaataacagacgcgctcctgttcaccacccatatcctctcgagtggtacatatctgagcaggtncttcgcgtgtggcctcccaccgtccaaccggcncctcaggtatgacgatgcccgtggtgcgacnaagcacgt

SEQ ID NO: 5939 - DNA, 1055 bp, Homo sapiens
  misc_feature (1)...(1055): n = A,T,C or G
aagtggggagttagtgtngtggatgtngtgnaggggnnngtgttttgnttatgtgtgtaaggatggtgagttagtgtgttgttgttttttttagtgtgttattntattattaatgattattagtaagttaattattttatattattaaagtatttttntttgactatggactaggttatgatacctgatgtacatganggnnagtgggagaggggtggagtgagtggggcgggnatgtagggggggtgnaggaggctggcnngctatttgatattcttttttaatataaattncaatcattntatatgaggttttcggtggtcgatggggtgaannaggtttgtgttcattgaaccaaantgggcaagagcaaggcagtataagtnncacccgacgggccgaggagctgttgtggtcactgcaagagaaataagctgacgaaggcacgcgcgcgggcggcnatctgtagtcggcgcgaaccgnntcggcagaggcgggggcgtagaatgaaaacaaaacacatttacgagttcctcgcagcttcttctcttcattgtacattcttcacctccctctactgctctttctttatttttttttctcatctcagttagcggcaggagttcgagggccaagaggtcgatctttgcgcgtntgtatgtgnaagtatatgnatgcagtgttttntgttttgacttctgctgatttgttcgctattctgattttattatcgtctcgtatgtncaccctgtcagtccaccacgcctcatctactcatcaatcgctatagttaatgcgcagcccacactagtgcccgcgttcatcctcaccccaccacatcaatcaattatctcctcgatcgcctcnagcaccatgtccggtttagttcggttgtctttgcgacttttcttgcgatccgtagttttagaagtgtatatccttacatatactattgtgagttttctatgtatgtctcctcttcgcgcacgtacgtccacgtgatgaaggtcccgcccgcacccaggcacgtggcttgtctcccccatgtgatggcg

SEQ ID NO: 5940 - DNA, 192 bp, Homo sapiens
ctactgagggtagacagcagctctgctccacgtatcttcattccaggaacccagaatgaaggagtggcccttaatggaacactgctggtatcactgcaaagggaaaagagaaatggaaccacctaacagctcttaaagtttctggtcataaaagccaaataaatttttcattaacatttaaaaaaaaaaaaa

SEQ ID NO: 5941 - DNA, 1172 bp, Homo sapiens
  misc_feature (1)...(1172): n = A,T,C or G
attaaagaaaattantttnaattagttagtgtaattaataatattaattaaggattaaagttggataatgtgatttttttattaaactnttagtcattttattattcattatagtanaatgaaaagaaatttttgtaagttttttttatttaatatntaatattaaaatatttnaaagaagaaattttaatattgnnctcatatttccgaaatatcacaagnnnccactgttccactcaattgtcctcggcgagagagcgcaccgnccataatatataagattatcaataaatagacaaacgtatttatgttctattngtaatttagtttcacggtccttatttttagtttcatttctttaattcgnagaacgaatnccatacactgcatgaactgacctctatagaccataagtacaccaaccacactacacaaagccattcgcgtttccatctcatcaatttgttttattttactacatctctctcttctgttctcttacccatatatgtctcaatagcaatnnaccgataactcattatatgtcncattatatatatatgattttccttttattctacctcactctatatactttatagtcatatgactagagagaataatanataagttatgggtaataaataattaataatattattaaaaaagtnaagatattttatatataggtgtcatagtnatatttatcacagtcntaatattaccttcaatcccatattatatttatgttnctatttatttaataattacaatatttactcaaaaattatgtagattnaaagatgtgtaagtagtntnaaattaatatttcatactaataaatcaatattacaactgtttcataatattcctccattatctataatattattctcactccactatatattcattaacttctcaccgtagtctaacatcacctccatctaacttacatcactcttatagatcacctcaatcttattctataaactgcttataatatagaaaataatccgcgaatagtattaatattatatactacnttccctctagtatctacccaatatgtcttataccgtagaaagtnctccaatcactaattatcaatctcgaatgtataattncgtatgataagcagtatataactaatatatttcaccataaaaggt

SEQ ID NO: 5942 - DNA, 1840 bp, Homo sapiens
  misc_feature (1)...(1840): n = A,T,C or G
cgcgcatantatatgccgcttactataagtgntagacgtncngaggtcgcgacgtcgcgctnacgacantatctcgtcgagantgacgcgaaactcttgtgatnctacatgattcgcgctgtagtatcaaacatgtatatatgcgtatcanacgangnagtctancacgtnccagtctctgtctccggctagaatacagangaggtgggcatnntagatgtgtagtngttgcgtntgtattatcgcggacgtgctcgcgcgacgcgcacgcntgctccataccgcgcaagtttantntnctcgactacttgcgtatctgcgcgtgtcatnatatcantcagcgccggtgcacaagatcatggcgctgcgacgtacacataccatcatcatcntcgcgcgtgctacgattatatatagcgatatcgagtccnccgaactatcatntatagtgcggcgcgcgcacgtaacagcagtcatcacatcgantcgcgagngtgtgtgaacatgtcatgactctcctgcgctatntagctgcgngtgacgcgnacgatatatgaactcgctgcacgtataacactgtatagtagcggtatcggcgctaacaatcatattctactcagttagtgcatagtctgcagagtagcgctattacatcgatcgcaatgtcgtatctcacatagcgtgcacccttatctacccgcgtataatatctgcgcgcgctacaacagaagcgagttcatactcgtatatggtggcgtatgtacgagatacatcgccgataaggcgcgccctccgtgaaatattatcgcgcgcgcgcgcgtcgcgcgtcttatcgntatctgcgaatgtctacaacancgatagagacgcgcattatgtaaaatgacggctgctatagacagtacgcgcgagcgtgcgctctcaagatngtgtataacnatcacactgtacggaatacantatagatggcatgctctatgtcgcgcgtattagatcgngtcgtgcggangncagtcgagtacacatctcagcaggctgtcgcgtgtgatatcactcaatgcagacgtacacangatggctgagtcgagtacgttgcgacgattctcacgcgcgccacgnacgcgtacaccattcgcgcgtatatcatatggccatgtacgtatcgccgcgntcgcagcatcgtcaatatgactaggcgcgattctacacactatncnggatatangtantggcantaacgcgtatccatctacgtgcgatgtcgcacnttcgtcactacacgctntacatgatactgcgtatcgcgcgccagcagatatatataaacataaacacataaatagccgcagtccgattcgattcattggattattgtatagtcgagttanaaggtatattagtacgntagtaangtagatagctagcagcgggtgagataattcgatgcgcgtccgcggcattcgcatgtctagtatgatgggcncactatatacgtattgtagtacagattgcgcggccgcgtcatctcgcgaacattgcgagtgcgacatatactgacgcaatgtcatatccggcatatctgcgtgatcactatcatcatactgcgcagcgaagtacaataaatantatgtcaggctccgtaatcgcgatccactattccgtacggtcgttggagagattaatgtctgtgtgcgttattgtaatatgagtgagcaaataaggtgacggccgacctacattatataatccgcgcgcgaacaaatacgcgataaccgattattacaacatatcgtcgtggtagatatcagtagaattatcctgatctggcgccggatatctg

SEQ ID NO: 5943 - DNA, 1262 bp, Homo sapiens
  misc_feature (1)...(1262): n = A,T,C or G
ctcatatatccgagtatatacaatatatatgcagagcgtactccagtgngctctccggcatgactagaagaaacgacactttctgattgatgtcaggtacatgtctctctctcgttcgtcgcgacancatcgcatgtcgtggcctcaatataatcgcgatctaggacgcttgtgctctcgcgcgcggagcacctgagcaactaagacatcctactgctcgcgtccctgtgcgttgtaattgcatatttgtgtggcatactacacattcacatgatatctcgatcgtagcgctactccggcagactgcactgctgtcgtcgttcgggtgtgagtgtgagtctgctagtacatacacagcgttctatttgtatttactagatatctgtctatcttatccatagctagaagatctcgacttgacaccccctctcctaccgtctacatactcacacaagtgacgataacgctgaacagcacttcgatagcctgtctgtgtgtacagtctatntgctctatgctgtctctgtcaacataattactgtacataacatctcattgatcactgccgttactagtgcgcaacactccacacgctagagtgtatgcttgtgtttcgtcgtcctgccagtgtgggcgtagtagcacgcaccattacgtcctcccttcggacaacggtcgtatgtgcatcgattggtgttatgatatgtctgatgagtgcgttggtcagtcggtaacacatcacacactggcatcgntcagtcgaacaacagcttacacatcacagtgttataggaggcaatcacatgactggtcgcgatctcgatctttgctatcgcacctggggtcgagtcagctgatctaatacgattcttgagttcgttctatgtcagcactacatatatctcagacataggaagtaatacatcgtggagtgagcggcgtgatctgagtatgtactactatgtcggagcatagtatcggtaggcggtggtgtgagttgtaactttataatatcgatcgtgcgcgagaccacnatcgtcgcatacttagtgttcgcgatgtgcgtcgggtgttcgctgtcgccacggaacgcaccaacaccactatctcacacgctctgctcgcgtcctactcgtcggtcaccactagagcgcgtagcagtacgtgactactcgtgacattccagaggcacgccnacgtgcgcagcgacccgcggcgcgtcacacacacacaagcgcacacaccctccacacgagcgtagg

SEQ ID NO: 5944 - DNA, 1159 bp, Homo sapiens
  misc_feature (1)...(1159): n = A,T,C or G
cgggcaactacacttactctaataccgcagcgttgcgagcaccttggaaccctgcactctgaatcccagcttcggtaatttgcttaacttaacctcatttcttacatgtagtctgcacgcacacgaaccctttcgtctcggagatcgagtcacagaggcacgacacgtagttgctgtatgaactcaacaggggcggtggatactactaatcctccttatataaggtagggggcgggtaccatccggacctcccttgcagtcactcatatgaccactgatcttggtgngctcctatcatactttgctagtacttcgtcttagtggtgctctcaatacaccaactggttgcacatggtccaggtgttatntagttttggcccagcgcgagcactaaaagtgtaataagagggcgtgaacacaatcgggacgtgggtgtaaatatacggtggcacattgcgtcggagattggggcggccaaagcaatctggagccagtaggatcttagactaatacgagtncgcagtcaggagtgtcgcatccgccttggaaggatgtgaaaaacataaataatatggagtgttgggggtcgtggtggaagaggaacaagggagtatgagtagtggttggctatctttgacacaaccgcagcacacacatcccacagcccgcgggccccgcgggaaaccaatgtggtcacacagtggtgaaatcaaatctcggtcgagggcttatcccaaccggctcgctgccggccatctaactgatctggtggcgtctacactggcgcgaggttagtgtcatgcaagtggggaacacaacactcggatgcggtaatcagggagatcactcatgccttctactcggggagaacaggtaggcctcgccggcctccggctacctactatccccaataacctactaacaacgacaaacagggtcgcaatgaggatggaagcgagtgcaaatggcgaaatagggcggacgggcagaggggaacaaccctaatacgggcggggtgaattatcaacagtggggtagtgggatgtggcgggggcaggcacgcggaaaagcaacacttggcgtgacacccggggcgggtgtcggcgttggtcgcgagcattgctcctgggcggtggtatgggtagtaaccccatcgcgg

SEQ ID NO: 5945 - DNA, 808 bp, Homo sapiens
aagcaagtcaaaatgtctagcccacaaccaaaagagaagagtttataggagtgtgatatcaggagacagaaatcattgtagccattttagagactgcctaacacatgctccaaatgaaaattacaccttcaagatgcctagggtaaaatagagcttttgtctcgaaggaggccaaggtgtaactttcttcggtcgtcctgaatgcaggttcatctgacaccagcggcctccaccatgccaccgaagttcgaccccagcaagattaaagtcgtatgcctgacgtgcaccagggataaatgtggtgccatgtctgggctgacactcaagattggccatcctgggtctgtgtccaaaaaactttggtatgacattgccaaggcaatcggtgactggaaggatctgaggattacagtgaaactgaccattcgggacacacagaccccgaatgaggtgggaccttcttccactggcattattattaaaggccctaagggacccccaaagaattaaataaaccgtaatagcccttacccacggggaaattttccttttgatgagaattgcccactttgcgtggcacaatgtggcacttgatcttccgccaaatatctttccggaaacattaaaaagcatcctgggaccttttaattttatgggcttgtgatattgagggcccgcccccttgtgacattctatattaatgcgagaaggtggggcggggtatatagcaacctttctcccagagcctcaaagatatatttgtacattaggggtccttttcaaattataattaaaacgctccccttcg

SEQ ID NO: 5946 - DNA, 785 bp, Homo sapiens
  misc_feature (1)...(785): n = A,T,C or G
aaaaaaacagtcacgggaattattcatgttgatcagaaattggccagagatatattgttgtcaaattgggacgcttcatgaatagactcagcactaaaattgagattaaactagaagacttttttcacagttgacccttgaacaggacaacagggctgcggttgtgcacttctatgtggattctggccaacaaagcaccggtgggaaataccgcttttacaagatgaaaaaccccgggtcacaagaggtctatttttggtataacaccagttacccaaggctaactggggcattttgggataaaatttggggaaaccttgatattctttgtaggaggatcctttttaaggaaaaaacaaatgttggggaaccactttgtttctgtccccttgaagtttgtttttttatgaatagggttaatataaatgccggtgccgcccatctcctttgttggagagtaaatcatgataccctccgccatgctccgcgtggctaggacgtgtggcggagggggacgtttttatttcgtcgaggcgatatttcagtactttccggactgttgtttttgatgggttgtatatgttttttcccgcgtcttttattatccccccacctaaagtggcgggttgcttttgtctttttatcatgccctgtgcggtctgagcgacagaggagatatgtgtggtggatganatgggaagttggcccggaataataatctatcgcccggcgcgcgcctgaaaaaacactgtgaaagatattgtatgcgaggggcgtcccgacct

SEQ ID NO: 5947 - DNA, 798 bp, Homo sapiens
gatgctgctgtgtctgaaactggccagtgaaacccacaaatctattcaccagcaccacacctggctagggacgctccgagagccgggctccttgctggtctcctgaggctgaggttcccacacacatgctcagtacaacctggccgtgttccttcatctcccaagtggatgaatgaagctctcctcacaagcatgcacaacgggtggacgccaaagcttcccacagaacacagaacctggctataaggctccatcaaaacgggaggtttctctttctctccaactgacccactgaaaggttcagagacacggggagaccaaaaccctaaaacaatgagggctatctttaacatccccacctaacaactcttatttattaagcacttgggatgtgtaaaacttggccaagaatttttcccttcatttccttgccggaatcggcaacactatataagaagccctgttatccttggaaagcaaatacccccgacgtgtccagcctgaggcgtggcaagcgcaaaattttcgtttaactatcctggggtgaacagtaggagtaccccctctttttgttgtaaccaacaaaatttatgaatttccccccccctaatcttttctcccgctattatttgagggatcttctattatatttttttccccgaccccccgagagctagattctctttaatgatgctcgtggttcaccccttccaagaccgctatattaaactttccccgccgacccccggtagagaacgagtgctcgtggttttagataagcacgcacccccgccctcg

SEQ ID NO: 5948 - DNA, 807 bp, Homo sapiens
tagccttagtggatactgagctaaaatgcccatcatttagacagacttactttcaaatcctggctctgttgctttctatctgtgtgaccttagacaggtcattctcactctctgggcctcaaatttttcacctctaaaatgggatgggtgacctcctcatggggaaaatgggataactaaataaagtaatgcatgtgaagaggctggcagggcacacaaaacatgtgctcaatgaaactggctttccttcatatacacctttcaaaacaccccctccatgaggtgttgtttctaactcctggcctggctacttttttttgggggccctcttacagccaaatgtaccacttgccctcttcttaaccctaaaaaatgatattctttctttttcttcctcaaccctaatccaatttctttttcttgatgtgagacaaccaaaactaagtttattggatatgtaagcctcgttgcccggcggagataaatatacaaaaagaactaacatcctaacctatttctacacctggccgttgataaacaaaactatgccggcggatgtaaataagattcccgtttcacatgcaaataacacccgcgcgattataaatacaccccccacatatgttatccgaatacgcagaatttctatttctcgcgtcatagactcgtgggagccggacgtcaaagatgtatccgagaccgatgccaacactcttagtcacgtaaatatcgaccaacgcccaccgccgcgcaaataaaaattcgtcgtcgagacttatttgtggtcgggattctcccccctcatcg

SEQ ID NO: 5949 - DNA, 796 bp, Homo sapiens
ctgatcaaccttgccatgtactgtgagaggataaggaggaaattttggccagagtggcaccaccatgatgacactaccatctatgagtctgaggagagcagcgaaggccccacacccacaccccggtgatggattttatctttcactcccggatatggacccttgaaaatgaagagagcataatacatgttgttacagaggccaagaaacatatattattgggcccttagttgtttatatgcgatacgagttgtggtgactcttcatacaccgaccaagggttgccgctcacgccgtgacaaaatctcaggactttgatagctagaatcaaagatagtatataatgaggggatagtttgtaggtgtgcgtaccggcttctcactgtggatttagagcagacattgatgtaattaacgatagtgatagtgtcaatagcgataatatgcgcaggaccatattattgtaagagccacgctcggcacgcgtaagctgaatccgtcgactccattcctcgtcagtgtagtgtagcgctggtggcaagaattgaaagtactatgcgcgaaacgatggaaacatcccctagactgacgataaatcccccgcgattttatattcctccccgcatcgtaatgccccgaggtaaacgtagcggatccttgcaaacgcgacgggtgcaagtagacagagatgatgaacaaggagaggagcacacttgcgtccgttatgtctcgtacgcgacagagcacaataggtgatccgatggatatcatttataatgcgagtccctcgcacacc

SEQ ID NO: 5950 - DNA, 1511 bp, Homo sapiens
  misc_feature (1)...(1511): n = A,T,C or G
catgcatataactgcgcgctgatgccgtgatcacgacagagagagagagacgaaggtnnnttttgagagccgaagaggagcagaggagagcagaagagagaggntnnntttaagagggcgcacacgaactgcgcaccactacaacatcagacgagnagnagcgganagaggagcagagcggctggcgaggacgnaatatgtatatagaagaggacggcgtagtgtactgatatgcggtcgtcgggatacgcgttccgttgccagtctgcgtacagtgttcgattccaatcggcatccgcgttgtgttgaggtgcgccgatccatatacgtcgtcntgcacaatactcacggtcctattcgcacagttcgaagactctgcgctcgagcctgtcgccgcgtcgtccttcccttnacgttagatacgagcgcatacatatatcgtacatcgtgcgcagcggagataaggagngatacgacagacgacggctgtgcacaccacagcnatgataaggcacacacgcagccgctatggatcggagaggcagagggagaggaagaggatagaactgaccttcttccattattagaaccatagaggttcgcggtggagtttgcgttggccgggcggccgcagcggacggcgggcaagaatcacttattaaaacaggatgaagttgagtcaggggcataggtcgcttaagtcgttcgacggctggagagtaatatacaacaaatcacgcaccaggaccagacggtcatagctatcatcatatacgtgtttcgcagtcaacgcttggtttgaggacgtaggattgaagggatgtcgtcttatacgtaccgctctttcgcgttaccgctcgaccggtcacagacaatcgtcgcggctcagtcgtgttatttgggtcgntggccgcgcgcgcagtgacgatatttcgcttatacgttgcgcgtcaagttcaccccgaccggacgcgtgtgtgacaagcggaattgagcgcgaatcacgcacaacccgttggcagcgttttgcagccgtcgcgcccgagccccgnaacacctgttatgcccggcttagccagcttgtccgcccacgcgcgatttcccaaagaaatatggatatggcacattcacgtggaattgactgaggtagtgcggtgaacgccggtttngtgcaccgcattagcgagtagagaagaaagtcgcgatgggcgtattagaaggtcaccagttatattgcggtcgatcggggcgccgtgcgccggttatgaccagtgaagttggacgggtccccagggctatgttcggaatatggcgtcgttgtagtcggtagatgttcagatctcacagatatgtattcacggccacgcgtacgaattcgcggcgagttccggcgactgtattggttctggantggtcttagctcgaccnccgtttagcgcaaccggtatatgccatgcgcncggccgcaagtgcgtgaatgtcgactactgagtatgttgacgaattgtact

SEQ ID NO: 5951 - DNA, 1331 bp, Homo sapiens
  misc_feature (1)...(1331): n = A,T,C or G
ccttgcgtcacgcgtgttctagccagctaccaccagctcctttcccgaattcgtcgcactatcctgcgacgtaggacgcaattcaacagtcaccggctgcgtttaacggtgccgaatcgtatgtgcgcgcgctgcccaaggtacaacgcggtgtcagcaaccgtgtgctgagcgcgagggcacaatcattactatgctgcctatacaatggatcaagttcgtatattcgttgtgcatctcgttatatgagactgggttgtgactatctttctcatgtcgcactgtgtcgctancttagctttacagtggggcaactgtgcgcaccgttactgctcgcgttgctatggtccgcccttcgacaggtattgttatagcatccagctgcacgtctcgacatcgtggttgaatttcttgggacacagtctgtgtcataaatgatgcgatgtgtctgtgtacgtatgaatcagtaggcttgcgcatctcacggctgcctcacgagtggacatattgcaatgtcactaggtcgctgtataactccaacctccacggatttggctaatactctgatgtgcctgcgtgctgtatcagggcgcgtgaatactagtgataggcggggaacatccgcatctggtctggtgtcggtgacgggactgtttccattttatgtcgtcctctcttgctgggttggcgtgcgtagcctacttatccattttgaggaagcacctctgctacgctgacttaggtatcctgcgcgtgcaggtacgtgattggtgttgcggctctgtcgcgaatatgcgtgggtgtgtggactgctcatgtagcgccacctagcggtagcgtcggctctgccatcatttctgacggatgtcgcaccccactctagtcctcacggcgttcaagtaccagcgcgttcgagttagccgaatcctgtgagttgcctccagttatctgcaggtgctcccgcgtgcgacaccggtctcacgggtcgccctccgcccatgatgtcgcacgttcatgtcgtcacggtctctgcccttcatacggtcatcatagtgcattcatttgcgtacttctctgactcgttacaccgtctgagagtcgctgcgagtcacatgacactgctacattctgtcgcgccgtcttgctctcttatatcactcgatacacgtagcgatggttttcgcactggagatgcgaagtttacacgccctctgcgggctgtctcgtccgcctacaaaacttctcgtatgatggatgggtgacttaaaagagaggccaccccgttccgttgggaaatccggtgcgggctgcgtgtncgagagtgtcgttcg

SEQ ID NO: 5952 - DNA, 798 bp, Homo sapiens
agttcatacttaaggagttcaatctgaatgaacccaggagagggcaagggatagtcatttgcactcggttttcagaagctataagtgaatactatcaaaaggcgatccctatgacttggtcattactgaaaaggcaacaaaattgaagactgtcttctcataattaggggttgctcactgcaattatccagtttgaagaatgtggattaaataaattaagctgatatctttacttcaggacgtctcaggacctttactttggtaaagtgatgctccaaagaggattgaagcctgaacttatttcttcccagtgtttaacctgagagaacatgttaatttattgctcaaggaagggcaactacaaaggaccttaaaaaaaaccattttctgttttgttattaaaagctgccaagttgatacaccctttaaattggggcctatcctccaacccaagtctgtttgggaacaaaaagtttatctgggccaaatcttttcacattctggattgaggggggaagaaaaataatattcaaccgtgctgagggcgcccgccacgaagctcccaggtgcctagaaaaaaacttccaatctggcctactgccgtataattatggacccccccactatacccccctggggggagagggctttaaaaacggcaaaagtcgtccggaccacctgcccgtagaacatcatttcaaaacccacctaattggctcggaataaactaaaagcaacagagatggggggtttagatatcatcacccccctatttaattgcgggtcccagccccaccg

SEQ ID NO: 5953 - DNA, 625 bp, Homo sapiens
catagctgcaacgactctcttaacatccaccgctacagtgacagaaacccaactgtgggagacatgctgatcaccaccaagtattcgagctctctacctcctgggcacatggctgaactgcacttgcaggcaacaaggcatttggccaaccaaggaaaacagcaacgcaacccatggaagagtaaagagactgagactcatctgttgtaccagcacttggagtcacactaagaaatcatcacactcggcactggagaagctctgcttgtcttgtggattcttggccctgaggccagacagggacagaagctgtcctttaacttgtcttcctcctgtaggaattccaactccagcttatccctcttcagggaaaaagcagagaaaatgaaataaactaaatggctgacaggattggctaagagaagaggaagtgggatgagggtctgtggatagtgatggacctcaaaacattctcacgtgaaggtttttctccctgtcacaaatgctgacggacatcagacatggccttcccatttaggtgaggctcttccccttatatcttatcaggaaatgcacgtgggatggcacaaacctgaaaaaaaaaatcacatcaaaaaaaaaaaaa

SEQ ID NO: 5954 - DNA, 824 bp, Homo sapiens
cctagctgcaacgactctcttaatcttccaccgctacacgtttgcaggaagggacctcctgggaggtgactggttcatggatgtggttccccaaagctgttctcatgatagtgagttctcacgaggtctgatggttttccaaggggctcttcctccatcactgtgcacttctcactctgactgccttgggaaggatgtctttgcttcaccttcttccatgattagtcttgctctgtctccaggctggagttcagtggcgtgatctcggctcactgcaacctccacctcccaggttcaagcaattctcctgtctcaacctcctgaatagctgggactacaggtgtgccccaccacacccagcttatttttgtatttttagaagaaacagggtttccccatgttggccaggatgggctggacctcttgacccttcgaactcccccccttaaactccccaaatgcttggattacaggcgtgaaccgcccgttcccacttttttttttattattttaggggggcaaaaaccacgcagttctgcgcccgcttaaaaaaataggagctcattgcaaatttattacgagattcacaccctcttttatggttggccccgtgtccccgctttgctccgcgggagggtttcaccaccgacccttcgttgccggctgcgcggtgcgggggtcgcgcccgtgtgcggacgggtctctctcctctcaggaccgtgttctcatcgtcccccaatactaccgggttgttcgagacatccccgctccgccctcgtcattttcagtcgcgaaccttgacggcgcgtcgtcccccccgtcct

SEQ ID NO: 5955 - DNA, 748 bp, Homo sapiens
ctccttttcctactgtggcattctgttatctgaagtcaaacgtacctgaatgtgtcctattgtgttactcaactcacttctgaatatggttctgttttgcataccaccaacccacataaccatttctgaatctcttgtttcacactgctccagtgacaacttgattcacaggccgaactagtgagaattgcggcgagcagtaagaagcagcgtgtggaaaagggagacgattgttcatcaacctggaggttggaccaagaaaaaaacctaaaagatgacatgttcccgtagacttgttctatgtgtggccctgaactgacatatagaaaatgtgattttttaagttaatgacctgttttataaaattttataatctaaaaaaaggaaatttaaattgggccttttagaaaataaaaaaaaaagcgccatcttcataaatgaatggaacccttgttaaaaaatactaaagtataattattattgtttggcttaaaccaagtttcagtcaaagccccctggccggctgtgtccaacatggcattttttgatcccttcttaaaaaaaaaagcgaacaattgttaagtacggtataaaaggtgaagtactaaaaattttaaggccctagacccggttacgcctgaaaggggagaaaggaaaagctcaaacacagaggtcgatttattccaacaacccacgggatgcccgatcgatatcttcgatcgcctcggtcgtctgtgcgctgccctcc

SEQ ID NO: 5956 - DNA, 875 bp, Homo sapiens
  misc_feature (1)...(875): n = A,T,C or G
agtaatttctagcaaccagctgaaagaggaaaagaaaaggaactagctggngatcgactctcttaatctttccccgctacacgtttccaagatcaagaaaatagagccctggcagatttatacttgaggttcttgaccccagtgcagagatccgcaaaggtacactgcttgacctcccctgcttgaatttccaggggtcaatcttgagacaaaccaaggatggagactgagcttccaaatcccacagattacctcaaggcagttggtcaacaactatatctctttggtgagaggatgccagtccatgctccaaatggaccacggctcaagatagcaactggaacaagacacacagaccttgtgctcaacactcctcctgcatgcctcccattgtatcttccgttttcaaagcccctcctccaaacctaaagttcgaagtcattttatggagttggaaactggctgcttccccactgttaactttggaaatgaaaccatttttccttttgttgtactccatccttgttattggctacaagcaacgtacagccaaacttcgggctagctacactttttgcatggtaataacatgaacggaaattgttcatacaatagaatgaccattattgtgagcaccacaacctatgctgggtattaacattccttaggtcattgacactcgtacagattaccaccccgttatcaaatccgccgaaacgtttatactattgcgccggaatgacctcttgaacttaaatcctcgggcatcattttctttttatagaggtttattgttgtatttaagctcattgccccgcagcagtaagtgttttcggtgcattcatggtattacgttatcaatgcgcgccccgaca

SEQ ID NO: 5957 - DNA, 601 bp, Homo sapiens
  misc_feature (1)...(601): n = A,T,C or G
tccctcnttcaaaacacatttataaagagagcttcctctgagccaaaagtaacaaaactgtttcacattctttatctggtagcaggctgctgtctaaagggcattgtaaacacttcccagactttccctcaataaggggactgcctgattctcagttacagaatgtcattagctctaatgcgggctggtttccctgctagaaaatagcaactaacataaattattaaatattaaaattaataccaatagactgtcttgcgtttgcaacatgaataaaaaataaaaaataaaattatagaaaagtgataagagtaatcttgatcttcgttggcggcccctgcctttggggggggggtaatttatgaacccggttcactggactcgtgggttcagagcgtcgggctgcagaaggcgttatcagtctacctaagggcggtattaccggtcatccacgattcgggggataacgcgggggacgacctgtggacaatagggctttcaaggggccggacacctttaaagggcccgggcgtaggggttttcccataggccctcgcccccatgacgagctcaaaatatttcccttaatctcaaaggtgcg

SEQ ID NO: 5958 - DNA, 606 bp, Homo sapiens
  misc_feature (1)...(606): n = A,T,C or G
ttttttttnaaanttgggccttttggggccccggntgcccaaantaaaaacccgncttgaaaaaaaatttttttttncggggtttttaaaaaaatttttncccccaaaggttctggggntaactgggtaatccccccaagaatttttntcccaaatggaaaaggaaaaaatttttttcncnaggtttttttnaacccntttnccagggttangaaaaangggatccaaaggtgatttttncttaaaatttccctttctaattcccggaaaaaaaagaccncagccagtgagggtcttttgctcctgttcccccaattttctttgtccaaatggctcagccttgaattcaagaggagtggtgcaggatttaattgctcccacttgtcttccttgtgcaaaactgcagctaaagagcaatganaagtgagaatatttacactcagcacnataccaggacttgttccaactttgtttttgaagcttntggccntccaangatttatttcttccncccatgggttcnattaaaaccttcncttggagaagaagaggaanagccaantaccgcctntttcatntataaccngnaaantncccagcccnttc

SEQ ID NO: 5959 - DNA, 951 bp, Homo sapiens
  misc_feature (1)...(951): n = A,T,C or G
cccctagccccacccgtctctcccgcccctcgtggtgctcagacatacaacataagccagatccgccggcggccgaaaactctcctcctgcactatcgatgggtccaaatcgctcacgggtgtgcgagactatctcgtgctccaccgccgtgtctacctaactaatgcgccccgagagccaccacccacactcgcccctatcagngcccatctcacccccccgccacttgtgcccatttatttacccttcgtgtcattatgctgcggccgcccctcaacactcccatcgcgctccacctcctcccttggaatgctgccaaccacgtctaccgccatgcactctatgatgtggcgatctaaaaccccctcctcctccgaaagctcgcaagtctgaatgatttaaataattggcgcccccggtcgttttctcaggtgcctcactaaacaaaaaacgtctgcgggtttttcactccctgtcaagaaggggccggggcgatttatgaagttctcttttgtttctcggtaagaaacgatgcgccgcctgggcggtcgtggtccctgttcttcaagtcttctcgtgtgctagggccacgccggcaagccgacagaagtggtcgagggtgaattgctccgcggttgtcttctttgttnacgctccccgcggagaagaccgaatgataggttgagaatatttaacactcaccgcgaaaacccaggatctttctcaacctttgtttttgaggcttcttgaccttccaatgatttatttcttccacacagggtttcattagatcttctcttggagagagaagagaaacagcccccccatgcatcttttatctataaccagaagattccaagcctttcaaaagttgtgcaaaaagaataaagtaggatgcgggttgcctctcctgtttttttctgcgttcattggctctactctccacccac

SEQ ID NO: 5960 - DNA, 346 bp, Homo sapiens
attttggtatgaagatgatgctggcctcaaagaatggaaagggaagactggtaccagccactgcaaaaacgtgcttaagtacacagaccagtgacactataaagcaaccgcacaaacaagtctgaataataaccagctaccatcatgacaacagaataaaacccacgcatatcaatactaaccttgaatataaatgtgccaaatgccccaattaaaagtcacagagtgacaaggtggataaagggccaagacccagtgatatgctgttttcaagagacccacttcacatgcaatgacacccaaaataaagggatagaaagaaatctaccaagcaaataaaataaga

SEQ ID NO: 5961 - DNA, 525 bp, Homo sapiens
ggacacaattagaaacactggttattttaccacagatttgaatggaatatcatattttcatatgtgaacagactgctttgagggactgaggttaactttcatggaaccaataaaaagcctcttggaaagactggcctggcaccttttctacgcagtttccttacaagattcctgacatcatagttaagtaaataatgtcattttctgacaggcctaggaacctcaagatatttggaagacctcaagaagagagtaattaacccaacttaaacaggcagtctggggcaagtcaaatccttggattggctccttattctagagaagtttctaatggtttgatttgagattccttatgaaaaagtttcaacaaacccaatttagataggttctatatcataaatcactatccttgctgaacttatataatcagaacaaagactaattttgcaaacaaattggtcttactgtgattttctttggtaaaaattaggagactagaaaaagaaaaatcatgtttcagaaaaa

SEQ ID NO: 5962 - DNA, 1665 bp, Homo sapiens
  misc_feature (1)...(1665): n = A,T,C or G
cttcatctgtactaactacatcatnnctacagtctagtactattacctgtagtcagacncacaganancacagtacattacgatgctantcactcgattgttcctctntcttctatgagagacgtttcgcgtagctgccttcgaganacctcgtcatgtctagtatggactacaatatagagcagcacacattcaccattcagctntgtctcagtcagtcagcgcgctgagatccncggccgtgagtatgcgcgacgcagaacacacacgatntcacattctcgtggagtgacatgcgtaactagtagtaccntggtcagttaagagtcactgcgccgtatgactatcacgaaggcggcagtcngtgtgctctgcgtctctgcgtctgatgtatcatacgtacatncantagccccgtagctgtgtagacttgtgagcganattntaggtcatcgcatcgtgctcgcccactcagcttacgatacagctgtgcgcggcnacatcgatgatatagcccatccgctgtgctatgcgcagtcaaccgcagccctaacagcgcagtatcngaccagntantgccttatcgatgtacatacgatgcgcagnaagcnatgtgatgtgagatgatctgatgacgacatacgagcntcagcgactatcgcgtatantggactacatctgcacgncngtcgcaacagaatcntccagaccaacatagaggaggctgcatgtcgtacgcgttgcagtagtcgcacnatcactccgattgcatccgctcatctcactagcgcgactcatgcacgtaacttccaatcacgcagccacgcgcgtcactccgtgcagcgcggattgagtgacancaacacacgagagaatactaggccancanatgtatgctccacgtctacaagtacataagcataganctagcgacacatcgaacgtctcgcgcanacacacaacacactcaggacacactcactagcagtcgcagttagcacagctgcgacgngttgtaactgatcacctcnccnattaatgcacgatgtgtantncagctgactctatctcgtatatgtncgtagtgcacgtntgntgtgtgtctgatcgtcgcatgtcgacgatcatgaanacagctgctctcgctacgtcagcgantgttatgtagctcatcntcctnctgtgctacactgtacgacactgcgtacgctactacaccgacgcatatacgcgcgtactcnatacnatgtctgattcagatctcgcacctcatccgtcgtctcaagcacctgacatcgtcntcctacgcgtctcntacgnacatacagaccatnagcgtgctgacagtgcgagtatgctaggcatagtcatatgactaagttangtantatgtacgcactaataatacgcgaantangagagctggctcantgaatnatactagaagtgtcgtatcgcagtgagtctatctgctatctcatatcagcgcgatgctgacacgcacgtccatgcgcgatagacactcattctgatatatcgcggagatgatgtctatctgactgaacagactcgtcgctatagtgaatncacgtcttagcaatgtattgctcactcactcgtagttngatcgtangagtctctctagactcgagntacgcatccacg

SEQ ID NO: 5963 - DNA, 888 bp, Homo sapiens
  misc_feature (1)...(888): n = A,T,C or G
atacgcacgttagattcggcatatacgaagaaaaaccgctgctgcaacnctctcttaattttccaccgctacagggaaagtgcttacctcaactgccaatttacggaggatctctgtggatggtaaatcacagaagagtgtgaaaggattatgagcaggagaatgacatatttggactatttcccagagagacaacaccgatgataatgaatattatcggctgaaagagaacaccagaacactgtttacaacgcaactataacatcttttattattgactactgacatctgaaccatggataatattgtctaaaaaaaaactagacgagaattgtgactactgatgtaaccataagactaatataaaaggctatacatgatgcatcaagttacttaccttagccgattgtctgtattatatcctgatggtgttacaactttaatttgttaagggttcgtctttactagaaggcgttaatatagtatttttttttcaaatagaacttactaacttaatttttagaacccgtattacatatcctaattgtttcaatatattagcaaaaatcagttagtctaaaaaattgttcagcagtataataatatttgtatcttagagttgtgataatctaaattgcaattcttataagttttatcatacgaaagtgacattcaaaagcaatatcatagtgacctactcataaattgcctattgtagcataaatatcccaataatttaactgtaatacgatattcatcacgccccccacattttttattttatccccccgtatttttcattttattatatctccctcgaagatatacttctatatctttatcatcccccactatataatatgataatactattgatctaaaataaac

SEQ ID NO: 5964 - DNA, 287 bp, Homo sapiens
cgcggtggctcacacctataatcctagcactttgggaggccgcgacaggtgaatcgcctgagctcaggagttcgagaccaacctgaacaatatggcaaaaccccgtctctactaaaaatacaaaaattagccaagcatggaggcaggcacctgtaatctcagctactcgggaggctgaggcaagagaaacacttgaatctgggaggcggaggtgcagtgagccaagattgcaccattacactccagcttaggtgacagagtgagacttcatctcaaaaaaaaaaaaa

SEQ ID NO: 5965 - DNA, 1001 bp, Homo sapiens
  misc_feature (1)...(1001): n = A,T,C or G
ctctagtcgcgctcgtgacagcntctngagtgagtgtagnggactctgctgcgacgggcggtagactangcgacgtgcttcgcggnngctcgcgcgacgtaggtatangtgtacggatcttaatctccgctgtatgatgtatagncgatattcgtgtgagccggtaagccgttcactgtgaggtctcgccggcgctcgtgcgtgatgctacttctcatgntccgcagctgtgngattctggaagtgngactctatttgagcctctctgttannccactctcgtnnactctctctgatcctttgannnatgcgtctattngntgactatcattannnactcgctctcgntagatagatattcgtgtgataggctagtgggagcacttctgttgagtnaggntgtgaccagcatccataatctatcgtcgtctcgcctggngcactctagctctanggacacctgctgcgggagttactgcatgactgttgnagtggacactccgattcaccatccttctgtttactgtacaacngacgcgccgtgnagggcgtngncctggcgctcgctcgcgttggtcgtgggtggtgctgcgnngtcgtgggngcgcgcgcgggnnatgctgcgcaagtcgcggggcgcttgcgtgtgngcatggatgaggggnngccttcnnatctctcctatactttcgtgctctttatgctcatcttngnngcgcagtttgcccgaccttgnngttccttctcgatgtcaaccgtagttantctttgcgcccttccattcgttcacagctcctcacttnntttccacttacactatgatcctgttgcaagcagtggagccttngatcgtcggtgtctgtcttttngtcttagaattattcttgtactttntcttgtgttctattgttcattanntttttctctgtgcggcgggtagtcgcatgtagggggtacccttacggtgttgcgagagttgtgcgtgggggtggcggcggtgt

SEQ ID NO: 5966 - DNA, 1654 bp, Homo sapiens
  misc_feature (1)...(1654): n = A,T,C or G
ccgctctgactgctgaggtngncatctctcagtcgctnacngcnggcgtcgtgcgactcgcgtgtagttgctntcagatcngngcgtcgtcgacgtagnagtggctacgtcctcgtngcgcgtctgtgtngatcacttangatactatagagtcatngnanngcatcgcacacgctgnagatcacatgagcgtcggagcgtcganaacgctacaannngngncggctgctctacgcnggctgcgctccgcgcagagaagtacngngcgtcgtcgtgtacgccgtcatctcacatanancganngncaacacctcgtcgagagtccgtcactgtcgtctgnactctangcgaannngcacttccgagagannnacacatcgtcnggaccgcgcgcgngcgcancccgattgcgcggagtcgtantccgcggannnnactagtgcgtgttcgtcgaccactacggagatantgagcacatccgtaccgcgantacgcgcatgcgcggnncgcctcctcgcntgcacctctacagactatatgtgagatatgtccttattaatacacagagatactancctacctgctncgctctacgtcttganntacgtgngtngtctactcgtcaccttcgcgcgcgtctctcgctgtactcagagnngcgctgtgtgcgcgctctagcgtgatatctcttnctcantaccttcgtcgcctcccggtacaccacgtcanctacattcttcttngcctctctgggancatcatctaatattnnacacctctgtncctgctctcatatcatgnaacatgtancncgcgtcgagatgccgttgcccttgaggtacacgacacgagacgtagcacacgacatggcgcacgagggactacattacancatccgcgccagcggcgcgccgcgaggcggttgnggtgtagctccacgctgatcgtcacgtgcgatgngccactcagaggantcttcgcagnggatggtgatggtgtagnggcagngagagngtagtacgancggctgagcgnngnnnngagccgctgcgtacgcgctganagacgctcccgctgtgcgcgccgggtgggagaggagcagacagcgccgagcgcgcccgcggtancaccgtgactcgcctcgagctgtgaccatccgctcacgctgtntgcacacagcgccactanagcataccatctctctgggacatgaacgatactgccgttgtgtngaccatggcgtgtgngtggcgcgcgcggccgngnggacatcgcnattcggcgggctacgtgtgccctcgtattgttntatctcaaatcatattaccattaacactcctntaccattncccactttgctcntangctgnngacttacccttatactcttatttctgtcaccctactctggacctccgcttntntctcttctaccttttttnnnnnctattttctctncctcccncccccctcccccccccctnnnccccccccccccccacctctnnntncccccnnnncnctnccctcnnnnancnnncccctccnnnacttcatttnnnnnttttttnnttnnntattntttttttttattatttttttatataannnnnnccttnntcttnatnnaanaaaagttcacctcgtgtcccac

SEQ ID NO: 5967 - DNA, 931 bp, Homo sapiens
  misc_feature (1)...(931): n = A,T,C or G
ctaacgagaggattgtggaaggatggnggtattcataaaagnagtatatataattttaaagtaacatagtgccttttcgtaataaccgtatcgattaggttttacattatggatgtatttgaaaagnnattgtatagaccagccctcatttcccctcggccccaacccccccagccccccccacgcaaaggacccagtgcaattcaagcaaatccaaaaagagtcacaccaacttgagttctgttccgctcacatgccgcctcgctcgcacnncaccacgccaccacaccaacatgaatcccacatatagcaatcccactcgtctccccccgccagtcccccaccgagcccagctctaagtttattctcctcccacctcccccgtccacgtcctccgccttcgcgtcatcccactgccatcacccgtagcagcacggacncgcgactcagagttatcgtgctactgacacccgtgcacattatccgcaattcaacacagaagcaaatgntaattccagtntagagtggatcacttatacagttnctagtcagtgaacgtatacattnaagcacccatgaccatcgtccccacccgagacggtagtnntctccagcgccggctcgattcgattataacgattgttttagtgcccccactccacatctagccttgtatacctcacgccatccccccactcactctcccaccctcaagctccccccaccccccctaccgcgtcacaccctccgtccccccctcgtctctctcaacagttctccttcacgacccgcccccgttcctcttcctccaccacaccttcttttttcaggtaactcctctcccactcgctcgaggagaggaggcaggctcagcgccaggtgcgtagcgcaactatcccgcgttaatagatggattaattcccactcgtcc

SEQ ID NO: 5968 - DNA, 1731 bp, Homo sapiens
  misc_feature (1)...(1731): n = A,T,C or G
cgatgggatcgcgnagcacgctcgngtaatatcgagagcgtcatcacgcgagcnctctctcgtccacancntcggacgcgctcgcgcgatcatctcgatcgagtcaatacgctctacgcgtgtacgagntacgcagcactcgctacgctcgttgcgtgctcnctatacgaaagnaacggaagagcacttgcgngcgatacatcaagcgcgaccggagtgtgatagtgatgagatagtggagtacgactatatcgatcgaggaatagcgcggtgacgcgcgtgacatgagtccgtacgaatggagattnaatcatcatatcatgcagatatcncgcagcgtcacactgagggcaacactgtcgacatgcagtgttgacgctgaagtcgtgctacacntcgatagantactactnagtgagagcacacgtcgtacgcggcgcgccgagcacacgatcgctgaatatgntggagcatactatcagagactnatantnagatggcgncactacgtctataatatataagttctgtcgcgcattacattgacattcatgcgatgctatctgctgctgantcagtgtatgactgagttatctncacgcgtctcgnacgcgntnatgattactatgcgtagatcacatatacatgagatatcgcagcgctatagacgcnacancgacgcatacgtgagttngggatcttcattcatgtgtctagtatggagactgcaganacgccangtgagacggtagtcgactgnagtctacatcatgatcacgcagttaggagatattatagtatcaacaactaangagtctagcgtgatgtgattgtctatgtctggagtgcgcgatattcatanacgatnagcacacacatcagagatgactacagncttcagcagcgacagcatgttgtgcgatgatatcaccgcatcgatgacgcgcaggctgnttagagagcgtcgagcgtggcgcatacagtncgttcccatctgcatgtggtgtcgagagagagtgcatgtcgatgccaatacactcacgcctcgctgtaggctctcacacactccgcgcgacgacgtgagacntgtgggcgacgtctgcggtctgtgatgtgagacacgcgggcacgtcgatatagtaataaccatgttctctacatctcgaatacgtgatatgcgctcacacccncgtattctatatatgattatgngctggatgtatgatggcagggcgatgcggtgccgatgtatcacgcgacggaactgaccgccgcgacaatacagtcttgccatcgtgctccagtcactgcctcactgctgactctccatttcacgcgcgcagcacgcatgaatcgcagagccatgtgtgcaagcgcatcagacgagcgcgacgatagaactgaggcgcgctcggtgactcagtagcacgttgtggggtcgtgtcgtagagatgtagagggtggcgagccggccgtgtccccgcatcggtgcccgtcaccgaatacctcacagtcgctccgctcgcaccgtgtcattctgccgacctaccatctancataaacgctgctcctcngtgtgcgcatatatctcccgctcgaactcgcngagactatatatctgtgtcgcgttgcatatattcgatcgcatctctagttatnccgctacatcctagtgcgcacagacagcgcagctcagacatagatagtgtgatgtgtaccatgtgcttctca

SEQ ID NO: 5969 - DNA, 768 bp, Homo sapiens
  misc_feature (1)...(768): n = A,T,C or G
cccctaccctcctcgtcccgccgcctcgcggccggaccgtctcacaacaaactaagcggggcgggggcgacatctcaatggttcccgcccgcgcgcgcgcttccggcggggaaanaaattgggcgcacaacatcttttgtggcagaggcccccccccttattttttgcatcctggtgttgctccccaccccccctttttactgccacccgtgtttttttccccccccccccggcggttgtttcttggggaaaaactttttttttttttgaaaaacccccccggtgggcgaacttttttggggacgctccgccttgcgggggaaaactctctctttcttttcgagcgggggcggaattttcttttttaagataaaaaaaatagtgtgtcgggggggggggggggcctgtttttacccccccccctcggggggggggggggggtggttttttttgtaaaaaaaaaaaacccccctcccccccaggggggggttcttcttttttcaaaaaaaaaaaaaaaatttggcctggggggggggggggcttacctccctcctttggggggggggggggaaaaaattttttttttccccggggggggggcttttttgtaccagtggcaaccccccccttcccccccccgggggggagggggggttccccccctttttttaaaaaaaaaaaaaaaaaacggggggggggggggggttttttttctcctctgggggggcccccccccccctttttttaaaaaaaaaccctccccggggg

SEQ ID NO: 5970 - DNA, 1261 bp, Homo sapiens
  misc_feature (1)...(1261): n = A,T,C or G
gcgcgtctgtagtcgaactagagacgcgcgcggccggtatgagctatntcgaggacgcatgcgaatcgtagtgaaggaacatacatgacacgtactcgncacgcagtcttcttgcgaagcagcatgcgtgtagcggacggttgctgatngagagttctacagctacagccgtgggttcgtgctcgtgtcgccaagctcaccaatactgtccgtactagtcgctcgcagctccgctactgcgagccacacgcccgtcacgttacgatgtgcgctgcatctcgcaattgctcgggntcacacagccccagagacggtcatcctatgcacaatgattacaactacgcgcgcacgcatacgctcttctcgttaggttatgttgcgtgcgagtctcattgaatcgtcagcttcgtttcttacatgtatcatagagagatcgtaatgcgaacgtgtgtactccgaatgctataaattgagatgctgcgagatatgaattagttctagtggtactatatattctgatgcatcgtcttgacaactgaagacggaaccactgctgtgaggttgggatatgcccactccagagccgcgcggncggaggtgacgataatcccttacacttagcacaatcttatagctacgtaactgtcgtggcgagcctaaatgttaggagcgagggcggcttatcgcgatgcaagaatcacagcatgtctgatacgcctatagcataggcagaagtacgcactcacgcgntgcgctgcgctgcaggcagctgagtgccgcttcagcacgggatcatagcaccatactacaatgcaaccagctcaacgtcgacactccaatcacgcagtatgcacgtgttgatgccatgtgcttgtctgccacttctaccccgcgcagcgtacgattaacacaccatcgcgcaacgaccatagatgatgccaccgtgtcatacgcgataacctaacacatacagtgcgtagtggtgctgcttcgtcacagtgttgtgcagatacactgacatgcgtgtncgataacatacctcgctgcgatgacgacgaacagagatcgtgataaccgagcgctcctctacgtctagacgcgtacatacacgggagcctcggcgttgctgctcatggacactaaatccaaggtgcgaagcaccgcgctggtgatatactgcatgggaagacttccgatcttcggcgttctcatcacccaactccaagataatgcccagtaagattgagccgcctcctccccg

SEQ ID NO: 5971 - DNA, 1772 bp, Homo sapiens
  misc_feature (1)...(1772): n = A,T,C or G
tactgcgtatagcgcatctcntctctctacacgagagggccatctgagagtctacatcctgtgcnctgtanggctcatgtntcagccgtgtntcgctcgctatcggcgtctctcactctctctgtntgtcgtcagttactcttcggtcctctccttcccgtgactcgttgcgcgtggtgttgcgtgtgcgagtgcctcgtgtgtcgtgtcgggcactcgtcgtatatatgctgtcttgacgctctcgtcctgtctncggcgtcatcgtccggcggcattgatattttgtgtatccgatcgctcntatatcggcgcgagcagtgtgctcgctgcatgtcagattcgacgctcgatgctcgccgctgttatgagtgttgtcgtgtgtcttatacattgtgttccttggatgcacntccgcaggctgctcgccgggttctctggaccttcatcgncatctctgttgcgtacgcgtcgtcgtgcgtggtcgtgctgtatgcctgagtcaatgcgccgtgcgctcgcccgaatctcgtctgtgtgagctgtgtacgnagttatccngctctnttctgtctggcgatcgtatgttgtcatctagtatctgttcngacgtctcacnccgcgagtcgtgatatatcggctactctgagtgcgatntctatgtacaccatcacgtgtggggtccgcgatgcgcaagtcgctatgtgtgtatcgctgtaccgtctctcgtctagtgtgcgtgttatctgtgagtcagacgtcgtngatatactgtcacctgtgtcgcgcgccatactctancctcgcgcacttnacattcgtcgcaccgcgttactatgcatacagcttntagcgatncgcgcgtatatatacatngactgctgctgcgtgtnttgngtatgtctgcngtagacgtcacancgagcggtgcgtncgtgttgctgtcggcgatatgtgtcgtgtcgtcgcgctntctctatcacatatgtnggtggttgtagtncgtnctagcgactctcacttccagcatanggcgctncanaagtggtaatcgnccgcctcgcgtnggacnctccgatcattgtcgatatatatcgcgcntagtgtactgatggaggtgtncgtgttgactaggtgtggttgtgtactattgtgtgtctngtacgcncntttcgttcgcgtctcgctngctcgcctgactcctctacactcnccactgcntgctaccganagaaanatagtgatnagtacgtgngtcagtcgctctagttgagatgtgttttttcaacttctanctcanctctcgtcgcgcgcngtcgnttctatgcttcctnctcgcncgcccgctcgtcgcgtgtgngcgatnttctatcttctgtcgnccgagctgcgngcgctgancgtatgcanttatanantcaganggcngtgcgggtgtgttgtgntntgtgcagtctctcgctcagcgcgcctgtgctattcagtgagtgacacactcgcacagacggtgtgtcatagacttaacagtgagactttctatgtgtgtatntattntntatacacacatacagagacacacacacacgagacataccatatatatagantatagatatanagaagaganagtgtatatanancacacatanancacnnananatataatgnnaacnnnggtttacngccgntgcncaagcgncncnnttttnnttnnncctcttcttctttatattcttactttctgatatnacatctcatctgcttacactgt

SEQ ID NO: 5972 - DNA, 697 bp, Homo sapiens
cctctcgccagctaagtattctgtacctcttctcgcgggtcttttgtacctttttcgatcgattatcgccggtgtcacgctctagaagctcaagacgcgcactatctgcgcacctcttgccagcccggtcgcccttgtccggtatttctggacctcgtggcttatcccctattttcggtttgtctcgatttcatcagctggccgacggtctgcggctcgtccggcctcgtctttcgttttgattcgaagggggaaaccttagactatccacgatgtgcgttaccttgggttactgggctaaatttcattttgtccccccattatattttcttcattatatcccccacccgggcggaccatatccgtgtttatccccaagtccgcaactttatcgcggctatatgatttgatagtgtgggtgtgaatcttcttataaacggtccgcctatcctgtaaatgaaattggtcctatggtgaagctttaggaatattgtgtataatgaaggtataccctccttttggttccccaccctcttgttggaaaaggagggttggggggggaaacttacccccagcccccccccccccttggtggacttctttcagaggggcgaatatataaaagaatgtcttttatgtctcccctttaggacaaaagcccaaaaggagtaaataaagtatcattttattaaacccc

SEQ ID NO: 5973 - DNA, 714 bp, Homo sapiens
  misc_feature (1)...(714): n = A,T,C or G
gagaaggaaacgcagnaangcacggggaaatagtagtgaggctctttttaccccctcccagacccctaaaactcacttnttcccctctccgatagggggaaataaaaaccnncctntnntnnnnctcccnctttccccccggtttnttttcctcttgcagggtctgcgcctccccgggttgcgnttctctccttctttttctccccttccgtggggggggggnnntcccctcctncccaaaaaaaanttctaagtgcccttctttctccccccttataagctttaaagggccggcaaaccattggactccttatgtgtaaactataaaagaggctccccacttagttcttttgtaactgatttcattgtgttcctcttgaaaaactaaaagaaataggggtctaaataaaatgcatgcctagagagcgtaaaaatttaaaccttggtattgaaaagatactattacccctcttggctgtggttggctgttccaacttaaagggcataccccccccactaacttaaaaaggcccgacattaaacgcccgctgctgaaagattttccaaaggggttaccgaaacccacaagaaaaaagagggggtgccggggcggaggacgtaaagaggtgcaagaggaagcccgcgcaggggaaaagactacaggagggatggaggagcagatgagagatcagggagcccaggccacaacgggag

SEQ ID NO: 5974 - DNA, 701 bp, Homo sapiens
  misc_feature (1)...(701): n = A,T,C or G
ttgcgtatatcttactatctttactattctcgtgactcattcgtatctgctcttgacgaactgtatccgtcacatactctactgtctctcttctctctgctcatctctcatgtccctcacttaatattcgtcatagcgaggagatcaagccgcgctctttgtagacgtctgctcacgctttcatctgcccctcacatgcatcccacgcgattgctcagcctgattccagccctccactacactttgtctttttattttatataatacttacgtggcccgtcgacacaaacatatacacactcatcttctctctgtgccggtcgcgcgcgaatggcatgacaggctgacgcccacgtcccgactcatccctataagtactcttcacaaccatacaattgcacttactccacgaatatattccaactccctcaacacgcgcacgtgcgcacttggtccttcactatccccccccttccctcccccccactcacactttatctctccatccctccgcctttcttctgaacacatttctaaatctttgtcccatcacagaacggccccgtatcctatcgaacagttttgtacagttaaacctgnntaagtncntccttttgtacatttcctnccccccctcccntctccgcccattctcccattatctgtcctcgcccgccctctntntcccgggcgtccaccgc

SEQ ID NO: 5975 - DNA, 593 bp, Homo sapiens
actgatgattcccgacaacccgaccaacctgacaacgccgactacagtagcctaatcacaacttaaaccccacgccccgcgcatcgctccagtgagcttccagcgtaatgtcgctgaaacatatgagcatcactcggcggcgactctgcggatcaactaggccctatacaaccgacccccgcaccccccgcacgcaccgcaacgaaagggtgtagagcggcgagcacacccggtcgtcaaagccgcaccgctcacctcgcacaacgaaggggcggcatggttttgcatcctcctcgcgccctccctcagaggccggacataaccctccgggcacctcacaccaccgcaggctgctgcataaacaatacgatccctgtcgttcacccatcacaccgggccgcccgacgccgctcccgcgccccggaaaggctacaagcagatcgaaattcctacaaccaagctgagtgacatgaccccgcatgtgctcaaacaacacgggcagttcctccggtcccccactcgctgtcagaagtcagtgccacccaaagcaatcccaccatgcgtatggcaagcccgcgccacaattatgatcg

SEQ ID NO: 5976 - DNA, 1670 bp, Homo sapiens
  misc_feature (1)...(1670): n = A,T,C or G
cgacgcgcactagacgcgtgttaatatgtaaatcacacgtctgtagcaagcacgcagaagttatacaacacgacgccgatggctgacacgctcatatctccacgcgtcgccggcgacaatgacggcgaccatcaccagtgccgcatgcaccacaacacgcaccacggttctgtatgcacaacgggggcgagagagcggctggntgcgattgatacactgttggtgttgcgcgcgtggaacgcctctgcgtctcgtgtagaggtgaacacanagtcgtgcgagacagcacgacgtgagtcatatgtggcttcnactgattatataactgacgcgcatacacanctagacgagctgtgtcgtgggtctaatatgcgcgcacaataagttgtatctcgctgatccgacaaatgaatgggtgtcgtagattgcactaactgccatcncagnagacagcatagggtcgagcatgatattaatgcatcganactgagatcatatcgtatagatacatgtgcacacgagcgtgcgactcagttgtgatcagcgaacttcagtctctctatctatctagagcacacaacagtcagtgcgtcacacctgatacacacggcgcgccgacgantgagcactgntagaactaccatacgctctcatgcgcatgacatgntcagcagatgcgtcgtagtgacgtnccancgagccgaagactagttctgaccctcatcgtactcantgctataccgcntagcgtccacncatagctagccaacgacgcgagtacatacgctagcgtctctctcnttcacacatcatacantatgactcgncacgtctctagtgcgctcnagatgcgtctaagagcacancgatcancgtcatcactantntgcacctcgcaacacacaccgacaagaggctccctggtcgacacgagacgtcaggagcaatcgatacatacacacacgaatgtaacatgtcacgagcactcacatctccactgcaagcanaccacaccgttacagtgattcggctgcagctgcacctatcncagatgcgcgcttcatgcatacaatgacgcagcacgagaaagacaccacctactgcctagtcacacacagcacatacgcgnatcatacagctactcgctcccagacctctctctgcacatgatccgcctatgcgtgatagcacataccacanacgacgcgagcncncactgcagtctcnccatcanatcagctatacanacacagtcacacatacatgctcatacanaatcaatcgtactatcgagatcatnttagcgcactctcagtcagtatacagacggaaacatactcgatcgagcgtacatccctcgtatcccttcacgtacacactcgcgcgacagtccacagtcagcacaactgactcgactacacnaggactggatatatccactgctactcacaacatacatgcgcaccttatgtaacatgattactcaactacagtcgngncgcacgatcgnacatcccgagcgtcactacgctattcatcttaccaccgatctcgactctctgctgttctgccacgcacagatcatgcagcgcacatcatctcaaccgtatccacgtgacgtacccgccaccgctcagtgagcagcaatacgagtactgactactgtctat

SEQ ID NO: 5977 - DNA, 822 bp, Homo sapiens
gatgctgagagactctcttaattatcaccgctactggtcagaaaaaggtggtggtgtggcacacccagaagcagagggagctacctgtcctgaggaggaatcagctgcatctgaacggaaggagagagagagaaaatactgatgccagctgagcctgggagccagccccaccaattgccctcggtctctgacctcccaatatcttcatcataagcttttctttgtagagtttttgcatttctgtgctgtagagtggaacacagactcgcctttgatcccttcaagtaatctcattgctcatcagtgtcgctgccaagctcctggaggaaagagacgatgctataaacggaagacacagtgcttctcattgcgcacttgatgagcggcttgatggtcatcgatgtgtgtccccaggggaatttgattcctaatgacagctggagataattaattgcaaataaaaaaaaatggtctgcagcccagctttcaagatgagacactctgtcgatggtatttccatgaactttgcaagatgtattagttgtggaatacaggccgttggaatttcagaaccaacttcaaggatgggattgaagcagtacttacagaggccaaaacctaccaaggaagaagtgatgtgtgattatcataagagacctggaatctctggttttaattggttgaagaaaaccagtagaggtatgacccaccaattaacctaaatattgaagtgttgatgtgaacttttacacaaatggaaaaaacgccttattttcatcagttgattaagttatttggacatagccgatctttccccatctt

SEQ ID NO: 5978 - DNA, 302 bp, Homo sapiens
agtgtcacaatcgtcccagaccatatcgaatgctctttgctctgcccagtccctttgcagggcagcaggagaaagagttctgggtgataaccaggaaacaagagctactctgatctggtctaaagtagcagccccagctctgccttcaacatgacgccctcctccactccacctaaaatgtgcttcactatttttttacagatttttaagcgtggaagaacaccaagaattcatctgttctggtgctttcccactaagataatgcgatactgcttattttgcatccttgcaataaaacctga

SEQ ID NO: 5979 - DNA, 796 bp, Homo sapiens
acagagcgcctagggatcctgcattacacttacagattaaaaaggcgatcatggcggttaaagatctacacagatgcctcttggggatgacatggtcacatcttaggaatcaagccccatactgatagagacccatggactgctgtcatagctgggcatgtgatgacataggtcaggatagccactcaaaccggcctgtgttgtcgcagaagacaacagtctgaaccgaactttaagaaacagctccatagtaagtgcatggagagaaacaatcgagggaattgaagagaacagatcgctccattcaatgaacgccctaaggcctggtagcttgtaaatgaagagagaagggatatagttcgattatgcatacactgcagtattagaggaagcactgagaataacttgaagatgaactcgcaacaaaaggcgacaggagacgactgtattaaacagttttgagaatgagtggtcagtcatccgtccaccgcttttggtgtggtcatggtctgagcgagatataaaagtaactacagtgaaatatctctctacgaatgcgggtattatgcggcacacactaggaccacagtcgatggcttcgaagtttcaaaggaaaatccggaatcagctatagtgggaacaatacatattttcatacccagcgccgactgccattatcagccagataacgatagacgcgagtatttggaatgcgcgagcaccgagtgcgtataagtatcgtttgatatatgccattgttagtctatgggacctagagcaaacataaaaataaatg

SEQ ID NO: 5980 - DNA, 946 bp, Homo sapiens
  misc_feature (1)...(946): n = A,T,C or G
accaagaaaagggaagaaaaagaagtaacgnacgtcgggaaaaaaaagaaagaaaaaaaaagctaaaaggaaaacaaaaaaaaaatctccgggggggcgcaccgcgngcccgcgaaaacagaggggagcagaggaagccaaaaagacgacggcccgaagggaaggacacgcnccggcgggcccaccccgaccccccagagcacaagggcgcgccccccccgagagaaccccggggccccaagcgccaacaacaacaacacacccaacacaccaacacccccncccaaccccaccacccaaaaaacaacccaaatataaggaaaaggaaaaaacacgaaaaccgnaagaaaaaaaacggcgcaagagcgaacaaggcgcgagtagagaggacacagacnacagcaggaaagcaacaacgacccacggcatcacacgagacacccaagcccgccgccgccggactcaaggcgcccagaacaaaaaaaaaacgcacaaacaacaaaaggggacagacaggancacaaaaaacaaagaccccgagggcacgaaacgacgagcggagagctcaagagagagacagcgagccaggagagaagaagaaacanccaacccaaaacacaccacaccaacagcaacaacaagnacagagaggaaaagccccgaaaagcccaaaaacaagcagaacagacggacgcagccccccaaaagacgcaacgcgaccaccccaaaaaacaacagagcncaacccaccacacaacacacacaccccgacgaacggcgacagacaacgcgaaaaccaccaaccaaacagcccacagccgaggagagtaacaaagccagctacccgccaacacaaccaacaacaaacgaagggagcccccacagagaacaccgcccgcccgacgccccaccgcggggcaagacccgcgacaggggcaagagaccc

SEQ ID NO: 5981 - DNA, 1118 bp, Homo sapiens
  misc_feature (1)...(1118): n = A,T,C or G
ggggggaagtnaaaaggaaggggnaggggaagaaaanaagagagaaggagggganaggnnaanagattgaagggnaaggaaggaagggtgaaggtgtgaggnnaaagaatgggaagaaaaggagagatggaaagaaggataagggaagagaaagagaggcgggagggattctgataagaagagatcattgattagcatttgtttggtctgaaggggtgaaagatgccggggtactataaaagagatgtgtgcatggacagaaanaatatgtttaatagattgagattttatttttacttttancgtttttgttatatgcgactggncaccgcttagcggtagtgtggatggcaaggagaggnnagactctgatagccacactcggatcccacaggcacgtcccaacatatccaagtgggggcccaagttgtgattatgagtacatcgcgccacttttttgtccgagtcgatgcagggggcagaaggaagggcgccgcaagatcncaggaccccgccggtgcggtgtgtccgcgcgttgtctgtgtcnncctctgcagcgtgcgggncaagacccgaggcgtcgccccgcgagctcactacgtgtcgggcgtcctgtcttcgtcctctatgtatccctccacccccgcgcgtccgagcggcgcttcctccagggcncaggctggagtgacagtggcgtagattgtctgttactctcctacattgtgctggacaaccttcgagcgttncctactagataactctccgtatgtgagtccnctaatagtcgcatattagtgtttcattagaggncaagatataggcnctcaggagtttgcattaatggccccgtgtgtgttccgacaataatgcaattatccgccatgcggcaagtgtncctggaggaatcgtgaatgggccttctctcagatagagcctatggtgttactagccaagtcagtganatcgaccgggagagaagatgcagtcaatacggctatatagtagcntcggatcagtattgtccgctntctggctagcgtcggctacactccgtgtgtnccttagtgtgtccgccgtgtggtagtgtcntctatatanncaacagatgatagtattag

SEQ ID NO: 5982 - DNA, 1588 bp, Homo sapiens
  misc_feature (1)...(1588): n = A,T,C or G
caggctgtnacttccacgctgactgtgcgctatccgngtcacgtacgtatacatagagagacactctcgacctcacccgctccttagcacactcgcagacaccgtcgccatccaccctcccccgacgccgctgntatgtcgctccgactaacccgatatacctganctccagtccacatggcncgacgcacgtgatacctgtacatactctgcgcgtcgcggcaagccgctttgagagtacacaagatgcgcgtctcgagtatgtccgacgcgttcgctgtcgtgncgcgcgtgagcagcggcagcagacgaaccagctagccaagaactagtacgtacactcacgtacgtacatgagaacgtcgtcgcgcgagcaagtattgttgctnangcacgagtatagcgcgcaggacgtaatcagagacacatacagcatcctccagcgctagcataggcatgctcacgcgccttcactaccgcgtttcttccacacgcctagttcgttagataaccngtataagcatacgcgatcancgcaataccagcgttgatagacgtcgattgagcatagatnattgaagacgtgcctgagtgtatatcggagtgcgagtgcatcgcgaccatgtctgagtntctgctcttctacacctgcgctctcaggcatgcatacgcgnagcatctcgtcggcttctgtgattgacgcgtggacttgagtggtgtagcctccgcgtgcaccacacagacgtgccagcacgtatacgcacgtagtcgcctagcgtctgcgcacacgcatgccgcgaagagacagcgcagtgtcnccagcaagctacagagttcgaccctcaatctcgcgcagcctcgatgtctctcgtatctatcgtaacgcgcactctcgtcagtcacagtctcacctatagactgccactgtggactgtgatgtatcatctcattaacgtgatgtgaatatgtcatagtacacgagacgatatgcgcgatgcgtgtgtcacgtacaaatatctatgataggagagcgctantggactagaccgcgcncagcctacaactgagtaatctcactctgcgacatcgagtccgtgcgcgcagccacatctcagcatcacctcccgcgcacgcaccacttcctccntcactatacgctgtctgngctatgtgtcgtaacgctgcagcatatatgatcgagtgtagcgtagacgcggaatcctactcactctcggaacatcactctactcacatactactcggtctgcacacctgtgtcccagccctatcacgctcgagncgaattcgctcatgtatagatcgactgccgtctgcgtctgctcancacacagaaccggagagacgcttgcgtatgtagtgtaacaacattagtcatgtactgagaatctagagaccacatcgccgccggcacaccacagcccgctggtgacagcatatagcacgtgtcatcgcatcgaacggagacgcgtgacatactgtcgaacgacgcagacaggaggtagatggcgccgcgacaacgtgggacctgtactagtaggagacgtggatgacctagacgatcacgccg

SEQ ID NO: 5983 - DNA, 1254 bp, Homo sapiens
  misc_feature (1)...(1254): n = A,T,C or G
gatacttgcgctgtcatatgtgtgatgttatcctatatagggnacgcgggtggcgatgtgggaccgatctggatgcggctgcgtcctctgtacgtatnaggtcgaggtgagcggtncgtgcttgtgattacacnctgcggcgcggcgtggtcgcgtgtgggggaggtggagcgagtgagtcaagacgcaatggctaatagaaggatgagcttgagggaatcggggcctgagcattgcagggtaatggtggaggagcnctacgctatcagagcgcagtggacatatataggncatgcacgatggtgatttggtacggccaagagctggcctctgtgtctacgannacacttattgtagtggtcgactgcgtgctgtcgtcgctacggnaagaatgtactgctgtgagcggcgggcggtcgcggtcggcagattggngcaccgtgaagtgtgtgagatcttgttagtaatgatgtacgacaagaatcgtaccacgcgaatgagtgagcttaaaagcatgctaacatcgggtgagtctgtcgagntaacgcgngacgcgtcgagaggaagattgacagagttggcagacagggaaggggagtgagatagataagcgggagaagagtagcgaggtgtaggagtagcagggagtgcgtgcantctataatattacgatatggtctctctgagtacattataaatctctgaaatgncacacatgnacatttccaaatcatgaccaactccacggaggggcgcgggcnnggcgctcntggcggtgtgggacatgcgggcgccgctgggtggtcgggtcggggatgaaggagaacgggaaggtcgctatggtagtatgatggagtggcatgctggacggactgctctggacttatatgctctctcgctctngctgggcgtgtgtcgttgtaaactatggtggaggcgnagcgacgtctgccaagcgctctagcggttcaactgtggncacctttcttgtgtcagttngngctgcatgtgntctctctgtacgtctgtacttcgtccctgcgatgcattcctaatcatgtcgagatctggtcggagtnnggggcgtgtnccggangttnngaagcggcctgcacgncccnctcttgtaacnttaccatnaaactatcacaaataattctacataacatgtgatgacagagtactaatanaatanaaagcagtatcctcactctcatatattaacaaatacaagatctaataacactnaacaga

SEQ ID NO: 5984 - DNA, 1404 bp, Homo sapiens
  misc_feature (1)...(1404): n = A,T,C or G
cgcgtcgactctcgaacccattctctaccaagagacgaccgagaagaaaatttgttgttgttggaccaacgcgccggcgccctccaccgggaaaaaacctnccgcgagacactcgacaagctgaccgcggaaaatgttttccgggggtgataatatcaaccttatcccgcccacgatagtttctcatatacgtcggtaaactccccaattatcagattgcaggcgtcgccgcatcatacaaaaataacatacactgcgagggaatggtgagggtgggaagaccacagtcgacatcaaaatctgctgtggggcacttggactaacaatagtcgggcaggtagagaataggaacgagacgagatttctagttttgaagaggtnanggacgcgagaatacgcgccacggatgcacatcaagtacagtaacaaaacctggtgacacgacacaccagctctttataatactaggtgagtggatgaaagaagtgatacaaggatacctacgccgattttcccccgattatccctccgcaccgtgtgcagcgaattaatacgggcgccgccgagcgcgngcggcgaacactgtcgttgttgaaattgacggaggaaccaacactcggatgaatgtggaggtgaatagagtagacacacactcatacgcgcgcgacactccaacagtgtggtatccataaaacatggtaggacaacacgacaatggggtaaataatctcatcgacnacactatggctacacatctgataatgttcagcactctctctggcgggtgcgcgctctaggatagagctaatatacacgatactactacaagacacaggactaatcgcgttggcacantcttatacantcgatctgtcttctcacacagtgattgcgccgacagctntnatctcgcgcgctacatgagccggcgtgtacatcgctagantgcattagagtaatgtcgagaacatacactgctctcatgatagctgcgcgagtgccagagcacatataacgagtatatatatacatatgatatacgcggtgacgtatgtagacacgtcgtcgatcacgatcgcgangcacactcaatatatatccaagcacgaccgcgctctgttgcctcgtgnacaanttccacttgtatatagtacggtcgccatcattaggtgtagagcggacggatcgccttacgacgtactgtctcatgcgccgacgcgacanagtcgagtgtcctctagtggtgttgtacagcgtcatagacgactagagtngtactatatagataacgtgttgcatatactaatcatattacattcgagcacacctaccacagctctcagaccacatatataggtggtatcatatatgatgcgatccgacacacgtaggacgccacataca

SEQ ID NO: 5985 - DNA, 766 bp, Homo sapiens
  misc_feature (1)...(766): n = A,T,C or G
atcttcacatcaccagtatgatggaattgaagcccaagattggtaatgttatggggacatttggcaatgtctggagatgggtattgcctgccatgacttgtggcggaggcgatgctttctggtttctagtgaatagagggcagcgatgctgctaaacaccctgcaatgctcgggacagagcctccacaacaaagaatcatccagccccacaatgccaatnatgccgaaggctgaggaagcctcggcttccacaaacatctgaagaaattatatctcacataataaccctttttcatttgaaaagaaggaaagaattacaaaatggcttgcctaggtgtactaatattgcaaaattttataagttgcaccctttgtttttnatttcctcttccacatcaatatctctttttgggcactgaattcactggtatattgactaaaaanaatgtgaatacgtcttttctctttcttttttttctttttaatctttttctgaggctttgttttttataatattagagctccatattttcctttaatgnccctgggtgcgcactcttcactcacaccttttctgtttgatcgaacccccttgttaacccatcctaataattattatccgacgctctcttttatgatggtaatatctatccctttctgcttgttcccccctaccaggaatgtatgcgcacgactatccactcgcttgattcgtttacttcccccgtttgcctgcgatgcccaacaacatttcgtcggagcgatt

SEQ ID NO: 5986 - DNA, 727 bp, Homo sapiens
  misc_feature (1)...(727): n = A,T,C or G
gagaaaattcatacctgaatactgtagacggctcccaaatgttagctcagaatttcagagaaagagaggaaccaactctcactctcctttttctgccacaaaggcagtgcatagggacaggaggcagataaatgctaggtagaaaagagctggtccctggtgaaaccccaccctcaagccaaaaagcctgaaaccatggcccaaagtgagaacttctatccatgtttttccagttgaatgttgccttttcctaagccccccatggctctgccctgcctcancctgggcctagaaagaccccaaactcatttggcaaaaaggagaatcagctggatgaaggggaccaccatggctggatgtgaaaaaaaaagcagtttggcttcaaagggaacgccttaaggggtgaactttttgaaacgatatctggctggagataggcgagactttcaaaggaaaaattccttacggggccggcccacccccctttgttttgagctcaccctgcctgttagaatcgccttttgaaaagcgagtaaaaatcccagggtgtttggtcaagagaaaagaaacagacgcaagcatggtcgcgccctttgtcgccgtgtttccgcagagcccgcgagtgttagaagatagcccgttcgccgtgcggcccttcccgtttgatagggtgggtacttgatagtcctgggcgcggtccgcccccgacaggagcggaggatgggag

SEQ ID NO: 5987 - DNA, 555 bp, Homo sapiens
atcctcagcgttcagtaaatcactactacacaattgtgggtacagcaacgttatgcgacacgcttttcgatgcccgcgagctatatagggaagagcgctggttacactagcccgtacgagtataagaggggcctctaacatatatgtgaaaatgtaaagaaacgtagattagagctcatcatgtgtctatcaacgtccgtatgtaatgtaaagagactgatatcactagagcaccgaggatgtgggcctcaaggaaaagaaagaagggtggtggatattatacacattattctagcgaagggtagaaagttagataactaataacatctgttgtagagaccccaaggaggcagcttatacaacgatgagcgaacgggtacattcaccagcatggccatataaaccttaactgtgtaagagaggacagaaagtaaacaacaaaagggagagaggatcttactgatcttaagcctcaccatggacagtgggaaaaaaatgccagagtactccacgaagaagaaaataggtttgaggatttaaagtatctcacggtca

SEQ ID NO: 5988 - DNA, 1380 bp, Homo sapiens
  misc_feature (1)...(1380): n = A,T,C or G
tatcaattattatatatctncntactatccactagnaaaattattatgagataaagataaacgacgagcnnacacacactctaagagatgtgtangagaaccagcgtgntgcctgttatatttatttttacaccacgacatcgagaaaaccctaatatataataaacaagttattatcatagtatcactcanatcccgcgccactacacctattttancttatgtgagatggagtgagaagatatcgaattctcaacaaatacatatatataattattacctaattaatatagtatctttatatattctattcgccaagttataaaatgtatatactatagtattgatactccccacgccccactctctctccacgccataaacaataattctatacaaccttatnactaggttatatatntctaataaagcacgcagataatttcgtaattcatgacatcctcccccttttaaatgtatatctttccgaagtggggcgccccccctccctaccattttactttttctcgcccaataataccttttcctctttcgctccgtctttttcgtccgcgctgcccccatataatatcagactgtttcaattcatctatatatttatacacaagaatatgattaatagctgatcggcgcgacaattctcatcatcactctattacgtctcatatatttgcggccgtatcatatcataatataatatataattatatgtctatttgatcacaacatttaagtattatactattatattaatgccacaataatcaaattactatcaagttaacgatcattaaatattcatcataaaatagacacatgtacaatgtattatctaaagcgatgtgtactgagtaattgtaagaatgatttcataagattacatatttcattcgattaatatcgttgaatgcacctctatgctccatatctatacccattaaacagaatctaaccagtaatggattagacatacataatcataactaacatatctgcatctcattattataatatgtctagtatttacgctatagtaacccgcccattatcctcccattatatctactntacgagtgacctattaatgtatgtattaatagtctatgaatcgtagatgcttactcgtgggatataaatgctctatatactctatatataaattatanatccgaagcattgcatcaacgactatagaagatactagttttacaaccgacacgcatcgctgcagcaanaatatcanctcacacgagtatagataananagtaacatagtattaattattaataagactataataataccactagacacgtacattanctgactagtctacactgttacatagtacttatatg

SEQ ID NO: 5989 - DNA, 2001 bp, Homo sapiens
  misc_feature (1)...(2001): n = A,T,C or G
ggatatctatgtagtctcgcgctgacgagtgtgcgacgcgcaggacacggacggagactcgttaccacgaacgacattcaagtccctgaagtgtgcgggngacaactcnangtatagtatgactagaggaggctttatgtaacaccgataagcgtaaatccatcagtatntcgtagaccagtcacatagcggagtgacaccagcgtngtganacgagtatgcagacgcttatntatctcaccccactgcntgagttattatctcgtacacagtcgcgcatgtatacagatctcgaataatcagcatatacncgtcgaccgcacaggagtatccgcgccagctgctacgcgacacgcgcgcttgtatgatacgacattctgtatacgcgtcgcagatagcacatccgacgatgtgtntcgatctcatgtagagacgtananangagtgtacagtcgcatagcccacgtagtatgatagtgactcgtagcgccgacacgattatatcagtacgctgtcantcgatctctgaanatattcactatgtaccgcgccagagtatatatcgccggagcacaagcgagaatacgtccgaaccggagatcttacancacctactatagtaaataccaatatacgcaccgcgccgagntagagagatgcgaccgataagcgacgaacanacactatantattcgtacgtacntgattacnctanganatacggtcgnattctatgctagaatgtncagtgtagaacttctatatcatatataagagaacacaccatacgatgantgacgacgngcagcacagatgcgcagacagcgagtcgacgagtgagtgntcatataatccagagcgagtgatgagacgccatgntcgnaggcaggtatagncgtcacagtgagcgcgcgtgtgactggncgtgtgagtcagagagcggtcatagagtgatgtgatacttgtagctctataccgagttcgatgaacgatantgtntgcagagtatgcgcgtgtcgcgagagagcagcgtgtgatccgatcgcgtgatagagcgtagcacggtgaatgaatattagtatagcagagcacgagtagatgcncacgctgantancgctactacgtacatggcgncgacagcggctgcgancgctatgacgcaccagnacgcagtncagcgacagaangcagcgtagcatacgcgacgctganntgncagagcgcgatgagatcgactgtnagngcgacatntctcgatcntgtcgcagtgtacacgatgagtagctgcgacgagttgtgagatactngacggtcccgacgcccagcntggccgcatgtagcatatcgcnatctgctggcgagacgaagacagatcgtgacncanangccgatgangngtagtatgatagtgcatcnacgcngcagtatatgtatacacgacgatantncgtacnatgacngtcgantcagctgcncagacacactcgacacnctgtgatatctgcgtagatccagtgatccacatatgatcaaagtattggtatgattgctcgcacacgaccaggtagcgactagatactcagcantatatatagcncgtcgataatcgncgatagtcacagcagctgctacacagctctcgtgcggtatgatcacanagcacttaaccctgtttactcatgattgatgcctccctgatagctctgcgcgcgtgtagcttgacgctantcgatatnctgatcctatctcgcccactgncatacagatacgntatccacgacnacgccgcnagctacacccgatatgatatataatgatgcagcaggtggtacgtgccgtagcgaagcgcgataaatcgcgatgatgcagtatagacgacatgcgagnaggatagccatacagcgtgactcgcancacgagatactcagacacggtagcgtcgcaagaatactgagagcgagacgtgagtgttatcttcgacagggcaccncgcgtgtcct

SEQ ID NO: 5990 - DNA, 1091 bp, Homo sapiens
  misc_feature (1)...(1091): n = A,T,C or G
atttaaatttnaaatatttaatnaaataagtattattattaagtgnattaatgattaatggttatggtaggatnagnaatatttataggttagtaatataaaactatgaaataattntgtgttttattatttcattganccacaaggatgtggcttgatgttttnattattggaggtcttttaggtttanatggtgnggtggttgnnagcgagttttggtctgtgttnntttgtctatgattcttatgtttcgagtcnnctatttcgtacacagattcagctccgtctcacccatttatttgtcccctcttgtattcctgttttttctctgttctcttgttggtggtttctgtgtctatacttactctatgtgccccctattcttgtttcttgtctttacaagtacgcgcaatgcacactccaatatgtgtctgtgatcgttgtgtgtttggtctgttgtgcccggactctttttctttgctcacacgacccatctgtattgtttagtattttcagccgtgccgtatatcctgtatttttttccttatatcctaacttactgcnccaacgcagtaatatagacattgccngcnncttctatatctttcgctccacccttctcacgcctcagtgtcctattatttcatatgtgtgcagtgaatgttnatttcatgatgttcnccttattatatgttttttttcttatctctctatattgcatttatttagtttgctctttggtctttcatttgccccgtgttttgtttattttttnnagtatatcattcttttcttattatgagggtgttgaggtttatatataataaattagaattaattatttctccgttcctcaaattttctatcattgataagtctttccccttcaaatattccatattccttttctccttcactttctggtccgaactcacgtctgctgaattctgccctgaccctcgcaaccactcctctttcctcgtcttttttgtctttgatctcctctttttctaatcgaacaaataataatcccactgtgagtcattgatttatcgttcccatttcgcttattcccgaatttgccccagttc

SEQ ID NO: 5991 - DNA, 1442 bp, Homo sapiens
  misc_feature (1)...(1442): n = A,T,C or G
gaggaagagagcaggagacagagagcgcgagacaaggcacacagacacaagaacgcagaggacctcggtagagaaggaccagagangagagagaagccctcaaggaggggcgagaaaccgaggggcgacgagaaacgagnagtgaaagagcccgcgaccccgccagctctctcgcgcacgcgnagaanaagaaagccccagggagcgcgcangacgcgagcggcacgaccgacggagacgagaggagagacangggcagcgcggcggcaaggagaggcaggagacacgcgcgaccaggacgcgggaagagagcggccacaagcaaccacgcggcgccagccacgcggggaccgaggcccaagagcgcgcanggagaccgggcaacgagcacacgcaaacagcgcgcacgcgcgcgggagggcgagtgtcttatctcgagagaagaggcggcgagacggacgagccgcacggcacgagaggcgcgacgagatggcactacgagagaacgaggcgagtcgaacaaacccgaagaactaaggcagtcgcccacgacccacccagcgagaacgcgcgtggcagagtggcgctggagccacgaacgaggatgcgcggagagacgaggagagacgagcgggacatagccagacgcgatgcacccgcgccgcgccgccgagagaggagggaggagagagaaacgcgaagccaaacgacgacgacgcaagacgacgaccacacgccaccanagcagacgggggcgactggaacagaccacgcaggagtgaaagaaagcagccaacgcacgccctacgcacatggcaccacgcgacgtacgcgaaaggagaagacgagcacacagaaccgaagcagaacgacgaagaagagagaacggcgccacactccaccagcacaagacaccaatccgggcgcaggacggccagcgagagaaaggcgaccgaggacgcaagagagagccaccagagcgcgcnacgcactcggaggcgggagagagcgaccatcaacacagaaactgagcgcggagcgcagagcggagcacgcgtagaggcagccagcgnacccgacagacacaacgggcgagcgccgcgacgcggntgaggaaacacagagagagtcgcgcacaccgcgcgcgcgcgncgagacgagtatacacacacagactaaccgaccgacgacgaggcgcacacgancagagcacgacgcatcgacggcaggtncaatcaagagtaataaggcatacgagcgaacgactgacgccccacgaganagctagcgcggcagcagagngcgtanagatgcgcgcagcactacgcagatagtgcancgcgcacacgagaagagacntacgaccgaaccnagggacgacgcgaggacgagaatngcgcgcgcgcgcacagactaggagagcgacgcgcacgagangcggc

SEQ ID NO: 5992 - DNA, 837 bp, Homo sapiens
aagaaaagtattaagacattggggaaaaatcgataataataaagtacccataactaacgatactgactaattttaatacgagaaagttgcaacggatagaaacaggcttttaataagaacaagtatagggcatgcgagtagcaatgacccctggaccaaagttttaaaacataaaaggtgtccgatgttttatagggatacgctgtgaatatgccaaagtttttggagcccctataattttctcttacaaaaaggtcgaaggtaataattatggaggcaataagtgtaaccctaatccaaagattaaggcccatgggccaattttccaataaatatttcggaataaatataccacaatagggttaaaagagtgtgttatatttaatttgagtaaaattattacaatccgaaaagtcctgttcgtaatgtgtgtgttcatgggaacaattttccaaaataaaatgggctgtgcggtaatgggaaatataccctccaaatctcaggggggggcctcctataagtttatttctggctcacggggtctgccgtgagaccagagtctctccggagcaactccccttccacccctgcccagggaatagaacatgtgcgtaactgagagacaaatcatgtagaaaaacaaggtgattttcctagagaaggactgaagtgctttgctagtattagtcactatgataaaaagtagagaagaactattctatttctttaaccatctaagagacagaccattcacttggagtgaaatatttaacctatttcttcatctcttgaattaaaagaccttaataatatgaattcataactcgaatatagata

SEQ ID NO: 5993 - DNA, 804 bp, Homo sapiens
cataccactgactcaaatatgtcagtatagtggactttcttgaggggtttcatccaattacaacattaaagaatttctatttggtttgtcttttacttcatcttcccatcagtacgatcctgttcaagttttgctggattattcctccaaagaaatgtacctatgtccagatattgaggctcataggcagaagggacttgccctgacttggattagactttagactgtggactgtggaattaatgctgaaataaaacgtgacttgctcctccttgccttccaccatgattgtgaggcttccccagccatgtggaactataagtccaattaaacctccttcttttgtaaattgctcagtctcaggcaaattacctatcccaatgtttgaatgagggaaaacaagatatgaaaaagacaaggaaggacaaacttagcaaagatcttcctcatacagaagaaaaatctccctttttccatggatggccatccccgaatggggtttctccaaggaaggagtaaaatagagttaccaaattgtaggcctatgtgccctgcccgttaggtaaactgctatttttcttcaactcagctggtactttcttaggaagactttgctattctctgggactatattatggtctcgaatattgggctcttataacaccattgtttttttagaagcactgtgccagggtaaaaaccaagtcaaggtgaccttaagaagaacaagtgggtaatagctgcttaacctgaggtgacctcctaattgaaaaaaccgggggcggccgtttccttaatgagggg

SEQ ID NO: 5994 - DNA, 352 bp, Homo sapiens
aaaccccaaactttccctcctgtgatgcctggcccagctgacatctgctgagatttttttttccaaacaacaaaccatgatccagaaatcccgttttcatcatgaggaagtaaatttgagcccagcccctggctgaatttgtaaaacctgaattaaggaggtataatctggaggctagtgcctgatttggaaactagaatggctcagaagtccctgaagctaaattattgtttgccagagccaagcttctgctggtgcaaatggaaacagtttgtcttgtcaagttgtcagcctttaaaatagtttaagactggttgtcatgttaaagtgcacctttaagaataaatggaga

SEQ ID NO: 5995 - DNA, 1109 bp, Homo sapiens
  misc_feature (1)...(1109): n = A,T,C or G
aaatataactaggagtnnttgaatnnncnaagcgggtttgcgacaaaaccctaaaagtccttggttgttttttgtgaattttgagggcgctaaagcaggggttcgcgcggccttagtagttctcctccacaattaaagggagaacgcgccgagtgggatgtttaaccgaaaccggtttgtatatttagggtcgatttgagtggttccatataaaaaaagagtggtacagggggacgcgttttttttgttactttctcggtgtgtacacattaccccaatacaaccctgtttttttcgaagtgggggggagatattgcaagagacagaagtgagcgcttacgtatagacaaaaacactctacacacaaggagggaggcgtgaggtggagccctcccgttaatacatcggaataaaataacagaaacattgcggtgcctgcggtattaggctgacataaaatcacaagtaatagtctgtaccgtgcgaactctattcagtccagtaggggtgtggtgacgtaaaacaccactaccacacgcgcctcttcatcgtctttcattacgtggtggtgggcgactgatatttggtccccgcaantcgcctacagtaggctggtttcgctccgagcgagttgcgtggattatgaggcacatgtttgtataacacacacctctcttcagagcggaggaatattagctttgcttcccatgtagatcatattaatgaaacgcataaaccggcgggcgtgtgtctgctcctcgtagtgttgctgtgagaggcgcgtcacaatgagacaacgatagaacgagaacaacaggagtacggttatgttttcatcgttgtctggtgagcacctgcctggtggagcctgatggtaaccacacccgggtcgtgatatatttcgtgtttgtatgggagatacacattaatggtaaagtacgnaacagaagccacgcgctcatcccgctttgtgctgcgtaggtagagtcattataggcctcctgtttccagcagggtacgcggggtgtttatctgttgttgtgtgttacatacatctagtaaatagtatcagcgtgtcgtagctcggtctatattaatattaacaataa

SEQ ID NO: 5996 - DNA, 1684 bp, Homo sapiens
  misc_feature (1)...(1684): n = A,T,C or G
atatcgcaggatcactcgcgtaacagaccgtactcctaggtacagataagatcaaacacaccacactcgagctttacgacgccatgcacaacgatgactatttcgacaatcttcagtgagaacagtagattcttcgatgatnctcatacaatgccctatgacattatgatacgcgtgcngnataatcgcacgtgcgctctaactatgagacgcagctaggaccacgaataactgagcgtcatnaacttcatcaggtagtcgtacagcagttacgcagcacccacgcatctnccgcgctatatagagntagagcgcatgtatgtctccatgtcgcatataatctcttcngtcatgggctgcngcatacgtctctcgttactgtgtatcaagtattgtagacnacacgcttagaactgacgtactcatagatgacactatgtacccacagtcgtagcacgcggtgcttgcgtgantngngtgtctgtcctgcatattgtaggacagagcatgcntctcgacagggcacttacatctgtgctagtcantacgatcgacgccgcgtaaattactcaacagtggtnagagcgtgantcatcacagctaagcgncgatgggtgatgtatgtgttgcttagtgtgncaattacatcgtaggcagtatacatatctcactgctcatagacgcaatagtagatcggcagtcgcagagtatccacacacngctgtacatctctatcgtaatgtctcncgctgcagcatcgacgtgcacnttcgaatgtgctcagcaacctcacgctcgctataactacgatcgtgngtcgtgtcgntctgacgtangtaggngnanacngcgacagtcagtacatagctggtgcctgtcatttnctgatctgagtggctgatatcgcagctctcagagctatgcttcagtgctgtcacgacacgacnantgtatggagtngatnagcacagacgaccgtagtgatatcatcgcttgacacgaactgtagctcgtcgtntcgcatgcagtatatcatanactgacgactgtgcagcgagntcgtaggcggcgagaatttgatgatacgcccncagagcgccgtgagcatgttcgtgcgacttcagcatatgctaatagtgagatantatcccgagctcgntgatgcaccgcngacgcgcataagtatagtgtgcagtgcacgtctgtangcgatagataccgacatcgatatcgtagtcactaagctcgctgttctatatcgcacgctcgcgtgatatacacgatggagcgatcggatagnancanggactcgccnctngctatgacattaataagtccgatgacatccgcngctcacattttaccatcgcgtcgctcacagacatcgattaagtccgagcgacgaatgtgatgacgcgagatgtcatacagttctcaataagtcgcgccacgctgtgataccgagagggcataacaagatagatgagaatatctagctgcacgcgtatacgacgatggcaatngcgcacgccntatcggtctaagtataccacaccgcaccatctttagtcatgatactgataatngtgtgccaccttcagcacgataatcgctgaccgctcgtgtgcccgcaagtaagtcgcgatacganantntatctaacatgatcacgctgcactgtcat

SEQ ID NO: 5997 - DNA, 1626 bp, Homo sapiens
  misc_feature (1)...(1626): n = A,T,C or G
atatattaatagggtaataataattataaatagtaaatgttaataagtatatattatatggagntnntatgtggtatgatgtgaagttgtatattatttatatttgangtnnnatnangtagaaattgttatgtnaaagtagtgaccgctggtngcatcatcattgtnatatattgctgtatgatggttatgtncaccnacnatggtaaatanaagcattattatttttnntcntnatgtgtgatattagtgttagtgagtgnttagaagtgtggantgaatagtggnnnaagagaagtanatatttgttgttataacagcnnnnngccgcgtagtgatgaggcaccgtgcatcncacattangnnctcgccgcgcgtgctcgatcctctgcgcgtcgcgcnctatgcgccgcgttcgagcatgagaagtncncacgaggatcgagcaccacgagatgcagcaaccagacggcnacgcggcggcgacacgagatggctgtcacgagtgtcnntnncgtgctcgttacactatgttgctnncagtttctcgagttggcgttcnttcgtggttatgggtagagtgcgncgtgctcagaggnnncgtatgtgacatgaaggtagatgaacgacagtgagaggacatggtcagatgataccgacagcgcacaggngtgagagcaggcgntgtacggcgcgctgctgcctcggcgagtntgagtatattnattgtctgctcgttgtacgctgcgccgtgnatagtcntgtctgcgccgtacacctaggcgcgcacgncagtcgtgnncnccgcgcgcactgtnatatatacgatagagtnnaatcacgcgtctatcatctatattagcnttcatagttcttcgagcggcgcanacatcagnttcggacaggttgtttcagtctcgcatattatgagacggttatacnntttgattcattatgttntcgtgatngagtgtatgtatgtgtatataggaaggantnnnntagttgttatatgtatcatatgtaatagcagatggtgttatantatctcctatgtataccgacgatcttactatcctttctcttcgtgtcatatgttatgatncntagtgagtggtaggatcgcgggacnatcttcaactgtaccatgatatgataatatgataatcgacgtgatgagtgaagaatncacgcaatgtagagtcnaacttatgacagtagaacagagngtttatcgtcacacttgctattacaacacacgtgaccctatncaacacgcgcgtccatacctccgtgtagtactatatgtactgttcgccccgacgtcccacgtgcccgcctctcactgtttgaattcgnttaccgttgatttcgtatttgtgttgtgcgctgntctgcgtccgtgtaattctctgtctctgncncacgccacacaccccactatagccaatatcgtacgtgttatcttctcncnctcacacttctantatcntacagactcacatatatcgctacattngtctcnnctctaccttattgttctcnacatgncatacgtctaactactctncnctgtctgacatgaagtgatagtncnacgagttagtatatntcaatggaagattc

SEQ ID NO: 5998 - DNA, 1383 bp, Homo sapiens
  misc_feature (1)...(1383): n = A,T,C or G
gttgatagttatgttttaaattagtgaagaaaaataataagnaattatggttatgtaaaagaaangtnaaagtagagattttttgaagtaaacantgaagaaagttaattaaaataaagattagcccnattgagagttattatataatagttcttattgggtttggtggttgttgtaaggagttagagtattnnngagatagtgaggggagtgagggtnngcgcaagtggccgcgtgtcatcgcgggancaccgagtaccagaaacaagtgaggacactaaacacgagtggcgatgtnnnaggagcagagacagtcgtaacctgcgcacgcataccacgcgatatgtttntatgtgttngtgtagtgatggtgtacttttttctatggcttgtgttgtgaagtatgtagtgatcgtannaatgctattttaatttagttaataaagatgacacacaccggtaagaaaacatggcgaccgcacgcccgacgcccgtgagaccagacgtgccgatgtgcttgtttatattgagttattatttcatactaatctcncagtaattctctttctatgcgatatccgatgtcttatcgtacattaagnaagaaacaagataaagaaaattattcagcggggttagtcattatgatattgaatcccacagagcgactgagnaaacaggagaagangagcnagagaagaaagaggatttgttatattataagtgnnnntttntgtgattagaatatttataagatgtnattatgatagatagtatnaatagttcgatgtnaataggtgaggaggtgatgtatagtaccccagtgcgtatatttgtgatgttatgntnnttgtagggtgtagattgactaatagatggagcgngttgaaggagtagatggtgnnnngatagagatgagtgatatgnnnagtagacgtaatggaaagtaatgagagaagtgagaagantatagtatacatatgtctgattatcatactctatataatcgaggcgaatgtagtacacagccgagtgtataatagttataggtagagagtcntatcgacgcgccactataagctcgcagtcagggnttctacgcgcactccgatacgtgctantacacatatagaagatctcattcatcaatccacacagataggtgntcaacacancgagatacacaagtatcatgtatatatacatataattatnacactcagcaaagatactgnacagtagtttcactaggaacaacacgagagtgncctgctgatacgatacngntcagatgcgcgtagtactgtgcagtagtgtncagccagtattaatgtcgatagaatgacgcactctagatgaatagtatccgagagtagaagaagc

SEQ ID NO: 5999 - DNA, 1819 bp, Homo sapiens
  misc_feature (1)...(1819): n = A,T,C or G
cagtctctcgccatgtgtcgcgccacgcgataatgtacaangagcccgaaggcgcgagagaggccctcgcgngngcgagtaacaacgcggacgcgagaganatctttaagncaaggacgagaacgcgcccagtcggatggtggacgtcacacaacctagtgagccagtctcgcccccgcgcgatatttatgcttggtgacaaacggcaggctcccactcccgcggcttaaacgggcatacacagcgcccgccagtgactgtttgagaccagaaacactactcccgtaaatctatcatgtcgcgaccccaggacttatccgcccaatagatagaacccccaggagtcatggccaacccgtatcaaattgtggcagcgccgcagcacgccccggtgtggtgacgcggcgtagtcagatagactccgtcgctngagtaacacacagcgcgcgctacgatccttctcatagtcgtgtagtatacgtatgcattcatgtctcgcacgcaagcggcagtccctctccgacctctttntagctagcgtcgangcgcatgacgactgtgcgcggacgatgggacgcaaagcgagcagcagatggtacgctgngtgcgcagcgtctccaccagtggttatgagaccgtgcacacccgctagtgtacagcgacggatantgatantagtagccagcgggctgtgatagtgatgacctcatatcgccgtgggttgattgtgtcntntgtccagcacacactgtctctgtccgcanacgagcgtgtgcgctcgtgttcgcgcatgntctatgcgactgctggatactagtgaatagcaaccgcgcgcagctacgtgcttgttagtccacgacgcatgactaggagacgtgtgactctttatgtcagtctccaatcgnatatcacgcgcgagacgcgtcgcgaccagtgtcagangncagtagagatatatcatgagagcgtgcgtgaaaatattagtagtgcgtgnacgacactncttggtccaccgattgatttcnagcagcggagtaggactccgtgtgtcgacgtacttatgtctggngtgctacgncacacattgatctacgacnctgcagcacacgtcgcgtgatatcgtgagtgtgatagagtgatcgactgttgaatgncgcgagtgcgcncgcacgctctccgacgtgatgctgactacagtgtctcatcngtcagtgtggcttcgatcatatacatgnctcgancgtgtacgtactgntgatgangagnagacgngcgantnagtgaagtcatgcagntcgagcgatgatgatcnacgcagacgacgcgtagttngcantcntaacgtcatcngaangctacagnangancggnantgaccantcgangncagcatcnagtagctgctgctgacgagatgtcannggagtgnggtgcatgnagtgctgcngcagacgtagncngttggcagtcntacacgtgngtgatttacgtgcgntatgatactgatgantctaccagcgcgaacantaatntaantagaccgacacacacnacatgttgtcncggtcangtagtgnattgtcgtcatgatgtgtnatcgtnacntgagcatcgncgtgccagatccgctgatgtcacaccagtgtgttgttnagtgtcgngacggctncgngncacnacgacagcncgnctncgatgatangncgnacagngcaantcacgatgtacagcatnagtagtggcccagcngtcgtcacgtgctgagctgacacncgtcantgctaatgatgttcacntcatggaccgcccgcgacagnag

SEQ ID NO: 6000 - DNA, 306 bp, Homo sapiens
gcagacatggctgctggatgccatgtgcatgtgcagaacatcagcaaatggacacagtgatcctgaattgtatgccgtatgcagcggatcacctctagccagcacagcacttcaactgacaagcccagataccacccacagtcaccagcatgcagagactttgcttttaacatgggagagacggttctccatgttttgtctttaagccccttccctgaacatcaccacctggagcctacattctgtgctgtattggctccctgtaaggcaaacgttcacactcaatcttccaaaaaataaaaacag

SEQ ID NO: 6001 - DNA, 807 bp, Homo sapiens
aatctgtgggatctcttagatgtttcctgcaagtgtcagattttgatgtcccatgtgaagtcgccaaattgaaattcatggtaacagcaaggtaacactaagatgaggagagaagcaaaagagctgcttttgaatctgaagatagaagcagcaaatcccatggggatcctgaacaaggaaaggagaccctgcctaatagcttccgaggtggcggccgagtatccacagttgggggactggagagagtggcatttccttccactgagtctacgacacagaagcaaatcgagtggctttttctcaacaatttcagatctatgcaccccaggccctggggagccgcccggaaggagcatgagctattttgacttggaatgcggcaagctaggccaaggaagttggagccaatagatacagtgttcagcaagacacccgagagagagcatttccctccaaaccaggcctgtgaggaaccaaaggaggaagcagcatagtggaccatctgcagcacgacccctaaaagtctgccctatttgagtggttttggaggtggggagggctaagccatttcctagaggaaaggggttgacctggccattggctagaaaagggtttccctaacttgcccttagccatactgaacccccgcagttaaattgttaccctccagctgcatggaccccttttttgatcctttctttttccctagaaacagtcccagattttttgcccctatccaccccctggacttctgaaaactgtttaccattttcaggctttttaacccttttatctcacgctgggcct

SEQ ID NO: 6002 - DNA, 781 bp, Homo sapiens
agacagagtttcggcatgttggccaggctggtctcaaactcctgacctcaagtgatccacccacttcagcctcccaaagttctgggactacaggcgtgagccaccatgcccagctgagactccaattctgctcaggatgacaatggactcaacaacaacaacaacaacaacaacaaaatagctgtgttgcccagcttcctttgcaactggagtcagctacaggatgagattcgggccaatgacatttaagaaaaacttcttgttgcacttccaatgatccattttaaaaggggacagattcgtgagcatatgctttctgcctcgagtccagcgtttctcaacactttgggccagacaattcttgctctggggtttgccctataaattgtatgatgtctaggcaacatctttggcttgtacaaattatatgccaggagcaacccattgcccccctcgggatgttgtgacatccaataatgtgttccatatattgccaaaggtgcccctggtgggaaaatcacctccagctgagaactactgtatgaagggtttcgtctgatcctttagggagtgccgatccactgccacaacgccacgcacgctcgaagaacggccagggacagcttttgaataaaaatagtagtggtagatatgtgcgatatatattgtttaggatttactgggctcttgttgttaccacttaactgccatgttttgagtctgcttatttctctcatctcggcgctagggcgcacttaccttttatgtagatgttagacga

SEQ ID NO: 6003 - DNA, 579 bp, Homo sapiens
attaattccccaccctacacagccctatccgttcatcaaaactgagctctggtaccatcttctctgtgaggacttaccaaatgccacatactcccctccctccgagaaaagcaaaaagcacatatgggtagtagaagttgccaacactgaagagaagattaacaaatgtgagcatcccaatgggacagacaacatgttcagaccatccaaagatccaaagggcaggctcgatcactccaattgacaccatgtacaagccaggaaatgcaggggttcaccctgaaggaccatgcccacaaatgggtggtgatatcttcaaaacaggaaaaaactggggtggctgtaaaagaaaccgtgcgggtgcccaagcttgcaacacataaaaaagaatattgggggctaaaaaagggaacccaaggggttaaattggctacaagggaaaaacggggacgagaacagcgaaaatgtggggtaataagattgggagcgttaaaaaaaatggagtggttcttcacgggggtgaccgcacggaataagccgacactccaagttggggaggtggagaaaattagtttatag

SEQ ID NO: 6004 - DNA, 796 bp, Homo sapiens
caaatattaaattaagttggtctgcgatttgcacatacttacctacaaatacaagtaatggatcccaggcctaattgcagtggactaataactgtttacttactgaacttggagtgaaaccttctgacagtgctgctgaaacactgcctactttggtttgaaattcacctgggtttagtgacgtatgacacgcaggccatgtgaggacacagtgagaagatggacatctgcaagccgggaagagaggcctcaccagaaacagagtatgctggcaccagaatcttggacttggccggtctccaaaacaagtccttggggagtcctggttctgcatcctagtccagacaattatgctgaaggatactcctgtgtgtggagaagttaaatctaatgtggcaagagtttggagactaggggcggagatatcctcaaggagttccattggaatgctttgacccagagggtgctgggagtatgtaatgtctggttttgagtttttctcttctttttgatatgcgaattctatattataatatcacaaaggtttaagtaaaatttagctttatgttacattacattttggggttccttggtcttttgagaattaaggaaaaagccttgattaagatgaccaacttctcctggtttgcctgggatttccaacttttgaactaaaaattaatatttccggaatccctcaacctgaacaatcaaaatggtggctactttggtgggagggccactaggataatttgggggaaaaagggtacacctggaacgggttattaaggtatta

SEQ ID NO: 6005 - DNA, 287 bp, Homo sapiens
tgaggccaacgaggccaggtttttattttttttttatttttttttttttttatttttttttttttttttttaatagtaaataagtaattttacttttcattgaagaaatagttcatataagcattacataaaataattacattttaatatgcagtcataatatgcgtgtggacaactcattaaaagaagagaattatgtacaaattcaggttatttccaagggtgagaggtgagttgtttcatgcttctaactccccagaaagcaatgcaaatggaaaaaacaatct

SEQ ID NO: 6006 - DNA, 970 bp, Homo sapiens
  misc_feature (1)...(970): n = A,T,C or G
aagtaagaagttaattaaangtaaaatnnnnttccaactaanannnanaangnannngntttctcttccaggagaccgcggtgaaacaacgttctacctggccgcttggccttctcgtggatcatatggaacaagctgcgcattataccaggtgatttcacgcacggcgtatgagagtctatccctacactaaaaggggggagcccgcgctgtcacctgcgttatttaacacaaacgaggggtgggaagtctaatactctccagggagcactccttaaatcaaaccactcggctgcatgaggtgggggatagtgcatcccgaaaacaaacaggtgaccttccaaaaaacgatttttatcgggggggcccccttaactggccgttttagctttgtcccccctgaaacaagaaatcccctaacccctcgctactcatcgttagaaagacgagtggtgggcccttttatgaacataaccttttgcgaaaaaataaaatcttaacatgcacctcttggaaaacaccctgtatttgtcttgctccacaccgcgatgcccttactcggaggagagagcgagccctcagtaaagccgtcccccactatgcgcgtacctcgcactcctcaatagaagaatgacgctccctgtttcattccaaaaacatagtatttagtcccccacgaaccaatatattgttttcttttgatcccaaccgcaagccctcactacggtaccccccgcgcccaccccgacgcttagcgtacggacaactcttatgcacactatcggcatctagacggaccatcctcctaccactccaggtcttcaattatcccaagtaataaaatacaaacagcttcggtaggtaccacgcaatagaaggcgctttttccaacccatccgcccatcctagntagtattacctcgactaaatgtaataatatgttacatttccctggtatcgcggatctatt

SEQ ID NO: 6007 - DNA, 1769 bp, Homo sapiens
  misc_feature (1)...(1769): n = A,T,C or G
tgactacaatgaacagtgtnatgcgcgcanggatgtgnannttnnnntnttcggacataactactactgacactcntctccgtcggcggaggtcgtatctgncgcactagagacaacatcaggcgacncnancacacatacgacaaccgtctagcgtgatgatgtntggtatcttatcatgtatcgtntcatctatggtaagctatgtgtgaatgtacataatagatatcgtggngagtgagaacttacattcgcgcagtgtnggagcgctggacacgactcatttgagtacaggttaatagctatcggacgacgagatggcgcgcgnacgcgagcgacgatacgangagagtgagaatacatgacgatatgagtgagacatgtcttacctcgcagctgtggtgaagcgcatcacatactagaatattacaaaagacgtgcacacacgctgagtagcgggagcggccgnaagactgcgtcacggtgccgtaaatcacctgagagctacagcgccgcactcgtagaaagcaggcacgcagctatattgtttacncgcgacggtggtgccgctcacatgatatagtgtcgatatcgtgggagtgtcactgtgagatgtctgtgagttatgatatctcacagctgacgagtaagacacgcattgcacgaagaatagtccattcacacgcgccgatgatcgcaataagagggtcgtcggtaggagnctcaatacgcacagctataggttatcagactctgagtccctcagacgcgcgcgtatagcagagcaactatcgtcctcaacgtgcgtttcaatcattcgtcacccnatcgtgatagatagaagtgaatcgagtggatgcggaggcagagaatgaagagcatccacgtgtttatggaccaccacacgcacctggtatctacgaccttncgtgtatatgcctctacttacgcggttgcgctcccagcgggncacgctgttgtgattagcactctcgtnctttatctctcacaatgaagagtacaataaccattggtantatagacatcgcatactccgacgtcttgntagctacgacgctgcattgataggtcgtatagggcactctactaganctgttactcgctgtagcatcgancgagagcatgagtgatatagactgcacagcgcgcattcctacgtgatgtcacgcngtaagntgtatgtgacgtctcgctacaccgcgngntgatgttcaacgacacgtacgcgtcgcgtgaagcacgagctgngtctngtaatantaggtctctacngtactagctcatgctatcttcgcactgtgtacgcaatatcgaantatatcgcagctacacagtanctgcatagaagtcagaantgcgtaganctctctnctctacgtcaacatatncagtgcagatcgctagtcgcatcttcatatcgcgtngtcattgcagcactctgtcacactagcgtgtangtaacgtgtgctnctcaccagacaagctaaggcagtcgcatgtgctgacagtcgatattcgacgtctatccggagatacggagtgagtcgcgtcgncttagtntctcagtctgcancatgagagtcatacacctgccatganctagacgcgcatcgagtcntcaccgngacgactcgttcgtagtgtcgcntcgacgacacacgngcgagcatgagagctgntgagtacggtcctgcgctagtagatgtagagagcgacacgtactaatatactatgcgcttatgtgtagc

SEQ ID NO: 6008 - DNA, 875 bp, Homo sapiens
  misc_feature (1)...(875): n = A,T,C or G
gtgatctggctctacatggtgagcaatgttataagttggtggtgcctatatgttaggggaagtaatctagatcttgtggagattgtgactataaacagtgactgggttgcacttaagagttattatccgctaatggtcacggccaaggtagaattactctgttgatttgtaccacgtaaggggggggatgtttcatgaaaagtacgggtctattttccaacggaagcaatttggaaaaagtgggggaaggtaacaaaaaaaaattttaatggtgttgaatagagggagagagggaagaggttaataaggtttggataattatagtgaagatgagggggaagaggggatttatattatgtaaaatttgtattaaaagaagaatttttttttttatttattgaaaaaaattgattggatatgataaaaaaagaagaggggaattttgggaagagagagtagttttggggaaagggttacaaattaaggggtgaagatatttggggcttaatgaggacggggatttttgttttttgaaaaaaagtggttttttggttataaatgacactttttttggatttatataaaaggaaaaggataagttttaccacccccacaaggaagntagctgttaagtagatggaaagtagaataatgaggtagagaaagggagaagaggaggaatatttgaanantgagaggattttagntaggggtggtaagagaggaatagggnggttgggtaggaatattttaggagagggtccctttcccantnnatnaanagattttggatcaccgtacatgctgttgaaagccacttctaggattaaaaaaaagaggggcggcggccnncgttgnnnnntatttattttttt

SEQ ID NO: 6009 - DNA, 1480 bp, Homo sapiens
  misc_feature (1)...(1480): n = A,T,C or G
atcataagcctctcccagtgccattgctcgctacattactcgatccactcgacgggggggggggttatgatatcggctaatggagagtggcctttagacaaagagggcggctcgtagagtgggcattgagtatggcgcgagagatgggggccgaagcaggtcgagcggatatacctgttccgctccgagatcggctgccctccccagtcgcgtcagcgatgtacaccaaactgattgtgtctttcattctaactggatccgagtcggagacgtctgctgtcatgcatctgctagcccgatggtcagtcaagccagtcagcttatctgtgagtaatgggccagtgagtgtcgctattacatttcatacgtactgtgtgtgcgttgtcggggcgacggcgatcggtgttctatacgatcttgcgcggcgcgacgtctcaccttcgtagagttaataataaatgatccgataagcgtttatcgaggcgcgacaaagcgcttcaccgacggggttctggtggtgtaaataacggagcatatgaggcgtgagagaggggtgggaagataagattatcatgcacngatgcactaatgatccgcgcgcccaacggcggggcaaagtcttctagctaatctcggcgtgtaatataatgggtgaacagaagatgcgcagtgagactgcggagagtgcgcgcccgatatagtgcctgatnatacgagggagactcgcatatcgggatccgcagatatacactcgctggcgtgtgtatccgatattggcactgctgcgagaatattataattctgtcgcgcgcatatatggatggtcgagattctgtacngnggtgcgtacgagactcaccgcgcgcgagnaagagacgtacgtggaactgcgtgatgcgacatacataaaacgagctgctgactatcgctagacgatgctgacatgtgttgcggtgcaagnactgatagtgtaganttgcggagataatgtgtctacgccggcacctcggcgaatgttgagtgaacgtagtgcgtcgacgactggcgtaactagcaatctgtgcctccgtgtagagagcgcattatgtgtgcgtagtagcttgccttatcctgtgatagaagtcactgcacgcgaggtgctgttatatttccantcacatagaccggtcngtacaccaccatagtttatgctcttctatggaacagcaacgcgagtgagcgcggacgacgtgcgcgctatcgatacgaccagcgacgcctgtagtgagcagacttgcgcgtcagcatatgatatgccaactacgatactcatagagtgctctatngtctgtctcgcgagtgacgtggtgctatggctatctatcaggctagcgcgaccgcggcntgaaaatctgcgtaatctcagncggcggtatactggcataaagattctcaactgacaatcagttatgcggagagtagtcagtaattacctcagctc

SEQ ID NO: 6010 - DNA, 1876 bp, Homo sapiens
  misc_feature (1)...(1876): n = A,T,C or G
tagatgtgtgtctgtcacgcgngcttatatgtgtgtatatctcactatgatatgcanaattatcaccataccctcacacgtccatgtagatcactcacacacagcacgacgctcacgcagnctcatgtagtgantgtgatctaagngtgcagagtnacgatcgcacagaggtgcgngcttcgtacctagcggtgaggtgtcacacnacactaaggtcgtagtgtgcgcgtgctcaagagcactactcagcgagcgcgtgtgacagatagtacgcggacgtatcacacatcgtgactgtatcgtgtgcacacgcttcagcggatactgtacacantgtggtccgaccgtagcgtgtggtgagtgtgtgtagcgacttcgtacaagagntntgacacgcctatagctcacactaacagcacgacaactcagcagtacacttagtagtatgagagtacgacgcaatgagatgtagagtaccgatacaggtgtcgacccatgtctgaccgagngtctctactaatgttcacgccgacgcacncatacatatgtgaggtgatgtgcacgcatatcatgactacatgcctacaagatgatgatgagatcaacgatgcgggtcggagcgnatgctggtaactactcaaaacgaagtattactccacatcacatatgttgaagatcacacaagagtgngntaacgaatgcggaggtaaatctattcaaccacaccaacacgcccacacatacatatacacggatgtcatagtctcacaagtaaatccgaatgattgtaacacgagttgtctgatacaganactccaacagtgtgccacgacgctgagcgatccgcgcgtgtgcacataaatgtgtatgaatctgtattcacgagcgtagcatggncgagcgatgttgctatnttctggtgtacgttgcataagaagagctacgacgcgagtcgatnactantgtgcacaataaatcagagatntgtaccacgataacangctctctataatctacgtntatatagaatgctattcgcgcganacnctcatgtgatgantaggtgacgctgagtactgcgtncaggtcgtctncgtcgcggtgcagnttgacacgcgcactcgagagacatgagcaagcagagtgctagccagtgatcgtacatgtttgtctgtgcacgcgcgcaccagagtcgctcagaggaggtctacgcgtatcacgcactataacacacagcgatagacattcattgtngnttcaatcatctgttatctcttcncacgcgcatcacgcactgcagcggctcgctagacggtcgtttcaccanctactaccgatatgcttcagactctgcatagtgtntatgcgtagactcggcgtanctncatattgctcgcgatcacatgatgctgtntttagagcaatatcgacacggtctggcgctatcacgcgtagtcacactcactgacgcgtgnatactagcagcatacatactgtagtcagcgtgtgcgcgagtggctggagccgccgctgtgtagtgcgctagatacanctnangtacctactcctgttgtgtactcgtgcgcgctcatgtcgcagcgacgtgcanatccacactaggcctgcgagacgcggagagcatcagcgggctgaagctgcgtgagatggcacgcagagcgtaagacgactgtcttgtagctaccaatatccgtgacgtagtcttcagacagcacagatcgagtatatagcgtcatactgtatcgaatagacncnatatatgacgtctctgtcacgatcgcacgtgacggcgaccaggtggagcgtatatnagtggnagagacgagacgtgctggtagcacgacgtgacatacacacg

SEQ ID NO: 6011 - DNA, 626 bp, Homo sapiens
  misc_feature (1)...(626): n = A,T,C or G
tgagagagacgcaagtcggccagtcgatatctcantacacaccattatctagacagtgaggagttacagacatcgttcgtcgtctgtgctgtnggtctacgcgcggcgccactgtgctgcgcacacgcgagacggtgagagttgatgatattcgctgtgacgagggnggtgtgtcacgtaggcgagcgcacgcgagagggatagaagatattaccagaccgaccccggacgacattctgantactagtatgcaagattcataacacacatacgccgacatatgggtggtacgtcgtctgtctagcgtttatccgatactagatagtcacattgttgtgatagttaggtagtatcgctacatcgcgcctgcacgtactcaactcttacgtactcgctggtcatgcgtgttatcgcgctcgtcgctgatggacgcgacggctcgcatatgaattgatanggactatctcacgtatacgtcnatgagaagtgcgcgaggacacccgctgtgcgagagtgtcgtantctacnctatctcgtgtgcagcgacactactaatcactgtcgcngcgtctcgtancaagnatanagtactcatcatctgctcatcgtcgtagatactcngctag

SEQ ID NO: 6012 - DNA, 787 bp, Homo sapiens
  misc_feature (1)...(787): n = A,T,C or G
gtgctgtggctcagtctgccgtccactttatgacgctggcgcacagctacagcaatcttcccttcgcattgtgacgcgcgtgtagcgcancgctgacgagattgncntgctcttctgctctgtgttcgtcagtctcntgtgcncgctactgcgtgtcaccntacgccgccagtctcgctaatgtcgttatactaatcgctcaggangtcaagtcgtacgtacgcgcgtgtgacgttcgncgcatntncttccgcgctagcgtatcgcncacagatgttgtcgcgtcatcgtttgttgagcgtccgcatcgcggcgtcatgtagtgtgtagccgcncnggtcactacaccgagagcgagaggacgtatcacaaagtcagatgctcactcggtcctgctgcgtctcgtatagatatcacgcgcgtagctcgcagntgtcgcatgacttcgtcgtgtgcgacctgttagttagtgatgtatatatatgatgtgcagtgattgagtagtgtgtnagtgtggtatgactcgccactgcgtgntacttgtcagctggtctggtctggcatcggtgctatctatactaacacatattcgtgtattcgnttntactgtagtatctctggctgagtgtatgncgagtgcgtcacactctatcatggngatatgatctgcatatatcgtgattgtatacgatgtgtacgagcagcagtgtatgcggtagatatataactcatcattacatnttcatgagaagactcttgtgtantagctctcgtnagtntgtgttgt

SEQ ID NO: 6013 - DNA, 740 bp, Homo sapiens
tttcctactctacttccttcaccaatcactcattcatttctcgataattcatcacatacatattggacaacttatgtgttactgatttatcctgggtgcttgagatatgggaatgatcaaggcagactcagacctgggccattttgacctttcaaactttctaatgtgaaggtatttagaatgtaccaggaagaaaaatgacacaaccattctttaggcaatttgatatgtcatgagttactaaaaatgttaatattctaaaacaataatttactttctaagaatactttttttaagtatcggagctaagtaaaaaattctctatatttatgaatgtttttcagtgcactttacaacaggaaaaaggtcagaaacttcttaatgaccaaaaatggacattatcacaacatatgatacattcatacaatattctccactcattaatatggtattatagaaaaacattttcagatatggaaaaatgattttattatattgcttactacaaaaaatatgtacatatgattctcactttgtaaaaaagtaaaaggtaaatattgatacacgtgtgactgagcctggaaatacatactttgaaatacttttgggtgatattttggtgattcctctttgtgctcttctctgccctctgaattttctacaataattatgtattcctttgtaaacaatagaaatatccaatcaatataaatattacacatcaaaaaaaaaaaaaaaaa

SEQ ID NO: 6014 - DNA, 450 bp, Homo sapiens
caagttcagctgtattgtggaaaaaaggatttaagcaaagattgaacctggtgaaatgcggatagctggtccacttgaggacattccatttcttcgcttctccaatggagcaggtttctgcacgcagctcacatgcttatatgtatggtggcattgcctactctctacccagttgtcccatcaactccctacactctacaccactgaaatctgtgcaaacaagatcaagctactgatcatcttctgaacaatgaattcttttctgacagggaaggattgttctgcaactcatgcggagcaccaagggtgctggagactcaggtccatagaacccagctttaccatacggatgtgcatcataacactgtatcatgataatgcaagactaaacacctgacttgatgcccagggcaatgatgctgtggttatcaaacaataaacctagatgcg

SEQ ID NO: 6015 - DNA, 688 bp, Homo sapiens
  misc_feature (1)...(688): n = A,T,C or G
ttgcctgactgcacgtataagatactccgaccaccgggtagggattaacatatggacgtagtgctgctatgaatattgtgagacccaagctaacgcgggtgcatatttttctgcaccatccctataccttcgagatggcttaactacccgatcaagaactctcgcccacaatacattatattcccaccacatcattcataaactaatagaacataaatcactatatcactgaatttgataagtaatcccccgttgtaactcacaacgccaccccgcgcttcgaacaacacccatcccagatagaaacaatttacacancaaaactacagttataaggaacacacacgacaatacgcagatcagcgcggtgagtgatagtgatacggcgcacaaatcagacttacgattattatatgctgctgacactggcaccttccaatattacttatagcgtctgtgtgtgatgttgacaggtatgactcgaattatgagcggtagtcagagaacgctagaatcagacgccattattatatcgtctgcccatagcgtctagagaagacgattatgatgacagaatgtaatataccgtaaaaaatctaccaccaaatataatgttatcaagaaacatgtcactcatagaaataaatatatcccgcgaccacacatagaccttagaataacttctaag

SEQ ID NO: 6016 - DNA, 660 bp, Homo sapiens
gagcaagatggggagcgtcagaaacctaactccaggatttgctgggttctccaaactgtagcgggaacctcactcccaggccgatgcccctctagcgtctgcagctctgggccccagggagggaggaaggagccacagagggttcggacaacagcactgactgatgccagagcaggactccattctgttaacctgacaaagcgcacaggctgcgccggcatgtttttcttccactttctacactaatttatcaaactggaaggaagagatcagaacatcaaataaaaatccacagccacagagcaattaactcaagacctagcatgtacctggataaggggactcacaagaattccggtatctacaaggttttaaatggcaatgttttctaactttgtatcttgggttattggtcgtcaatgtttccaaaaataatcactcctctcagttacattttctgatcaattatggaatgaggtctgcgttatacaacatagatttcaccgagtggggaaaactcatgctcttgagtggtcagctagaaagctggcaatctttggtaaaaatgcaaatttttggcctggcaaatgatgcttgctgggttatagggcattataaaactagatgcgggccgctcctttaagggagggtaaatcaaga

SEQ ID NO: 6017 - DNA, 292 bp, Homo sapiens
actgggattcagaccatgagctcctgcctttggacttcagttgagttacaccaccagctttcctaggtttctggcttgcagatggcagatcatggaactgctctgcctccatcatcatgggaaccaattctttgtaataatctctctcaatctcaatctctctctctctctctctctctctctctctctctgtgtctctcccctcccctcattggttctgtttccctgaagaactctgattaatatagcacacttattaaaaatgttttctaaatgctcaaaaaaaaaaaaa

SEQ ID NO: 6018 - DNA, 219 bp, Homo sapiens
  misc_feature (1)...(219): n = A,T,C or G
cctcctcggttgcaagaattgaagaaagctctacttcccagatgcaagaccatgccgcgaggcttatccagtactccagtttcagacatgagagcaaatctacccaggactagaagccatcatcctgagggacatctctgcctcctcaccctctctgatgtgaaattaaacttaactattgtccnnaaaaaaaaaaagggggggggaaaaaaaaaaaaa

SEQ ID NO: 6019 - DNA, 800 bp, Homo sapiens
atgaaaaagtatacgcaaacgaggatatagggcgcgtacatatcaattaattatcagtcaacaaatatatcatattagtaactataactttaataattagtctctagaggactgtagataatagggcaattaaacagcaaaatatacatacgatgggtatgtacaagcagacaaacatacatagtcaaaagagagtaaagaattgatatagaatgaagatgtgtggagtctacataaaatcggattcaatacgagaaggagactagcaaaataaaaaaattatcttcaaacggtatctgtaagtgctgtgtatgagaggagagaaagataaaataggatatgtaagagtttctgtatacaaagaccaggaggtgttaacttggaaagcgatggacaatataggattaacggtatactaaagaataagagaataaaaagagtatagcaaatcatactaaaaatattatattttcttttgtcatggaaagacatcataaggcgagggagaggggtaatttttcacgaagacggggacgagccgggtgagattagcttataaaggaaatacttcttctattgaagggttaagtgcccgtccttcggtataaaaaaaaaaaaaaaaaagtatgatgggcgtggcctcttcgttttctaaaaaaaaaaaagctatttttttttggggggaacaaaaaaagaaaaagttaatatttgttgtgtttttttgggtagggggagaaaagatatccccccccccggatggttgtttattgtccccccccccgtggaagggggtggggggg

SEQ ID NO: 6020 - DNA, 1520 bp, Homo sapiens
  misc_feature (1)...(1520): n = A,T,C or G
ccttagtttagatgttctaatgatgcagtgcatcttgcgcgcgagacaaattggcggatcttgcttgcgcttacgcaacgttgtgatattcttttatccacgcgtcgtcgatccttgcgaaatcgcgttgtcatatccgcgtcattgctgcctattcatttggtcttatgtttgttactgtctgtgtagcttgttagtcatgtcgataaggctcggagggagggatcgccgctattgtatgcataaccgttctagtagatgacgttcgacgacattggtcaataacttgacaggaagtcgattagctgttgttcgtaccacatcatgcgcccagttcgaagctgctgtacgcgccggccggtatattgcagttgtctctcgccgcgcctgatctaacactgagagcctgcaccgccgcgtgcggatgagtggtgcgtagtcgctcgcaccctacgcaggtggntagcatgtacctactatattatgtcgagacgacgatcgagattaacgacagtcgtgcgtcaacacagtatgtctagtccgacgatcccacgctgcgcgcgtacgatgtggtgtatcgctgatgctatcgtggatatcgcgtgagagataagtggaagcggtacgtcccggtctctgggatccgcaacgtcgtaatcgtctactcatgatgttgccaaactagctcgatattatgtaccgcacgcgtcgcaccccacgcgcatacacacgccgacntattctattcgcactatactctgcgatcgacgcatattacagtccgcttgtgtgcgcgcgcccagcacgcgcaacgcacanccgctcatcaatatatctcacgtgattatataagtcgantctagtcacgcgtccacagctgtcntcgtgttcacgcncacagctagacatatgacatacgtgtcagcgacgccgagatcgantcacagctcgcgatctcgcgcgttcgtgntcattgtgagtacaatgctctagatcgcatctccgcgctcatcgcgtcgcacgcgattgatgagatagagcgcccgtcagacatgccgtagtccaccngcgcgtagatagtgaggcgcatggtccgtactgtcntcngatgccgtactatcagncgtcgacactatattgctntggatcgtcccgtcgtcangntacgagtacatcagagctcatgtatatgtgtatactgcgcgctacgcgcgatatctctagatcacatagcagtgtatcatattgttatacgatgatgtccgcgcgacgtgcacgtgtccgcggncgcatatcaattgtacctatctctgttctttgttatgccgcgacgtgatccgcgcacccncgccntgtgtgcgagatgttggtgcgcgcaatgtagagtgttgtcgtagctagtctccgcgactgtctatctatctctctntgatagacgtcactctcaccagtcctgcctatatacatctcctctccctcataagtcatgctgtcgtcggtcacatatcgtgttagttgct

SEQ ID NO: 6021 - DNA, 1060 bp, Homo sapiens
tctacttctacccccactgcacactctctcaacgataccatgagccggtagcagtggcctcttcgccacaaccattcgacatcttcagtagtattcggcaccgcgccaacttctaacaacaggcgccgcaacagggacaccaactctcgtgtttctccctcacattatatataataatatctccaattccaacaagtcacatttttttctttatcacatattttatcagatgcgtctccatgcgagcacgtgtgtgtgtcgattctgtcatctcctgcacaaaattgttctcgtttcacaatcctcacctttcacacaacccacacagcggtgtatgagccacgtcatcgcatacgcggcgcacgctcgccgtgtaatgatgtatctgtatcgcactaatataatcgcgaggtgacacacaacatacgatggccgccagcatgacacgtagttcgtctctccacgctcccatggttaacccatcggtccctgccgtcgggtgcgtgcgcaactcgcgtaagtagtatatctcatcaccatcctgcatcagtcccctgtatatgttatgtgtatatatacttacaggtgtccacaccatctcctagttttgacccacccgtaatgctctctgtgtgctcgctaacctcaggggtatcgatcaccactctgttctgactcctaactacgagctacgacacatcagtgaagtatcggtcctctcggaacaagctcgctgcaagacgcgaaggttgccgaacagaggtaactattctctagtttttccatcttgtgttggcgattgttacataaaaaatttattgttcttgtacggtggtggggcgggtgtatattaaatataaatcaactctacgatcactaatgggtcacggccacacctctgtcaacttcttaatttacatcacctacatcatctcgcggttgatctcctctccacctgtctctcttccttcctcatctctctcttgaaaaaatgtgatgttaataaacataagaacctgatgtggacaacctcgataaatctgttttacgtcatcgctgc

SEQ ID NO: 6022 - DNA, 787 bp, Homo sapiens
atgcatatcctccaagttgacagtccctaaagcaacccaactttcctttttctatgttcattgcctaattttttaggctatttcataagtatccttgtgaattcactatcaacattcagtatcagtgtgacctgcactccactgcactccagcctggacaacaaagtgagaccctgtctctaaaagaaaaagaaaatgggagtggcgatatgagtactagttctttgtgaaattaatatggtgaggaaaaatatctttctcccaaaaggctctataagaagcatgtctggggagacctcaggaaacttacaatcatgggcaaaaggcgataaggaaagaggcctcccctacatggctggagcaagaggaaatccaatcggggagctggtacaccatcgttaaacaagtggaccgccggctgcacccacttcctatcccgagaacgagaagtatcatatccccccctcctggtgcctgcgcagagtctcgcgaatcgcgtgttgacaaatgggggaataaggacggggcgttggattgaggtgcgggtcgcagatgacgaagcgtagcgagcgatggggcgtggaattaagccgaggaacacccttagggatcgtttgggtgagtgtttatagaaagagtaacggacatcaggtagccacttactgtccagatggtgggattgagccgccaactcgggcgaagctgagacgtgcggaaacaaggtaaaacgcgggtgtgctgacctccccgtattccccctgaccgaccaccctatctcgcccgcgag

SEQ ID NO: 6023 - DNA, 810 bp, Homo sapiens
ctcataggtggaaggaactcatctccagatgactcttcagactgtggagtttgagacttttgagttaagcctggaacaagttaagactttggggaactattgcaaaggcacgattgtattttgaaatgtgagaaggacatgaaatatggggggccaggagtggaataatatggtttggatgcttattgcctccaaatctgatggtgagacgtgattcccaatgttggaggtggggcttagtgggaggtattggatcatagctgtggatctctcattaatggcttagtgttatcatcttggtgataagtgatttctcgctcagttagttcatgtgagatttggttggtcttaaaagagtgtgtcacctccccctacctctttgctgctgctctcaccatgtgacatggctgctgcggcttcacttctaccatgattggaagtttcctgaggccctgaccagaagcagatgctgggtgttatgctttctatacaggctgcagaatgatgaaccaattaaaccctttgtttttaggtagatgtgaggtgtttgtttaatggagaggggaaatggccttacaccccttgtgaagtgggcagatttgggaattgcgagctaacgtgagactgggtgaaaggtgtgtatggcctgaaaaaaacgcagtggacgtgggtttgtgaattgcgaaattgcgggaagggagaaaaaatggtggggggcccttggcgttgagggtgggtgaatggtatccgggtgttgcgcggtagggggataaggcaaggaggggataatctcagaccttcagtccggtg

SEQ ID NO: 6024 - DNA, 822 bp, Homo sapiens
gagccttatcatcatcaaacctaaaatcctcaacatactgttgggtgaggggttgaggaatggagccatcaaaaattgccttttctacctgctggcgaggccagccttatctgatctgtaacatagcctcctaggacagtacattgtgtgagtccttcttctgggaaaatgctcactggtgtattaccactccaaaggcacgccagggcgagcttcctccttacagaggcatgtgcaatgggaatccattctcactcaaaattgcgatcaccgtactaacttcattgaacatgcgtggcttgagaaattttaggaaagcattctttttctttaagaggaccctggttgtagtagggccagaaccccccccccttcctgtgggccacatactctttcactgccttagagatgggttgctgcctacgggccgacgaaaatgttctgcctctgagaccaggcaaatgaactgctgcttcccagttggcggaccctgggggcttaagagcctgggacgcgcggttgcttaacttaggtgcacccctgcatttggtgcctttgggggtgaacccgtttactggggtttgaatccctgaaaaataacggtggagttggggttgccttgccgcagcacctcctatggagaaagaggtgcgcggcccctcccaagaggcgaggatgagcgcgttgggtgcccgaccgttgcgcgtgggtggggtttgctgaggccgacgcgatgctggagatgagagcgccgtgggccaccgccgaatggggggctgaggcggggtaggatggcaggatggccgggacacgcgtggcgcg

SEQ ID NO: 6025 - DNA, 834 bp, Homo sapiens
tctctaatttccaccgctacagaaatgagtcactaaatccagcccacgctcagaggaaagagaattaagcccgaggttttggagggagaagtatcaaatactttgtggacacttgttaggaaaaacaccactgaaattagatttaattgcaattgaagaaaatgcatagatgaagagactctgatttaaaagttttgtgttggcgctggaagaagtgaagacttggggggctttggtgatgtcatgaatgtattttgtagctcattttctcttgctgccaccatgtaagaaatgtcttttgcctcctgccatgactctgaggcctctccagccatgtggaactttttaaacacaggactgtgaccggaattggtgggttcctggggtgactgacttggagaatgaagcccgtggccctgcgcgatggggggtgggttgtgggggacaagctggagtgggcatgctagcgtgactggaagcgcagcttgcgagaagctggcattggggtacctcgggtgtgggggatgggagaaactggggggacccggggacgcgggggggggggtggggggggttgggggggaggggaaatggggattgggggggggggaaattgcgtgctgggggtgcgggcgcgggggcgggggggggggaaacggtgggggggatgaaaaagggggggggagtatgtgggggacacgcgggggagtggggggaggggggatcgggaaaggggggggcgaggggggtgggggtgtaacggaagagaataaatggttgtggtggggtgggggggggcaaaggggggggggaaaaaggtgggggggcgggggg

SEQ ID NO: 6026 - DNA, 847 bp, Homo sapiens
atacaacagatgcgccttgcacaacttgctggtgtacacacctgtgaggcgacccccccactcacctcttcccaaatggagaaccctccgaggccttccatattggcttctgccccaggaaccctcacagacgcttggtctgattgtgcccatcatgaccccagcttcctccccaatatgtgctggagtggtatgcgatatggggggggccgagatgatgcaaactggactttcttgcggggtcactggtaagactcggggctgattggggaacggggacctgggctggggagtaggggacggaggcggaggggcgtgcaagcaacacgggggaccgcggggtggaggggggatgcacaatgtggcgaggactggggagcgagcgctaaccaagggggcgtgaactggggggtgggtgtgggtcttaaaccgaagggagcggggagtcaactgaatgggggtgcaacctggtccacggcccactttacccccagtggttggacataaatgggcaaaagggtggtggaccatgggtgtgtgatcgtgggtgtggggggcgaaaatggtcatgtgaaccgggaaagggggggaagggaaacagggggacggtgatgtgtgcgggcgaacacgggggaggggaaacacagagggggggaaccacacaccaggggtgggacggggcggggccaaaaggggggtaagggggggggcgggcgggaaaagacaaaccggggggcacagcgggggggttgggggatacacggtgaaagtaaggcacatggaaatggtggatgtgtgggtggtggaactcaaggtggggggaaaacacagcagaggacagtggggg

SEQ ID NO: 6027 - DNA, 812 bp, Homo sapiens
  misc_feature (1)...(812): n = A,T,C or G
tctctaattacaccgctacaggcctctgttccagtgatggcaaagatgaccccaagctgctccagactcaggtgccttactgcctatgctttgaaaacgacagagagtgttcctttcacagaaaaccctgtggccgggtgtggtggctcatgcctgtaatcccagtactttgggaggccaaggtgggcagatcacctgaggtagggagttcaagaccagcccgggggatatggagaaaccctgtctctactaaaaatacaaaaaataattagccgggcgtggtggcacatgcctttgaatcccagctacttgggaggctgaggcaggagaatcgcttgaacctgggaggtggaggttgcagtgaacccaggtncaccattgcccttcagccttggtgcacaagagcgaaacttcgggtgcaaacaagaccaccacacctaaatacacgcctggaaaaatctgcaaaggggaaatgaattacttgatcctgttacaaattttaaaccatgggcttgccctagaattgctatgtgaatggagcgggtaggctttccttaggcgtggggaggcgtgtaactgggccaccaagcttgatggggggtagggtgattttgcggtaaattgtggggtgcaagtgaaaaaaaggaggacttccggtaaccgaaacggtccctaggcgggtcacttgaggtggcggggcggaatattataggacgtttggtggttcaggggattacttgtgggagaagatgcgtcggcacatagaggtagcgttctaggtcaggttggattgaacattcgtgagatgtggg

SEQ ID NO: 6028 - DNA, 139 bp, Homo sapiens
ctttgacttactgatccccctgccttggtctcccaaactgctaggattgcaggtgtgagtcaccacacctggccagaatagactgtgtcaataaatggtactggattagttggacacccacaggcgaaaaaaaaaaaaa

SEQ ID NO: 6029 - DNA, 815 bp, Homo sapiens
atgccctgctgtggggctgcactctcagaggccacccatcctcagggatcctgggattcaactttgagagcataactaagaatcaaacttatagagccaataaaagccccttgggaaactggcctcataccttctctacacagtccctgtacagggttcctgacctgtggctgaccccgcttattcctgtaaaccaaccagggaggggaggctgctactcagaagaaacaagaggtctgagtaatggaaaaatctggattggatcaatattctaatcctggacatatattggaatcaactagcaactctatattagcttggttcccaacagttgcccaatttatggaaaggcttctaatttagtttacatgggataattttccttattttagtatatggctggtggactctctgggtaggaatcgcaaataccgcttactcaatgctttctaaaagtgaatggcttatcactcttcgcagatttcacctttgtgtagaacttaaggagtaagatgggcccttgcctacccggagtggtgtggagtgggctgcggtgagccctagtaccgggagaccctggtgggggggcaaaaggtggcgacgtgtgttgtgggtggagaagtggcgggggatggggggcgggggctcccacagcctggggataaggagggggttcttgagggggcggtggaaatgtagtggtgcggaaaggggggcgcggcgggtgggaggcggcccagcaagtggggtggaagcctgtggctggtggggcgggggatgatgatgggttagagaggacggacaggcgcggggcg

SEQ ID NO: 6030 - DNA, 1164 bp, Homo sapiens
  misc_feature (1)...(1164): n = A,T,C or G
acttgagcctaacccgataccgacggagacgagcacaaaggcgncctggttggccgacccgnngccgggcgcttgcacggcggcaaccatgcggcggcccggaaacatgcggtgcacgcgtaccantcttgggctagttgggcgtcagtactgtacgcccgccggagtggcattcggcgttcggtcggctatactaacacacccttgggtcacatacactcgcggcacgggaaagcgcgatgggcgagaggcaccgtatttaatcgaccatggtgtgacgacggtggaaaccgcgcagtctgcattggcctaactttcttttcgacgagtgcgaaacacggtgatgtggtgcggataactcggttgtatcatagtctctctaaacagggtccacatcaccgtcgttttgtacgaccagattactgctgtttagtacttacagaagtgccccaggtgtgccgcgtttcccacccagcgacaaactacgctattgatcgcagcggtgagtcaagaaaaccggtatgagcgataactgctaggcgggctcaacacagacaccgagtgacaccgcgactcgcccgtggatcttactacgtgcaataccagtgggattaggctcaagttcttgtccgtctcgtcggacggacagaagtccatctttctacaccactctctcatctcttatacacaccgtcttctaggtggtctgggtgcggtggaacaacacgatatactgccacgctcgaacctgctacccatcatcaggtcggagatttaatcatttcttcggtgtaatctccgcgataacacgaccgtataccataagcacacatcgttgctcgagcacaggccaaccgcaccacagaaactggcaaatggactcgaatatataaccatctgttgcctccctgctgccagcgtcgcgcgctgtttggccgggaaagaatctatcatattctcacgcattgatgagcgtggatattttcggtcgggacatgtggcgcgcatcaccaccgcgcttacgagggctcactgccgaacggtcgttcagatgacgcgtcatgacgcgcacgagcgctagacagatatcacgcaatcgatgcccctcaccgcggcggccgacactacgctgcattgcatggccaactaatcaggccatcaaat

SEQ ID NO: 6031 - DNA, 1037 bp, Homo sapiens
cagttcaccaattttccgcctcaagtcaggaaaacacaaacagtcttaccggatacaagcctaaaaatttccttctacgccttgggatatataaccgtggtgtatcatgtgatttttttgggcatataagcctactccagctaaatggatgacgccgtcagggcttttaacacaccattcttgcacttatactggagagaccctttttattaaaccaccgctccaggggaaaatgcttacctcaattgcgaatcttcggaggatatctgaaggatggcttaaatggagaaaaagtgtgaaatggatttttaacgccatgcaaaatagttcttatgcgggacacttgtcaccaagaaaagacgaccagctgggaaagatattcgagatcttacatgcgggtgtggtgagaaaaaacacctaccccacacatttgttcgtcgcaagagcggggctctttaatatctctctacgactgtttttcgcaaaacgttgtcattgttccttccacgtgtagtaattataatacccaacaccataaagctttgtacgagacttttttgtgtcccccgagatgccacctttcaaaacaaacaccacaataggcggcgacgtaggtatcccgatctcttaccgccaggagaggagccaaatttaactcattaactcttgggggggtgaagaactactaagacttgttgtgtggggcgtcattcacaatcttgtgggatgttcgacacatgtgagcacaatattattaaatatacccctacccacgtctggagaagagagcgacacattttggccaacgcacttatatgggacattaacagtagacgcacatgttgtgaggaaagaaaattgttgtgcaaataaactagaaaaatatcttcttctctcccatcacccgctagaagtactgccacctcttcaatttttttgcgtggttgttaaaccaccggggacctttgttctctacccacccacaaagtattcttcactagtattgcgggcaatgtccaacattaacaactccctcg

SEQ ID NO: 6032 - DNA, 1315 bp, Homo sapiens
  misc_feature (1)...(1315): n = A,T,C or G
gcgccgcccggtcgagttgtgaaaaattcgagcaaggagtttttttgtcctcgccgcctattttactgaaccgctaacgcagtcctgctactgaccccagttctactaagctgtgtgatttattaattaaccccggatcgactcaatatgaggctttgcccacagattccatgctaccatatctggctaaaaaggtaaggggtatacgttcgccttaacattagctctttggcgggttcaggataggacaataaatcctagagaaagtacggtttgttcgctatagagtggaaccatcacttcctgatagcgcatacctactaagcactgcgacgacatccacgcccgtgcgagctaactggtgattggttaaaattagaagggtacacttgcaatctttggattttcctactgcgtatacctcgttcgtgagggacaatgtagattagaatcgataccccccaccccgaggctttgattgaacacccctcttgcccgacccgcatccagtagtttattatggggtgtctcggctcgccgctgacgacggactggtgaancatataagtaacanatctcattcgcttcttaaagtatcttcagtaatacgctcatctcnacgctgaagagacgcgcaacatctacggtattataaatacaaactaagacatagccgacagtgcattccgggcgcagcgagttgcaccactacacatntatagatattccncgttgtctcggcgatgcttcgtcacaaagtcgtgtgtagcttcaattggcctcgtcgtaagcgcgcattccacttgaatantcgagtgtcacgcgcgctctcgcctcacgattacgttagcgagtgagataccatcacgcagngcgtgagcgacgctactgctctctctgaactcatagaccacccncttatgcacacggncgcantacattcgtctgacgcgtagtcgtatgtatgatccgtgtgctcgtgattgtcgttcnctcgctttcncgatagagcgtatcagctctcacttcgatatcntgacaacacncacgacagctcactttcgatcttccttatgtcacatcntgtagcaacacacacacatagtcacattaagntcgcatctgcggctcgcgcggttctaacatttcatatgnttcgtctgccatatncatattactttactgtagatgatcttatagnagatatggttatgtatgacagagtcatacacatatgcgtactattcntgccgttngcaagctcttacgatacgagacgagaagagagttagcgtagacgcgcgctcgcacagcg

SEQ ID NO: 6033 - DNA, 1352 bp, Homo sapiens
  misc_feature (1)...(1352): n = A,T,C or G
cacacactaccatttaactccgcccttatagtccgagaaaccacgagaccggataangcttcatgcgcggaatacaacgcgaggtgagaaaagtttttancacagtggacgtaggactcgtcagagtgacaatttgtaggacaacttggcccgtgtacccgagcgctactatttaccggtagtccttcccacacggcacacaaggcggaatcatattagagagaggtgtgtgtgttcacctccatgtgtgttgttgttctccgatgccactactctgcgactccactttgtaatgctcagcctcggtgttgcctcgcttctttagtgcgcctcactaatctggtcagcgagatcgcgtatcacactctcacacccggcaatgtgtcctgctcgggtacaattgagacgacgatacgatcaatgagacaagtggtggtagggagcgatagtagcgcacgagttttagccgcgtttattggagtaggataggatccgccacatttcttactcgagctgtgagcggtcaatctgtagttaattaagaccacagtgcaacttggtcggtattattagatgttcacacgccacgccgctgggcccactcaccggtgttgtttgtgttatcaaccctctgtgtaggagaagatgtgaatgtgacatagcccactcatctgacgtctggctggtattatcgcctcccacctacccgctctaggcagtagccggtgtgctgtagtttgatgttgtaatgctaaattcagcggatccagcaggtgaacacactcttaaagataacgacncgtctcacgggggagtcggagtgtgggacgtgagagtatcacacgtgaggaatagactcactatcgtcttcacgagtaaagcagtggaggatcaacgcacgccgcgataaggagagggagacgatgtggtagcgggcgaacagatcgccatgggtgcgacgttggtgaagggcatccgaaagagtgtcgcgaggttagagcgcactcgncgaccatgtgctgttgtattgtatgcgaactgtgtggtagnctatagcggtcgcgcgtagaagataggtggatatagaggtcgatcgaangcgggtgcactactacacgtgatgactattgtgagatgttacgaagagactacaggaagtcgcataagaacgacgttacaatctgaccatttggatagtatcctttgtgctgtttcttcctctactatgagtacgacttnttattccgtaatatcacgctctctacacgctgttggtcgtcgtacacagacatatagaagtagcccttcgacgatagaatcataacgtattatgattcatcacgccatcatag

SEQ ID NO: 6034 - DNA, 1129 bp, Homo sapiens
  misc_feature (1)...(1129): n = A,T,C or G
ctcatcctgctccgcctcgcgaacctccttacgtcgctatcgtaaatgccgccgcgtgtcatgtatttcgtattatcccgcgtttacgggaagtagggaagattggggcgggggcccgcctcccgcccccacaccgatcgagtattttgtgtcgatccacggtcctatcctatgacgtacccaacggcggcaacagaccgcacacggccgctttggtcaactcacatggacagtaggcatccacccctcacccgtctcacacctgcgttatttctctaataaaccccacctggtcgcatgccgcgccgcaagttattgcgtatgcgtatccgcgctggccctcataactacgcggattaggtagattgttgtcaatcctgcgccctatgccactcgcgagtttaacttatttgctgtgtgatttgcgagangggacttaataaatagcgtgtggtcggttatcggcgtgctgtgtctctggttcattattcgctctctgctcctgtcgctttatataccgagtcccgtaatactaccgaccttaatcatcgtattgtggtcgtctaccatctccgccctcgactcatctgcacgatagctctctgactgctgacgcacatcattccgacgttgtccaatatattcgcgcccatacccgtagttatagtcacccgttttcactctgcgtcttacgcgtcgttcacccggttctgtatctttcgtacattctcgttacatacttacactcccgatatcgtctcgagtctctcgtgtgagtaccgtagtaggttgggcgtctgcgtgcctgcattgcctttacatgcatgtttatcgtggggcgtcatgtatctgaacggtgacacaagcgatgcgtcgacccgacatcgcggtccatctggcccatgacctcctctctgcgtcctctgcaccgctcacttagataacgattaataccgggcaacgcgccgctccgtacccgcgattcttccgatctccgccgcccacgaaaaaatccgcgggcgcggtttatgttaaaaaataaattgtttcgcaccatgtctcccaatgtaagcgatatcttcgcgcctaatcccgcattgcgtgctcgtcttcaatcatctcctctatt

SEQ ID NO: 6035 - DNA, 1407 bp, Homo sapiens
  misc_feature (1)...(1407): n = A,T,C or G
ttatctatccgtttaatgtnnnnnttccacaannnnnannngnaggggtttcgcccacagaaccgcgggtaaaacgaccccctcggcgggggctttttgtgggatgtttacagaggggagaccacaaaaacagtgggatttcaccctccgccgcgtggcgtcgggcgctttacntctgcggtaaacatggggcgaacaccaccacgaccgactaggcgagtattagtaccacccggcgagagtgttgtgttgatgtgtgtattagtcacgcacgtcgggatattcaactcatatcaacanatacacaccacgaacctcggcggagacgcagcgcggcgcttgtctcgtttcttaatgtagtccatatgtttttcccggnacagacnccttctcagaatggagagcacttatattcaangggcgggtgggcagctgttatcataagttcacttacgcncacgcgacagagagacacattttattctcgggcactcacgtttccacactcaaacgtcgacgcctcggcgtccaccacatgagacaacataccgatggtgcgaggattcccgacgactacaggcgatccctcagacacagttctcggcgtaacacagttcgctaccatctnctatgcctatgtacagcacacagatgagcgcgcatatgctgacgttatagtatacaccaccgcctcaatctagtttgttctccctcataagagcatcgcactgtctctccgttgggagcgcgtctgataagtcctccagcagcctaggcgctctcacctagcatgatgtactatctcgcctcttatctgcgcagccgcgtagacacatcgtcgtctcagagactgcgttatcagtgtggagtatgaagtacaactatatatatttaatcaacaacttcggtgtgcgtacgcgactacatactgtactgcatcacacgcaccccacgagtcgcgtgtcgtgtgcgcttatgatgacgacgaagtatgcnacgcgatgtatgagctgagtaacaagattggatagtaatgcttacancgttgcgacgctgtataatcgccgccgctgcgcatatacgcagacagagcgaaccaagcgatgtgttagtgcgcgcatgtccgactcgatactatatgncantctcgacgtggagttatacncaaaagagctatgatccgacgaagacatagacgctcaaaatagatctctgtttccgtgatcgacgcaatgtngtataccagatgctacgatgattatctatcatcacgtccncgatgtatgtacgtagtatatattactgcataatgaagtcgagtattgtgtgtggataacactatatgactctgctaatgtctcatgcaaggcgacncgtgactatgattgntcatatgatgtcatcacg

SEQ ID NO: 6036 - DNA, 1560 bp, Homo sapiens
  misc_feature (1)...(1560): n = A,T,C or G
agataaaaatccgagttgaccgtccgaatatagaagatgaaaatacgcgatanacaagagagactcttaatccgtgcatgtgcgcactgctatctttaaatatttattctcacgcgggcctaccatatcagtatacgcttgactttcgactctaccatacatggacacacagttaaagcagagaagaggatgacataatacnaccgcagtngtccgaaccacatatacatgcgcagcagattagacgagtcgtgaagtatcatgcagccagcgccgctgtcgcgtcgttagaacacgcgcatatagtaacgacgccgcacacaccacccgcgacagagacagcatatctccacggggcatancgatccttgaggatacgtagagcacgcggtggtgagagagacggacacagcttgtactaccgttgacgcgagcgcaccgaagaacgagaagttacactataccacttataccagtanatagtagtctctccctggaggcgacgccagctgcatgccatcacaacttgagggatggaccacaaaccatagatgcgcacatgatgtacaccccagccgacgatgtacggctcgaatagctcgcccatattaaatacaacggccattaaacacgaaactatcaagtgatgggatgatgtatcgtaggctatacaaagcagacgtatcgaacgacagctcgacgtaacattgcagccagcactataatgatcacgacatacgcgtgtcactgcgtccgacaccgataatatatatagacatcatgaagacggccgcgcaaatatactaattacnatatattcagacacaccgacgcactattcagantcgccgcnataagtatcgctgcaggatgtcctcgtctcagcaccgtaaataagtatgatacagcgcgtcacagcgagtgatcgtatactcgcgatgancgtggcgcgacgcgatcgcactcacgctagctatgcgcaacatattgatgtactgcgccgacacgtcacgccgaccgtgtactatgattacgtcgcaataccnagcgccgcgtaattgctaccaccanatatattacggctttaccancactgtatcaagacncgtacgcgcgaacctctctctacctgtatatatcggagtgctcatatgcatcgcgcaagaatgagacacgacacagacgcataaacggtcacccacacctagaggacaccaattctcgctacgctataattatacacncgctcgcgaagaagcacgcatgcgttcacgcgagctatgtgagagtgacgtacatgggntccagtantcgattangatacgtcagtaccgctgcaggtgacactattaatacgcgcgctcgaatctctgatatcgaatcaagacaatgaantcgatcgcgccacgtcctgacacgattgagagacagcgagagagatcgagcgntaggccagacgttactacgttnagtatantccgacncaccgcacggcgtacgtatagagttacagtgtgacacctagcagangagagtagatatcggagcaccgcgtatgtc

SEQ ID NO: 6037 - DNA, 1501 bp, Homo sapiens
  misc_feature (1)...(1501): n = A,T,C or G
aatactaatacttgctggcagagatatatatcgcggctcggagcgccgcgcgttagcggagtttcttccatcgacacctgtagcatttatcatttaacttcatccacccgcagttcatctataattcaattcgccngtcggcgtggccgcgctctctaggcgttggcgtctatcagcgctcgtgtcgcctgcttgggcatttcggaactgaccacacgatgagcagagtatgatctgcatgtccacgagatcgtgantattctgtagttcgtctgtcgttgtataagtgttgcgacgtgtcagccattcacgatagatacaatagtaaactaatatagacacactactgcgcctcagggagtggtcgagtcagaggctcagctgcgatggcgtcagtctcatagctacgatccacgtattagcgacggaatgcagagacagatagtattagttgagtgacgcagcgcgtaatntcagtagtgacagctactcggacgatgagcatctcgtagcagagtggtcagaccaatgtagccaaccgtactttncaaataggtatcgacgccgtgaagacacgctctcacgctcgcgcgtgccatccacacatatcgataanggtaatgtctatcagtcgcatccgtgtgtcgctgtatactgacgcgacgaatcgctgatgacaagtcnatgatacgagtagtaccgagcggagcacgagtgacgataccgcgccgtgtaagctctaacgttcgcagctgcgtagatccgtcgtactagtatcacgcgatttggacccactggtcgtgtccgattggcacgcgccgtctttgtaatggctccctagtcctaccgtacatcgcagtggtgtcaagtcgtattgatatatctccgcgagtgtagatctaatgactctggtcgttctcgcatcgtagttgcgcgatgcggccactgncggatcgtgtgatgcgcgttgcgcacaggcggcgtgcggccattgacactcgcagatctagtctcgccgagacctctaccaccgctgtctctcacggagtctctgatatactgagccagtgtagcgtgtcgtacaggcgtcacgagtaagcgtactgatgtctactgagtactgtcgcacgacacagatgtctcacagtnactaggccgcgctcatcgtctacgtgccgcggctgcatggtgtgtgtgctctcagcaccctcgctcgccgtacgtgtgacgtttctctacacgcagtgtatgcgcgttgctactcacgtagtagagttgctccacgtactgtgtatcgtcgngataccgctcgancgtagggctctactcgtcagatgtgtagtagagtcaccgtcgtcgcgntggatgcgtgagtggtgtcgtgatatacacactgagagcgctgtcgtggtcttnatcctcgacacgctccgccacatctgtnantattagatctgcnacgtgtgatctagcgcagtatntctgttcgtgttactcatcg

SEQ ID NO: 6038 - DNA, 1616 bp, Homo sapiens
  misc_feature (1)...(1616): n = A,T,C or G
atgaanataactccaagacactatataaggactngtgcgccgagctagaacgtgaagcgataacgataacactggtatgcacctcatcattantcaagaatcnctgcagtctatgntgtaacgatgacacagctcgagagtacattcactgtatgcttctctcgattcagtctcgntctcatattatactgtcatgtaagcatgntccatgtatntgctgtatctgtatcgtgccaactcctcgcagaagcttaggagtatcatcgtctgagtgaagtcgatactatcacgtgtgtgtgagtgtaggaatcctttctactaatagtatgcttatgagtatgcagcacataaccctacaagtgtggatcagtggaatcagtancatatgacgaatgacaaggctggtgagatgttctgtgctctattatctagacatatactgtgacatgatgtcattgataatacgagtgactcgcgatacgcgatatataattacatgccagatgggtatcgaacaaagtagtnatatacacgctatccgatactgagacgagaacaganatgacacggtactagcgtgtggcgtacatgcgagtagagtgctaancgcattcaaggctgaccgactcttcatcgctgctgtgaacttcatgtatactatntaatctgcgcacaagcatatgctactncatatgcgtcgtatatagtgcatcacgatgtgatgtcgtcgtgtcatcgcgcactacattgttcagccgatatgtcgtgtgcanttgacatctnaggtgaacagaacggtatggagccgcagtacactgngatgtgtctgacgtgcttagaacgtgtgtgtcagagtcgtctcgaatggagtgctctgatagatagagatggctgtcgngtctactgacgtagtgatccagagatcagacgtagactatgtgagacattatagacgctggtcggtgcgctactcggtattatatgtgtgagatacatctgtgagaatactgtagcgtatgatagtcgtatcacttttcgtatatgtctatacttgctgatgtggatcaggtaggaaagtataggagatacggtagacgttctgtcgaatattaaatgactanagatgtcgtcatcaaacagagatgctccaacatagaatagacaaatagtataataactcactaagatcgtgcacagtgaacgtgtatacattcgtggaggatcgagcattttatctcactcatctactcagatcatagcgtcgacatcacaatctatctcaattgcanggtatggataatataattcactagangctcgcctctgtcgaggtgagaacggtcatcgctagatcagcgcgcggtagagggtcgagactggagactcagcagctagccgcagcagcagactgctagatggatgacgatgtgatcagcgacggctcntnaggcgagctgtgtgcaagagtagatagngcgtcaatagtgcagagagattgagtagatcgtgatatagnagaacgattaagacttgctatgaggtcgcgataggcgtgctgtatgatcgacgagtcactcagttgcatatcagcgtgcgatctccttctgaaacacaga

SEQ ID NO: 6039 - DNA, 1849 bp, Homo sapiens
  misc_feature (1)...(1849): n = A,T,C or G
acatagcattcattacacgtctggatgattgctatctctcgaagtacttancacgccagcagcacgagcgcatggagntgnatgtgatcgttctcttacngccgtacagtaacaaccaatgcgncatatcagatgttatatgctcttctgantatcggtgatcgtgtcagatttatagatatatcttcatctggtgactgcatccacaacagagactcactagacgtatctgtcgtgctcgcattacatgacacgactcgtgatatcgctcgcatgacgccaggaatacagtaatgcgaggctacctaggagaactctgccnataatgcctagcactganctcgttcatatagttcatatacctctcgtaccgcgtacagcaagctagtancaccacgtaggacatgagaggcgcgtgcagactcagtangttacacgacttctatactcgtctacgacgtaccgatgagcatgatctatgcgtaatntcacacagccgcgcggtagcgacagcagaagagagagtaaggagcagatcgcgcgcgaagcgcggntgacactgatagtgtctcgttgttatacactgaactatatttgctggaacagacaacatgagcgtactccgcggcgtcggtcgcgaattgccgcgctcgtcagataactatagcagtcctanacttacangcggccgtacgcagagagctcagtcagtggcgcgcaacgcggtgcacgagcctcacaagcgacgatctgtagatgctcgaagtgnatgatgaagacataacatctgctgtgtagtaagtagaagtntagagagaaatnaaggagagcgagtataatctgccgccaggagagacgacacacatgtcgcgcgatgacagagaatctgtcgtgcactcatgcgcgtgcgcctactatagtatgactgtagtatcngcagcgngtatgtcgtacgctctgcagctcagctagaacgcgcactatcgtctcacagacagactgtctaacgtgcctctactctagcgctctatctaccgaatctcgtaccatatctatgctagnagcacgagtcaacgtctagcacttgcacgtgatgngtgagtacnatgacatcagcgtcacctcgctcactcagtatgcatagcngnctagagcagttctcgctcgcgncgtcgtgctctctacggtnttctatgtcacagccgtancagtcacacgcatatgtcngcacgcgttgctggtcactcggnagcncatccgcgtcagccacaatacgtgtggttanacngagcagtcacgactatangctagaagatctgatgtgtntgcatcgctctgtgtaggccgantgtatcagtnttgtatcgcactcgtaacgtcacaatgatcgaccagctgacgnatntatctatgtctcgtgtgcagattagagtctacgtntgactgacttcgtcacngtgctggatacctatagatcttgatagcgtgtcgctcgtattacntctcgcactctagtgtatgacgcctagtcgcacgcgtcgtgcctgccgcgtgcgtagtagtatctgacattacgtcacacgctatatctcacgtgtatatcgacgttctgtgtctaagagctgagaagtgtgtgtactgtnatatgcgatcgatgtgntattgacgatctaatgtagtagcntgtgttatagagcagangtgtgtgtatagctgacagcgtacgagtgatgtancagtatgacgcgncgcatgctggcgctggnacgggcgcgccacgcgacaacgcgctacagatacagacacgagacggcagcatacaaagcgtcagcangnagccagagagcag

SEQ ID NO: 6040 - DNA, 1586 bp, Homo sapiens
  misc_feature (1)...(1586): n = A,T,C or G
ctgagttgagctgagtataccgactcacatcacgactatgctcatcnatctcgtagtacgtagtcacgctagatagtacatgcgtgtcctctctgatngacgagngtanantatatcttgcgtcatntctcggtgtgtacgacggaagactgcgactgtactcactcgtatggcggagcgctgtcgattagatnacgacatcgttgcacatctgactgacgatagagcgtcgcgcgacgagttacaatgactaggtacanatnatgagacacagacgatacgcattcgacgagatgcacatacgcagacgccacgacagctctgaccttcaccactcaactaccgccatcgccntntccacgccgcactcacnactgcgcgccgcngttgccacagatccacngctgacacgctatgtcagtcatatgacgcgcgcttagcaccgtgntcacattagtctagtgtacgagtggtctctatggtgggcacggttacgctactgaacgctcgttttgattcgacaatcggactggtaataatactgacgtgcgatatacatcgcgttctcgactggatttgtagtgttacgcgctcgctagatcgaatacgtagtcgcgctcacagagtgatgcagccactgctnaatatcgcgcgtgcttctactcaggctgactttatgtcacggtctaacttatataatgctggtacctcatggtattcgcctggtgttggtctgatanttatcatacaattgatcattaattcgtgtgtccgtntacatacgaatattgttgttagtattatcatgttatgattgagtacgttagcaatctcaataaactatcgtgtgtgntcgtcgtgttgcttgctactaactaacatanctgagtggntgttgtgctagtaatagcttgagtctatcgtacncgacatatactgttggtgtatctatagtatactcttatatactcagatcangtagcacgatcgatgcgtctctcgatggtgcaccggcttcactagcacntgacagttgtcgtactcacacgtgatctgtgcacatgctaaagtacactgagcgtagtgagtggacgcagcgcgcatgacacttgcgctgcggangcgcgcgcgcagccactacaananatcagtgtgtcgaacagcngagtatcagcanagggnctancgtgtgatctcganagcagttaggtgcatcgtangctggtgctccaccacnaccgaggagtagacgcgacggacagantnanagagcnctgtgcatcgcggcacgacgcatgtgcatgcacagactcgtactagngtgtgncagtaacgtgcgctgccgctcagcgngtaccaacacgtctntcgctcncacggcgctcgtactatacgcgtagataatcagtatgatcgcgcgtgtgcgacagctgtacatagcacctcagactgcgaagtgngttcatgtcgtgacatactctccgcatacgcangtacgcgagaggntnagacaaagctcactcgtagtgtactatatataatctcagtcatantgcatgtagtggacaatcgcanacgcatcactt

SEQ ID NO: 6041 - DNA, 886 bp, Homo sapiens
ccccccccccctccccccccccgctctttccattaaaacccttccccgtcgcatttatccccccaaccccccatcaacgaccgagcttcatccatctccaccttccacagtcaatccccccgcaatgacccctgcctccccttgactccccaccccgccccacttctcctttcaccccccccccccctcaacattgaccattgtgccccccccccaccttctactcgcccccctccgcccccacactgcatttctatctcaccatacacaccccttcctgattctcaaccgcctaaatacccgcgaggactcaaacagcaaaatgcgccaacccaagccaccgccccttctcccccatatgccctagccgccccccaatacgcccccgacaccaagttccccacacatctgctattagcacaatggagtttaaaccccccaatcatagattattccccatctatcagaatggctaaaataacaaaaggtgataatccccaacactgggtaagatgaggagaaactttatcactcatccactactggtagaatgtacaatggtacacccactctggaaaataacttagcagtttcttttaaacctccacatgcatttgccatatgacccagctgtcacactctttggcattcatctgacatgaaaatttatgttcacacaaacacctgttcatgaatgttcacagcagttttatttgcagctgccgagattgaaaacaacccaatatccttcaatgggtgaatagttaaactatgacacattcatacaatggaacaccactcagcaataaaaagaataaacttgtataataaacagcgatgcggccgtctgcgcccggtcgggtgatatcttgggcccaagccgtat

SEQ ID NO: 6042 - DNA, 1705 bp, Homo sapiens
  misc_feature (1)...(1705): n = A,T,C or G
ggcgagatagagaaacgcgcgcagcggtgggtagtgtgagtctgtctgcgttcaggttgtcgatgatgtgtgtgtgctggccgagtagctgacctgcgacacgaggtaattcgagatagggcacgccgcatacgtgagacngcgcagagacatgaacgagagcagcgcgcacacagtaacttactgaaccagcgcatacagagcgaccgcgaaggaacagtatgtaacgtctctcactgagctatccgaagatcgtcttttcacacttccagagacgctgagagcgctcagtcactaggccacgactgatatgagctggcccagcagtgttgtatgacgaccgagtcgcagctttcgctgcaacacgtagcangtctgcatgtcatcacgcgcgagaagcaggttaagcataggaggggagagcgtaaagatgcgagagatagtgntgctgtgagagagtgcaagtaccagaggagacgcggatcggcatcatcgacgtcgagttgtaatgtctcaacacatacgttgctngacgcgctacagnatactcacgtcgcatgaagtatcataagtgtagagcacgtagcaatcgtctgtagtntcttactgattatgttgtcgcgcgtaggtggtgatggcgtangcgacggatgagtgctacgtgccgtgtcagagtgncgtcgacgtctccgtacgantcatgngcgtagangcatagnatagagtacgtanaagtaggaggatggagtatgaagtcgagagagatatgatgtcataagaatatacagtcttgtcgcaggtgcgagtccgcgacatcgcctcactgtagacacatcgatgctgatgacacgacacacctatctggatggcgtcagtggacactcgcgtgagtcgatagatgcttatcgtgtgtatgaacgcacagtgctattcgacagacgacgtactcgctgagcggcagttgagtcgcactcgtcgagagnacgntacgtaataatattaaacagagtgtatgcatgtagcaagagtnatagcgcgtntatctgacnatagagttcgncgtgantgactcgatggagtaggngacagatcgtatatagnagatcgntagagcgagtagtacgagatatgagtgatgaagtgantntatagattgagtaacgtcgatcagtcagtccatacgacgtcatctgcgatcaatgtgagcaagatgtngagcgctacangatgtgagatncgtagtattgactgnagatgtatataantacgtngagtatgtggatgctgtgntannaantatatgtatgatgtccgcgactccgtcaggantgtacnanagatactgacgnagcgntacgcncgagtagncatgtgtgacgcacgactngcagcagctnacgctacacggagcgtgctganaggagacgactgatgtagatcacgaacactagtctgntccntcttacacgtcagcacgntacacagtgtattcgtgctcgtagtgaccgtgagantatgtgagtnatacggagatgtaantcagtnagtacgtgtacatgcgctcagaggcgtgtgatcgnacntngcactcacatacactgganagtaagtagtntgatgatangtcacacgagtngcgatgcgtgtagtcatacagtattacgagtaggtattaatatgtctcgtnagcgcgactggcgcatag

SEQ ID NO: 6043 - DNA, 1498 bp, Homo sapiens
  misc_feature (1)...(1498): n = A,T,C or G
tatatcgacgtgactgcagcacaataatctattattatttcgtcttcacgaccctcttttaaaaaaagaattttgcgcgccgacttcctacacgcgccggtgtacaaggttaatattaatgcagaacatgcaagcggcgttcttcaatatatgagacactaccaaagatcgagtaatactccgattttgcaaaaattatgtaaaatgaacatgtacaggctcattccgtgaaccgccatgtaaactagcggggcgcaataaatctgcacgcgcgtcagaatccataatagacaacgagagcgaataggtatatgaataactactcacacccctcgaatgcgcagacagagaatagtatcacttaggattatagtagacatcccgtggcagatgttattttctgtggcgacgatgagagtgcgcgatgtcaagacactcagactctgcgatcagtgcgatctctacctatgaatatatgcatacgaactacgtgcatagaataagacagtgggatatgactgcgatgattagatcgagtagatntagtatggacaaagacttgcangaaacggattagataggaggagacagtaagatatgcaggcattatacacagcacgctgtagcagcactgaaatgaggacgtagtagctaactgtgcgatcatagagtaggacacagttgaatcgaacgttaatcgagcgcaatagagatagtggacagtcacagacgtcacgnagtgactcactgatgntacaaaatcgtcgcgacgcgattgtgcgttaagatatatgcacttcagcgtcatgagcaacgcgtctcggtacgtgacgcagtgtatatcgagtatgagtagcacancacgactcagtgtaccgagactcacngagttgtggatagtgacacatacacaatagtatccatnacacgntgaggtgatatgtagtatcgcggtcatatgtgtnagtacgcgatagacanatgatatatgngcgatgtgagagcgagcggtgcgtgtaatatatggagtataangtatgatgaatagcgggagacgtagaaggcacgtatacgtgtgatcagtcgtcgacgaatcaaaggtagatgctacttgatgtgagagctgcagtatnacacgtgacaggagagacgtctagtatgatctagcgagcgaagtaggcgtagtgcgagaacgagcgcatagtcgagntatctanatcgatagcgtgacgcgagcatcggtgatactagtgactgtcgtgacgntcgcgaggagtntgttcagtatgtatctntgctatctngagatagagncgtcgacagagagtatgtatcagcgctagagcntgctgagcaaccagcacgcatcggcgttgtcgagtcgactctcgtaacgcgtagacgtacgagcatatatagtaccaagatacatagcaagagaatgagtaagtacacttatgttaaatcgacgatgtgctgaactagaatcaacgatcat

SEQ ID NO: 6044 - DNA, 888 bp, Homo sapiens
  misc_feature (1)...(888): n = A,T,C or G
cggcttgttacatccttgactcccatcattagaagcttactttggtgggcgagggggagagattctcgaattatctaccatgagtctccatatagggctagctaagcctgctgggcagcacacacaccacctccacttgaatattcttcaggtaaccatcgaatttaatactctcactgaaactctctccactatttactctctgtcggggcgcgagctgcgatgcccagtcaattatctatatgtcagctgagttgaaacaccatcagagggctattcttcattatgcatgaactggccatgtaccttgtaaccaagcagactctgtgggacgacattggtgcaagagtaactcataagggaccacccaccttatgatactgtgggtcagatggatgatgatgacttgggggggaatgaaaagctgagatactggggattgcgatgaaacttgggaggggctggtagtaagactgggggaccagtgacatggcgattgccagaggggggggggtgggatgataccgacgccggcgggaagaagcgcgactgcgggggtcatggccaaaggcaggagagctggcgtgttagggcgatgagggggggacgccgagagacgcgcatggaaggggatcctttgtggcggggtggggggacgcgagtcgcggcgagagggatggggagggggaggtacggctggagtggaattgagaggtagtaggttagggagagggatgggaagtgtggctctggcgggtgggaggcctgggtgttgaacgtggaacgaagaggagagtgtgagacgagtgaggtatatgagggcagcgaggacgagtgcgagagtcgagagagtgantgtggttagtggngcgggtgcgaggaaggggg

SEQ ID NO: 6045 - DNA, 133 bp, Homo sapiens
gctctaatatccaccgctacacagaggattcccttcatctgagaaagccagttttcatccaaaggatccacctcacacaagtccaggggagatgccatccgcctcagtgtgtgccctaagaaataaagagaga

SEQ ID NO: 6046 - DNA, 128 bp, Homo sapiens
cataaaatgtgtctctattgggcaatgaatttgctcccttaaactgtaagtgaacttaccagctttatgttgattattgtactactctgcaaataaactcaacaattttgtgcttaaaaaaaaaaaaa

SEQ ID NO: 6047 - DNA, 1650 bp, Homo sapiens
  misc_feature (1)...(1650): n = A,T,C or G
atctagatgagtggtgagtatatgatgtattgtggttcgancgctgtcgcagctatggactgagttatngtgattcgctatctcacttcagtcctcattcctgtctanctgcgtcaacttctcgtanatatcactcgtcntctagtcatcgcatatctgtcgcggtgatacgccatgcgcctgagtacgtccgctcatattcagcgacatgtcgcagctgtacgtcatactcgtcgcgagtggtctgtacggcgagactactgggatcacgtcgtgctagtccactattatgacactggagtggcgtatctacgctagggctcaggagtggtctgcaacggcgttatgtgcgtatgaaatgctccgggtgtgctcnagctactcgcgctgttactacatgaacgcagtagtacgtgcatantaggagtcgtcgtcctacgaataattgtatattantgtagatatgagcacaacggcagccgcggctcgtgagagcgctgtggcgtctctcagatatgcacatatgntgcagcgttcagcaatacggcatacntagtattggcatgtcacatattgacgtataacagtctgtgagtcgcgtntctctctctctcttgataccgttgtcggcacgacatgctgacgcggtacacacgagacacgataagcactntctatcgctgtgcgaccgagtcgacagcagcatgtttctcgttntgngacataagttgcatacntgntgatattctctcagacctgtcgtgagataangataataataggtgtgcgcggtgtgacttagagaggtgcggntatactcacgtgactaccgtccatnaagatatacgtcnatactacggcggtgtatctgcatataggatcggngagtatgtttcgtttgcgtctaactcanactggtgctcgactatataagcgtacaccgatataatcgtgcagcgtatatattctatngacgtgatgcgtcacgaacatcgtgttatcttcgancatcgtggtagctagcaatatgatactgaacagtatgacgctgctgcgactntcttggattttttatgtcntctctatgacgatgtgtcgtattgangtgatgaggcgaagcatgataggatagatgcnctattggtctcatgcctcttcgtgtactatgtcatgcagtctcgttatcgtggcaacatatagtcagtcgtggcagacttccacgcagtaataatgcgtcgacggcgcgtttcattagatgtgaggcncacggcgcggcgtatatgatcgctgttacgcgcggtgatcttagagatgatgatatctcgatacactcatcccgaaagcgggcgggcgatgtaatacatggttgtaaagtctcattgcgatgcgttcggtctatcggagtcgcttagcgcaggattcgacaccactactgcgtcgcgtcgaggttcgaagtactactcatcgcaggtaagatactgtagtgttgtggagtgtgatcatanaatcactngacgaagtggtcaaacgttcatagtngacacatctcaatctgcgtagtggacttatngccgcagcctcaccgcattgattcttgtgttcacgntgtcgtatctgctcgtagtgtgctacaggttcgtatgttgttct

SEQ ID NO: 6048 - DNA, 1579 bp, Homo sapiens
  misc_feature (1)...(1579): n = A,T,C or G
cgcatacgcgccacgcgcgacacagacgcgcacgcaagcgagcacacccgaaagaagcgggagcttggccgcgatatctgagtttgactgactcttgttctctcatggacatacaactgcattttagtgcttggcttgctgactaggcctgcttatattctcgaatcacagagaggaagtcacgtccgcgcgtgagcgcactcgcgcgtagacacgcggaacgctcggtacggcgagggcgcgcggncagcacggcctaggcagctcgaagtacggagcgagagcccgcacgccaccgaccgcgacgaatgaggactcgcacgcgcgcaggccacagacacagacgacgagcgacagnaccgccgaaggaaggagataacgtagaacggcggatggacccgggacacgaaacggaagccgcgagagtgcattaagacgacgcgccgcagcgtcggagcaaacacacacgtacgccagcgcctgtgtacggcgggtcggagagacgccgagtaccaaagagctcgaggacagcgctacggcgctagcgcagagcgtcgcgcagaagacgagagcgaggagaaggagacgcccgacatataaacaatagcaccccgcgaagcaacgcaacgacgagaccgcccactgaccacgcgggcagcgatggaagcttcgncgcatagaacaggtggtatctccatgcgcagacgcgcatcgcacgcgaccgcgcggacgagaccggaggagcgcagcgcgcagtcngtcacgcgcagagagacgccgggagagagagtgagaacatngccagcgtaggcgacgcgcccgccgcacgacgcanagcactcgagtaagacagagaagactatacgncatgccanacnacactagcagctgcacnacgatccgcaagacgacntgatgcgagtacagccacataacgcatacgagcgagcagaagacgcgctgtcacagccaatcgnacgacgagcgtgaggaacgntcgcagtaggcgagacacagacggntcgagcgacacgacacgtgcacgtaaatccgnagcagacagaagtcagccctacaagcagcgcgtacggaccggtgcaccggcggaagactgagaagaggaaggaattatagcataactgacacagcagagatagnagaaacgcgatcgcacgacacgcgctaggaacgcgccagtctatcgaccatacggaccgcgcngacgcagcgtaatgcnattatatgatagatagtgtcgcgcgcgcccagatatatnccacgcataccgcgcgcgcgcgcagcgcgcgacgacacacaaccgacaatgcgagcgacacgtacgatcgntagncgcgncgacgatgactcgatntgnacggcnagagagcgcgacgcagctngagtacgcgcgcgagcgtcgctcaccgcgctacgcangatagacaccgcntcgcgacgcgtactacgcgntgccgtgtccgagnggcgcgcgtgagcagagactaggcgcagaccgcgcgcccagtcaacatctgtgaacgatctcactagcctcgtcgatatatagcgtcagnagcag

SEQ ID NO: 6049 - DNA, 683 bp, Homo sapiens
aagactcgtttccggatgcgtcaacaccactggactggaaggctaccctctggccggagccctgcgaagcaccgcgagacgggggaggagacagatacaaatgtatctggaatcaagcagcacatactgaagggcgcgtcacccaaagaggacatgcaacttcatccggagtcatccaagaaactaattgtggacggggacctagacatcatgtgtattaggccaggatgccggtgattgcggatacatccattgtataaacttgagatcctgactaccggctggccacatgtaaccaaaaagtggggcgttgaccagaaaaaggagggggtgaaaaaaaaaagaacggtgctggttaaaagggggacacaagggggaatggggcacggggactgcagatttaacgtgaacggtaataggtagggggtgggccacacaggaacggggaggtagggaaaggaacggtgaccaaaagaaattaaatggggaaaaacggggggggggagaacagggacaaggatggggtgggaaaaaacgaggggggggggggcagaaggtggtggaggacggggaccgcgaaggaaggggacgggagggacgggagggggggagggaaccgggggcaaaaagggcgggacgggggggggggggaacagaaaagaggaagggggaaggggggagca

SEQ ID NO: 6050 - DNA, 1170 bp, Homo sapiens
  misc_feature (1)...(1170): n = A,T,C or G
ggctattgccctcttacctgattgcgtgctgtggtggggattgtggcgtgcgttggtgtgtttaggactggttgtggcacagtcatttagatatatgtgggggaatgctaggctctgcgggatagtggtagtggggtgatcgagagcagtgtcgtatggtgtatgctagaagaggggatgatagtggggtgaggacactcggtacgattggttcattcggtagtgttgagttgttcgttggctggntatcgtacgatagaggtagaagaagtggtggcgaccttgctatttcttatcccggncacgtatattntcctcctattctatnaacttttctatttgttgatttgtgtcttatctactatanaactacactctaatagacgagggaatctgagtgcgtattcggaatanaaaatatttataaacttantaaatacatatgnnccttctgatttgtttttcaaataactcacnaccactttaaatattnnacatctacccatacttcaacttnacttcattcgtgataactgagtgtttcgatggaatttaacaagccgtttagtactctcgtcaccattcttatcgtggcggntantctctatggtatgtctgtgatggtaatcatcttgtcgtgggatgtaggacatattaaataaactcaatgagcgtgtgacttgctgtgtggtggcgtctgaggtttgngtcgtcggtgctagtgcacggtctctactgcacgttatctattctttttnnactgatntntgccacgtatcgacacatgtaaatacatgctcatgaatataaggtatatgaaatatnatattgattaatatatgtgtgacatattgatcctattatattctgctttgtcgnnnctatctccggaaaagtggggaggacttggcggtaagacttgggnngnagtgtgctctccactgctgtcgatgnnnctgaatancttaaactctccatntacatctttactattttctcttatctattctattctctcatccattctcttttttactttnnggtcttcaacaatataaatncctacttactcatgtaatttccctaaaactcatccttttctattactttataattaatatttatatnattttatattaccataattaactacactccanccccctacct

SEQ ID NO: 6051 - DNA, 829 bp, Homo sapiens
aatttaaaatctgagactaggagatattatctttttcaaggcctcgcaaggctgtgctgggattcaagcccccaacatccttcttctacactttctccattgttttggatagctctttacagttaacaaaatgccttcaacgcaatgatctcatctgaccttaacaataaccctgggaaagaagaattgtaattattatctccattttgacatatatgagaatcaaagctcagagaggcaaaagtatttgccctggttgacacagctagtgaacagcagaaccattcttcatttcattcaaaagacatttgctgaacaactcccaggtaccagacacaatagctaataggatgtaatgcctcaagctttctggctgcccagacttgtggggctgaaccttggccactgctgtgtgttaagtactcatccaaggtaaaatgtggataatgtacatgttaactttgtgttgtccaaacatggcccagaaagtggctgggtctgaaaggacattgacaagtaaagggctgatatcactgggaagcataacttttataagatgatcggacgaagggatcttttttaaaccctgagcccaaaaatatgtgtgtaagcaattaaacaggtctgaaggtcaaaagtctttttaagaattccctctatacacatcaattcctatacttctataccccctaagttggaaacccttgtataatggggtatagtatattgatattttgggccgttatgcggcattttataagaggccttatcttattttatcgcgcatcaagtgtgatagaattcacgcatcgaatctctatgtggtact

SEQ ID NO: 6052 - DNA, 1822 bp, Homo sapiens
  misc_feature (1)...(1822): n = A,T,C or G
agtcgacatgcgcgctgagacnacantgctatgatcgtctgcgcaactcgtactcgtgctacgtgtgccgtattcgcgctagcgtacatgcgtcatcatcagcgctccgacgctatcaccaagcntcatacactcgtcgatcatantgtagtcgatcngctcgcgtnatcatgtcgctggagactgatagcgcgcgtcgacatactcaccgacgcgacatgcgatgagcgcgatctacgatccacgatcgatataggtcgactattgactgacatggacatgacatcgacgcgctatctcgacgagatgatatatatcatcatgattactgtctgccgctgtctcatgcgctcgcgctgtgagcgtgctgcgtgaaaacgagcaataccgcgcacagacatcagatgtgcgangagtgacacctctcgcgtcgctctaaccaacacgcagtctgtacactnctgtncgctgcgtacacgacggcgtacgtcgtacttatatactgtagcacgtagttacactcgtgatctgtgtatcttcacgataatctcaacatatccgcatgtgcagtcgctatctagcatcgtgtgatagctagtaatangtcgatgcgtatttcgtggtatgtcagcgacgactattgcggtgcgtgtacgaatgatatacagacgtatcaagtgctcgtgcgcggcaccttatgtgtacgatcangaggctcgagagcgactgcctatcacgtgcttccgcagacgcgcgtgatatgcgacgacagcagcggcttacatgcgcaaaactggcgacgcgggctagatacaacagttaggcgcaccgctcactggctactggacgagcngtacgcgcattgataacgcgcgtcgatactatntgaagttctgacagtaacatacgtctatgacgcatttccactgagcgcgatatacaacgcgtgagtcgacntatgtgctcgctgtaacgtattcttataagatatgaccgatcaatcacgagntcgagtaatcgtngcattgtcgtgcgaattgatacccgcgaactcgcgggcgcagcgtgtacctcagtaagatgccgacttgatatgctggtcggcaccgcacgtcgtacggtgtcgatcggagaggactgtcgccgtcgtcaatgactcattctacagcatcgtctctntctcatcagnatgctgtcatattcagctcgttcatattctcncgctcacactcgctacnctgctctcctcctgggtacgatatatgatagcgatntgttatgactatagctgttactacggtcgacatntgggacacgcgcacgacgngagancgaactgcatatatgctcgcatgcgcgcatgactatatatacaactcaccgtcagtgtactcatatncgctctacngntgtccatgctcgaggcgtgtntgngtactgtcacttgcgatatctgcacttgatactacgttgcgacatctgaaccgtcgcatgtagactacactactgcatgaataatnactgtantccgtccgcgcgacgngtgctgtgtgactgcganaggatagatagtaatctagacacagatagatagaagtggatnatanggcgcgnggtcgtgctactgtacgcttatatatctcgcgtacgtgcgtctactgtctagctcngtctctgngagaaaaacgtnngnatcgcggtgngtgcgcgtgttgttntgcnacnngantgcagccgtcgatcgtcgtctcgtcttgtcgctgtgctttattacntactcaccgtctctgcctatancgaaagacngactaatctatacagt

SEQ ID NO: 6053 - DNA, 849 bp, Homo sapiens
cgagcaccccctgcaatatcgcccactcacgccccacagcgggcgcactcccgcccacccattccgtcaagcacccacgccggcgcaaccgccgcgcacgccagcccgactttccggcgtggccccttgtgttccccaccggccctcacacgccacactctaaccgacacgacctcgcgccctctagggtgctccgggcgcgtccctaacgccttctcgtccgcacccgctacaacacgggaactcggatgattccttctcctacctactacctatccacaacgccctctcccactgtgccaccctagacctatcctccccccaccctcgtcgccaccccccctaggcggaatcgattaccctccgcaccagccccctgcccctagcccgtctttagcccaccgtgccctcttcaggggcccgaacaccttcgccccggtaccatgtctgaatgtgtacaaaaagtagatgttttagtcttcatgtcacaaaatttggatcctaacacacggcttggggggagaggcatttaaaaaccctttttaatcccaatccctctaccccaaaccccccgagggcccccctccaccaaccttgtttacaagagccccttgtttttttgggttttcgcaaagggggcatttttttttttggcataaagtgtgtttttttctccacaacaaaaatcatgggcggggttaaaaaacacaccaacaaaaaaaaaccacccaacccaccaaaacaaacacaaaaacgaagttacatcccatagaaagagttccctgttgcggccgaaattgtttttttttacctcacctacacgctttatccacagtccgcatatctaca

SEQ ID NO: 6054 - DNA, 1007 bp, Homo sapiens
  misc_feature (1)...(1007): n = A,T,C or G
ctcacacgtttattgctggggcgggggggggcttttgacacaaaaacgcagaacataaagtggggggggggtttctttataaaccaccccgtccaagggttgttgaggaaaaaaaaaaatcacgggggggttcggcggctagccccggggtaaaagcaaagtgagttgtatttagaaacgggatgtgccaggggggagttatatcattctcggcgagtcaggagagggatgagatctctgccaagggaaaaattcgtttcgttatgtgctacaaggcagtttagctttcggaagaataaggttagtgaggaggtagagagaaaatagctgggtcataggtaagaaagagtattatcgtcgcaccgcgcggggataagtgaggagggaggaagtgggtatgcgtttcgcctgtacgaaggtacgcacaccgctccgtgcagtaccggataaggttgtgtatagatacttactctgtatattggttcgtcaaaggttcagtantacgtgcgttcgtgcggtgggcttagatcggtcgtgaggcgcgggtctcaagaaggatntcgtggcgtggcgtgttgtttaggtataggtcagctcgcgtgtcgcgagatagaatgaaaganaagggagtggcgtngcatggaggtggctggcgagtcgtaagcgcagtaagtgagtgtgtcgggctgcacattggatttacatatattgaatgtggcgggacattcgcgcagcgcaacgtctgtgggnaggcggagtagctggtggtgtacgtgcatatgtgtggtgtgtgcacttgctttccgcgtactgcagtgtcctatcttgtcgtcggctgtngattcagngtgcgcgctggtatattgaacgcatgtgccgcgcaagatgcgatgntagcgtaacagccgagccagaactgtgagtggtgatggaaggtcagtgggtaggtgaaagcagcggtagcgtcgcggtacatgcagatatcacagcgcgaccgagagacgccg

SEQ ID NO: 6055 - DNA, 951 bp, Homo sapiens
tgggcggggtgaggggggctggcgcgggggggttaggtgtgcgatctgcgctttgccgcctttcgggttatgcaacaagaactgtaacggtagtctgatactaaacccgtggatgatactctgctcttcttgtattcggagggtagcgacaacgaagacgctgccgtgggaagggactatgcaaatcgatcgggagtgagcttttgatcccgaggccggagcggtactgggggggggtgtacggcggtgtcttatggttgcccggtggccactgttagagacggaatgatatcggctggggatgggcgcgccaagaatagaggggacacaaccaaatccgccccggacctcatcttcatgccacgacggggggggggggggaggtgcatcacctaggggcctgccatggtcggggccaaccgtcccgggtgagcgggatgtggagtacctgaagcgtgcggataccaccctcccggcctccctacatcgcgccagatgtagccggtaacgtgcgggaagaagcgcagcattagacatggaccggacggcgtggaggacacgaggtgaccgatgaagggtggggaggagaacaaatccccgacggacagagagcccttagcgcaaagagcggagtgagagacgtgggagagcgtgggtgagtggtatacgcacaaggggggggggcggggggtgaagtggggaatagaaggaggtggtgtgtttgagaaggggaggaagagggacggccgaccagggtagcccccgtctgcggggggcactcgggggccggggcgagtgggagagggggcgtcagggagcaggggtgaagggattgccaactccccagcccacaagacaccggccgcacaaaaccagggagttccttctacccgacagcagtctcggcgggcggtgtcatctctgcctgccggcgaggagcaccaaggaggg

SEQ ID NO: 6056 - DNA, 1282 bp, Homo sapiens
  misc_feature (1)...(1282): n = A,T,C or G
ctcagtctacagtcctgcgtcacagctatcgtacttatacactantctgctcactactcagtcagtgtgcatagctctgagagtgcgatcgcgctagatgactaagaacctccttcttcgcctggtcgcctcgtcggcgctcnagcagactcacacagtacgagtgtactgtaggatatcgagcgtactagtgtgactccattagcacgcgagtacacgatgcgcgctctgtacgagataacgacgagtcgtgcgtgtggtgcgtgactcagctctccgtgctagatcgcgctgcatgtatgctagntagtatctcgaccgattctgcttgcacgcctaagcgacatattagtattaacggaggttgacctgggagtctgtggagtgacgcagaagggattatgtaattagagtattgacagcgtcactggcaaagcagagcacatcgcgtgccgtgacgcgaagatctagactcacaacgccgtatgacagcggctaacagactccgagtgctgctatgaccagctcagcagcacaacgacgcacgagtgcgcagccgagggtgaggcacctactcgacgaagacttaatattgatatatgtaaataataatatatgttcaaaagttaantaggaacgcagtctctataccctagcgtgatcanctgcctcctctcccccgtcatctactgtctgcgtgattggctgtggttagacaagctgggatcncgaggatctaatatacatctatcgtggttgattcgatgactataacatcatatctcatgtaatgtataccccacagtcatatctgtatactcaagccgacaatgagcgtcaacgaacatcagacgtagtggccgactcacgagcatacacacacgacagcaacatcaactacattgtcgtttgtgcgttggacacataccgctcgcgagctttgccgctactatntataacggataaagcgataacgctcaaagtagtggtagaagtgatatgaggtcagaacagtggatctgcagaatataatcttctcctccggtggggcttgatcacagtgttatatcacctctagcgtgccgcgtcacggcgcacgcgcgtcgctaacgcgactcagcgttattgcgaatcattacgctacatcgcgccacgtcgtgcgatccnctacacgagaaaaggnggccgtaaagtcacccggacatnctacctccaagccgaccgatcttgggtcgcccgtcgatagtacgtctcagtgcgagactcgcgccgcgactgtgag

SEQ ID NO: 6057 - DNA, 349 bp, Homo sapiens
tcttaatatccaccgctacagatccagggactagcatcccaaactaggaatgcaggctgctcccatcaacacactgccaagcagaggaggaagagttctggcaaagctgatactggcactgtttgcaagatttgttgatgtctatttgaactgatgggccataggagctgcctacttcaccatgtttgctgatgtcactctggtggctgatagatttggaatacatatgttcatcaggcaatattggttccttcagtatggctgaattgacttaattggacaaatagaaagtaatttgttgtatataggtctgctttatcgatgtttaacttatataaataaaataaga

SEQ ID NO: 6058 - DNA, 1255 bp, Homo sapiens
  misc_feature (1)...(1255): n = A,T,C or G
aatagaggtggnaannnaagnnnnnnnngnnaaanatggccggtccttnannncccaacccnaaaccaacannaacaacttttntannnnnnnnnnnnnnttnnnncccaccccannccncaaanacctccctaacnacacctacacacacccgcacccccaacccagacacccagccgccgactaacacacccaccgtccaacacaaccccnacccccccacagccacccacccggcggcacacgcggcaaagaggcccatcgaagccgtagacaggagtgaagaggaaggagacacaatgacacgaaagaaggcngaaagggacaagagcactaccatagaagctctgcccccacgaccactccccccacacttacacaccacatcacccccacgtgccacccacgccaccccgctcccnacaacagaatagcataaaggacgttcgccccgcaacggccaaacgcacagcgcgggccccaagagcgagtgtgaataacgtcgtagnacacgcacgcagcaacggaancattgagtgctcgcggaggccacagcagagaatgcaagaccgcgaaagtgcaaaanaaacagaagcgccaagggaggtcgccgcgcgcgccttcccacctctacgagtgttggagggtgggagagggcgtaaaggtgaagataaatatatcacgactccaggggaggatgaatcttggataagatcccaacancgaccacaagtaggaatccaggcaccccaaccacaagcgcnacctacgccgcagcatgaagaaagtctcaaagaagactcacatacggatggatcgagagggcgccctcacggcagtaggtgcgccgaggacgctcaaagtccaaatcgcaacggcacacgcgcccggagtcacgactgcgcgacgtgcaacacgacnccacgccacacgcgaagcggtccgacgcacggcgaactgcantaccagctcgacatagctacatgaccgaccacgctcagcggcatacagtgagagtatatcacaatcacacgntcctgagaggaggtgacgtgccagcactgagtcacgtnccggcacgacgagacagtacggacgagtgcgacaccacacatacagcgcgtaatcagccacgacacgcgtgaacgcgcgcatccagtcgttcccacaccacgaccncaagcgcaacccacgcgaacgggtgcgatcagtcgagtagcacagcgcacccagtaagactctagtcgcctcacga

SEQ ID NO: 6059 - DNA, 518 bp, Homo sapiens
tttaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgagccactgcacaaaataggggaagaagacgtgggagacaaagatgtggagcctgtcttcaataaatttacagttagtttcagggtacattgtttttcttctgctgttaattaggtgtatccccaagacaataaatacatgaatggaaaagtaaaa

SEQ ID NO: 6060 - DNA, 340 bp, Homo sapiens
atttacacactcagtcccagaggtgctgaaactacatcagaactaagaccgtgtgtttgaaataccctcatcctctttcatatacttggaaaacttctacttctacttcaagacccgactcatttgtccccatccccccaaccagcctcatggaagagttcatcttaggacctctgttttataatactcttcacaccatattccagttatctgtgtacacacattcctcctaactagcccataaccttctccaggtcaggacctgtggacctatgtcttacttgtctctgtacacacagtatctggtttcccggcattcgggaggtagaataaacaccga

SEQ ID NO: 6061 - DNA, 955 bp, Homo sapiens
  misc_feature (1)...(955): n = A,T,C or G
caataacatatggagggtaaagaaagagccnnnnccgggtttccacggaaaaaaccgcctcaaaagtgacctgacaacgccttccggatacataacacggggcgcatccagtgattgttctgggcatataagccaacccccactaaagggaaaacgccgcctctgcttttattacaacagttttttaacttgccccagagtgactctattaataaaccgccgggacagttgcctcatccccacgggagaccatagctcaaatcaggcgtggggtacttttttgtgcccgagaggcttttggggccgctagaccccctctcaaccccttcctatactcaagctaaaccagacctccagaaacgccctgggcctaggttgcccccttaaccttggccctgccccaatatattaattagcgcccggaccccaaaaaaaccccacccttggtaaggacctccatgcccaaaacctaataaacaggggtttttgcccctcgcccttttggggcgccccttatccttctctatttgagccttgccaagaaagaccccgtgcagcaatggccgaaaaatggtgagcaaattgttttcacaaacccccacttgcggaggttctagatttctagcgtgggggccccccctcccccagatcacgtagccccacaaaaaaagactcttgaaaaattttttccaccctttcttggaccctccttgggtcaacacaggcttcaccgcgccttttatgttagggagcgtcacgtcctactagtcaacgggactaaggaccacaccttgtattaacctcaaccctcgacgtcccgcccaaccttggtggtgttttctctctctccacccaaaaaacataaacggtgcaaaggggtgaaacgctcgatgatacacagctccctcttgccctctcgcgcccccgcgaatntgatataaatcgaagacacaag

SEQ ID NO: 6062 - DNA, 862 bp, Homo sapiens
atcgacaatgtatggtactctgagaatggagagaggctgggcacctacatgggccataccagagctgtgtggtgcgtggacgctaaatgtaacaccaagcatgacctctctggctcatatgtatacaacttactcactctgggactgataaataaaataagataggtgtttgacaaatgatacgagggcgctaatatttattatcaacgatcatccaccctatcaatatgatcatcatcttgctccgataccccaaatcaaagacagcaacacactaaccatatataaaaaacacaaaccttagaaccattattacaataaccgatacaataactataaattctttctcataacaccacaatacattaactcccccatattacccacaatgagaaccaaatgaacgaagccatcccacaatatttcacatatattacctatattctatattaacatgcacccaattatttaacataaataaaaaataatattaaacaaccgcccatctattaatctcccaattaatatatcgcaactcttgccatcataaatacacaatacgataagatatttaacacaatacaagacatcaaccgacgacattaaaaatctctatatcttattaatctaatcccattaataatttatttacagtgtcttaaattaaatgaccacattaataaaaacgcctactgcgatcgtatacccaaacacgcacagttaaccccgttacacatctaccatttatcacccccaccgtttaaataaaagagttattaggaacaacatgactaacacatacgacccacacctatgatttatagttattacttctttgctatgagagagaacagatatgagt

SEQ ID NO: 6063 - DNA, 1031 bp, Homo sapiens
  misc_feature (1)...(1031): n = A,T,C or G
atctcgagtgagtatctcttacaatcgtgtgcgtctaataaaggcatggaggtgatatatacagcatgcgagcgttgcttggtcgtgaaaacgatctctagaaggagaaatatttgagcttgntagacgcgtccaaccgcgcgatagaccgctgtgangaggacccagtgagcagagctcaatacacgcgtcanacggactgtctcgcactaccgctctgtctgtgtgtatacatatataattatggtgcgccgatattcgccgcatagcgcggagcttgttataaatactaganggancaaggcggttgtcgtcgccacgcgtgccgacactatattanggccctgccacaagagcgcgcgcggccgcgtgcacacggagagataaagaanacacacaacgacgcgcgccgtgtacgatgaccgtatcttaagtatatcgctcgagagatagaatacgtaggtgacctgatctacttaagagagatagccgctgacggcgcctatagtctggcgtatcgcagataattgagtgagcgccgcgctgtcgctcgatttactcggggcggccgtttaccattaggagaaaaaataaacggacaccttagagggtatttgagtataagctcggcccatatggccggaatttatggacatggtaaactatgatcttaagcgcgaggagaaaaacgaagatcttcccccactgatgtgcaggcgggccacacgcgtacgagttggtcgcgatttatcccctagttgataattgatctataacggtctgctgtaattaccaccccacgaatcgatttttttttttgtaggggattagagtggcaagtgttcctttccctttctcgctggcctgtaaaaaaattcgagcaacatttatagcggtggccaaataaatatttcgtttccacaatttgtggagagcggggtaggcatcccccgggggtctagagacccccccccagatgataacaaagggctttccagcccaactctgaataaaacccaaagggaaaaggg

SEQ ID NO: 6064 - DNA, 811 bp, Homo sapiens
ccccaatccctctcatattatcaacgacgttgaactgaatgtgatataaagcatctaatttcaatttaatttttccgggattagatcggagagactgtctatgaagactgtcctatgatgatgactcttacgatacgacagagcccctcactgtgctctactacaattatgtacacacctaacaaacacggagctaataatcattattaataagaattagtaaataacacttgcggaacagcgatatgctaagacataaattcaaataaaataaatatattacgtgtcataagacaattgctactgaataaaagtttatgataagccaggtatatcttttatatgtaatccctcgctctatagaccatattattcggtatctcacaatcactcccgtaataataactataatagataaaaaatgtttaaagctaacttgtttacctattttattaaaattcatccctctgctcactgaggtaaatgcatattctgattggctcctttgtaacagctaattagaaactcaaaagaatgcaactatttgtctatcacatacttgtgacctggaagacccctccctgcttcaagttctccccacctttttggacaaaaccagtgtacttcttactgtattgattaatgtcttgtgtctccctaaagtgtataaaaccaagttgtgccctgaccaccttgggcacaggtcatcaggacttcctgaggctgtgtcatgggcatgcgtcctcaccctggaaaataaacccgttcggccaagtttttttttattaataatttatgataataaatttta

SEQ ID NO: 6065 - DNA, 590 bp, Homo sapiens
attttttttctttctgttgctcaggctggagtgcagtaacgtgatcttggctgactgcagccttgaacgtactgggctcaagcaatccttctgcctatacctcccaaatagatgattccacaggtgaagaaggacgtgtctgcttccctttttgccatgaatgtcacctgaggcctgtccagccctgtggaaattcccgcagaaacaagctgctgtgcttgtgaactagctatggtggacactgtgagtcaagaatgtaggcttcttccagacaataaggaccacttttgacccacagccaacaaaccacttaattcttttttaaccatatgaatagaaggggaagttgattcccctttgtcaacccctagatgacaatgcatcttgtcgttaaatttactcattcttgaatgtgtctaaggcagagccttatttatccatacccacctttgaactcgaatgcctcgattacacaaatcatgatccctatactcccccgtaaattggtatttattaaacgcgctacctatccagttcgctcgacaatagagtttagaaaccgtactacatcccaacgcggagattagttg

SEQ ID NO: 6066 - DNA, 736 bp, Homo sapiens
tattcattaactaatcagccagctaggcgagaaaagagagtgagcgcactaaccggccctgctactttatacgcctgcatgcagtgatttacttagtgcctggaaaattagagtatggatttcgatcaggaaatatgttaacgcaacacttgctgcccttcgcagaaggctatcgaagtgaccacccgccccctgacgtaataacctttattcacgccggttttccacccctcatatactccttccctgattcctcctgaatttcttcccactccattatcactgatgtcctataccaattttgatcgtacggccgatgcgtggtacaccatcgattactcgcttttccccagccgccattttagccgtgcgcttaccctagacaccctcatatctacagctgactgtgtataccccgatagagatattggtttcgtagttccctatttgttaccgccctcgttttcccccgcttcgttcgccccccagttatcgtggttgaaaattccccaccccacctatgtcgcattatctatcgctgtcccacccgccctatgaaacagaaggggtgcgaattcggtcgtattagacgccgcctttccgcctctaatcccccatttttaccctcattccaggcccagttatggatgtgtatccgtataaattcgcctatacagccgattatagcgccgacctatatgatttattgatcgtcgatcacgtattgttatatagt

SEQ ID NO: 6067 - DNA, 834 bp, Homo sapiens
ttatgcgggaactgactctcttaatctccaccgctacacgcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaagagacaggggtcttgccgtggctggtcttgaagtcctgtgttcaagcgatcctccctctttggcctcccaaagtgctgggattacaggagtgagagactgcacccagccttactcctctttagactcacaagcctagaccaatggctttcaaattcttgcccgtgacctatagtaagaaatacatcccaggtaactacacaggtcacactgtatataactgaaacaaaagtttactgaaataactcccttactgtgtgtgctgggctagaatcccttatatacattgtgtatttagtccccttctaatttactgactgctaccccactaaattaattttggtaatccactgatgggtcattacccaaaattttgaaaaaacaagcctacgaaaagaatctcggcatgtatttctagcaacaaatgagtaattgctgctcttatataattcctcacatggtaaaacaccccaagggacattttggatactcgggaggaaaaatcccatttgacacccaattctgtcgcccaccgttttatagaatgtttcatttcatgagccccccgctccactaactcgccgccactgagtacgttgaccttattccgaatggctttcagtccactcacaagtggggt

SEQ ID NO: 6068 - DNA, 790 bp, Homo sapiens
gctctcccttcaaacacccgttaacatccacagtggcggataaaataacataagacagataaatcaccgcgggtggagaactgtatccatatgggactaaatttggaagcataaagtatatttcttcagtcctgtcagcacattatatgtcattacggagttataatatattgaatggacgtttttgtatttgattctagcgacgaaagaaataaggattatacttatcagcttccttataaccataatagagcttatactggatggactacaaacggaacttgtatactattccttgataatttccgatggcttgttccatgtaacccggcgatcaatagttaaccccccctatttactccaaactctgattataggaaggcgtacaaataggtcagttgtagctaccgataggtgattgggctcaacgcatgggcttaattggtatgactcttaatgactacttaatcctgtggcaactgaacataaagaaaagaagtaaaaaaggtacaaatatcaaaaagcacagatcactgttcttcatgttgtaagagatgatacagatgttgataaatatgtagctggacccgaaagcaacaatatgtgaaaaagtgttgtgcatactacaagaccaaaggatattggtgtctattaagtaaatgcctcagtttatttatccccttgatgaattatagactataatgtggctgaacgttgtatatcctaaaataaacccgttgcgcagaggtgttttttttatctaaacatttaaaacacgtaccaatttgat

SEQ ID NO: 6069 - DNA, 1488 bp, Homo sapiens
  misc_feature (1)...(1488): n = A,T,C or G
gatattatcactgagatacattcntnangttctcttctactacatcagangnaccctctcnanctctggcagagcgcatctctgcgtcgngnacttctgtagtgagcttctcttccttcgctgnccgctactcgtctanngtgtgantcctggtgctctatctaggaatagtgaatgaggtatataccgngnaacatgtactcagctactacctcggtactctcctcgatcgtcgtggtgcgggtcgataatggatagagggaggtagtactagagatataccantttcactcgctgtgncactctgacgataatcttatctagttggtggtgnagtgtcattagttctcattcgatcagagagacgaatcatctntaagtgatatatatctactctcgttgtcacattgtactcttttcattatatnaccactactatattcacttattaatcatatanactcattagtataatctagatatttangtacatcaattactcttactannnaactattcacatgacagtcatgcatcattgtataantattctctggancatatctgatacatannncatctcttaacttatacaaccccttacacacaactnnnnatctataatcactctattgtacagatcacattatnncccctctataactaatataactgccaatacattcattctgtacganccctcttctggtcnncactagtgatgaaacttcgacatcatctaatcgactcctgccatctttattcttgtnnattctctcatcaccatctgctctcganatactatctcctntcacgctcttactgcctacagcatactcgattaatggttancactatgtctaaatattacataatataacngcagccttgtgcgctgntgggtctgttgtctatctggagctctngtatagcgggctacttgtcactatcttcatctcatttgtactcttatctcctctcgatannatacctancgagnnattaaagacatcgcacactaaccactcaacccaacangcncatacctacccttatcatctntatactttgatagttattgtgtgttcgtcttcatcctacctttatagttattactactcataagnacactttattctcatagtatgtgagnttgcgttcttgttcgttgtccgccattagtgtnnacagtcgtctatatgttctgcactactaattgatnngcattactnctacccttcactctcttcatntccatctctctntnactcctctctacatcttacccaattccctcccctttaacncctctaccctcacctactttacatttnnngnacctctctgattatttacatgcnaatctctattctatgtttccatttccttaaacttctctcctcatcacaatccctctctctccttttcttcttttactnccttctacacctcccccttcatnnncttaatcatatntncatttttaat

SEQ ID NO: 6070 - DNA, 1197 bp, Homo sapiens
  misc_feature (1)...(1197): n = A,T,C or G
ggtgagtggtnatgagtagatatgnanattgattataattaatagtnnttnnttattaaatgtattaagtngagtgnagnataggaggatgttagtaagatgatacgagaacaagatgtacactttgtgtaagtatggttgcnnatggnattttttaaacttattattaattatatgaagtagaatgtatagtttgtaaataatgtanatactatgtaaacaggctcaccgtgcttctctaaatcattccatctcccgcggcnccnacctctcctaacgctcgcgtctcaaccccctacgagtgtttacnccatccgagttcgcacatgttactttcttgtctccttctctatttttctctgtctgtttatttcatcttcttacctaccctttctcttcatcgattgcttattcgacttgttnnctcttcctcatcgtgtttggcagttgtcttctattgctcaactccccccatcagttctctccactgcaaatcctctattttttattttcaagatcaccacaccaactatctacgccctcagctggtagttcatagcnccccgccgctcatagttgnntcagagtattcattacaatattatctatcccccacacaccaaaatactacctatgaactaagattnattgacaactggtgctatgtgtgtgatatatgttgatatattccgttatgatcattattaaagtaagattcnttcttcttacatgccactatcgcactcacatttattcatcttatattgtntaatgcattagtctagctctcgagatctttatccgatagtaagttgnnaacgatatagcacaatgtnaactactattancaactccttatgtatacttnatttctnctcttattgcctcctctatcatttccatcatctctctctacacactgtatttctatcactatgcatatatacacatattgctctccacgatccacgccttgacccccaatcatcacgccacctcatcctacgcatctaaccaacacacctccacacgatcctcttctacctcatattatactatatcattntcgttaccanctactattattatccctctcaatttagtncatagtacactccncgtcatctgctcgcattctccacacaaccgttnactagagagtctaaatgagncctaacatgatcagccacacaactc

SEQ ID NO: 6071 - DNA, 863 bp, Homo sapiens
agttagagctatgtaaggtggcatttagtttgtgtatctataaggcgatatctaccataaagtatcagattttttgtttagattgtaccaggaattaggttagggtacgcttgttaatcttaaaagaaaggggtcaaataggtcaaattctggttgttaaaaggtcagagaaaagaggatacgccaatatggccataagtttgttatgagagatttttttagcatctaaataaaacgatgagagaagcggtccattcactcgtttagtgggggtccttccaaaattccttcaaggaataaaatggacgcaaaagattgccaggggatagtaatggtttgaatacaacttgataagcttaaattatctaaagattaagagaactttgtatctaaatggggaatgtatattttttttcaagcatgcacacgtttaagggactgacccatgtattaaaacaatgttacagctttcggactcataaagattaatataggcaatgctctcagctgctatgtaataaaggtaagaatgaagtgacagaactctctacatttgaaaactaagcatatgattaaatgacattgtgctaattaggaaatcataaaggaaattaaaacatacatacaattgaaagataatgaaaatctgaagtacagctaaagcagtacttagcagaaatttatagccttttaattacagccttcaatataggagaaacaatgaaaagcaaagctaagcattcaattcaagaagttgtaagaagagtaacatagaaacccaaagtaacaagaggaaccatacataaagggctatgcgtccacgtttttttttttatttaattcgtatgaatattgattaggta

SEQ ID NO: 6072 - DNA, 835 bp, Homo sapiens
  misc_feature (1)...(835): n = A,T,C or G
attcggccggcgccgggcgcccgggggacgggcagcgggaggggatattgaactccgctgactctctttttaacccccctgcccttcctctcaatgtctactgttgcccaaatcctttncaaaggcnacggggggggtattcactctacaccccccnntncctttnnnntctnctcaaancctatactaactttnatcctaaaccaaatcctttaaaccttnaaacccccctcccnacccaanntntnactaanntcacccttntcaaccttttnaccggggggggggantncactanaccnnttcttaccttaccctcccaaaaannncccctacannaaccttccctcancactcaattcacccttatctaaccctcctaaaaaacactaattttaaaccctcttaaaaacccctccttcatttaacaccttctcacctaaaaacttccctaaaancccctccaacccccccaaaacctctctcctttaaatcctctactccccaaccccccctaaccttccaaaatttttcccattctcccctcaactttccccaacttttcctcaaacacaccttttttccaccccctttattaccttcccccaccttatctttccccttccccaanctcacacaccccccctcccctcttcctttnctttttaacccattccccccctttcctcccacttctttttccctttcattaaacaaacaaccacctcctttttccccctnacccccctccttccccatcccacccccccccccctccaaacttttctctactccccccttcccccccttttcccttttnaaccctccccccact

SEQ ID NO: 6073 - DNA, 1501 bp, Homo sapiens
  misc_feature (1)...(1501): n = A,T,C or G
ttttnnnnnnnnnnnnnnnnnnnnnnnnnnnngggtttttnngttnatanngtnattantntgnnntnnnntntnnnanagtnnnnnnnnnnttggnatgtnntagaggntntgnatttgagtcgtgtaaggtgaatttagtggtgcaggatatggtgtatttataagttaaagattgtgaatgcattaatgntcggagggatagagatggagtgagatttaaaattttgtatgtgatttattgtgagagggtagattaancagatcataattgtaaantctatcatccagatgaangaggtggtatgtcgggttagatgagtagnagaagttggagttgagttgtgacttntagcactcgatatattgttatatagtagaggagtaggtagtatgatgggatggtatgaggtgatggttatagagtgttgagaagttgagtagatgtgagaatttttatgatgagaagtagattcgtagtanacactcgacaagaaagtgacgaaaggctccggcaagagtggtgtataatatgccaaagatgaggacgcgacgataacagacggcagctggtcgtagagtgagagcgaggagcggtaataaggtgcgcgagagtgacnggagtaacacgattatggtntgagtgtcgagcgagaggagagtgcancggacgagtcttctggtcaggttcngttnctagagagtgcgatgacgtgtcgctgatgtgtcgttactgctgcgctgttaatgcgatgcattacatcacattagagtatgaaagataaaacgtaaataacacacgtangcgatatgtgagtggagttagagataagtgantgtgnaagtactattaagtgtgtatatatagtattagaagtgtcgtagagaatagataatacttatatggtggtttattgctgtataaggtatgcgcagtagatgtgtgtgtatgtatacttatnattctatagtgctatgtattatatacacagatgatgagtgagctgatataattagatgaagaggtagtgatactgtgcgtgaattgtgcgtntcgcntactgtctcatacgaangtgatattatcagcacangagtcagcttaagtgatgaaantattatangacatatagatattcacgagcagttagtttgtcatcgancatgtggtgatgcgangcgcggagcaggatgcgttagttaagagatctagattgagtagtgatgtgtatcacatgtgatgntgagagatggaggtctactgaacgnaganacgaacgaggacccatgagtcgacgtcgctcgatagtgcgtagttaggtagctcntagtcagacgatcgatgttgatgtatgganctatacacaagataagagagagataagcgagatagcaggtgagagtgtatgatgtgtcatagtgtagaatgtaagtaggtcgccgtgtgangtggtgtagatagagatgcgtctggtagtctgagttgtgatacggtacgtcg

SEQ ID NO: 6074 - DNA, 2093 bp, Homo sapiens
  misc_feature (1)...(2093): n = A,T,C or G
cgcgagtatntgtgaggagagtagggtgtacagangtggtgtgagataagagcgtacagcacaacacacacacacacagagacagacgacggccgcgacgactcgaaaaacaacacatgcaacggcgaactgaacgaggcgcacgganancaggacgcgacgagcagatacgcgatntaacgcgtacgagtagtagacacgtacagtacgttactccctctatccttaccaccactnacgcgctcactcgctcagcagcacacgccagatgntatagtctactgcgtctangtagtgatgtcanactcatacgcgacacacagtcgtcgagttcgtgacgctctcgacagagcacgcaggacacaccgagagagtccgacncgtacgggtagactacgcgcatagtaagngccgtagtanctcagctcggcggccaaaggcgcaggcgacacgccgacgcgcaccgccgcgctgtccgcggcaagcgtacgacaggacgacgaggcnaccacttgtgccagatcgccgagcgccgctccgacgcccgcggcgcctgcgcatgatgctacactacgacgtcancagcatgccaccggatgcgcgctgacgtggntatcgagtgacatgttntgccagagagcagtatgtcgtnagancgcgtgacacttcgntatcngtctggatnanactctatncgtgagtgtgagtgatatgctcgagtacgataatgacgcgncntggtagcaccatccacagcgcgcgatcacgcattcatctagcgangagcgtcntagancgagtacgtaanatacgnncagtctntatgtgttcagcncactaagcgttgatcagtgcatcgacgccgcgctcgtggcgtgacgcgagcnangttgacgtcatatagtgcntnactaacctcgnttatcggcantgagtgtaggagtacgtagtatatgatagtgtcgnatgangatctagagcacggaatacatatatctagtctatgtgcgagtcgtcgcatcgagcgcatantcgtctgagtctacgctcntnaccgtgtcggatcagcagtatcgattgcacangtatgagtgctacagcccgtcgcgactgcacccgacctcagagcatatncacgctctgtcgcgcgtcgngtcatgacgcgagtcancgcgcgagtactactcgactacagtatgtgagagagtntagtacangcgcnacgacgcagcagtncagtngccttcgntctctaantagantaaggtcgcagnatgncgtcgcatcgtcgtntcagctntntatnatngagcnnantctcnctcatnattgcntcactcnctcntatcnccgacgacgatggcncgntcnagcanantgctcagncgatcnatnantangtntgnagcgcnactgcggcatggcgcgnctgcagagtcgncagctnatggcgncgcntatcgcactatgaganattacacacgtcagcgtgctatcgtangnagngnctncgcacangnatgagctgacgccntgcgcgacncgtcaccacntcacgcgagcttcgtagctcactactcgcgccatcntcngacggcaactangcgncagtcctagctgcatcatacgatgactacanacncgtntgtnacnagatcantgcnctgagcagtctatagctcgagttcggtggcccnacagcacnagtcgtgacnangtactgctcgngtngtcatagtgacgcgtcatacgcngnctncgatgntgcncatcgaaggagcatgcnagacntgtcngtcgctgnacacgcnatcagantcgangcncagcnntnncnatattgacttacttngatgngntgncatccgtgacgcnacgacagctcctancagcagcctcatgatgcgnagtatagtcngaacgactaatctactantcgtcgggtagcgacgagcgtacagcagcantgncnatctagctagcatncncggctgcgcagtantgtntctactnacggctccnngggagtatgagtcngagtgagacngcngcaactacngtggtgnagtngcgtacgcncacggagcggccng

SEQ ID NO: 6075 - DNA, 1027 bp, Homo sapiens
  misc_feature (1)...(1027): n = A,T,C or G
tgttatttaacaaccatatccaattaaaatcccntgcgcggctaactgcatccactctatttatttttcaccgctacacctgcctgactcccccttcatgtagcaaaactacaaatacctacagagacgggtcatctttttctcccaataaataatataaaaaacacccccaaaaacccccccctccccattctctcataatttataccaacccacaacccgcccatttctaaaaagagacccatcacaaataataatttatcttcccttctttctttcccaacctccccccccatattattattttctaacctcttacatcggggggggggcttcctatttcttaatttcccgcattaactataaccataacgctcatctaatctccccgccgccaataaatactctcttattaactattcctccaatgacatataaccataaaattcaaaatctagaaccctctcataattttataagtatttcattattcactccctatatatgcagatacctttaataaacacaaaattccaccctctttactacacgttgaatccagccataaataacaatatctcctaacataccatacacaactatttacatttcgatagtgaaaaccagcgcactacctcccacataatatacatacttcaaggccataccgccccatatcacaacgaactagacatttaacactatgtactcgatattatcctcgacagcatgtatcacctcattctcaccccgaccactacatattataataaatgcatagtggacgtaccaccctcatcccccgattcgatatattattccattactatcactcaaccttctcaatctatacttacatacagtcagcacgatagcgattatattcactcctccgcacaaccatatcccatcgcctagtttacaatcttcagcacatccatacatacacacactattaataagggcttatatcataaagtaaaaaaaaacacataacaatcgactacacaatacaaatattaataaa

SEQ ID NO: 6076 - DNA, 1296 bp, Homo sapiens
  misc_feature (1)...(1296): n = A,T,C or G
cgagtctcccagttaatcgcccacgcaatcaacagataaccgccaaagcggnagggacttcngcgggggtacaacacggtcnctaaatgttcgcctgtagcaatgccgtgtggagaataatcgcaacacggagggcagcaggcccacgagttattgttcttgggcgctccagtcaggtctctcatccgctggtatttaaaatatgtgattattcgcgcggccaatatgtgtttccttgctacacgaaacaagagcgcagtacacggtaaatactcgcgccgatggatcgctccattatatagaaccacccgtttttctgagcagatccaaaaagcggggcacctcgcgcgtggcgttgtcgcggggactatgccgcttaagattaaagagcgctactttggggcgagggtagttttcgttagcactccgcagcgcccgagatatgcgccgtagatcatacacgatacagatgatccaaggcgggagacagcaactggatctgttgagtcgagggcagcttggatagttgatttaaaatatccgcccccatcggaggcccgtagatgtagttatggtgtagctacgcagagagcgtcggcgtaagagagtggaatgtcccgattatccgcgggagccgtgtatttgcgacgcgggcgcggcgtgtggaactggccgtggtgaggttggtactgaatttgtcaaagaaacaaaaaacgcgcgtcaagcgagttcttctcacagtttcggaatattagggttgcctgcgatgcgaacgcactagtacccgggctgagaggagaggtgtgggttgcgtatgcgcgcagatgccaatcggtcccctcctgccgctctcgtataagacagtagtgtcgagtcacgaaacacagccaggcgcactatgatggtcatgtacaagaggaaggaccattagnatgcagtgcttgtcacttccgcggctgtgtatgttatgttacagacaacgtagttcgttatgcgctcacccattgattagcggggatcctcgtggngtgcatcaggtagcgagtaggcagctgagctcgcaagcgantctcatgtagagatgcgagagccacatacgtacatcactatataacgagtgtgcacgaatgcgcgcatgtgtagtagcggtatgtgcggctcantgccgtnagtatatgtctccgtgatctattcgcgccacagcngacacacaacgcgatantatgcggagaccggtggtagtgaggcgcggntgcacgngtggccgcgcgttgtgtttcacgtcccgccatacgt

SEQ ID NO: 6077 - DNA, 1094 bp, Homo sapiens
  misc_feature (1)...(1094): n = A,T,C or G
agggccggtatggcgagtcgacagtcgggtgtgccngcgtnnnnnnanaccaanngcganattgttttctaatgtanacgcgagagaaccaattttttctggcgggtgtctccccggggctttgtgggactccccaaaaacccgtttttcccaccccgggggcggggtggtcctcgtatttaatgggaaatcccacaaaaacccgtggtctaccgccaccgccggtgtgtattctgtgttttctggggagactttcaaaaaaaacatgcattaacacccctccccgttttttatctaactatttcggtcataccatgcacgtaatatcacacataacccacgccggggggggggctttttcccacagtgggcgggaccccaaaacaaaacaatatatccccactctccggtacgttttaaagtttcacctagtgaagagtcacaaagtgtttttttttgggcactgattcgtctatttcggtatgatggctggctgaagcacagggacgttattattagaaggatcgctcaatgccatcggtacgaatagcggcttgtaccccctgtataccacggaatgtaagcttagagctattatttattatttatttggtgaaaagaaatggccgactatttgtattagtgcgactgcgaatcacgcattttcacttgaggtggttattcaaaagtggctgcgaggcgccagattgtattattagccgaatgaatcacataacggatttaaattcagtattcgagcatattagaggtatgattacttctacaaaagcgcccagatacaatcacaatagatagtagtagagaataagcanaattatttaaaaacatagtaaagtggcgttatgacaaactcatctatgtgtgtgactcgaatataatgatcagcaacgcatcttcttactcgtacagatgtctacatacacatacgagacaggatatatcacactgcatataatattctttctctaatatcatatgtgtcgtatttgtgattctgtatngagatatataattcgtacacactcccgcgcgcatcacatgtccacttcacggcaacaaacgtcgctccgcag

SEQ ID NO: 6078 - DNA, 1169 bp, Homo sapiens
  misc_feature (1)...(1169): n = A,T,C or G
ggttagaaaagttgcgaagaacggaaagaggcacgaacgggcaggaacgaagagcctaggctcgcgagacgactgctgcttgaatttctctcacgncgctaccagcgcaatgctcaataagtatgagctcagcaaacacatacgccccacgcgctgtgtcctcgtgcgtgcgaaaacgcgaccacacacaacaaaaaaataagtaaacacttgcgaagtaacatagatgtagagtcacgcggaatgcaatcgccgataaaacctctccgcgcgcccgcgacaaagaagggtggcgagatatttgttgaggcaattactctatagtacacgaataaagaactgctcaggcaaagagacgagtngataaccacgctggtgagaacaccatgaacagcgaggcgattagtttataaccccgagggaaagacgatgggcgataaacaaagggacgtgcgagcgcggggctcgcggatgaagagtggtgacctacgaagacgagggactgaggggatagagcgaggtgggggcccgcgcgaccgcacgaagcgaaaaaaaatctcgcacgcctgcgtatggaaacgttcgcgcgccggtgaagcgaaggaaaggagccgcgtgccgaaagcgggagacccaccgaggacatagaaaaggggcggggtaggtgagtaatcgcgaaaaaaagtggaaagaggatagcgtaagacgtgtgggtcaggtgcataacggtggacaggcgggatagcgaaacaatagcaccgaagaaccggcgatgtgtgacagtgcgcaataataaagaggcgcgcggtgggaagggatttgaggagggcgcgtcttgcgatcgaaatacgaccaaccgacaacgccgcgacgacgacgaagtagcgatcaaccgcttcaatcggcattgaccaaattacatgcgcgcggctgagcgttatgacacgataacgcgagcagcacgcgggagagatgtacggtagagcgcacgggcacaggaacagacggtgatgcggccgaggtcggtgtggggcgtaaccacgagacgaatatgcagggaggcggagccgacgggagcgcacgatcaggcgagttataccacacggcgtgactcgcaaagcgccggcggagggcactttattagcaaggagaggaagggacatggcgcg

SEQ ID NO: 6079 - DNA, 784 bp, Homo sapiens
ttcctccagcataaaaacaagacaaagttcctgcagatctgctctaacccaataataaaattggacaataagctgcatatctgccggaaacctgggactggcaatggagatgagaagagaatcagaagggagctgtgactcacgcctataatcccaacactttgtgtggccaaagtgagaggatcatctgagctttttatttttgagaccagcctggcaaacacaccactagagcagtttaattgccccaaggtggccatgctgtgaggaagtccaagagcccatatggagagaagacctggagaagtctcaagaccacatgaaggaagagagttacccagccagccctaaacgctggctgcaactgcaaccactgtctgactgaagtcagggaccctgaacagaaggactggctggaaccaaggcagaagaacataaattgtgaagattttatggacatttatcagttcccaaaattaaatacttttataatttcttacgcctctctttactggaatctctgaacataaattgggaaacttaattcttatgcttgactttaatcctctaaatcctgttgtcttcataggctgaaaatgtacgtcacctcaagacatcacctgatgacaactttggtcaaattggtcctaaccatgcgtgttgaaaatacgaaatctgatctaaaactacgactgggaacatttgaaatagtgccccctgaaaagaacataattcagcaattttatggaacatggtagataccttagggcaaacggctgcaggg

SEQ ID NO: 6080 - DNA, 1472 bp, Homo sapiens
  misc_feature (1)...(1472): n = A,T,C or G
ttgttagagtttaataagatgtaatgatgatataaagtaaggtgaagggnaaggtgggagatgaaataagataggcgagagtagntaaaattataagtgttagtaaatagaaagcccatggcgttaactacaccttagaacatatantgaatagacaatagaacgagaatgagggcggagcagtgagaagggaaagagtgaagggngcagtgcgtaagggaggnagcattctgtttatgctatgtcgtnccacaactctgacacacaaacaataactcagtacccncactcgtccggcccgctcactacatcagccttcctttcacacaagagagagggccncgctagggagcgccacgagtggggttcgcgatgatgcggcacgccagcatgggcggacgattggntgtagcttgtacagactctgttttttcttagtttacgtcggtcataantattcttcagagcgaagttgagaagtttagtgtggatttccacagactgattcggagagatgtcacaaatatgtaggaccaccgcgcgtgcgctcgagtacgcgacgcgcagcggagtgtgttgatttagtgtccgacggcgctcatagggcgtgggggcactcgcatgcgacgtcgtaaagtcgaccacgacgtgatgtgacgatgtcatcgccaacatacagtacgtagaatactctccgatcggtccgcgagttttacatacagtgtcancaccattataagaatgtgttgnttgagccgagataangcnggtgagagaggggtgacagtaaacgnagnanntaaacagtcagtccaagtagtgggttgaggatcatagttgatctgcagccaaattgtcccgccgcacacccgtaggataggtgttgttgttnttactanatgagatgtaagaacaagagtggctgcgtnttagtagaatgatgaaagtanttacgaganggagagttagagtggtccaggacgatgtggcgcncgactgtntgtatagatgagtagatagtatgcgtatatgtagatcgtgtaccgacatgctatacgcagtgctggtgacacatccctcctatcgtcgcntctgtanagacatagaagaagacagatgcncgcatactcagcgcacgacagggcaccacacacactgtntcantncgagcgcgacgctcatcgacgtgtngttctcgatcgtagtgtcagtgatgactgctcgagccgttgatcgtctagcgacagcgccagtgccgatcgcgccgcagcaagagatgcacagtgcgtcgccncacgtcgccgccntctgcatgtgcgctagtgcnntcttcgcgtttcgtcganagcaaggaagtagacacgactacgncagagaggagccaagacgagcagcgagtgtatgagagcgnncagagtcgagntgcgcgtntagagctcnntacatgtgctgctaggttgaggtagggtanc

SEQ ID NO: 6081 - DNA, 876 bp, Homo sapiens
  misc_feature (1)...(876): n = A,T,C or G
cttctgagttatgtgcagaggggacgacggatcccgcaacttagttagagaaagttggatagaagagtactttaaaacttatggccttgttttgttccggtgtttcgggcattcaagaggatgctaagtaaaagtttttttttcttgtataaaaaaacctctggtacaacgtgggagtgttgtgaaaaaagagactacgcttttgtccagagcccaacaaagaatgaatgggttacgcttatcaatacgacgctcacgggaatagactggcaaaaggatggtgatgtatcacggattttttcactttacaaaataaatgttaaagtttgggaggaagaaaaatggcttaagaataatcaagaaggcgtggaaaagaggaagataaaggggaatttctcgtactgacggggtagggtgggaaggtaagagcgtgtgtccctttaaatgacagggaaagtggggcagggtagtgttgggtagagaaaggcgaggtctctgtctagggttccaccctcagggacctaggtgaggacaggcacttctgccttcaagcccaaatgttgcattttccaagcccaccctggcctgcctcacccccattgtgagaatataaaaacccaagaccctagcaggcagacacaaaagcggttggacgtcatgaagaacacatggacagaagacacaagcagctggtagtggagagcacacggcggaatgacgcagagttttgctggagcaggccgccaaaggacccgactccagggaaaaaccatctcccttcttgctcccccgtctgctgagagctactnctaaacaataaaaccgtatgcgcccagcgttttttttttgaccattgcgacctcaactctacaagca

SEQ ID NO: 6082 - DNA, 1480 bp, Homo sapiens
  misc_feature (1)...(1480): n = A,T,C or G
tattacgcctggagcgtgttaggtgtagtgtggagggtgcgaggcggatgaattagtcggcnactgnctgctctggattttcgcaccgcttcagatagactcgccaggtatgaaaagtgaaggaatagatatagctgctgttacatcagcgcctccacaaagagtaggaataatnctctatctcttttnacgagcacgagtatggcagcggcagtcctatagaagtgaggcaatccctcatagtcatctgcccgagagtcgcgaggtgtagtacttatgctgagaggtgcggccactatcttgacactcgagcgcaggtgaattacagactacgagtggtagagatatgacaatacgggcgagttacattctatgtgccacgctcgtacgccttatttatctttcactcgnatcgatcgtaggacggacgacgcgtctcttgtacgatttcaactagtatgtctcnattagaggcagcctcgcaccccaccagtggtagccgtgccgcatcaagttgataccagcagtntccatgcgcgatagtgtataatgctctacactcctagcgcgcatacgtcacgctcgagaagactatactgcacattcatacacgcggctactctgtcgcgctgtcttagtattctatcgatgatgtatcatgcacacactcgcatgtgctgagcatgtgtgcntgtgttctccgccgacagtntatgattatcgtgagttggcattnagtgtggagcagtatggatggtatcagttactacacgtacgcgtgggccgcgtggtatcgtctacgtcgcantgttattcgtggcacatcgataggcgcgcagcgcgatgtcggccgcaccgactcgatcgcatgtgtcgcgcaccggtagtagtaataatatgcatcgtatcatgtgcctatctatctccagctcgtcctgtancgacagtgtcgagtcncgcagtcgctacatacgagatacagcgganctatcatagaagatatgctatatatatgatatgaaatgcatatctaacgaacgcagaggacgttgaacgataagnccggcgccctgcgcgcacgacgcgaacgatgcctagctgagacatagacagagcgcctatttgtcctctcgtttcgtttctgcgcgtagtcnctctactccctcgcagcagtgttgcactggtcatagangcgcgcgtcgccagtgagtagtcgtaatacccggtgtcatctcactgtacgttatatcccagctaggcgtcgcgacagcgtgtntatcaccagttatctcggctccgcgcgcaccctattttacggcgtctgcccggcgtatgtatatctatatacttgttgtaacacgcttgcgtgcgacgcgaccacatctctgtatactgccgcgcgcgctggagtctacccgtctgtctgtantatgcgatcggtaggcgcgcgcacgccggctcagtgggctgtcatgagtag

SEQ ID NO: 6083 - DNA, 794 bp, Homo sapiens
cagaatgaggcacacagaagtgccacagaggaaatgatggccccgggataggaatcatgaggccagccctggagcccacagtatgaaccagcatcctggattccctttcctagacacctgcaatgtgcttaaaggtggctggggagggttagcccacatcagccacgagggagttgttcctcttaaatggattttctagagaacccacttgggcctctctgagtacccctggcacatgtgaacattttaaccctctttggcccccttttaaaacctaacaacgactctggcctgtgagggtggaggcgcttaaccgaaaccatttgcgcactggcgtgcttaactcctgaaagatgctttcaaatctgccaagactgtcctgatggaattcctgccggggctggccccctgagcaaaggcactccttccttgggccttcaggtttctccacttgtgagttggaaatttagggctaattggtcatacaaaaacagaatcacatagatactaattagtatctcgggtttttcggtcgttgcccccgcctttttattttatacaccaacatacgcgttgtttccccccctcgtcgcctccccccttataggggagaaatagacgaatatcgctccccatttaacttatttaggggggtggtcgctgcttttggaagtttagtacccttacacacaaggcgttgtttcttttatttcacaaatcagcggagcccttaaggaaaccccgttgtccccagacgcatagattgttcccaacataaaaatgcggcgtcctcg

SEQ ID NO: 6084 - DNA, 952 bp, Homo sapiens
  misc_feature (1)...(952): n = A,T,C or G
ttttttaaaaaaattttaataattagnaaaacaggtcgttggctcaacgatggggcccaggacgtgctgtttttttttttttttattgcggacatgttagcattttataaccaacttattgagacggccgtctaagtattctctaccaacgaccgggagtcgaactactgacaccagcgagcacataaataagcgcacccgccaccggcaccttttcaccgcacaagccccctgcccgcgccaatctcccacccccaattcacacacgaagtgtgttagatactctgacccaaaaactccttctactccccccctctgctcgaacccaccgcagcccgagcccccccccagccgcgcatgatgancttcgcacgccgcccctcccgcgctgcggccacccctcccccacaacccgcaccggcaaccacgcacgtctctagacgcctcacggacgttagcgaaagagaaagagaagagcggcggaagagccgaactgctccatcgcgcagctctgaggatgaagccggggagcgggcagcgagcttctccacggcgagaggggtgcggtactcaatatttccgcttcagcacacccgcaatacgaagagtgaccatacagcagctaggcgtgcgctcccgtacgggcgtagtcgtaacttgcagagggcgtcagaaaccaggctcgacgcgcgtaatgacagcaacaaccggccacgtgacccacgtgacgcgcagncgtacctcacctagacgtgtatgtcgcgcgttgaagtaggtccccgcgacgagtcggctggtccttagtagccagcgaggcgcttgtccntcagcgtctcataacgcagcgttgtcgagtgcagcgtcatctcgcgttagcatcccagcctccctcccgcagtgacaacgcgtcctcaggtttctcacgcgacatcaccagtatagactgcggtac

SEQ ID NO: 6085 - DNA, 788 bp, Homo sapiens
atttcaaaccatgacttcaactgccttggactgggttaatgcactttcatttctgaactcttcagcatcaatcacatctggacccagaacaatctcttgacaaattcctacttggctgagctgttgctgtcaaggaaagtttcactgatgtcttggccacgaaatagccgcaagacccctgagcttgcctggctgtggccctgatcacagtctgcctcactgcgaggccaaaccaccagctggcaggctcctcactgctgtttggttgtgtgcccaggtgcaggcttgagactgcattctgggtattccacaggaagtctgtgggtgctatttttgaatgggtgcctcagaaagtcttcctgggaaagaacggaaagtgatccccaagcacatccccaacccattatggctatttgttccatcccaagtatcctgagaattctctaaggagacttgacacttacttgcagaggttttctgttttcttttaaacctaagctccctttttggggtttcttggccctcaacaataaagtcaggagaattttattgacaagctccccttggctggaggcctaaggaaaaacacttggccaggatctttcttacattgactttgctgtttcaaaaagagctttttgaggaaaagggggccgaacgtttttctgacggggcccccaaacgcataatgggattggtttttctcccccctgggcgagaaggttatagggacgccctcctgcccccctgaaatttgcttagccctgttatagtgtgttcccaaaatc

SEQ ID NO: 6086 - DNA, 971 bp, Homo sapiens
  misc_feature (1)...(971): n = A,T,C or G
gaaaaggtaaagtgtgatattaattacattttcttaattatattaattatatcagtcgatagcacgtgctctagcttgggaggacgggatgtctttataatttggaagttttaaaattaaatttaaaaaaagtagggccgtttataccgcaccgcccatctaacaaccacattctatcatagcctaatccgatatacctgcctcctctatatacccgttccactttactctttctcgaatatatatccctcttatctctcttattccttaattcttctttcttaatttttgtacaaaaaaactaatacaaatatatnatgattttaatttttttatacttgccatatccggcttctccagacacgttctcccatagcgcactccgcacatactctccgtcacattcgtgtcattactatcgccatgccccattaaatcgagaacaccccagatatataatgatgattcttttattcntattctgttttatatatttatatttnccaatttacatctataagtgaagttctcatcaactagcccacatcccctaccccaagtttgtttgtnnacaccagttcagactacattacgtaatagctgaagttgttcgtgtattcatatttctttataaggcatgtttactaactactcaataataacgatgatttcgcccctctcggcgacacgtcgactccccgcgcgtgtacctcctctantcgtcacgttgcctacagtgcgctctcagttcnccacactttcatagagtagtctccaactataacatacactacgtgaatcacgacaagacggctatcactacgaatcgacatatnagactgttgtatatttgccctccatattnacgcatatcacctcttcctgccgataggttacgtccaggagtttatccgcaatacaagatagcactaaccagagacacgtacttccagacgagaaacacagacgac

SEQ ID NO: 6087 - DNA, 591 bp, Homo sapiens
  misc_feature (1)...(591): n = A,T,C or G
acagcctctcaatgtcgcccaagttgagatcagtggcccggttttgggctctatgcaacctccaggtcccatgttcaagcccattctcctgcctcagccttccagagtagttacaggttcagccaccaagcttgccctgtggtaccagcttaatcctctgtgtggactcaggactcagacagcaaggggtgttttcacagcctaagggtttgtatcagtggagacaaaaatgattccatcttggatgctaatctgccatgctgacttctgatcagccccagtctcatgaatgcccccaggtttctacattagttcttgtcctttgtgtaaaaacaaagcaaccttgatgttatcacacaaattataggctatgacacacatagcattcttgtctgttctggaggatacctttggttgtcttgctggagcacgtatgcctcttctctatggtaggtaagtcttgagtctagggagtcaccgggcagagatatgcttgtcttgtggctgcccaagaccacactccgatcgtaagttaaataataaacacgttgcgaccacntttttttctctttttttcctctgtaatatatc

SEQ ID NO: 6088 - DNA, 769 bp, Homo sapiens
cgatcctcacatggggcaccggctgtgggggtctgtcctgcaggtcctgacacaacaacgggtgaataaagtacactgacacacagatattctgctttgccagcttgactgaccatccaggcagatcaaaggccacaatcaactcatgagtgtttaaacttcacctgcttgattggaggaccatcaatctaatgtatttggaatacttctgtaaggagatgtgttcttcttcctattattttttaattgatcatgtattaatatcagtattggttgatggatgtccattttatactttgaaaaagatccatgctacatcattcatttaattggccaaagcaccacagctttattaggtgctgggagctcattttgtttgaatcctgcatccttacaggacacctgacaccttatttttttgtttttgaaaacttgcgtatatcctggattaccataaatcctaagctttgtttctttattacctttgttttacctaaaatcaaccactttataaaagattgcatgtttctgatgctaaaaaatagattcaaaataaacaaggatgcggcccctttcctttaggtgaggttaatttatgaaccctcgttccctgacccgcttctcctggacggccggcttgcggccatttgtatcttttactctaaggccgagcacgtttatccacatattcccggggaaccgctggaaataaaatctgatcaaaaggtcttttaaatgcatataccctcttaatgccttccgcgttgcc

SEQ ID NO: 6089 - DNA, 908 bp, Homo sapiens
tactctcccttggttacccgttttttaggacgcaaggaaagctgtctgcaacgactctcttattatccaccgctacagatgcttcctgacctcaaaaatcagactccaagttcttcagttttggaagttggactggctctccttgctccttaacttgcagacagcctattgtgggaccttgtgatcaggtattctgctgacactcagcagacattgtcttcaaaatgtactctcaagtggtcaggatcctattctcatggtactatttcctcgcttagaaaataaaggatgaaatgaactacactatcgaagctactataaagatgaaagaagatgaaagttcccagtaggattgttgccatgtatgacacccgttatgaatagtatgtataataatgagccacatgcgtgtcaggttaaggcctccaacaccggacatggtagtagttgatgattaaaaattaaacaccggtcgcagtctcttatgcctttccagaggggtaaatttatcacctctcgcgtccctggctgcctgtgcatatgcggtatcacgcgtcgccacgccgcattccttttctttaagcgcggtcctgtcccgtcatacctcaggattctcgccgatatctcctcgactatacccgccgaacttgagtggttcccctacgcgcgccaactgtgtccgccggttttttggtccacaatatttagcttcatgtctcctccctctccacgcggggctctgaagacgatgtcccgttacacgcccgtgtagctaatcaaagtacgcatgtacccgactggggcttaatatgtcgtaggtacgcgaccgcctcgtttccattttccatagcgcaccaacccattatcatctatcattttacgcaagttttttctgtgcgcctatcccg

SEQ ID NO: 6090 - DNA, 215 bp, Homo sapiens
tgttggtcccgcggtttttgtttatgaatggaggagagagactagctgcagacactctcttattattccccgctacagatgaagaaacggaggcaaaaatacgttaagttgcccaagatgcagccagaagtagactcagatcgtccatgtttcatcactgtgtcatacctgcccaattaagataaattagtattgctacttaaaataaatccaga

SEQ ID NO: 6091 - DNA, 567 bp, Homo sapiens
tgcatcttccttcaccagctttgagctttggagatcgcagcataggtagttacgggaagacaatctcaggcccacattgatcatggaagtctaccttttaaagataagtgagcccaccaagctggaagggtaatcccccctgggcaagtacgaatttatctaaagaggatttaatgtggaaaccccggatccggcccgctaacgggtgactggacactttaagaaggttcggggacctctcccacgtaactgttaggccacataaagggtgtggaactccctacttaaacaaataatatttagccctctagagagcccggagggcccaagatttggtctttgggggggcgtaccggaaaagtgtgtaatttttagggccatttcttagggcaaaggggtcgtgtgtcgtctttaggactattccggtttaggaacacccggttataagaaaatcaaggtgggggagggaaatgcgcaaccgtgtcgttgttgaggtccccccgtctgggggtccattcggagaatggagtttaggatatattactctcttaagaaaaccgccggtcg

SEQ ID NO: 6092 - DNA, 780 bp, Homo sapiens
aaccctacctaaagggataccgcccgcacgggtgttgtcacaacaagatctacccttaggctgaccggcctcaattgcttatccaccgctgaagggaaaaaccctttttgagcaactgggaaacaaatcttaacaacaaacgctggcaacaaagtagaggggagataacccgccctttttggagtttccctctcctcccccaaaaggcccgtaaagtatgggccccgatgtcgggctcccttttatttcttaatttaaagccgaggtacaaagcgggcacagggttcccccccttttttataaaggttttaaccgagagtaagtgagtatttataaaaaggggcccttgaaacccattttttttcttgagggcatcttccagtgcaaagagaatgtttctcccaccctaaaaaaggtggttcgccctccacgacacaagggataatcgatttgggggggcgccgtgtctaccactccttctatgaaaccccagtcggcgccggcactttagaggggaaggagaccctgatcccatctcattgtccagccatttcacgcctatcgtgtacgatcgtgatgcgcgcgtatctaacagacaaggcgagtgtgcggttgttattaagatccaagataaaatccgtaacgtgacggcgggaatcttctccacttccgagatggtcagtatattcgtcgcatatagtccctttttatcccgcaaccaccggggtttaaagatcgcatgtagtgcgataattatcccactattgttctcccccgagg

SEQ ID NO: 6093 - DNA, 1434 bp, Homo sapiens
  misc_feature (1)...(1434): n = A,T,C or G
ccgccggtcgtcgtgcgtcgagtgcggcacaatggggacgcagaagattatttcttgtggtccatcgcactgcctatattcagcttgaatatctcgcatacgcacgtacagctgtcattgactgcgcaccagccagctgatgtgcaactgtagacggaggcaggcagtggatattcatatcccttatactcaacacgggtaacacggtgtctgcactcttggtagtgtttatacgaccagtaggtgtatttgatgatacaataacttttgtcgtagccttaggcactttgcgatgcaagaatgcacgcaaagtgcagcatctncacgttaggactcatcagatcatgaatattgagcatatctcgggtataagccatgatagctttaagcctcacttagtgggcgcgcatataaatttgcctgcgtcgcgttacaccgcactgttctgtagtatctgcttggtagtcatataacgcgactttcgtcatgtaaggctctctgctcgctcgctcgattattgtctcgtcagtcgagtagatctttgaactgtgcgtactacgaccttctcaatcatcatcatcgctatacaccacttcttgaccttagggtataggctgattgcgctcgtgtcccatcgtgatattgatacaataacgaaatcgtgtcattttgctttcctgcgccgcgccttcccttccgtatatcccatattgtgtaccaccaatttccgtngatacttaatttagtatgttccctttcgttctattctccatcgcgacgccagtgccttcactctttagcggcggaaatagatgtaatgtcaactgtgtctttatacgtcgcatctgtcccgttaactcgttgtaatcatctcctaccgtcaccagcagctacaaatacgttntgttccgaatacaatcatctcttatctgagatcacgttcatatctaatctctatgttgcgcgctgatctcagttgcctgcttctatcatntgtgtgtcnccttcgactcgctcatatggatgnttaagcttgttgcgtcctctccgtgggtgtcgtnatgctcctatatgtctnctatactcatatcccgtctncgtcgctcacgatccccggttacagatatctaccgtctagcacacacggagnacgtatagactgaggatgtncgcgacagtactttgtactagtcatagtttcgacgctgtggacacagtgcgctgtctgtcgtttaactgcagtggatacacataggtntatgaatgcttgtnattatagtctcatattggtgtcgtcgtttgtantnacatatgtgcantntagtctcagtgtcagctatgtgnctgtcncngcacgcgcgtcagtgcagtaactcatcatncncagtctgcgnctcggcacgcgctgacgctgagagcgtggntggcngcgag

SEQ ID NO: 6094 - DNA, 789 bp, Homo sapiens
catacaatctgaagtctgcagtctgcaactcagaagagagtcttcaccagagcctgaccgcgctgccaccgtgatctctaaattccagcttctagaactgtgagaaataaaattgtgttgtttactaaaatatacatatatattgctttatatgtaaaaattttaaactttaaatgaaaggaacttttcaaccattgatgtacacttataatgaggccacaaagaaaaacgtacatgctggagcgcattggcaaggatatcggctcactgcaacctctgcctcccaggtgcatacgattctcctcaccctcccgagtagctgggattacaggtgcccaccatcatgcccaggggattatcttttttggcaaataaaataacttttctactaaaacaggtcgggggaagaatatatctccagaatagctgaagattttccagagtggcttggctgttatagtatggggattaaacctaatgtttctgattaacattgtctctcatattacttacgaattatcgacaaaatgctaatttttcatttggttgtgaaaagataaccagatgcgacttttataatgggccaattttttttgtttaaaagaaaaatctcatctgaatccttggatcagaattattgtctttccataataaccccatttaagaattttgtaactggaacgaaacccttcctttgttttttctttccctctcattcatcgagtaaacattcggcatatcccatttatgaaaacatttaaaaattcgtgaatctttgcagcaccccag

SEQ ID NO: 6095 - DNA, 1333 bp, Homo sapiens
  misc_feature (1)...(1333): n = A,T,C or G
attatagtaatgatagantaantgtntnntgtntgtngnngtatagatgtataaatagtataaatantnnantnnntnatantanatatagcataaagaagagataanacatagaaagangtggnggnnnggncccttttnntttngnnnnnnnacnnnaannangagacagaangnnncgtgncaggngngnggancgaggaaaacnnnnngacgnnnngggncgncncnacacgngcagggncgagggnngggngggngcagngcgnggaggcggnccaccgggcgcgcgagcagnggnngnacacgagacgnanagacagnnnccnggngcnccnncnggccgcgcgcccgcgccacgggcgcgcgaaccgcgcnccacgcagagcgcncaanccagagcagcagccgcgcaaggacgaaggcacacagggaggncncacaaccgcgcgcccacacagcgagccnacacaancacaccagcagaccccgggagcggccangagagnncgcacggccgagcagagccaggcccccaagacggacacgacccgcacaccacaaacccacacaaacggttttttctcncncnnccncnacgcagcgcgaagagaacacacaaggaagagggnncnagcgcacagacagcgaagacaagngcgagaccagagagacgaaagaagngagaaggtaaangngcaggcaggccgcagggcccgccgacggaacgcacggcccggcggcccggccgcccgcaccaccagccaccaccgcgcgcagcaacgacgacccccccccgaccgacacacnaccgagccacgcgcgccccccaccacaccagaagccagaacgaaagaacagaagaggacgnagataaatgagccagccaaactatataaattgtaatattnncttctttagtanctatgttattatatatttctatgctcaagcgcattatttcgtaatggctaagtattatcttctntctcctagccggcgatatcttcttaatatgaaaatatagattgatatgcccgtttttgttagttttgatgccaccagttcatgattgttatgtatctatcatatacttatgccctctgttttatatttccatgcattacgttatactaaatcatccccccctcctcctgttatcactagaatgttactcctacttctcatatagcaccgctaaatcaacactccagaatggtaacacacacatctcttagcccttctcgccttccattaaatagatctccgagtttggtacaacacgtcataaaataccactagaataatactataaattatatatcaaatatac

SEQ ID NO: 6096 - DNA, 980 bp, Homo sapiens
  misc_feature (1)...(980): n = A,T,C or G
tcctgtcaagcaaatgatgcatagcaatcgagtgtttatgcatcgataccangcgaaggacatcgtgtaccaatcacantatcaggcaagaaagcaccgcntngaggatacatacattgtatattacacacataatatagacntatacaactggcacgaaggagatatcagtatggagacaccagtatagcacgagagagcgtagacaagtatcagagatcatggagcacagagcgcaggagtggggcataggcaacaacacacaccaacctggacacaagtgtgtacgccgcgacgnaacagtgcgtgcgtcggtgcgagtgaatgaccgatagtgcacactgcacgantgtgacttatantagacaagagaatgctaatcggtaacaacacacaacacagcctattgaaacataatgaaggccaactcaaaccgatacatcggcagacacatcccagaacaacacaaaaactcgggcgcctaaatctggaccatcaaaccgaaggacactatcgaggaacgaataacattaaccagagggaagaacaccatgaatacatccgtcactgaactcacatccgactcgaaaaactcgtcatgcttgacaagtgcagctccaaaatcacctccatacgacatacgcaccggcagataagacagcacccaccgtaactaattagcacgccccaccgagatctaaccgcaggaacccactgtatgaacctcaacaacttaaataggctaccgccaaatgcccccgcatcccctccaaatatatataactaacacctaacatatgaatatcctccgcctatcaaaattacccgccaaatcctctagccccgccccgaccataaatatagaaacgcccccgcgaacacccccgaaagagcgataaccgcggcaacagataagcggcttaacccgaagaagcgcggctgtaagacagatgagcggcgacgcggacgcaaatcacggg

SEQ ID NO: 6097 - DNA, 1999 bp, Homo sapiens
  misc_feature (1)...(1999): n = A,T,C or G
tggggggttntgttnnngtgggtggggcgcgnctcgggcgacgaggacgagagagcgggagaggaaggttttttttgtcgcactccggataatccatgtactagagcaggcagtcgtcttgtgtatgtgatgcagatagacaccaatngcacgaccgcgcggcggagagtaggagcagcgcgacgacgagggacacagagctnacgaggagagatgagtacgtgtaatagcagcagaccgattattacgttgnccgtttatgaaagtataccgatctacgatatagctggtaagcggctgctaatcatccagttgcacccacctcattctcgttgccagttatcagtggtatttcgtcgccaccgtgtacgcgtcaatattaacgaagtaaccgtcacaccgtttacctctcatcatgtgtaacgctgaccagcagaacaccggtgtattaccatccacgtccacattatatttccacagttccacaagcctgtcacatggttgtatgcaactatgtccagcagaactgtttagttacccacatcccggtgttagtacttattatgtgtgttcagcacatattgttggtgtgtcgatgttgtttgctcgttcctatgctcgcgcacttntgacctctgtntctttattaccgtcgaacatgataantnatgttcaacgtatgcgcaccgtcagtcaccagttcgccgcgtcgctccctgtatcagcactactggttcaacataacgccacaatcaacgtagtggatggtggcctccgcgcatcgacagtttgagtntgagacaggagccgacacagagtgccaccacgtcaacgaacatgtgagtagagctcatgcatccatagccctatattaatgtgtgttgacggcagaggacgcgtatgccacgcgtctccacaccgctgtatggtgtatcgatcgacgtatctcgagcccaagttagagacgtaagcgacactggatgcgcacgagaggtgcgcagcgncacagaggcgactatactcacgactatatgacatcgcgcatggtacngcgacatttatttttgtcgcgtgacggtccacacggcacatcgtagagcgagttgactattgatttaattaggacgantcgcgcgcgtggtcacgacgcgagatatacagcgacagctactctatctngtgtatgcagcgcgagtcgagtantagtcagcgcaggcagtcacatagcttcgtatttttacgatccgaccgacgccatccagagtcagtgtactntgtgtgtagcgcgcacgtcgcattatatctacgtgctcgtaagtcgatgataccacgactagntantgatagtagaccgaaacgcgtcgacacgcatcagatgatanccacacacangaccatgttcgcgcgaggcgatagcacgccgtcgctctgtgcgcgctgaatgtatgcgccctattatacncatcgtgcatgnatatcgcgttatgntccncgtctaaccngagannaacnacagcgcgcgtgctcntacatgtgcgtgattcantcagtgtcggccctcgacatacgtacgactggtgatatgatactagcgcacgcgacganangatgtgnacacatacgtgtggtatagcantagcagtgcgacganctgncgacttctntgcgcacacgccgcgatcatgttgcacgtccntgctcgcgntctataattactaccgcgcacagcagctcggcgaagagagacatngatngagcgatgtgtcatgctagtatgtaactcacagacgaccgttcgcgtcatatnacagntcgtcgccgtnctctcggcagcgtgtgtgatcacacgagcgatgactganaccgatgtgtgtagtccgacanattcgttactcaccacacgtcactcagtgctcgttgtctagtngcgcgcgcacacgcacantacacatcgtacatagtgtaatgtagcagttatgatcagcactcatatgacgct

SEQ ID NO: 6098 - DNA, 1605 bp, Homo sapiens
  misc_feature (1)...(1605): n = A,T,C or G
aataaatattaaaaaaataacacacacaaacacacaaaattaaaagtttttaaggcagaaggaagaaagaagcaagagagaaggtttttgagaatgtttatataggagtcacaacacatangggaggtgagaagatcaacaacgaagtgtataggagataggttgttttcatagggatacgtaagtataancataacacggattcgagtgacaaatgacatacaacgtgaggagtacacgtaactgaggataccgataatgtataggtatagtcttctcggttgtcgcgtattatagcgtatgacgttgatcctttcgtctatgctttcacacttaccgcgacccactgttatgagacaacttccatgtgttttacacgttcnaaatgcagtcatatagtattagccctttcccaccctgtgttgtctgcgactccactaatgttgtttttgtgcttaaccagatgatttactgtcaaatgatatcactcattctatttacccctcntccttcccttaccttacccatccactcttaccatgtgtcctttcttccgcgttccgctcttattgtttgtcgcacgtgttcacattgttttcaacgcccacaccaccgctcgtgtctntcgccgacactaccagtagtattagacacgagttgcagttgtctgcccccataataactgtggttaccggtaagtcgatgtagccatcgccagatgttagaccaccactattgactacacacacagaacatagtgagtgacttacagtacttcgctcttatcacatgtcgttgtcgttacagacacatgagcgnacgganagatacgagaacgatacggtttaacacgtttcagcccgttcttctatacgcccgtcacccgacctaagccaccatagaccgtagttatttagtatcagtgtaggctagggcgcgaagaagaaaacgccgttgttttattacaccgattagtatctaataaacaaccaaattcgttataacaacacaccagtcaagacgaacgttatgcaacactattgtaatactgatatatatggtgcccgcgtttgtatacaccaggcccagcatcttaacagcagcatttcgggtgttaacgcgcgtgtagccgagtgcgtcgcctggtatacagcacgtatggcgtaagtcggcacaacggagaacagcgacgtgtcgctcgtatgttgtattgcgcgcgagcangaaatcgacactgtgtaaatacccacgctgcgatgactctcccacagcgcgtgtcgctacaccctcaccacgcacaactctcgccgccacgccatacattancgagtctagcatntctataacgccgcgtcacgtgtacgtctgcagccgtctcgtgtcatttttgcncgctgtgtaccatactgcgtgtgtgtgctaattcacnttcgcgatacatcactcagtgtgaatttgacgcnagcgtgccanctcaatccgtgtgtcatacacatntgattatactacanaacaacaacaggcgcgattactttaggtnagctcatgcggcagaatccgcatcgacgaccttgcgtatcttanatntcgcgactctcanccgct

SEQ ID NO: 6099 - DNA, 204 bp, Homo sapiens
tctctaatatccaccgctacaggagcggcagctgtgagctgattgcaggctctcattatgcagcagcatcgctaatggcctgtgacaaagacatgcggcttccaggccttacccccgagagccaattaaacacacatactcccttcctgtttgcagcacattacaatgaaattaaactgaatttcaaaatcaaaaaaaaaaaaa

SEQ ID NO: 6100 - DNA, 1132 bp, Homo sapiens
  misc_feature (1)...(1132): n = A,T,C or G
tgtgggagagtggagatgagagtgagcgagatancgggaaagtaagtgacgganaagatnggagaaggtcagatgcggagtggaggggagaagaaggagaggtgagagaagaggagagatgaagtgagagaggagggtgggtgatatgaggggggagagaagtgggagaaagatagtagagaggtaagaagagatgtattaaagtagaggaatagaagaatagagagaagtataaggagagataagagtgagagaatggaagtaagagacaagaaggaagagggggaatatagagagatggagtgaaagtggggnagaaggaggagagaagagaagaagggaggagtaatagaggtgaggaagaagaaggaagaaaagaagaagagagtgaaagaaggggttggtggaggtatggacaaagagagagaggaagagaagaaaagagagagagggtgggggagagagagcgaggagagggtggttgggatgtatagaaagaagataggattgtggtagtgtggagaataaatggtggtgatggagaggagagagagagaagtgatagtgatgtatgggagnnggatataatgcataggacgttgagatgaggtgtntnaaagagaggaagagaggaggagtatggaaggaagaaaagaggggaagagtggggagaaaggagaaaggagagggaatgatagagtgggagagaaggatagaagnagagtgggtgggggagaaagagagggtgaggaaggaaagatgggagagatggagtggaggaaaagaagaggagagaggggggagaggagggaagagggaagtatggatgtggtagttatattaatggaggaagagcaagggaatgagagggaagagataacacactcccacagatagtggtaagaaggagaaggtgtaaagggggggtgtgtgaagtggatggaaagagaaaaagggaaggttgttggagaaaagaaattatggagggggataggnaaagggttaaagaaaggaaattgtaataaaggaggtaataggggaaatgataaaagatgaanaaaggggtggaagggaaagaatttgattttgaaaggccaggagaacttgaggaaggaaggaaaggttggggggg

SEQ ID NO: 6101 - DNA, 961 bp, Homo sapiens
cgtgtcggcggcggtctgcggcgggccggcctcgggccgtctccccctgcgcctgctgctgttcgctgtccgtttgttagcctcgtggccggcgacggggccgttgctgctccgtgcttgtctccgtccgcgcgccgcggagacgtggcggtctggcggctcgcctgcgcgccgccaggttcggtcgggtgtgggtcgcccggggccgcgggcggccgcggcggtgccgctggagcgccccctgcccggggcgttgctgggcatcggcgcgtccgctgtgcgtcgccgtcgcccgtgctctgccggctgctctgtctccgtttccgctctgagcggcgcgcgtcgcggctgcgggcgtattccgccggggtgcttcttgccctgtcggtctgcgctctctgctccccgcggggtggccctctgtggtatctcttgtgttctttttggcgatccgcgtctgtgggtgtgtccgccggcggtgtgcgcgcgcggctgggtgctctccgtaggcgggcgcgctcgtccgcctgcctctctcttcctgctccgtgagtgctgcgtcggtccgttccgcgggtgcgggctgtccgggctgtgtcgtgtcgtcttttccgtcctgcgtgcttgcgtgttgcttcggcagtgcggctgccctctcgccgcgggtgaagaagatgcgcgctgttcttgcgccgctgcgtgctgcggctgctgtgcgctgtctcgtgttgcggtccctgtcggccgctgtgtgggtggggtcttgggagccctgcctcgtcggtgggccgctggggtggctgccgtggttcgccgcgtccccgttcgcggcttgctcgttccgcccaaatgggcgcgctcgtctctcggggtgagtccgcgttctccctctcaccggtgtgttcgttgtctgtcaactgttgcgtttgtgtgtggggggtggcgccgctgggttgtgcgg

SEQ ID NO: 6102 - DNA, 596 bp, Homo sapiens
aggacttaagaggttgatcaccaatctgaagattgacttcttcccagggtccccactggctacctcattatctttcaacagcctcatgctgatatctacagcaaagcagcacacctcttttttttttttttttcttgagacggagtctcgctctgtcgcccaggctggagtgcagtggcgcgatctcggctcactgcaagctccgcctcccgggttcacgccattttcctgccttcgcgccattctcctgcctcagcctcctgtgtagctgggattacaggcgcccaccaccacacccggctaattttttgtagagacgggtattcaccatgttagccaggatggtctggatctcctgaccttgtgatccgctcacctcggccttccaaagtgctgggattacaggcgtgagccaccacgcccggccacacctctttttaagagacaacatggggtgctcagcaatcatggaatttgccaaaataattaaatacaacccccaattcttctctggacaagttatccaacatatctgagcctcggtttcctcatctgtaaactaataaaataaaatctacctcccaaaaaaaaaaaaa

SEQ ID NO: 6103 - DNA, 291 bp, Homo sapiens
cagtgctttggattgacagaatgatacccattttaatactgcacttcttaattgtgatgatacctttgaagctcattctcctcatagagcacgcacacacagagactggaagtttgctgtgaaagatcaagataaatattccaagaatgagaggcagttttgactgcataaaaaatgtttttgaaacgaaagaaacagaaaagaaatgaatatgaaaaaattaaatgtacctgaatattaataacaaaaagttgaaaataaaatttgaatttttattcaaaaaaaaaaaaa

SEQ ID NO: 6104 - DNA, 819 bp, Homo sapiens
acccttatgaggaagacgcaatcctttccacactgtttaaattggcacccctgttgaaggtcacttgacttgcacattctagcaatttaccatgagatcctaaagaagcaggttcctgatttgtgacaaaaatgtaagtgagctgatcctctaaagcatttagggggtaaactttttcttttcctactgttttgttctatatgtgagtatgccgtccgtatttacctaaacaatttgccatagctatggcaattaaccaattgtgattgaaaatgttctcttagagatgattaaaggtttctatgcttcataggcttataattcatattttaatgtttgagggactatcaagctacttggattctcagattagatttttgcgaaacaagatgatgtacgttctttggcccaaactccaaaaaaataaaaaaaaaacggcctatgttgaccttatcgaaggatcttctgcgcccggttccctttatcgagggtttgtttatggaccctctctcacttgcctccctgcttctcgggcgttatggacgcagtctagccgcatttctctccccctaatggctgttataatgttcattacacaatataaaggtgcctgccgcctcaactcatactgttctcacaatcgccttactaaggctggaattccgttaaccaggcctagatattgtgattaatcctcgcggcatcgcccctctaaaaaatgtgaagaaaatcttcacctctttcacttgtacgcacacccgtatgtgttcttaactacacactacacgcccgccactataaatttacttcggacgcgcg

SEQ ID NO: 6105 - DNA, 278 bp, Homo sapiens
atgtaggcacacaggtggctggacatcgagaggagcacatcagtggaggaacacacgggttgctggacatggagaggaatgcaccaacaggcaccggcagcggggaggccactgaccggcagaacaacgcagagtttggctggggcaattggaggagagcctcgaacactgagtggcccaactccaggggaaaaccagtctcccttctggcttcctcatctactgagagctacttctactcaataaaaccttgcactcattctccaaaaaaaaaaaaa

SEQ ID NO: 6106 - DNA, 875 bp, Homo sapiens
  misc_feature (1)...(875): n = A,T,C or G
gggtcgtcggggtaagggacacggtttggaggaaggaagaagaaaggttttgaggcactcncaaggangcttaaggaggacnaccangnnnagcgccacgnncacagaacgagagcggtcggcangagcaaggacaagagaaacagcccgcacaacgaccggaggaaaacaagacaaacacagcaggagcaagccacccgcacgcccgggggcgaaagagagcggaccagccggggaaacccacgcccgcaggccaggccaagaaacagggttttttttaacgcagacgagcgggaaaaaggcctagaaaagaggcgggggaancccgggggatggacgaaagagagcgggcaggccaccccagggacgaaagagagaggccacgacgagcccacaggccagccgccaaaacaggccaagagagcaaccaggcaaaggggaggccggcagcccagcgaggcaaggagaagaggacacacgcggcccaaagggcacccggcacgaccggaaaaggaaaagaagaaaggcccaaccccccaccaaagaaaaacaaacaggacccgccggcccccagcaggggggcccgcgccgggcgcggcccgacgaccgagggcgagagacgggaagcggccacgaacggacggagcagcgcggaggaaacaaccgaggagagcaagccgcgacacaacacaaagcagagagcgaggaagacgggcggccggccgaaagacggggcaaacacgaaagcaaaaaacacccgaagcaacaggggcagccagacggcgaggaagccgcanaaggggcaccggaggacgggaggcgagccagggcggccgcgcccccgcaccgaggaccggaagacagaacgcccagcg

SEQ ID NO: 6107 - DNA, 900 bp, Homo sapiens
tcctattaccccgcccggcggcccccgttcggctacacaagtggtgatttgcagaagtcacagaccgtgacatggccttgtgttgctggaagcgcaagttggcatagccacaggttgcagccctggcaagatcaagccaaagtttcctgtctatcaccttggcacgtcttttctccattctaggactcgtcgtcccacatccctctcgcggtcgctcaccgcccgctacttcgtccccccccgctcaatacgcttccttcgacatacgttcgctcacggacgtttatctgcttggctactgtcccacattatctctctcgcgcccggtcaccttgtctaccgcctctcccccccctccaccttgtccgcgcgtcgtccgtccccgccccccccccctcgcgcctcggtcctcgcctcttccttctacctcctataatatcctcccgcttctagttcacgcttaccccccttatcttcttacacactccccactctcaccttccctcccccctcccttttatttgcaattcacctcaccctcgaacgctcaatctgtttaataccacgcgcccccagatcgtcacgctatcttttctttatctccccacttcccccacctccgccactcctcagcaccgctcttgcctcgcctctttctcccccctaccccctctgagtttcactcaccacctctttggtattatctcgcttcgcgtctctcaacccctccgttctccgccgcgcctatcgtcgcccatctagcccccttattttctgcaccctatatctcgcccgttggcctcctcccttctccttctccctctctcccctcctccccgcgcttctccgcttcagttcttcccttccttgccctcgtgaccgtctttatatatccctttc

SEQ ID NO: 6108 - DNA, 1835 bp, Homo sapiens
  misc_feature (1)...(1835): n = A,T,C or G
cgacagacttctaccgatgatagctcgtgtgcgcgncgcgctgtgncgtcgcgatcaccgcatcncactagttgcgcataaccgatcgtctgtcgtcgcgacgcagatacatgnacgtcggtcgtgtggtgantncatcggactcgtgcgctgcacccagcactctcgcnagtacacatctatacataggtgtatggagtgtgcgcgcggtttgagtngcggtatgtccgctgcttcgtcgcaggatgcacncncagaagtctgtgtgctctatattgcgtgacgtgtctctgatctttctcagntgtcatgtatctgttaganccgaatcgnccgcctcgccgtgtgacttagtgtngagtngcaagatgcgcgtgtctatgagtgtcatgtctgatgtagtatgagtgtctgctcctgtcttcgtganattcgcgctcnngctcganctacgcgacgagatctactgcactgtagntgtatgntgagatctcgtgtctatcatntgcgctatatcagtaatgactgcgtgttatctatgcggatatgatacgtgctcgtcgcgncctcgtgtcgtaccctctgtacgctgctcnttancagctangtctcagtatcttatcagatntcanatgtgctgcagacgcgcacgctacggtcggtgcgngcgtcggtgantgtagcactanacactgtatcgtantatgccacacgcggttagagcgcgcgtgcttatgtgtngtcacgcagcgcgctgctcantcagattctatgtacgactcgcatcnaagtcgtncgacgactctactacatatatacatgtagttagtcatatcagggtgtgcgaggagntgtctnctgcngtacgtaactagtacatgtcctactgtatantatatacatatatttatcgtatgtcacatccagactcacgtattatatgaacantaactagcggtcgtagatgagcgatctgatgtgcagcgcgtagctagcgccgtcgtgcgatatgcacagtcacgagatcagcnaccagagacgactctgtcgagaggtcgctcttatccaagagagagatgtgagagcgacagaagatactctcgacgcgctctagcgcggagtgagnttantncggtgtcgtattgcgtnttgcagaggcgcagacgcgatctcacgtatnagtgggtcggtgggacggtngagtgncgtgacgcgcgntgagcgatcgcgtacgtatgtatatntacgctcatcttgcagtattattattgcatactgtntnatgctctgtattgtctgtagcagcatacanacatgcgantgncagaacgagcgtcgagtacacgagcgcactgtgagattatgttcggtactaacgtacctgagcanncaacctgattgccgnctgagagacgatctgatatatgtagtagtatgtgactcgttctatgcatgattgntgactgcaggagtcgtgggcgtttgtcgagaaatctancngtggataatntcgcttatcacgtcagtctgtatgantatctgtcagattagtctgcatatggctgctntctgtcacgacgtcgtggtctagtacagtgtcgcggttagtgtagacacagaatacagccgttagatntctgtagtgtcgtgtgtcgtcagcgtatcgcgtgttgacgcacgtgcgcgcgtntgtgctatgggtgcgagatagtggcgagggctgagtagtcgcgcggcgcggtcgtcggcgttcgtagtgatatatgtacgactaacatcgtgtcggctgcgcttgcataggcttcgcgattgcggtgtagtncaggcttcgatga

SEQ ID NO: 6109 - DNA, 766 bp, Homo sapiens
  misc_feature (1)...(766): n = A,T,C or G
tagcttcctcccttacataaaactttctttaaaaggctagggctncaccatccctttcacttaaactaaatactatatctaaactactccttcccatctctgaggttcaaataaaaatactcttttccttatgatgtggaccttaacctcccaaaactatttaaaaggggccggggttccccttcttctttgaaaaaaaaaatacaaacctnggggggtttccccacccccctattttgcttactaagaatggttacattcccccctctccctcttctaccactatcccgacacccctagctttaaaaacacccttacattattgcccaaaacccctttttattcctatcctgcacctttacccctagaaagacctagcttaaaaccctaaaactctcataattttccccctccccacaaccctcttaccttttcgccctattcccccttgaggggggagcagaacgccgcccccacccgccgccccgcggttcactccacgttgggcccagctcacccttacgcagttacctgaccccccaaactcctgagaacccgttttcacagctctaaaactgctttcacttttatactcccacattccgcttctttcatacctccccctatcctccctctcccccacacccaacttaccacccacattcctccctcccccatttccccaccaagacccgcacgctccgccaccctctcttcctcccctccttttggctccccgccaccccgggatctcgcaccgcaccct

SEQ ID NO: 6110 - DNA, 1900 bp, Homo sapiens
  misc_feature (1)...(1900): n = A,T,C or G
aaaanaaaaaaaannggggggnnnnnnnnnnnnnnnnnnnnnnnnnnnnnnnnaanaattnnnnaanattnnnnnnnnaaggnnnnnnnnnnnnnnnnggnnnnnanannnnnnnnnnnnngnnnnnnnnnnnnnnnnnnnngnnnnnnnnnnnnnnnnnanannnnnnnnnannnnnnnnnnnntagtgnnnannnannnnnnaannnnnaanagannnnnnaaaganannnnnnnnannannangtggagngnnnnnntaaagaagangnnannaganaanngnagagagnnnngnnantgtaaacaaaagnagaganannngagannantaagagagagagtnagaaggnnaangaggagggacaaatagtganaccgagttnatntngatccagntcgcggtaaggtcgcctccgccagagcgagcgtcncactaacacacantagtcgtgcgncagacacacagatcatgacggacgcgctagtgcgcncaccacacagccgacggtgaggctgtgcgtgccgngcgggctctaccgaacgcagcggcnctcgcactgctcgaccgcctcacaaccatcatnacgacgctcgacacagggacaagacgcaacacggatagacagccgaagagagctataatgacgcancacagaagtnaagcncnngacncnacgccgcaacaatatacatgcaaactacactccaactttatacagtacaccgtgcacctatcgtnctacacgctactccaanacgcgtcagagacgcacgcgncntcaccggcacgccgaattgacgagctacgcgaccgcgcncnacacacacgctccacnacagctntacatagcacgacatgatgatccaggagggnatgcgcaccgagacncancatcacgagcactgttacgcgtaacacaaaganagcantgacacgcgangtatgatataagangagatgtgccgcattggtgtagtcgtgcgatgatgacatgtgtagagaggatntcagagatagtgggntatatgtatgtacgcgatcgatgaaatncagagatactatgcgtcgactagtatagacaagctcctcanccttancttngcgcttacactatggtccatgtgatcagtatgcgtgtcnacgatatgatagaatntnctatgcgactaggcgtacgtgcgaacggnatgagacaatatgcgtatgcgcgagtagtgtctagnctcatgtacactggtctacggcnacacccacggtcatctacgacgtcagncgtgngtcgcttctagcgtgatgtgcatgatagtgctcactcgactgcgtcgtagactcgacactcacgtactgagctanaagcatgcntcgtagcctacacacgcgngatgcgacatcgctgtgtcgacgaaanagtcngctcgggcganctcgtgacgtacgctgtaattcgtagacgctctcacagcgcacggtcgccngcacgtacgaacgatagtagatgntagcattacacgatacncacctagacattctccatcgtgtactatngagcgcncgatcgctagtcgtcacgatcatangactgtgtcgntcagagcagagaagagagntgagagtgagctgcgcctgntagagagagantgaggagtctgngtcgtagaggatatgtgaaacnnntatagagtgagtcggtacgtagtcgacctcatatgcacntagtgacagtgtgtgactgactcgcaagtctgacgacagacagagagacacagagcgacgacgntgcganataggacgcgcgagagagagacgacacgcgcagcgcgcncgnacgctgtacacgcgcgcgatcgtgatcgcacataatcgtgagcacgtgcgtagtggnctctgtcatacaca

SEQ ID NO: 6111 - DNA, 1190 bp, Homo sapiens
  misc_feature (1)...(1190): n = A,T,C or G
aagggggggggaagggagaggacgnnnagganaatagnagagggaggnnnnnnnggttgatacaaatgaaggtatacaatttaggcacaaactttttggaccaaaaaattaagacattttctctaatgctttcacccagcacacggacacagaatagcgagaagncctgtttgtcgatagatataaggagagaacagataanacatgagcctcgcatggaacgtacgcctggagggaanaacacagaatgaacccacaagtnaccgcacagataagtataccatgtcatacgtccctgtaattgtctcaaagtgagcatggttgcctataattgctcgtctctaactccgctctctctctctaatttctatacctctcattgatacactttnnaattcaaatatgtccattaacgacaagcccggcgacggcagcccgccgcttacacagtaccaacagccnncaagacagcctctgcgaagatactgactccaaagccattcaagcttcgaccatatgcccncctccaagctaccacaacccctcctcatacgactacaggctatcgctaccccacacctcaccactcccactcccccctaccccagcaataagcacagnccccgagcgaccagaaggcgcaaaagtgtagagagcgaaaggaagaggagnacgacaaccgtcgtctcacgccgcacaaccacaagcccagcgtctagaggttcctctaccaccccgacaagcgattcacggccncagtgcnacataggtnnaaaggcgaactttattagcaagacaccgccggtccccgtagtaacgcgcgagtgtgcgcacccgaagaagaaagtgcaagataggnaccaggatcagaaataacctaacgnctgctgcacgatcgctccctgacatgtccagtcactgcatcagtncccatctgaagagtcctcccgctgtacaanaccaccccctccacgtgctcgcatcgagtaaatttcatttcatttctccgcagacagaggacacgagcgagagtgctcacctgctcggcaacatgtaatatnctcatatacgtatatagtcaccatcgtcgcactctctacagtccccatatcacacatctgatcccactatcaaagttagtgcccagtccctataagcccaacacagacataccagaaggagtggacgcg

SEQ ID NO: 6112 - DNA, 2007 bp, Homo sapiens
  misc_feature (1)...(2007): n = A,T,C or G
aaaccagccacaggngtcagaaggcgcagcgaaatcagatntctcagataatattaagagagacataanntttatatctnggtgtggttgcgccgtagtgcgagcntccaccatcttatatagnnngaagtagagacggantagacgggggagcggactcacacacttcagggnccacaacagcccgcgacanacgacaacacgcagcgcgcccncggcgccgnggagaaggggtgagagggagcggagaaaggcaagcaanacacagaccacccataagacacgacgacggcgcagacgcatccgcgtacacagcacaacctcaacgtacaggagtcaccacacatcacgctacaaatatagggagatgagacgtctagacacacatatatcatgtcaattctgatgtctgtgtatgtattctataatgaattgttaacgctagcttgacatctacatttgagtgatatagcttgactgttctcgtggttgcgacgcagcctccgcatatcctctatatttcgtcttagccttccgttacgtgatcgccgtagatttaatatattacaatatcaatcaattcacacgctaataactgaatatatatttatgatatgcangcttnacagtcgtaatcatggtgtagcgttagtgtgtcaaatatacagagctatgttgttatgttctcgtcacctgcagcgctcgttctcattttcattacgatctatantcataacgtatcngtcgacatctcgcgatcttagagtagtatacattttatgacttacgtgcgtcacgcaaacgcgacggttatgcgtacaggcgaagtatcaagacgagatagaacgcangtcacgtctgagaaagacacgaagcgcggtaggacgggtgcagactaagaattttgtgtttggtgagtatatacgcctttcanatgagtacaataatcttatcgattatcatcaccgtagatttactgttcaacatatgatttagttaatctacagggtggttgaagcacgtatcatcacctggtgtgtgtctgtcgagtatgagctatattttattattgtattacgtctaagtaatagtgcactggcacnttccacaatctatagattataattatgtttcgtatgtctgttcttagtatactcattctccgtcgtctgcggtgctcactaaactacagatatactcgtctatagacaatataacagcnagacactaatgtcgcgctcagtacataatatgaatttctcttgtatcgcgatattagtgtgtataggagtgtgtattaggtatctgctgcacagtatgttantatgcataatgtattgtctntatctcgagtattgtaacgatgcacgcgtttacttacatgttgtattgtgacttgttattaccattagcaanatatatacggaactatatcaacantcacgatgtgtcatcgatagcttattcatgccatatgtcactgtacgagacgtggtatnataatgctattntgtccgtagtctcagatantgcgtgctgtagttattgtcatgagtggtgtataggtgtngatgtagttaatatagttgtttattncacgttnctgacgagtatgtagtttgtcagatacatgacgtctctctagtttgtctgcaatagacgtgtgagaagttattgtgtatatanctagtntngtagtctgtcntgttagtgtancgttctatttattagattgtacgtcgttntaacgccnttgagtccantatactcagtgtatatgtggtatntaatcacggcgaggccgcgatttgagtgtacggatagagacatagatatgattttgtactgtggtantactctaatcatgtagattatgagtnattattatattatatttacatanctcgcttacagttcgtacaacgacgcgttgaanaanatgttttgtatatataantctntaatagcgcgagtacagtacagacttatacgtgagaagatcagtaa

SEQ ID NO: 6113 - DNA, 390 bp, Homo sapiens
catgaaaactgccttgggtgccatggcgcagcctgcccatacttcaggcacagagcacagaagattctgtggtttccacacctgggaagagaaaagaaaaaccttccagtgttcaggtagccacaacttgaccatggggaccccttgaactggcacgacctcccgtccgcacccaagtccccaccagcctgtccctctgatggttctgggctgggtgtggcagggaaagggcagaagtgagactttgacctggtgggtgcacacgcctaggtgtaaatctagctccaacatcttacatgagaatgaattgaattcagattctttaatggctcaccctggagttttatccctcctggtaataatttcatgaccaacacaaaaaaaaaaaaa

SEQ ID NO: 6114 - DNA, 480 bp, Homo sapiens
  misc_feature (1)...(480): n = A,T,C or G
catgccctggtaatgggaggaaggaaaaatcatcaaacccagatcctgaaaacagctagggtttggacaagtcagactcggttgggagaaacgtctgggaaaaggtgtgtcccacgaagattccctgcacacacttccctccggaagtttggtcggcacagctgaacatagtccagctctcaaagtcctccactgggacgtggccagaagcatctgggctacaagaattcagtgtccttctgagtgtcttaagaagagccgatttgcatctgaattctaggaactgtatgagtttattcacgtccatcactaggcccaaagcggcgttgttttccatttctccagggccttttctccagccgcccttgctctccacccaccccattcctgccccctcccactttctctagacatgaagatggtctcctgcctgattgggtttgaagtggaataaaaattntaaacagaaaaaaaaaaaaa

SEQ ID NO: 6115 - DNA, 496 bp, Homo sapiens
catggagtaccaattgctataccacattctcacttgatcccctttggatgaaatgaaagaacagctggtttgactgatgagaaaacggagacacttgaattaatctcactctgtctgttgcccaggctggagtgcagtggcatgatcttggctcactgcaatctcggcctcccgggttcaagcaattctcctgcctcagccttccaagtagcaaggactacagatgcgcaccaccaggcctggctaatttttgtatttttagtagagatggggtttcactatgttggccgggctggtctccaactcctgacctcaggtgatctgcccacctcagcctcccaaagtgctgggattacaggtatgagccaccatgtccagcctgaaaaaaaaaaattaaataatccagaggaaatgaagagtcacaaatttataactttactctcttcctctatatgtatataataaagtaatattcatgtttagaaaaaaaaaaaaa

SEQ ID NO: 6116 - DNA, 836 bp, Homo sapiens
catcctttcggattcccgtctgtgctctggggatgaccctggtattatctagactggggacaaaaggtgcctgcacacatggacacaggacatgaggactgaggcggaggccaggggaaccctgtggggcatcatcttggcctttggactccaatcccctgtgtttgcttcctgccctgtaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcaggtgcgtcaggagcccaacgctcagggtaatcggcgaaagtgaatgttggatagacattagcaaccagccagaccaatagccgttgaaacagctgacgttcggcgcgcccaaccggtggcgcaaggtccgggcgacgatcgagaaccatcaatgcaatcgccgctgtctccgtcataatctcgtcattttccaatgccagtgtcggaacctgacacaacgggttcggagtttcaataactcgcgtgaagctccctcgtggtcaaaaccactgacatcaacgaactgataaggaatatcagccagtgttagcatcagctcactgattgtagagccccatccgggtacgccatacaccttaatcatatgcccctcacaatcttttaaagattaagtgtaggacagtacacaggttaaccagcaaaaggatttgtcatttttttcgtcagttgtattaatcccccttcaggattgtaaggaaggtgttttgca

SEQ ID NO: 6117 - DNA, 1146 bp, Homo sapiens
  misc_feature (1)...(1146): n = A,T,C or G
gaggaaagaaagagaggaacagagtaggaagagggacgccgcgaagaggggacagagcccttgaagcgaggagacanaagagagaggagaggcttttcaacagagaagcaaccccgagngcaaacagaccgcgacgcggccgcccacacgccgcgccgcgacgaccgcgggggagcgcggggaaagccgccagcaggcnagagacgaagcagcgagggnagggcggaagcgggaaaggngcagaggagaggcncaggcgncacgggcgagccgacagcgcgcgccgcgcgcgcgccacgagccacccaccagcggnaccccaccgggagggagaggagggcggccgagagngcccgcgcgagcacacagcacgcccgcacgacggcacacgcacgccccgccaccagagcgacggaccaccgcacgccgagccccccacccnccgacaacgggcaagccgaaaaaaccgcacgggaacccgccgccgcacacacggacggagaaccagcaggcggcagacccgcaccccccgcccgagcaccggccccacaaccagcaaccgcccagcgccaaagggcgggacacacgacggacacgggcccacgcggcaccccggagacgcggccgccagcccacgcagcggcncggggcgcgcccgcgccggccaccgcccgaggcgacgcgagccgcgggccagcgcccgacccacacgaggagccgcaacccgacggcaaaaggggcacggtccacacgggcgcacgaccgccgcggggcgcacaccaccacacaacacggcgcccacacccgctccacgccgcagccgaggcaagcggnnaagagcgcggcaagtagcgagaagagagccttcgcacacgacaggcgccggcgcggacgcgcacaccaccacacccgagccctcacgcgcgcagaagcacaggaagagccagagaggcccaagcgagcggagacgagcacagcacggaagaggaaacgcagcaggcgcggaccacagacaaaaacaggagggngcgaggaaggagtaaacaacaaagggcgcngcaagccgcggagccgcagggtnncgagacgaccgaacaccatacgccgaggcaaagcaaacgacagcaacgaggcgctcgcgcacag

SEQ ID NO: 6118 - DNA, 736 bp, Homo sapiens
gcctgaagtatctgcctgtcaacagtctccagccccacctccccacccccactcttgggaatggactctgacaaactcaccatcaggaaagttgatgtttcccatctaggatggaagaatgggattctgaactttgtcactgtttctgaaacgtcatcagctcctgtaattgcatggttgggacagatctatttaaattgctttgaagttttcccaggaaattcccacttttttgtgcaacccaaggaattgaggtggaaaaaatggcactggcatcaatttgcttctcaccacgaccttgtgaaggaggcaggtagccactcatatttatgatttaaaaaatgagggatcaacaattaaaggggtaacagttctaggtgcttggactattagttttatcaaaaacacagtcggtataggttcattgacagctggcattcatcatctgaaattagatccccctttgaaattattctttctctcattttccttgcttttacatagaagttttttcttttttttttctgtaaatagttagataatggcatgggatgacactgcaaataggcaatataccatacaatcaattccatgtattaattccagaacagtttcctcattaatggaaatacaggatgcattctggtatcattattgttgacatttctctttgcttttattatattcaataaaatattgtattcaacagcttacctcagagagaaaaaaaaaaaaa

SEQ ID NO: 6119 - DNA, 990 bp, Homo sapiens
  misc_feature (1)...(990): n = A,T,C or G
agagaaaaaagagccccaaaaagagaacgggcgggacgagcactcttattgtcgaccggggggagacgcctaggggggcgaaacaggaaaanaaagagccggccgacgaggagaagagagttacaacaggaaaganaacaccgaccacaaaagacgaacgacagccgcaagacgcgaggcccgaaagagagcacnacggacgcaccacgccagccccgagaactacccccccacgaaccgcaacccagcaccaccaagcacaaaaaaaaagacacgcaatagtcaggacagaacttttttttcaaagaccggacaaactcacaccactaaagcagaaaaaaaacaacagcacacacggagacggagaggaggcaggcaggcgagaccggagggcgaggaaggaggcggccgggggcgccggacgcacgcacggacacgggcaaaggagaagcgagcacgcaaaaccgcgatcacggacaacgaaaagtcacaacgcccgcgcgaggggcggagaaggcggcgcgccagaagtgagcgcagaaggcaggagaggaggaccgaagtaggagagccacggcgaccgggccgacgaggcggaagtcgacaagggagcagcggaaccccgcgccccccggcgcgacagcaaaatagaggaaggagcacgaggccagcggagcgcgcggaacagagcgggagtagacaaaaccacaaagcgagaacacgagagcgacagcagcgagcccggcgagagaagcgcggcgcaggaccgcgcaggagacgtgaaaagagcggacccgcaggagccacactagacgaatagagggacggcgagcccgcgcgcgcagcgcgcaaagacgaagtgcacccagcacgccgacagcacgagaacaagcaaccgaagaggaagaacgacgcggcggcaagaacataagaggagcgaacgcatgggcgccagagcacgcgcacgaagtatcagagaggccccgcgcc

SEQ ID NO: 6120 - DNA, 804 bp, Homo sapiens
cctagatggcaactctgaaaccatgataggtgaatggaccagctatttgagcaccaggaaaggaaatggtcacagcagtttgggatggccccagcagatgaaatataacagagtcagtgtgagactcctggatttcctcactgtcctctggctgggactccagacagccccaaacctgaaggggcacaaatctgaaaacaaaaagaagtccagaaagccctcttgttcatgattgaagataggaaaagaaacttctttggctcaaagcgaaggctcagtcccctgcacaagcaggtggttcacacctgtgttctcatctctcataccagcgcctctccctgggttcacactgctgacctatggatggagacggcgtttcctgacccagtccactccacaatccctgtaacctgaaggcctgccgaccaaccctgctaaataacaatatgatgctgagcctcatgggaaatcccactgaatagaaatgcgcataatacactacaaacattaataattttaatacgtaaaataaacatcggcccacttatggtctatacaggctggatctcaccaaaacgctccccttaatgagagggactatcacggaaacactctctactgtgctaagtcgcttatatctacccttgcctgccacatcgctacttcaaactagaaataaacctaactcgtacatacaattaacataaggagaaaacgccacgcatcccccctattccattcactgccgaaacaactctatcaactaagtactcagccactctagtagaaccgtgaacgaacgct

SEQ ID NO: 6121 - DNA, 1101 bp, Homo sapiens
  misc_feature (1)...(1101): n = A,T,C or G
gccagaaaagaacaacgacccagaaaaacacaacaagaaggggggggggctcggaaganggaagggggggggggggcctcgggggggggcaaacaagagccggaggaaagcggccccgcgagagaaaggagacatacgacacgcaaacaaacgaacgcccgaacgcccgacaccaggcccaccgagagacgagaccgccgcggcagggggaaaggaggggagaccacgccgcacacgacacacgacggaagacgagaaccacgacgcgccgggacgcgcgagcgaagaaaaaagcggaggggaagaaccacaagcgcgcgacggagccttttctttaacacacgccggcgagagggcagcggcacggacccgacgacgaagcggaaacgcaaagggacagagcgacccaaaggaagcggaaaacagacgcacggacagccgccgcgagccacgaagcaggcaggcccagacacgcccggaaaaacgcagcgcacacagaagcgggagaaggcaagcaaagcgcgccagacggacaagccacaggagaaaaaaaaacagacgccagccgcacacgcacagaacgcgaccgcaacacaccagacaaacgagaaagcgcgcgagagaccaacggaccagaacgagagaacgccaccgccccggcaggcgagacgcaaacagacagcccaaaaagcagacgaaaccacaccacacgcaacaccgaagcagaacaacgcgggccactgaccaggaggcacaggcggcccaacgggcgcagacaccgcgaagcgaaagacacgcagagcagagcacagacgcaacacgagagccgccgacgcagaacaaacgccgagcaagcgccgccccgcgacgcacgaaacgaaggacccacccacgagccgacgacaaccgaggagaaaccgagagcgccacgagcggacgaagcacagacaagagcgacccggcgagcagcgccggaccacacacaggcgcgacccgcggccgagaagagcgagcgcacgcgcgaagcgcagacggaggagcgcagaaccgccacgacacgaaacagcgcgagcgacgacaaaggcacgaacgacccccgat

SEQ ID NO: 6122 - DNA, 253 bp, Homo sapiens
ctttagatggacagaggaagaaaaagtgaaggaggaggagaaagaaggaagaggaaaatcaggatgacataacaggaagaagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaatacttttaaaaaaaaaaaaa

SEQ ID NO: 6123 - DNA, 1193 bp, Homo sapiens
  misc_feature (1)...(1193): n = A,T,C or G
ctctgtctccgctccggagaggatctatgatagtagacgctctctatttactactgcgttccgtctactcgtatatatagacatctattatcgtctaccatgtgtttctnggctcgtcgtgtgctcaagtctatatataatctnacacgtacctggacgtctcagagtccgccagtcagctcgatcgtcgacgacactgtcgtatctnttctccgctcgtcacggactcantagtgngtcacatctgtagatgncattatgataagggagntgtgtcggtgttgcgtgtctcaggtgtgcgatgtgtggagtatattgagagtatgaggacgcgggctccgagtatgcggggctcatgcgggccggtacggtccnagctgtgcgaccattatctgntatgtagtcgtacgtttgtatagagagtaggagtgtatgatagggatagagagtgntagagtcgtgtgctgtgtcttcggatcgcctcgaacacacgtatgaaaccaattccgcactttagagaacgaatcacacgaatatcttggtgttgcgcaggggattcatggctaattattgcactctttcttaacggaatggcaactgttgtatcaagtgtaacctgatcaagcgtcgtaaactgtctactcttagtagcctactgaacttgttcgcccactacgtggctattctcgtctgcgctaccttcttatcggtcagtagctgctggcggaggcagatctgtgcataaaatattatccgctgtaatcgactttcttgtgttatagaccgcagattcaatatagacgggggggatacgtgacgtgctggcgcgcttgatacggcctggcggagccttgcggcggagacggactttctattgactgtggctgcgtcttcgtccctacgccttgttgggtatgctagatcatcgtaggtcacggattccattacctacacttccctcatcgtgggatagtagccaagctatcttcgattcggggacattgcgcgtgttaaaaagcggatcgttaggagtatattaagtgtcggcgtgactgtagcctgacgcgtggctcatctcgtggatagattcattaaaaattactcgggcgcgataaagtctactctcattatgtaactggtcgatcgtatcaattttacctcgggggagggcgctcgtagactgtagttgtctt

SEQ ID NO: 6124 - DNA, 1008 bp, Homo sapiens
  misc_feature (1)...(1008): n = A,T,C or G
ggccacgcaagcgaggacgagggagaccaagaaaaaaaagacccttttcggggactaacagcggacccctgcaggggnggnaacaggananagagaggggggacacgcaccacgccacggttacaaaagaacacaagaggccagacacagaccacaacacgggacaacaaaaaaaggggagccagggccgacgaagggccacgagacccgnacgcgccgccggcaacaccgcggccaaccacgacaaccccaggacaaacgagaaacggaggcagacaagagagacggacggttttttaaaaagagaggccgcgcaggcggcagcgcgcagaagacacgagcgacgagcgacgcacgcacaaccgaacacgaacgagcgaccacacacaagaacagaccagacacccagcccgagcacgggcggcgcacgcccgcgaagcacgacgaccaccgcaacaaacacgaacaccgcgacagagcaccgacaagggcacacanccgacacagccagaccacgcgccacaagcagaagaagtgcggggagcgacgaacagcagcaaacggcgaagcgcagcgagagcaacaccgcagcgcacgcagaccgggcacaacgccacgccaaccaagaagagaacagggagacagccgagggggggacagacagaacgggcaacgcaaaacgagaggccgacgagagagacgcagagagaagagccgcacacaacaccacagaggcaaaggacacccgaaaagcaaacgagagaaggangagacgagagggcggaagagcgacagacaacaaacgccccacacgcgacaacccagaccgggaggcaccgcacggaggaacgcncgccacacaccacgacaagaagaaccaaccacagacgccagaagcgcacggacgcacgaccgcaacacacccgacaaggggagagcgcccgcggcggagaggaaacccaagacgacagcgaacacgaacagcgcgaaaaccgacagcgagaacac

SEQ ID NO: 6125 - DNA, 1465 bp, Homo sapiens
  misc_feature (1)...(1465): n = A,T,C or G
ttttttttgtggnctgtgntnttttntcccgctcttaaggttggcgtcttagtttctgttctcatgacctggaccatctctgctggcattagcgccgcgcatagtgaatagacaggctcaagggggcaaattcacacaggctgggctgtcagggggacgtagatgacgttgtgtgatgttatttaatgtttcttatttgaataaatggtatgtcaatcaccaaccatcaaaccccatcacactccacaggtgtgtttctgatgttgaagcatagatttacacacggccggcccgcgcagcggcgcccaccgcgtgggtacatcgctacaaagctcctagtcacaagaaacagacccaccattcattgagtggtttaaacatactagancaccgaggtgtagcacgttagggtaaatctagaccgcgaactacatccaaagaataataaatcgccgaggactggtgtttaccggacagcacccccccatatcaaactgaacagattccagactatcctccgtgcgttgtggcgttgaattacacactcttcagtcttagttatctctgcgtatgcacgaaccttcgtattccctcaaagcattacggcgcggttcaaatagaaaaaaatcacgcagccgtatccccggctgatttgccataatcggtgctaagagaacgcaccgcgagcttaggaatcttcaacccatactgtacgtcattcgccaacctcgcatgtggtatgtcgcagagtgatcaccacagccatggggcacattaccctcaatggagcaatgtaaaggcgccacactgcacacaataaattagtttacacatgccgaccactcccactgcctttgtgatacgtgctacacattgatcgtaatagaatatattacaatagtaatttgccatttcccgcccaccggaagctgaacttcagcttgctccaagaaacgtgagccatcggtgcgtctctcccacacatgtaaagtatatgggctgtgcgcctacgcacgactgcgtagttgaggcgatatgccccggcgtagagtttacccaccggatatcatatataccttaaccgcgcctgctataattatatgaggtatagcgttacacatgcgacgtaaataaagatagagtccagagtgcatcatgctngataaaatgacatcacaccaactaagatattttaaactcgcgagggcngctcacctaacccttagaccgatatggatttagccttagagtgttcgcggagccccccttatactcaagggcgtagcgttactgtccgacccgaactatcacatcttatacccctccgccaatctctcctgtaattagcggagatnttagggtggcctataatgatatcacgagtatatgctcagtcatatatgtatnttgtaattgagatgatatgtcaatcgcgctggcagctctgtctgtcgcatgtaagttt

SEQ ID NO: 6126 - DNA, 1543 bp, Homo sapiens
  misc_feature (1)...(1543): n = A,T,C or G
tgtgtgtgaagactgncgtctgntgcncanatgagagtttgctggaggtagtgtgtgtgtngtgcttgtcacaatgagcgacagcatgtcgaacggcgngtcgctacntctcncnctgacacgatcacnacctacattactgatatcacgcccntatgggcagtngtgctgtatgtgatgtaagcccgagtgcagntgataggcgttgcgtgngttgcttgtngagcacgtccgtatctgttccatgataggtgtacgcatacgctgnatcaatatatgatcgcgataggtatcgtattntcatatgcgacgagcagtgatctgtaggagagtagtgangctcgcgaagtctgttacatatagtgtatgaacgcgcacgcgccgctgtgcggatcatgtgcgggtctatattaatgtntaccggacgtgtcggattaatgatggaggtttctgacgtacggcgcgctatggatacatgcgcataatcacgttacgatatatacgtcgacgatagatgttgtatcggacggacacgtacaactgcttgtgacaacagtacgtgagtgatagtgccagaggtcaaacaaattgatgcagaagcagcagccagctgatagttagtccgcctacgcgctgctataatcaatcgcggagacgtatagagcgctatataatatagaggatgtacacaacagcgatgcgagcgatttataggaagatgcgagcgttacgcatatggatcctgtgttcgaacctgagtgcgcagtgagtaagcgacggccggagaccgaaccgccgacagtatacacgtagtgcgacgtctggatttccgaatcaccgtttatgcatgtacttagccggnctctaccgcgcgtatcaacaacactttagcgtacaaacgccgacctaccgatcgttcattcgcagcaatgtgtgcgatcatactgcatgataggttagaccacgcatctacgttcgtacttactagtgtctgtgttattaacagttgtagcancgcgccactatggtagaaggaagacgcctacgctgctgatcagcacgtaagtgtgacgtagaatacctactcggcgcgcgtcaactgctatctcatgacgaacgaaatnatggnagaggagccacggcattgcgtatatcagcgacgcggttacgctcgtcactttaacgtcgacatcgcccatacggcgcgcacggtgagcgctgatattacgtattctatatcaatgggtggtgatacgtggcgacgttcgtctctgtatgcgactattagacgggctcgcgctacgcgaagatagatgatactcccctcgcttgcgatagtatgaacagactatgacgaacactaggtaatccggaggacatggaagcgaggacacgtgtcgcgtacgtgacaccgcaagtgtacgtcgcgaccagagatagtaaggtgtgcgtgtgagtagctgtgctctatagctagagaggtgtcagagttgaccgagcgcgcgcacactatacacgaagactaattaacatagtacgcaag

SEQ ID NO: 6127 - DNA, 270 bp, Homo sapiens
atctttcttctaaccgacatctggtaaccattcagtgctgcatacacttcctgcaggctgcccctctgttctctcgcccttctcacctcacgtgattgatcacctgacaagctacctggatttcctagtgccccagagttgccctcaatcaacacacaacacgttcccatgtggaatcttcaccaagtgttcatttcttccattacatgaaatagtattctctccctgtccccaaaactttgcaataaatccctggcctcgttggcctca

SEQ ID NO: 6128 - DNA, 1744 bp, Homo sapiens
  misc_feature (1)...(1744): n = A,T,C or G
cacgacacgcagcaacgcggaggacacaccaccaagcgncaacgcgaacgcggaaacaaagcgcgcgngcgtgcaggcggangnaaccnagacgngcagagaaagcccgttgncagaagggcaggagaaaacanagggaggagagcgaaaggagagngagnaggcagagaaggaaagacgcggcaggcgcnctccagagagacgcgaaacacgaggacgggacgagaagagaggcgacacaggcgagcacagccgcaccgcgccanagacaccccgacgaacagaacgccgcangcacccgcacgaagaaacaggagagggacnaccgcgaaccggagancnggaggcgcgccgncgcagcgagcgcagcacngagcaggagcacagcagcaagacagagacgcgcgacgcgcggcggcaagcacacncacggacgcggagcgaagagcagagaggcganaggcagagagcacgcaagagcgaaacgnacacagcgcgcagacagcagancgcgcgngtctcatcagacgagaggagnagacagacgacacgcacggacgccacagagcaagacancnaccgaccgacacgcgcggacganaganacgngcacgaggaggncagcacangcaccgcgcagcgagcgacgcacacgagngcgancgcacgaggcaggnacgnaacggagagacaggacgaacganagcgcacacaccgaacggcgcaggcganagcgcccncangcacaccgacnccaccacacnacccacaccgacgcgcgacacacgacgcggagcngncgnacgacgagacgagacgacagagagagagagacgcaccgacgcggaagacgcgaaccgcgacgagcgagcaacgagagacgnagncgcacgaacgcgacagacgncgncagangacagagcgcgagacgcggagacagacagacaacacgagcagagcagagaagacgcacaanggcgagacagagcgaagccgcacgcgaccagcaagccacagancgcgganacngcgacgaccaagcgaagcagangnacacgcgcgaagacgacgcagacgagggaggccgagagacacgacagcggacgagagacgcgcgacgcacgaagagcagggcgcgcagagaccnccagcacagngcggagacgggagcacaacacagancgcgaccaaaagacacacgacacgcagaagagnagcgcncgagagacgcgcgaggagcgcccacgagaaacgccacagagagagcacggacacaagnacgacnagcagagcacgcgagcgagcaancgacgagaacgacgacancaccacaaccacacagagcgcgcgcgcngncgcgcagacacgacaaangagagcacgcgangagncgagagaagagcagcngacgagcagagnagacgcagagagagacgacgccccngcagcacacgcgcancagnngacgcgcagacgcacacagcgacaaccaacgcgngaanacacacacagaggcacgcgacagaancngcgcacagcncacacgggcacccgagcgaccgcccagcgacgcgagcgagcggacaacgagccacacgcgcagcagagcgcanangcagacacngcaacgacgcaggncgacgagcaaggcaacggcagagacgacagcaccacgagacgcgcnccanacncgaggcaacgagncnagacggagcgacggagcaggcgcgcagcacgagcgacc

SEQ ID NO: 6129 - DNA, 2147 bp, Homo sapiens
  misc_feature (1)...(2147): n = A,T,C or G
ggagcagacagctgtcagggangacacgaacgagtacccngccacacaaacgagcatcgagaagnagagcagagagngncancgcngnagagacgcacnnnnnccttttncntnctnagggntnnnnnaacctnnncgagacacagagagaggagaggcnccgcctgncnanggnngngnggncacgagngatntaacannnngnagnnagnnancanccnccgnanacgcanngnngagagnggcgnganacgacgacaaaagcganacgcagacagagancntttttcgncagagagaagcgaagagagncggagagaggcgnagagacnagacgagcagcacagagcgacgcaggacgcacaagacggcagnggacagcgcncgacacaccagacagngacgagcgacnangcgngacagcaggcgagcgncgngcagcgacngncacgcgcgacagcagaagagncacgcgcccgnacgcgcccgacgacgagancgagcngcagcgnangcangcngangngangangacgnanagcacgcgacnancngagagcgagacgggcagacgcagancagacagcagacacgaaagacgngaacagcagcgcgagcgncagcananacngagacgacgaggcangacgcagnancagananncancanncgacgagnacgcagacgaccagcgagcgacagacgaacgacgcgaacgacgggcngcnacgagctttctttttttttgttatagacganagacncacgcgancgnacgnanganacgcgagcgacgagagcgagcgacggccggcgagcancgacacggangnagcagcagcagcgcacgacgacgcggcgagacngcnagcgangncagangancacananncaccnacaccacagccacgcgncnagancacanaccgacncgcgacnacaccgacgacnncnanancgcancgnanagcacgcacgncgagccgcagccgcgagcgncgacgacgaagacgnacgagccnnagcagcgncngagacgacgcagacagcggcagcagacgcgcgacagagagcngagcgcgaccgagcgcggtggcgcgcncancagcaganagcgagnagcgagcnacccncaaaacncgcgcccggcgcgcacgcnaggacagaagagcagaggacgacgcgcgcggaacgagcggcgacatgcgnacaccaagactacagcgcaagcgacgatacacgcaggaacgcagctgacgacgcngcacatgacaacgacgcggacagaacagaggaacagacacgagagaanagcaacagacgacgcgcacacacgaccggacagaggagcggcgngngcacaagagtagcgcgcacgcgagcgcgcgncgcggagcaggggaanngngncanagcggaagagacgagcaggtgcgagagcgccgaccatacgacgacgcgcgcgcacgcacgccggcggcgactcncacgcacagngaccacgcaggcgacgcgcgctgnctcacgatcggcggacgggcgcgcactgacgcagcacgaaactgcacgcncaaccgacancnacagacgacagaagagcagccacacgacgcgcganacncngacagcagcgacgacggacaggcgccgggcagcacacgcagcgtgagagacgggcggcggcacgacggacaggantgcagncagncacggacgtcgacaacacgcggagacgcgcgatgtcggcgncggcggcncgactgacggagacgagatcanagcacagacgccacacacacgacagagacgcggancncgacacacgtcgcagagcacatagacgggcagagcgngacgcgcgcataccgcgcancacgagaagacgnagaacacagacgcacacagagcgtcgcagagcgcagatagacggaanngaacgcgatgtgcagacgcgcgagaancgcacacgagcgacagacgcggcgcgntcgcgaagcggcatcgaccgacgcgtcgagcagntcgacgcggcagcgggcggcgcgacgcggaactcgagcaggacgcgtcgagcacggagcgcaagtcgaatagcgagcgcgcgcgcgacgacgggacacagcgacgcagacgtncggcgtgcca

SEQ ID NO: 6130 - DNA, 1509 bp, Homo sapiens
  misc_feature (1)...(1509): n = A,T,C or G
agcgagctcacttactacatacgctgcatcgataactactgatcgagacaaagagcgaaggagaggngacgggtgngagntggnaacaaactgccagtngagcagacgcggtanctnaggaagcacagctacactactctctacacatcttcactactntnggtgcacattgcgcacgtactcggacttagacatgcatactagtgtacgagagaacgctttagattgatgtacgccactcacactgtatagagataggnaaagagggcagatctgcctctcgtgcttatntngatcgaacctggcactgaaattagatgaatcaggcagtattgcgagacgtgacgcattgtcagtcagtctgccaattcgcgtgtagtgagcatctcgccataccatagtatctgatgatatgtcagctctctctccgcatacagntgcntgtctctcgatgtatgaagactgtcgaccaatcctattttagtacnagagtgactcagntatctcgacatgngcattgtctctgttgcgttatgcgtaggatacatactagcgctatcgcctgagctatgcgtcatattgtaggnttacctgtaaccaaccggtacgccacttgtggaatgcagcagggaccactatacacacccagcntncgctgcatctcaatatggatgtctgagacatcaactacgctccgtggctgtanagcagtcgctagactgtggtggggtacagtgacgacagtactagcggtgatgctancngagactctcgctatatactatatatatctcanatacgtgcaccagacgccgaagtatgacacacgagctgactatcaaagctagtagcgaacggctacaatntcgtgtactttcgctctcatcctcgttaaagactgcgtgattccgcacatagcgtgcgcgactaacagctacacgatatgcatnacgcagtgccgagtgtatctccgttactacactcactccacaatatgagtaagagacgacgatagtgctgcgtcagtaacagtgcgtacgtganacacgcttgatacgagagcgtataantgtaagtcattggtgaatactagaccgcgatcatttatatgtctctacgactagtacagattatcagtaggacagaagtcgagacactctcgtagacgccgtatgactcgactgagacgacactcacagatcacactacgcgtcntcncctgctcgatcacgtgtgacgcagacgtccntcgatacagcancnntgctagcccacacttctatacgcgacccaccgactctctggagcgtgcgcgcacacacgatcacaccgccgcacacaagaacagcgaatgcaggccaccacatcaatcactcacgcaacattctacttaacgcttgtncgtttaccgtgtcatcgtagcgttactctgttctacactgccgacacgcagactcaacgtatatacacaactcatcgatgnctacaatgtattcctacgacgtcatc

SEQ ID NO: 6131 - DNA, 1175 bp, Homo sapiens
  misc_feature (1)...(1175): n = A,T,C or G
ccaccccattcgcacagcacaccgcagaaggaaagaaaacgtttggtggacaacacctagcgacatgtaaggaggagcaaaacggcgattagctggcgcaacagcaggacggatgatctctcacctgaagaagctgaggaagacctagtcacgtaaaacgaaaggggacagatagcttggtgaatcgctaaagatagagagaagcacggctgagtaggacggacatgagaaggcttcaacatgttggacggataggctttgcagcgggttccgtattaaccgccccttattttttttcctgtgtggagaaaggagaagctacgcgagcacgacttatgcgtttaatacgcccgttcaatacccgnagcataatgcgcgcggaagtcaaccccggaagaacgcacagtaaacgactagccgaacaccgggttgaacccctcaatgcgacccaccgtacccatgcccccataagacccgtatcgccatttatttcacgcgcaccatccttatccccgcacgtaatgagctatcacccgcctacacagatgcggtcgcgcgcagattatcaatctgttcggcggcgcgtatttgtgttataatcggagaatggncttcatactcccgaacagtagatgttctccaataaatacgacgtactcataggatggtataagtagaaattttacacgccgcgccngccctcgcggcatactggtacatgtntctcagtcttattgtgcagtgcatattacgtggcgccagggtatattcgacagtgagacgcggtgttctatgaactatctctacgccgcgccgcgttgtaggcgacacgatatgacataacggcgacgaggcgtagacgctaatgtcgcgtttgtagccagcgcgcctccgacaaggagtgcgcgaggtgcgcgatgagatatatatatgcaggtcgcgctagacgtacgcaacatgacgacgtcgtattcgatgccgtacgcgnatggagntggagcgccgccgccgacgatatgcgactntaatgtatgcgtctanggcctngagatnccggntcagcgatcacgtctntactcgcagcatataacgcntcactgtataatantatcccgcgcatcgcgnganatccgcacgccgacgcgcaccgatatgttatagtcgctgactactnc

SEQ ID NO: 6132 - DNA, 501 bp, Homo sapiens
cataaatatgacccaaaatccactcctcacttggacactgctctggttatgacggctgacaagaagatcctggtggttgctggtagtagatctcctaatttaacttcttcctgctaactagtaaaatcaaccctatgtcaaaatcaagcccagacttgttcctccaccattcacaactgctctaaatgagttttatcccatgctgtgtggttagcaaagtcttcaataggacagccttcctgcctgtttgtcaatagctaataatttcttttgcttctctccaccctgccaccccataaactaagtatgggcctcatttaccttatttgtaattcacaacatagaactgacttcctcattataaaagtttccttactcgaaacaattcaaggactgggcagcattgctaatattacctcctctatggaagaaaatcagccaaataattaccaccaacagttgtgccagtaagcaaataaatgtctggcctcgttggcctca

SEQ ID NO: 6133 - DNA, 319 bp, Homo sapiens
ctgagcagtcactgactaccattgctttaaggattcaaccagaggagcaggatgtcagcagtggaacacacatcttcaagagcaaatttgtatgttcctgtttgtacacactgaagaccagcagatgctactttcatgaaattatgttggggatagtgtgaagagacaacataacacattttgtgagataaaaaatgttctactggagatattgtgaagggcaaatagtatatcctctgtgctattggctaatattttaatggatttttatgtattcaattttttcattaaattgtgatttccctgaaaaaaaaaaaaa

SEQ ID NO: 6134 - DNA, 1226 bp, Homo sapiens
  misc_feature (1)...(1226): n = A,T,C or G
gcgccagaaggggggaatcacgactgcggcgcacgcaaaggagganccctagtaggttgacanagaagaagcaagctgcaggagggggaaacngagtggacagtggggtnacgagaaacgataagcgtgtaagccctcacaggaaggaggggacagcacagacggaatgagcgacggaagtccaagggaggtgatagatagcgtacgtcccaacgacctgcgaccccagccggaacacccgacaccgacggggggttgcaggcacgaacgacagtcaaacggcgagcgcgagcaccactgagcacgtgcgagcccgagccacgcatgcggcacggacccccttgttttggcgcggacagcagcacaacaacgcgcgagcacggggggacgacagagagcagaaaagacagcagacagcgcgcataaggggagacgcgccgagcgcgcgacgagagcagtgcgcagagaccttcacgtcgagcacactacagccacgtcggacgcgacagcgcatcagcaagcgtcaggagacgggatctagcgtcgcggcagcgccgcctcgagcgctgacagcgtggcaactacggaggtgaatgagggagtgtagacgtggcgctagagactgaaacagttgagagcgtctcgtgngtagggtacctgtgagatctagacagcgcggcgcaccgacgaccaacgcgcccacaggtaccgaggatgcgacacgaccgaagcccaggggantgggtacgagcgcgcgctcggagacgatgacaacagcgtcgggtgtcacaccgggacggtgtgcggccgagaggggcgcgtgcggtaaggcagatcgatacgagacggaaggcgcgcggncacctagacgcggcggcgcgcaggtctaagaatagcacaggagaagcncagcgatgaggaacgatcacgcacggaagaggnacacagcagatgacgaagtgacgtgatcacccgacaggagaggcagangcagcaggatacacncagcaaagaagatgacacgcgtgtgcagatgccaggcagagcncagacggacgctacgcatccgaacgcagccgangcagacgaggctacacgcgcactagaggcggtaccggagagcctacgaccaggcagacaggagcgacaatgagtctcacangccggttcgctatgcgtccgagagctagacggagatagggagtagaggagggncagcacagcgt

SEQ ID NO: 6135 - DNA, 1433 bp, Homo sapiens
  misc_feature (1)...(1433): n = A,T,C or G
gcgaacacgcgcgggccagagccgagagacaaagcacacgcaagaagcgacacacgcgcgcctccggacggccggaccncgcgacgagggcagggcttccagccggggaagaaaaacaagcgacagaacaaagcgcaccgcgccgcgagaacagcacacgacaagcacagagagagaaaggnaacgcaggacacgacaacgaccgcgacaacgcaaacggacggcggccgcgcacgccgcgccgggcaaccacagacgcgccgcgaagcgcgccacgccggcgaacagcacgccgcgaccgaagagcacgacgccgcccgaccggcgaggaagaaggccgcagacggagacagcgaggggagccgnacaggagacgcacgggcgagaccgccgcgacgcacgaggacggacttnctacgccgacgccagccgcagacacagacgcacaancaccaccgccacgccgcaacacancgcgacgacacacgcgagcacgacacagnagggcccacaccacgacagccggacgcagggcagcgcgcagcaggcaggangacgcacgacgcanacagccaccagcggancgcgaccgcacgcgcgcgacacgagcgcggacaaccganccgccgagcgaccacaagcggagaccaaccaagcaggcgaccgcacacacgagcacccgcgcgaccgaagcgcaagacgcagccaacggcgagaaganacgacagcgcgaccgcacgacgagcgcagagacgcggcgcgcgccagagccgcgagagcagacgcccggggacgcagcgacaggagagcgccgaagggaagagaaggaaaagcgcccaccaccgccgccgcgacgacaancaagccccgccgcgcgacgacgcacacacgccagacgcgcgncgcggacagcaccgcagccggaggagcgagggagggagcggggacgacgcggccagccagaaagcgcgacagcgccgcgcgccgacacacacaanaggaagaagcgacgacangcgacgcgcgagcgagcacgaacgacgcggggnagagagcgnagcgcgcgcgcacccagannacacacgagcgccacgagcacaccgcacgcgccgcnaccacngcgcgacagacaacagggagagcacgacgcgacgcacgcgcacgncnacaagcacgagacgagacgcgacgggacgaagagggcgcgcgccgccgcgcagacgcgcgcacggagaccagagaggcggcgcgcgacgcaggaganagagacgcgagagaccgcggacgccgaacggcggacgngccggaccaagacgcagcagcgcgcagcgcncgacganacgcgaaacacgagcgcgcagacgcgcacgagacgaggaggncacaccgcgcgcgcgcgnacggcgccgacacacgcgcgcnacgcgacgcac

SEQ ID NO: 6136 - DNA, 1567 bp, Homo sapiens
  misc_feature (1)...(1567): n = A,T,C or G
agcagcggaccagaacgcagcgaagcagcggcgcgaacccacctactcgagcgagacgcacgccgacgaganggcgagccgcgccttcagatatagtttnnngaccngggcggngcgcgngggnnttttnngggaagggggngnaaatcccngggncgccgcgcgngnnggnggngnngggggngngngngggggnnnggggggggtcttggggnnngggngnggnnnngggggngaagaggccctgttgtgtcttgtggggngngngnnggtcgccgctgggcggcgcgcgcggccngcgccggcgcgcngcgtcggcccggcntgtgttcgggcctgcgctcgcggcccggccncgggcgcgcggccgcgcgtttgtccggcgctccgacccccgcccgctccgcgccgcggcgcggcggcgcgcgccgcggcgcgctgccacggcggccgtgcgcggcgcgcgcggcgcgcgngcgcgcgcggccgccgcccgcgcgggcgtcnccttcctctcgtacgggcagcgcgcgcgcgcccggccgcgcgccgcgccgcgcgcggggcgggccgggggccgccggcgggcgcgcgcgcggcccgcngcgcgcgcgcccgcggcgccgcgcgggcgcgcgcgcggcgcggcggaccggcgcccccgggngcgcgcggccgccgcgcccgccgccccgcgcgccggcgcgggggncgcgaggaggcggcggcgcngacggcggaggaacgcgcgccccggccgacacagcgggcgcgaggacnagccggcgacgcaaacagcagcgaccagcgncgacgcgggccagcgcgaggcgcgcgaagaacagccgcgcgcnacaaccagagacgagcaagncgccgcccaccaacccgcggccgacgcgccgcgcgagcgacaacaggcgccgcgacgncgncgcgcgacgcgcgcgggaagaggagaaaggcacgcggcgcgccgacgggacgcancgcgcgcagcggncgaagnacacgacgcggacgccgnacacaccgaccgcgcgcgagagaaggagacacggcgcgcgcccgcacaagacgacgcgcccgaaggagaggcgcgcancncgcggggcggcgcggcaggcgagccgcgacaccgcgagcgncagaggcgcgcgccgancgaggcagcgcgcgnanggcgagcgagagagcgaganagggncgagggngagcggcgggagcgngcgngcncggaagccgcgagnagcgcgagagncgcgcgagcgncgagcacgcacaccacgacgacgaagagcagagacacacgaccagnacgaggcggagagcgacgcagagacaggcgacgggncgcgcagcgacgcacggccagcgaggcacggacgcnagacgacgcgaacggcgacagncaaaaaaagaccagcgcgcgccagcaccacgcacccagcacgaacacacancacggaacgaccggcagcgcagaggagaacggagcagaacaanagagaggaaagcgcgacgcgccacagacgcgcggagccgancgagacgagacagcgccccg

SEQ ID NO: 6137 - DNA, 1466 bp, Homo sapiens
  misc_feature (1)...(1466): n = A,T,C or G
acagagagaactgaacagagaaccacagattaagggagatcaggaacgcgggcgncggggcggcggttcccttgntctagatcggactngggcgcagggcgggagggccttcngnnggnaggaaggacgatncanagnaggancancagagacagaancaagcgcggcacgcgactgnaagaacgcagagncgttacaacngganagngacgcgaccgagaggcagcgacaccgcacgcgccgacgncgcgcacagaagngagagangaggacgaaccagagagcacaggacagacggccgccgagcggcgagangacacgcagaagagacgccgaagcgaaacgcagcgccgaangacgacaagagcgcncgcacgacgcgcgtagcagaacagaccacacacanaacggggcgcggaaacaccacgacgcccgacgcagcacgacgncacgagacgcgagccgacgcgcaccacaacgaccacgcaatcttattctctctgtatacgacagcagcggcgagacgacccaggancacagcgcgccacgcgcaagggcacccacgacggaccgccgcacgagccacgcaagacaaagggcgcaagcgcgacgcaggcgacggcgcgcgcgaagcgtagcggggcgacacgagacggagagcagcgggggacacgacaccacgagcaccaanaccgacggagacgggcggcgacgccgccgaggccgcacgcggacccgccgcgaacggaggggaagcagccgcgagcgggacagcgacaaagaacgacggccacgcgcgcaagacacacgcnaacgacgcgccccgcgcaacgcagccaacacgaagagcagaaaaagcagcgacgccagcccaggccgcgcgcacaggcgagccgccgaccggggcgaacgcacgcgaggnaccacgcccacccgacggcgcggccgcgcgaggagacagcgcacngcacgagcgccgacggcccgcaccgacgcaccgccgccgccggcaagagaggcacgagccagagcaacacgctgcgtgactggagaacgcactgacgcgccgcgacacgcgcgaacatatcagtgcccgcagatgctcgcgcagtcaccacacgcacataacttatgtagattgtnaatacagcgcgactgctanaccgccagacgaatgacgcaacgangaacactcggagagtgtgcagccagcgccgcgacgtgagacacagacgtgtatggctagtagcactccctcacaccagccgatatcgactgcctcgatgcacacactacgatactgcacgctaaggtgaagagacgcaacagccgcacgcggccgncgcatgcaatgataacatacagacatgcacatnactcgagcagtgcgagcgcgacgcacntctcagcgacgcantcggatacatcgatgtgacgngtacagcgtagcgtcgaccntcagcact

SEQ ID NO: 6138 - DNA, 252 bp, Homo sapiens
ctagatggagcgaggaagaaaaagtgaaggaggaagcagaaagaaggaagaggaaaatcaggatgacataacaggaagaagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaatactttgaaaaaaaaaaaaa

SEQ ID NO: 6139 - DNA, 984 bp, Homo sapiens
  misc_feature (1)...(984): n = A,T,C or G
accgaccacctgcacgcccagatattacccaagaaggggggcctanttgtgaatggggcgggggctagagggggaaacacggccgacgaagccgccccacccatggctttcagagcaggagcacgacccgacacaatacctacgatgcaggcggtggcaccggactagtataagagagcgcaaccgcaggaaacgcgattacagcagaatatagcacgaggaagcgatccatggcgtaatttatgtgacctcgtttagacaagcacgcattttttttccaccaagcaatggtcggggtcatcagtcgatacggagagtgttgtatgacctataaggtcgcacagatcaggtccttaacaagtaatcgcagcaatagtcagcccgccccgccccacgcggccccagacagaacacagcagtgggaacggcctaagacaatccatcaagccatatacccgtgacatgttgactacatctttacccaccccgattcgctcacgagccacacacctcatgtacttatagacccacatcacgaacaaaccattatttttgtcgcacaccacgccacccaaacatcacccccaaaggataaatcgcagcgagacagaacccggccgtacgcgacgctacgtagggatcatagacagacgacccgccgcaatcctacgtctcactattcatcaacgctagccacgacacgtacgcgtcgaatcgaaggccgacagctcgtagaagagcccgaagaatccccgccacgtatgaggatatgaatacctccaacgacactccctataccatgtgaataatctattccagccctccccgactatcctggacgtaataagtccccacaacgcgttcccccagcgataccgggatcactgttagtactccgatcgaccgtccaaaataatgtatcagtacaccaaatcctaccagccatagctacccacacatagctactgacgaagaagcgaccag

SEQ ID NO: 6140 - DNA, 285 bp, Homo sapiens
  misc_feature (1)...(285): n = A,T,C or G
cgtagataaaacatctcaagctttgtaatttggggatgaccaccctcagtttttgatactcatctataattcaaccaagttggagaaaagatttcccagaacacaagtatctgtcctaagtttgatgcaaattatcagtaaagtataancggagtctaccattgtattgggtacatgagaaacaaataaatcttttattttactcatgagaaaaagatgaaaataaactttacagcaccttggggaaaaaaataaaaagtatgattcatgctaaaaaaaaaaaaa

SEQ ID NO: 6141 - DNA, 1444 bp, Homo sapiens
  misc_feature (1)...(1444): n = A,T,C or G
gcagggatgacgcgaaacgcgacgccagatcgacagtagaagataacagaggcggagcacggcaggagacgcggcgcctcaagtagaggggcganagcacgcgcgcgcgagagccagactttcgcgcggcgcgcgacncagcaacaatgcgccggagacagacgaagacgaccgcaacgccccacggacgaaaggaggcgggcgcgagcccacagcagccaggacgagacagcaatgcgaccacgcgatcacacggcacgaagagggtgccagggagacgtgacagaactactaaccgcggcgcaccacanagcacagtagcgcncgacgggaggacccgcgcgcccacagacacacgccagcgcacgcacacagatgctgaggagcggaagaccgcaaccggctacgaggcgcgcgaccacgacagacaggtagcgcagacgcggcacgtcgcgaggatagaggcagagggacgcgacatgcgacaaangaccaaaccccgcgaggagangacacggaccagcccacccgtcgaacagacctaaacccagaacagcgcaaaaggcaatccatcgagccgcgaatcagcgacgacaacgtgccacacgaggagcaacaagagggagcggaaacggcgcgaacaaccgagagcgacagtgcgggccgcagcagcaaacgagcacacagacggccagcgacaagcggcaccgagccccaacgaacacacggacacaggagagacacgcggcccgaccccgacggacgtaggcgcgtacggccacgcacgccacgacaatactaggagagcaagagacgagcgacggncagcggaacacggcagcgaaataagaggagaagccgccccacacgccaaccgcgagagaggaacagcacgcgcgacggcgcgcagagcgcgccagaccgccggaccgccctagagcgcacgcacgacagagtagacacgagangaggacagtaggagatgaagacggccgaacggtagaaagaagacgagatcgccacgaacggacacgaggcacgcgcgcaacggcggcgcacgacgacaggcggaggcggcgacgacgactcggccgcggaggcgatcaccccgcagacacaccatgaagagagtaatgataccgcccaatccacggcgcgcgcgncgagacagcagtgagtgagccgcgagncggancggcgagcacgccgcgtcgccggatcgcgcgacgcgcaagaaacgaacagcgcgacagactggcgacangacgacagcacgcagggcaggacggtacgcgcatcgtagcgcgcacggcgaatatcgcgcgcgcgacacgagcatggtacgacgagtagagacgcaggcagagcgcggcaacagcgacgcgcatagcacgacgcgcgtgacagacttgagcaacgcgagactctcagcacccacacacct

SEQ ID NO: 6142 - DNA, 1565 bp, Homo sapiens
  misc_feature (1)...(1565): n = A,T,C or G
acccgactctctcatcgaccagacccggagacatatgtacgaccaggtccgcgcctggacgacgggatacacttctttcgcagagaacaccccggcagcagcgcgcaggacttctacctagacgtcgtagaagtctccactatgaccgagtatgagtcagcggagtagtcgactatcacacgcttagctcgtatncatatagtggagaaatagatgaggacgtacactggacgggcagtgatcgtgtgaccgcgtgccactagagcaaggtcctcccgtccagcaggatctagactatccgtcggcccgtgttcgcccgcattatgacatcgacgttgcgtcccgccgatcacattctacgccacataacgcacaagcatcgcgcatacgattgccacgcgcatacacagtgacgagacaaattcaagaccagctcgncaccgaattagtcacgcaangttgtattgggtgttgcgcgcgccgcctgctcgcgcactagcacatatgattgtaacgcagtatgttacacgcagcagccacncgccactcaagcgagctacacagcaaggcgtcgacgccacatccagtcgccgctatgcttactcgttcgctcgcgctgatcgatgcaggccgcacgtacagtcacatgttgatcgcgcgccgacagcgtatatcatacaactcgcgactcgatatacncgctagtcacagcacgtgcaggagtgattcgcgcagtgcacgtancntatgcgctgatcgactagtcgagtacaatgcagntcatgatgtctaacgcancgcacncgcgacgacacgcacgctcgagaagangacaggtgatcagattacgcgactgaggactcgtgcgcgacactcacatccgctagcactcagacatctcctcgcactcgacgatctccacgctcgcacgcatntntctcatctctgtgctactacgaccgtgcgtcgctagacgtcacatatagctgagtgacgtgccacacgctagctctcctgtcgtctccgctgagtccgcctgtaccactctctcatcctacacacatcccgacagcgatgaggcactagcccgagatatgtanatagcgcagtcgttcagctcgacaatcncctgctgntacacacgcgctctgcgacactggtcaaggtgngtagatggtcantatgatgtctgagataccataagcctgtacgacaggcaagtgctacagtgcgctctgaatcgccgatgacacgcgtaacacgtgagtcgtgccangcgagaccgtcctcatatctactactgtctgtacgtgagctgcgtgcgntatatgnaccagagcctcacgatctantgtgtcacatatgctgcgcagctcactantgtacgtattgntccganantgacgtcggtgctctgcatgcgtncnancngtgagcgtatgtanagctgtgcggctgcgcgcgcnacgtcgtagcagccgctgaggtagacgagctagcatgtgagctagctnctactgagacatatgtacncatacngncatatgattctttcgctcgagccg

SEQ ID NO: 6143 - DNA, 1171 bp, Homo sapiens
  misc_feature (1)...(1171): n = A,T,C or G
cggacggaacgaggcaaacgcacggacgaggagaagaaggaacacaagacaaggcctcntncggannaatnaagagncggggcctttgagggggaggaaaacaaggggagacagcacggagggagagagggaggcgagagggagactaaagagagagacaaggcgggaaggcccgagcgcggcgaaggcagagacaaaagcaggcaagccagggaggagagaaagggaagggaacacgcagagagaagcgaaaaagaggaagagcgagagagaaaacagggcacagagaaggaagggccagagacggacaaaacacacgagaacgaacgaaaaaacaaaaccacaaaagtttttttaggggggaaaggacagcagcagagggaggaggaagcgagggagagaggacggaaggaggagggggagccagaagcgcgaaagacagcgacggaggaggaggggcaggcagaaggaggaacggcagacgcaccggaagaagggaggggagggagacgacagcaagacgacaagaaacagaagaaagaaaaacaaaggaaacacaagaacacgcacgcaagagaaaggagcggagacacaaggaacgctnaacagacaaaagggaaggagaaacaacaaaagcacacaagacgagggaacagaagaaaagacacgagggcgcggcaagccaaaagagggcaccgcgagcgacgcgcaagacaacagagaggagcgaagcgggagaccgaacgcgaagaggaggcccgacacaagaagggagagacaggggacacgcgagaccaagcaacaacagagacaaagagaagagaaagcacgaggaaggaacgcagatagaaaggagcgcggaacgacagacgagacgagaaacaggagcacgaanagagaggaaacacagacaagaggagcagagaacgacgacacacgtagcaaaagagcagcaagagagcgagaacggatatagtgaagagaaggcgagaggacggcggaggacggaacagaaggtaggaacgcgcgcgagagaccgagatacgcacggcagccgnaggcgcngcggagaagggtcacgaagagtgaagagaaagaatcgagaacagagggagagcaacggacaccagggagagaacgaggaggaagagatacgcgacagagcagaacg

SEQ ID NO: 6144 - DNA, 1013 bp, Homo sapiens
  misc_feature (1)...(1013): n = A,T,C or G
cattgacatcgctttacccgctactacgttaaccagagggaggggggggaggcctagttggtgacttgcgcaagcattttacagagaaacctacatcagaaccaactgtgaatgctgtgttaaacaaaaaaaaggagggccagcggatcaagctgtaatcagcgtctggtgagggggctagagtccagtatgtctcgcctccataagtattggatcatacgtacgatgttgagaactagttggggcagtatatactcatctagagtgtttctgttcaatctctgagtggacacgaattttctctaataaagggggtgtgcctacacgtggttcttactgagaaaaagaatcaacaatcgcaattctatgatatattttgatcaatagcatacactaagtgtatgtaactcaatctatacatgtatttgtagtcggttgttttctcttttagaccatcgagaaggtgaaaactttttgtattcgcgagtctcatttaatatcggaagatgaatttcatgtaattagtgttgctcaatagacaggcaatgcctgtactatcgcctttgcagatgagtaatcaaataactagatataaatgtacactagatagcggcggccctccggcgagtttcgacgtttatatttcataggaatctagcactctgttaaatacatcctgttacatctactatacactccgacatatagtatttgatgaactcggttattgagctatacatgtagagaggatgttactgtcgacgtgcttgccctccctcgctcgacgtgatcgtgtctaatatgttccgnatacatttttgatgccacgtgacgattaatactaacatagggcactactgattactaccgggtctctacgccatntaagtatatatcactatcgtgcacatctaatatttgcaacatcgcactagatatatatattgacgagtagcctctctacacactgtgacatatcacagttggcccgttaatagtatatggcccgagag

SEQ ID NO: 6145 - DNA, 385 bp, Homo sapiens
  misc_feature (1)...(385): n = A,T,C or G
cccggcccccccnnccnnccnnnnnnnnnaanaaangnnnnnnaatttcccctggccccacttccctcggtgctccccctgggtttnggggggtggcttaacttcanccccgccctnnnntccccctnnccccattagaatactgggggnccctnatccctcccctcttnnnnnnnnnnntctcccttttcccttccccccncccnnnnnnnntttttcttttnttcctcttntnnnnggggngggctctccccccgttccctcttccttntgtngtgttggggcctcttcgcctctggtgttccccgcgggggtgttggggcgtccccnnttcggccgggggtgggcccncctcttcccctcgnnttttnnnaaaaaaaataat

SEQ ID NO: 6146 - DNA, 1437 bp, Homo sapiens
  misc_feature (1)...(1437): n = A,T,C or G
ggagggggagagctgaggcggagaaaaaaaaagaggaagagaaaaaactcgtgtaggtggactgaagaccacgaggngcttgnggggggnaaaacgnagcgaggaaggaaggaaagggggagaaggagaggaggaggtttctgagaggagggagaggaaaacacagggagaagaagagagaaggagagagaagaagagagagggaagagagaagagagggaggggagcacggggaggaggagaggaggagagggagagaaaaaagaacacagaaccaacagaaaaaggaagagagaagaggagaaagaggagagaggagagaaggagagaggagaggagagagagaaggggaagaaagagatttttttttagggggaggaagagaggagggaaggaagaggaagagagagggagccggagaaagacgaacaggaaaaaaggaacacaaaggcgaaagtcgaaagaaaagacgcacaggacaagaaggaaagaagagaagaagggaaagggagagggggagaaggagaagacagaagaaaaaggagagaggaagagggacgcaaggcagaataggagaggagatgagagaggaaagaaaacngtaagaagaaggacgaagaggcaaagagaaagagaggagcgaggaagaggaaggaggagagagtagagagagtggagaggagagagagaaggtagagaggaggggaaaagataataatggtagaggaggagacacgagggaagacggaaagcacagacagagagaggagagagggagagagagagaaangacaaagaagaaagacaacagacacactaaggaagggnagagagagagagagagagagagtgggagaggaggagggatgagagaggaaagagagaacntagaacaggttgagagaagggagagaagatgncacagacgatantacaanacggagaagcgtggaggngacgatgcacaagaaagaagatgaagagaagagaagatgaaaagaagagattataagagcaagcatgacagtaggagaagaagctacanattacagaagtagagtatataagacacatgagagangagaacagaaaattgagaagatagggnagattaagagcgaggagaagatgtacggagagaaganagagacgagaacatagaggacgatagcggagacgagagacagagagagaagagaggagacagcacagcacgacncacgaagtacgaatgaacagagaaatatgcagagaatagaaagcaaacaacatcagaaagtgagagacgagaggacagcatggagngcgacgtcgaagatacggngcggagagacgacatctcagangaaacggacgtgagacagatgcgtagggtggaganatgatgcaggacagtaggagaacggacngagcacagcagagtcagcgagagtatag

SEQ ID NO: 6147 - DNA, 378 bp, Homo sapiens
catgagctcctgtgcactctgcttgcttatctaattatgggcttgctgagcaattcaaggggctaattttgaaaccagccagacatggggacccagctgcaaaattcaagggactacctcaaagcagttagtttacaacctggtcattgttaagatgatgccagcccatgctctgaatggatcatgagtcaagatagccactagacgaagacacgcagaccttgtacccagcactactcccacaagcctcccatttcaagttccctttttttaagcccgtcttcccagcctagtgtttggaatggtctcttactgacatgagcctgaccatttctcaactgctaacatttgaataaagtcgtggcctcgttggcctca

SEQ ID NO: 6148 - DNA, 1103 bp, Homo sapiens
gcgggggaagacagaagcgaagaagcgaccccaacagagcaggggcctagggagacgacgaggggggggggcttcgaggggggcaaacagcgggggagaagagcgccggccggacagaagagacgagaacacacgagaccaaagcgcagcccccccggcaaaacaaagcaaaaccgcaagaaacacccaccaccgaccaacaaacagagcggcggcacgggacgagacggagcgcagagaaagcggagacacggacgagcggggcaacgagagagcggggcggagggagagcacgacggggcgggagagaaagaaaggaggcgccgggagcgtttttttttcggcgggaccgccccggcgggcggagcggagggcagggaggcagcggggaaccagcaagagagagcaacagaaacacaacccccccgcacacgcccccacaccaccgcgcacaacacagccacccacaaacacccaacagccgccaccgcaagccacagcacaagacagcgacgccgaccacgaaccgcgcaaccaccacgcccccccgcgccacgacccaccgccacggaccaaccacaggaacaccaccggccggaccacagaagaagagccaggagaaccacacagacacggcagaagaaagcaacgacgagcgcacccgacgaaccgcagcagccacaacaggcggcaacgaccggaaccaacgcacgccaaccacccgcagccgagaccaaccacaggcgcccaaccagacccaccgccggacccacgcacagcacaaaagggaagaaacccacacgcgcccacgacccgacacaacgccgcgcacgccagaggcagcgcgccacgggacctccgcgcgaggcaatccgaaacaagaaccaaccacacacgcggctaacacacacacgacggcggcagaccggggcccgacccgacacgcacccaccaaaacgcacccgcccaacacgccgccaccacgcaagacacacacaaacacccacccataagcacccaccacgacacacaaagagaaaacgaacagggaccctcgcaagacagggacaggcggacaggcgagcgagccgagacggaacaag

SEQ ID NO: 6149 - DNA, 1783 bp, Homo sapiens
  misc_feature (1)...(1783): n = A,T,C or G
aggagagagctagagccatgaccggagacgaggcgcgcacagcagcacaaggaagcaggagcggcggacgcggagacgacagggangaggcgcctacaggnggggggagaaaccagagggngagggangnacgcgttttagngagaagaggacgggaacaaccaagcacagacgcaacaaggagagagagngcgagagaacgncgcaacacaacacgccaagacgacacgacagaganaccgaaggcgacgaggacaacagggaagaacgacagacgacaggagaggcaacagcacataccgaggacaaaganaggacgacgagagagacaagatgcgcacacgacgggaggatacgaagaacagacagagcaccaacacacaggagcaccacgaagagcgngtcgcactngatagagtagaagagagacgcgaccggaggacgaagaggcaagagagaacggatgtaagagagagacgacgcaacaaatagcgaagcgtagagagaggtagcagcaagagagagaagtagtctacagcaactcgggcggaacacngaatcagcgtaatagacgccgcgagagacagggcggcgagcgcgcgcgcacacgagngacgtactagtacggacacnaacgcgacaagcacatgcacgccgcaccaccgacaagaagcaggacggcccagcgagagcgagcgcaagcatgcgaggacgccgcaggtcgcagacggcaggagcgcgcacgaggtacggcgagccggagcgacatacacaacgccganagcaaacacagcgagacgaggagagaaatagaagcgagcacacatcagaacacgcgccacgagcgcacacacaggacagatacagacagcagacataactaacagccgcgagacactatacggagagcagacagagcgtgagaagtgaacnagcgcgcgagcgngcgaggcgagggagncaggatacgagcgcgagagtgacgcgcgcagcacggcgcgcggacgatcgacatcgcgagcgacagagcgacgangagtagatagccgatgcgagagcagtgaacacacaggccgcgcacacgaggcgnanatgtacngcacgcgntcacaacagcaacgacgcagaccgataangagaagtgaagataggaagagcgcaggcgaggagacaagagataccagcgagatagagtaagacaggtcacgacgcgcatagagagacggcaggaccagcgcgacgcggaaganagcaggagagcgcacagtagacagacacgacgnactcagacgggaggatcgcacgctcacncatacgcagccganacgacacgacgcaagcanangcgtcacgactgaagaagaggatatatacgtggcgcgacgcatcgagcacgaagagtgaagagcagagagagaacgctcgcgcagcagcgagancgagaaatgatacacgtcgacacacgaacngctagtcactcaaaatgcagtatctacatggcgcagaaacnagagncncgagagaggacatatacgagagcggcgaagtagancaggtcnatagagagcgagcagagacgacagnacgacgacgagaggagtagagagttggacgccgcngcaccacgacgacgacaggcatanagtatagaacacgcagcagnagagcacagcagactacagagacnacgcacaaganangagaaactagacatagnagnntcatagcgagcgcagcagacggaccagaggacgagnagcaacggtggnacgagcgcncgcag

SEQ ID NO: 6150 - DNA, 359 bp, Homo sapiens
agcttgtacgaggctgttcagccatgcctaggagcaagccaacagtaaggaagatgaatgctttccattacagctctccaaaaatggggaatgcgagtcaagaaattccagaatcctgaagtacatctgtatcagggaacaatcaaggatccacccactcgttcattaaataaacatcaatggtaacttctatgtcttcttaagcaagctagaaggcatgaagcttctgaagtaaacatcacagtcgtggtccctgagttcataacaattttgtttagagaaaaataatacagaaaatgaatgtattacacacaccaatcaactacaacaaacactaacactggcctcacctggcctca

SEQ ID NO: 6151 - DNA, 1164 bp, Homo sapiens
cgccgtcccattctacctcccgaagcttcgccacccggtttttgaaggagacacgcgaacgacaagcctatttgccgcttggcgtcaatgttgcgttgtggccaaaactcatgattgcaaggataccattatccacagtgatgacaggaagactaggtgcccaggagtcacaagctggcaaggtaaagtgcatcgcagctagatgaagtaaaacaatgtctgtaaggactgtatgacgaggctggaaaacagaactgtcagtgcagtgtgtgactgacctgttatgccatgttgttagaaaggatgtgttgtgcatacaggtggatgctgactgctagatgaagatagcagcgatgaggcgcagtgagagaaagaaaaaatgcggggctgcgttggcacatcaataggatgagagctactgaggaacgacttaacctattaagagaggggagcaatgtcatagataccatcggctgacatggactcaactgagactacggaacgaatcggtgtgaatgcacagacgagaatacacgtacactgtaaaggacggggggtggcggcgggtgccgcaggaatggaggcggatggctgcgcgcaggtaacatgctcatcgcaaggtccacgtaaaggttcgagaaccaattcaaggagcagccttatgaaattaaatcatacaggaacaaacacggtgacgaacgtgtcttgggttgtcccgttagcgatcagtgccgaaacccaccggcactgtgggggagcctcgcccgttccccgtagaactgactcggacattggcgtcaaagataactagcagattccagaagccagaacaagtgtctgtctgggggggtgtgagcgctgttgatcgcgctgcagtagcgagagtttaaaccgcttcgtcatgatcccctaagcctcccccttagacagcggcctcctcctggtacaaccgtgtaatcatgaaacccttatatctttcacgtctcaacagcgacacccgcgaatttcactatgttccggccggaattacaccacgcccctcccgccgcattaatatccttgcggtttattcagctggttacacgaggtccagtcaccgggaggtcacgtgcaatagctcgtttacaacgtcgtaattctgcccgatatacgaaagttgtatgt

SEQ ID NO: 6152 - DNA, 1367 bp, Homo sapiens
  misc_feature (1)...(1367): n = A,T,C or G
taaagaacaataatttccgnaacgggaataaagaggcntccgttttttttttgtcccatcgcctctctcccggttttggtttcggccccaaggaacccaccacccagccgcgaacagccccctgtccctccgcccgccccccttattgctatgagtaccacgacgtgaatacgagccgcgtccacgtattcgatcgcccgccgattccgtgtcagcgactggcgtcgcttgtgccttttgtcggtgtgttaatagcaagcgaaatctcagaatcgcttgggtgcgcgggtgtacgcgtccggtacttatgctcttacaccatccttacccaaacacaactataaatttctacatagtcccgtggcagaagctgtcgccctgagcggggtgcgaggcgcaggtgggccatgccagagatgagtcaaaagggaaatgaataaattaggccgtatatactaacaatgacgagacacaaactactctttccacgccacttccgcgtgtgttgcgccagggcgctcgccgccgtacgacatttcgtaatttgtaccagacgggtctcgttaatgacgcgataatgataattataatcggaccccgttttatcggtcgagcagtgtttagttcgcgcctatgagggagtcgggattacatcgtgtagccttttcacaantgccgcgcccttacgctttttacgcgacatcgctgcgattgtcgcgtatgcgctagtccgcgttttcagtctggagagacggagaagagcgtcccgcaccctataaattcttcacaacgtgagaaggattttgcagacgaccgattataacactacacaaactagtatacagtggtgcggatatacggatatcaaaatgatacctaatacccgcataatagtaccccatttaacgcattagaaaaataacgaatagttcactacacctttccgtctaatttcatctttcaaatcttaaatcaacgttacacacactttatcatccacacacattacagaggccgactatgcaccgcctcgaatacacgctttgacactattaatcgcgttaaagacacgccggcacaatcataaccgtgcactcagcacccgggtataagaggcgcataattagcatcacaacaccgctatgcatcgttgttaagcagtataagcagctcgcgaggcgggtaatttgcgttcgtgtaccacgtgattcgatactcgaccgttgagacgctataacataatcactgctcgttttaagactgtataaaaaacgtgacatttctaacgccgctataataagtagtctcagacacgtattacaagcgttgngtattcaaacggcgcgatatgcataatattgcntagt

SEQ ID NO: 6153 - DNA, 1514 bp, Homo sapiens
  misc_feature (1)...(1514): n = A,T,C or G
cgcacgtctgagacagcgtatacatgagcgatcgcctatgtaatatgcctcacccacgcgcacgcactctacagaancacacaccacacttgcgngcgtaacactcatctatagatacgcgtcacctnatcgactcacacgcgtatgatagttgtgttgctacagcgtacgcgcgcttagccaacgcgactcatctcatgtatcgtgagcgtagtcactgccgcgctcgcctctcgctcagtccttcgccgtgtgcgtccctcagagaacgatagacagttcgcgacgcgcgtcgagcgatcactgctcccatactcnctatctatgacagccaccagaatgctcgacgccatcacgagccacatcgtcgctctatcgcgacgcgagatcagatgactcgacaggacagagcgatagagcgcaatgttgacactcaggacatcacttcctacgtgatcatagactgactatgatgtaggattcgatcacgaatatatccagctactcacgcgcgtnatcagacgtgctctcgctgctcactcgaagggcactatcgatgcattcactgctattacgctgcgccatcatcagtcccgacagacttcctaagcacacgctacccagcctctcgtcctgcaactgcgagtgacgcgacgctctctgcgctncncctctcgtcacaaacatccacttttcatatcaagatatacacgcatncgtganagcgtcgtatactgaatcngtnatcgagtagtgttgagctcatntcgcgtgatantgtctagagttcgctctggtgcttgagaantcagcggngcgtggtcacggcncatcgacggtgctgtctgtcaacctatacaccatgtgcactgaggtatgatagtctgcgntcactatgtagccatatcttcacagcaccacacgccgcgcgtgcagctcgtcgaggagaatntatatctccacgctccagactgctaccctacacnacgcctccgcaggtccncagtctgtccaggagagtacttctgagatgtatcatactagtagccgngagtgcatgctcgctactactcgcacagtgtagtgacacgatcttagcgtcaccgacctccatcgatctgtctcgcaaggcgacagcctcgctggccagagctctcccgtctntgcgtgcgctcactgatacgnctacgacatgacactgcactgaccacccantcgcgcgctcgccgtgtactgtcacatatacagntcgatatacgtacgtcgtggtgtatgagtnatcgtcaagatctcggcagcaggtcgctgatcacattcgagcaggcgcgacgactcntggagcgccaggtagagagcgtgcagacacgtcgaactgtcnctccacgcgtaccgcctccttcgatacacgacgactatatgacatatacgtcatgcctcgactagacacactaacgtgtagtatagtattggtagcgtcgtcaccggacagcacgccactcatcnacatcctctat

SEQ ID NO: 6154 - DNA, 1132 bp, Homo sapiens
  misc_feature (1)...(1132): n = A,T,C or G
ctggggtgttatattctcggttggcctccggccgcccggaggggacgagcttggcggggagacgactctcttgattttttcacgcggctaccgcccattccattcctttttggtttatattatggctaacgccgttgttattttattttgtgggagacggcccccgtctcttctacagactccctttattctcccccccgatcttcgatgattgcgggatccgattcatatctctctttcgtacctcccaacaatgctctcgtgttcgtctttttttttgctcctcgttttgggtggctggccgccaacctgtattgtctcccgtatgtcgtcgctcgccttgtgtcgccatgcaattgtagctcatctccccgcgggggggtgctgtggctcaatnctcctacataagctgatctccttcgcgctatctgtctggtccgctcctcttcactccgtctctccgcgttccgtattgtttaccgtttctccgctcccctcgttcattgtgctgttctctatacgattttctatctctcgtggccgctccacgtcttttcttcgtttctgctcgttccgtctcgccgagcgtgtctcctggtctcttatttttcccctcgcccgcccctactttcagctcgcttatcttcgttactcccttcgtcttgtcttccattttgcccccctccccccctcacctctcgttccctcattctatttttcggtccctcctagctcccatttcccggttgctttattccctgccccgtattgcgtccgttcccgtggttcttcttatcgatctctcctctcctccccttttttatcccccctttactgtgccgcctattctccttgtcacttctttcctttccgccgctatctattttcctcactgtttttttttctctagtttgttccgcctggcgtttcgtttcatcttgttgttttttccgtttcctcccgctcctcgttcgccgtgttctgccccgattctgtatgtcgcgtctccctctcccatctgatcttctctcgctcctctcctctatccttcgctcgcttttacgctttgtaacccggtatctactcattattattctcacgatattctgtgtgtccttctctcattgttgag

SEQ ID NO: 6155 - DNA, 855 bp, Homo sapiens
ataaaatcgtatcacatgcgagataattttataaatattagtaacccaaatgtgagaaaatttctaaagcttgacatcaatgatttctttaaggcacaaacatgccaaacaatggcaacatcttacattatagcggatgaatttgtgttttaccagcgtcccgaaaagagaaataaaagctaaggtaataaatatagttagagatattagcagccacaaattagataaaaatgctagtatttggagtatcaaatggattctgagaatcaaagagaaaaaactcagtttcatataatgatagataagaggaataaataggaatttcatatgagaggaagcacaaatctcatataaacatgtgaacaagcctttaacatcattagtagccagggaaaaacaagaccacaccccaaaaattaagaacatagaccatttcattctcataagatggtcaatagtcaaaattgtgccaaatataaagcaagggaagctccagtctcctactggtgggagagtaaattgatacaatcattttggaaaacagtttgacattacctgctacagctgaaaacaaacatgttctataaaccaggaattctaccgttagatatttaatccataaaaactcaaaagacaaatgcacaaagtttacagttttgtttgtttaaacaaaaagaaaaaaaggaaaactgaagcaagtcaaatgttcttcagaagtagaaagaacatttaaattgaaacaaaatttcacaatgaactgtgatagggcattgagtgaattactacagaggaggggtgggtaaaccaaaacctacagagcagtcaaatgtttttataaataaaggtagatcgccg

SEQ ID NO: 6156 - DNA, 784 bp, Homo sapiens
atctataaactcgtacttatgcgctaacaaattggggactaaaatgaattaagaagtgctaaaaacaaaaaagagtaaaagaataagaagagattaaaaaatatacaataagaaaaaaagacgaaacgatgaaatatatcattaagcaaatagaaggaaggatgaatataaaagttaataacgatataatgaaatataaattataagtatgactataattatataagaagatttatttaatcacaattatgaaaacacaggtaactttataaaagtgggagtcaatatgaaaaataattaaaaatactatagacggtcacaaagaactcagtatgtatgtctttacaaaatacaagaacatggaatataacatataacccactgccgaagattaatttcttccaactctattagcctggtaaactgaacttaactcgagcaggtgtctaaagataaagtgggtatacactgcatgtccctaatttgattgtttgccaaataataaggctcttgagcatttacagtaatgtttaagtttgcttcagaaggtgtactcttagccacatccattgttaattgtgggcctgatgaaaaagactgctcttccaaaccatagttgctttcttggtgcaagacagtgtgtaaagctttcttccggatgtgcaccgccctgatgcatgtcttggattgagcattcactgcgggcctcgatacgttgtggctttattagttttccactgggtgtggtctgtgggtctgggaagagctgcaggaagctctgatg

SEQ ID NO: 6157 - DNA, 1761 bp, Homo sapiens
  misc_feature (1)...(1761): n = A,T,C or G
ttttnnttttnnnnnnnnnnnnnnnnnttttnttttnnnnnnnnggtggttngtnatgatntaantaggttnntnnttatannantgnntatanttannaattnagataatgttntnnnanntnnataatnnnatnnnattatagagtttatgagattntantatcgtaatgttatgtgtataatanagaggatgatgatcangatatatggtaatttagtngatgataataatagataattgagtatagganagtgtngttatgagatgaagagagtcttgtatatgtgtaagcatatgatattattagagaggatgctaagcggcgacgggctggctcgcgttgatagacaccagttgaggcgagtggtacatgaagaactaagtagangtagagatgacacagggatgagtgtagggcatgctagacgngcagacaataagagtggacgtagagtattatagncgtagctattcatgatggtntgtctaggttgtagagtcgtagtgtgattattagtaggatgagtatgtggatctaattaattagnatataggatntgattnagcatntntgtcaacgagacgcagagtgttatgctgncgacacagcnacgtaganctganattgaacacgcatacgcgtcctcggcaagtaccctgcgttcatcgatncgactagagggccggtggcgctcatgcatgctgcagttatgcgtacgcncagcgcactcacgtgagcgnanaaagatacgcgagcgcagacacatanagcacgcgcaagcgcnctggccgaaaggcgcaagactacgcgctacgacgtatcactnantgatatgtatcgcgtccattctcgctctacttcttcgtactctctactctctcatcngatntgcacacttgcgctgcatagtgtcgtcggtacgtctgagtgccgccgtactggtncacgactgatgtgtgcgattatactgtgagttgatgatttgagangagcngtncgntgagtagcnacatagtntntacctgctagtgagnatcnatagacgtagaatgtattctatntangtantggntaatatgtatgtntgtgcttnatatatcacatgtaatnagtattngtgtctgatgnangtgatgantaacgtcgtnatgtcgngatgttacagttactnagactcgtagtatgtactcacgntaattgantatgtctatatatacatagtgntagncgtagtgantgtaatgccgcgtntgagttcgacatatcacacacncgtctgctacgtagacatagacgtgtgtgngtagacctcacagtgtantacgtatgatgcgcnatcgtatgtgaganactnacgctagcacgtgacgattgcacntcactatatcnagacntngctgagcanganatcacgtgtgccacgctatgcagttgtgatactanatgtgagtcgntacgtgacgctagagtcagtcagtatngngcgcnatatcgtcgcgacgtgtattctgtctacgtacgtcgctactcacgtgcgtgagtgtgtatctgcctacagagtcgtaaattacncagtgcgtctatgtactatctgntctactgcatctagtcganctacagcgntctantacccccaactncatatcatcacagcacaccgatacgantcgtccgacactgagcngtacgtagtccngtctgtattcatgtatactnctgtagacatntcatgctctctctacgactacgtncttacg

SEQ ID NO: 6158 - DNA, 180 bp, Homo sapiens
cgtttgactctcattctctacaaattatcagaatataggcacttgcgtgtaacactagcaggtagctaagctgtctgcacgcccagaagagacccctcaccacaccatgctggcatcctaacctcaaacttccagactccagaacgttggaaaaataaattcctggcctcgttggcctca

SEQ ID NO: 6159 - DNA, 1659 bp, Homo sapiens
  misc_feature (1)...(1659): n = A,T,C or G
gcgagcgagagaggaagggacgacaggaaacgagacgcagcacgcacacaagagacaccgccttcgncnagannaactnccgcaggcacggggccgccttccancggggcgaggcaaccccnaggnncaagaacaagngacgacgcacccgcccccgcacgacagagcgaggccanccacgncgacacagcacgacgcanaggaagngacgagacgacacgaacacacgacccgcgaccgcgacacacacgcgcgggaacgcgcggacgggcgcacgcccccaaacagaagaganaaagcagccacggagacgcccaggccccccgcagcgcgacgggagcgagcgccgaacggcgccacaccagcagaacgaggccacgacacagcgccgcggncccgagaccgacgccccggngcaacgccggcgcgcaggcggcgcagaaggccgaaagtttcttctatagcaacgcccganccacacacagacaaaagagagacagcaagacgcgacagacgccagggaggcgggacaggacgcagcaaggagccaggccgcggnagagggagagccaaaagcgagaggaggacacgctcagnagcaccgccgcgcgcgcacacatccacacaacagcagagcgacgcacatcgcagcactgcgggcgagtcggaggtccaaacgagcacacgacgcgagagcgancacacagagagcggacgcacacagtagacgacggcgcagcgacacagcagacgacacggtagcgcacancagncagacacgacgactgctatagcaggcgcaccgcgcagcgctcacatagactaccacagaccacaccacaccgtacgacgacagagagcgcgnacgcacagcgcaccgtacacngagcacgaccgccacnacagcaccgagangatgacgacacaggtcgcaagagcaggcacacatacgcgcactcgcgcgccanaagcgagcgcgacagaagcacacacgcagcgtgcgcagcacgccagatggaatacgacacgcgcgacnagagaggcgcgacacagagccggacgacagcgagncgacgaactacgcgcgcagcgcagacggcgacgagacgccgcgacgcaacngacagacgacgcggcgcnacgcgagancgagagcacgcatcgcgggccagcagncacagtgcgantacaacgcaacacgcgacgagcagcagaacacaggaggcggcangtcgtcngacgatacgcgagaggagcgcagcgncgacgggagacgacagncggnggcagatgagtaaaggacgcagcaatgacgcgagagagacgcacgacgcgcacnacagcaagcacagaggagacgcgacgcgacaagcgtgagtagcgcgcgcacgccacggcgacagacggcacgcagacacgcaccaggccgaagacgcagcgatcnccacgcacgagcagcgcgacaccagacgcggcgacggagagagcaggcatgcggangacacgagagagacgagacgacagcacgaacagcngtacacgcgacaganatcaggggaccagacaagcgagagcgagacgagacgacgcccgcncacacaacacggcgcgagacgcgagacacgacagcacccgagcgcgcgcagcgagcacagcacg

SEQ ID NO: 6160 - DNA, 1070 bp, Homo sapiens
  misc_feature (1)...(1070): n = A,T,C or G
agacaaaaagaacaaccaagagacgcaccaaaaaaaacaccctagcgggaaccacagaaaagcttgagggggaaaaccngnnnacaaggggcggaagaagcacccagaccgtcccaagcgagaaaaacacaacacccagcaccagagcccacggccccnccacaccgggcgaancgcagagggagaggccccagccagacacggcccgcgcaggccagaagcccccccgagcacgcaaccgaccaaagcaaaccgccgaaaaccccccggcccaaagaccccaacagcaaatttttttttaagcgacaagggcncacacaacggcaggaccgcaggcggcgncgcccggagcgaggcccccgagacgcgacagctagacgagaaaccacagaagaacgagcagacgaccaggcagaccacccaagagagacgccacagacacgacaccagcacaacacaaacgaagcagccggggccacccccacacgccggcacgccccccgcgacgcccgagggcgacccgagcacccgagcgcggcgcaacacgcgcaacccgcgccccacagcccccgccacaccaccaccgaccaaacacacacacccccccccccacccgcgccccacacgccccgcccccacaaccaacaccaagcagccatcacgacggacaacaaagcgcgcngagaggaaagacacgaaagcgaaaagaagccaggagcaacgactaaccggcgccccgccggggcgaactccccgccggccgacggcagccacaggctctcaccacccgcgcccacacgggccaacccccaggaggccccagcggccacgcacaccacccggcgcccgcaggcgggagcgncgagagacgagaaccacccacatctcagacaccaccataagaacaagacgcgccaaagcggcgagagcacgcgggccaccccaccacgccaccccgcgccacgagccgcccgcgacgtaggaccgcggcggcgcccaaccgcggagccgaacacgccnccgacgcacgcggcgcaaccccggcccgcgaccgcgcaccaccgcacgaa

SEQ ID NO: 6161 - DNA, 795 bp, Homo sapiens
  misc_feature (1)...(795): n = A,T,C or G
ctttaggagaaactcaaaagagaggctaaagaaacacagctactcttaaagaaaaaaagacaagaaaacacaaacatttttattggaaacacctgaaatttattggaaattggattctaaagcagtcccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgggtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcactgtagttaaggagcctaataacgagaaacttatagttaatatttttgttcttattcgccagagccaaattttatctggaaggtgagacttaaaaaatacttgcatgaatgatttgggtttctttaatattctaggctaaacgttaactacattattggtaggaaacctggcattggtatttcaaataattanatgattatatattggttgtcactttntcttgattccatgaaacccggtttaactatagttttaaaattctgtaaagttaagcctttggatgcctaggattggcttattggagggtgcttt

SEQ ID NO: 6162 - DNA, 863 bp, Homo sapiens
  misc_feature (1)...(863): n = A,T,C or G
gggacagagaggaggagcacgagggacgcggcggggaggccctaaggagacaaaaagggctcggggcggaccggcgcgcgggggggagcggggccgcggttaggaccgaggcacgccgggcacgccaacaggcacggaaggaggagcacaggccgcggggcggcgcgggggaaccaaagacgaccagggccagcaaaccgggggggggggcgggggccgagcggcagcaaggagggcggaagggaagttttttggcagaggcgcggcacagcggaaaaagagaccaggaaggccacgagccggcgagagccgggggcgccgggagagcgcgcgcgcccgaggcgacggggcagcgcggcgcgtggagagccagcacgatcgaggaggcgaccgacgcggcgccacgcaagaccgctgcacacgaatacaaggggggacggcacagacgcaggtcgaggccaagcccccgcgccccacccgggcgagccccagcgcaagaccagcgggggcgccagacgtccgggacccagaagcgagccgggacccccgaggcgcccgccgggcgggcggcgggcgcgaggccagccgcacacaccgccaatgccgggcacggggcgaggggagaggcagcgccaggcgccgcggcagccccacacagaaggaccggcgggacggggagcaacgcaagaggagganacgagggggcgcgccgcgcgaacgcgcacgcagagagaggctaaccagagggggaccaggacaggacagcgcgacgcaagcgggagtccaaggacgccgacaccagcgccacggcaggaccaggggcggcggcaccgggcacgcggacgcaacccggcccgagaccg

SEQ ID NO: 6163 - DNA, 1301 bp, Homo sapiens
  misc_feature (1)...(1301): n = A,T,C or G
gaagcgacacgagggagagaccagaggcgagaccgacaggacgcgaaggagacaaaaggntttgtttctctgggtaaaactnnnncancgaagnananncnctgncncgngngagnggngtaaccanngnagngcnagacgacagagngnagaggagcgagangcgagacgcacgcgcgaagtttacgagccgagcggagcacagcgacgacacgacagagacacngcanacgcgangcanggcagngacgccnacaccacacngacgcgcagcagcgcgcgcagcagcgcanagcgcagcgcggagcaggagcgagaancgaacgcacgcagagcacgacggcanagcgcgacgcgcagcgccgagcacacgcagcagagagacgagcccgcgcagcccgcgaacgaggagcgcgaaccgccacagaagggcacaaacacgaggangcgagcggagacaagagaagaaacttttctttctaagagcaggcacaggagcgacgccacgcggcggacggaggcacggagcaccaagtgcacggacagaaaggcaggagacacacagaagacgaaggacgagcgcgaaaggtcnacaccgaaccggcgagcagacacaccagcgccaccaacgaccaacacaccacgcgcagggccgcaccctaccgaggcgcacccggagcgcacccacacagcaccacccacacacaagccggcaagaacagagaacactacgaggagagacgcacaacagggcagcaccagaacgacaaagcagcgagagcaccgaagcagccaccacagcacacagcacgagcgcgcaccagagcggcaaagagacgcgcacgcaagacaccaaggacgagacacccagaccaacctgacgacacgaagaaagggacgcagacgaccagcggaggcgcgacggggagcgagaagggacgacagggcacagcgcagagacagcgagacgcagcagacnaggacacgacacgacagaaacgcagagacacgaccgcagangagcacgacgacgcgcacgcgagcagacagggaagcacgacgcggcacagagagagagcgagcgacgcagcacgagcagacgagcggagacactcagacacagcgagccgcacacggcagagagacncagacgcacacaancgggagagagcaccgacggagcgcacgcggcacaaagacagagagacgcggaccgaggacgagaacggagaacagacacagctcccgccaacacacaagagcnttcgacgcacagcagccggagagcaccgcgacgacgg

SEQ ID NO: 6164 - DNA, 1278 bp, Homo sapiens
  misc_feature (1)...(1278): n = A,T,C or G
aggagaacggcagaagaagcgcaacgcgacaggagacaganggcgcangcgaagggacagcggcgccctcaagtnatgtcnggactngggngcgcgccgagagcttttcaagngagggcngaccaacccgccgccaanggacgagagcgacgcagcgcacagagagacgcaagcacagaagtctcaccgcacacagaaaggagaacgacgacagcaccgacaccgacganacgacgcgagccggangcaanggagcaaganagaacgcgacgacaccaggacaggcaagagagacaaaccgaacagaagcagccgacgacacgaccgncgcagacgaaaccgangagaggagcaagnagacgagcaacagcagccaccgcaggacgccagcgacaggccacgacgcgcgancacgaacgagncacacgacaggcggcgagcagacccggacgagacacagaaacatttttttttccgaaggcacaacagagcagacacgcgacgacgcacgacgaaggaaggagaagcagagagagggagcgaagggcgcgtacagaagacggcagggcaagccagaaagacgagacagcaggaagcacgcagcgccggcgcaggacgacagaagcgcgacgaacaagaggagcacgcagaaacgaccaggcacgcgcagcacgaagaagcacagcgaagggagaaacgagcgcacacgcccgcgaacggaaaaacaggagagcggaagcgaaaaaaagagggcacgagaaacaagaggagaggaaaaacgagccacgccaacagaacagaagcccaacngggagcaaggaccaacaccgcaccagccagaaaagcggacgagatagcagagaagacacgaaaaaccgaaccccgaccgacctgccgggcaccggaggaagcgacggaaccgacacgcgaaggagacgcgagacggaaagaggcccagccacaagataacaatgcgcagcagcaaaagagcacaagcacgaagaagagaagaaagcagacgcggatagagcgccaacggaacgaagcgccagaacgagagcggacgcacgccgaggcgcccgncgccggagcgaggagaacaacaaagcatcgccgacgacgcggggagaccagccgaggcgagaggtggcagcgagaagaggaaacagcaggcgcgcgcgcggtacgaaaaaggagacagagacacgacgacggcaacgcacgcagaagacgacgcgccgcgaagtagaacgacngagcgcaggagagcagcgagct

SEQ ID NO: 6165 - DNA, 246 bp, Homo sapiens
ccctgtatggacagaggaagaaaattgaaggaggaacagaaagaaggaagaggaaaatcaggatgacataacaggaagaagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgttattaataaaaaaaaaaaaa

SEQ ID NO: 6166 - DNA, 1168 bp, Homo sapiens
  misc_feature (1)...(1168): n = A,T,C or G
ccgagcgcgaccgagggcacggcgcagaaaacgaggcgccagcccgacgcgcgcgagaggggcccttaggaaagaanggaccgggcgccgcgccgaggctttacgngggcgaacgcacaaccancnggcaagcancacagcccgcagaccgcgagangagacacgcaggcngcagnaacaagacaccnaccaggacagaccaccgcacacacaacaagagaacangaccggacaccaagagaacagcgcgcccacgacaccggcgcagagagangagagaagaaacaagacagacggcagcagcacggncacgacacaaccacaacancgacggccgcacggncgagaccagggcggaagcacgcccagcagaaccgaccgaagaagagcagcagaagcaaaacgcacgcacgcgccgagttttttttttctgcgagacggccgaagaaacaccacgacccggccagacccacacaaacggcacgggcgacaaccgggcggacggcacggcgcgccgcgacggcgcgagcaacgcggcacagcacaagcaggacacgggcgccgaccgacgggggaaaacaccgacaagagaagagggccgggaaaacaccaccgcccgacgcaacaccaccacagcagagcgcagcagggaacagaggaagagcgcggacacacgagaaaaccagccgcacgcagcccaccaaaaaccagcaagacaccaaccagagcacagcgcaacaagcgaaaaggccacgcgcgcgcgccgnggnngggcnnngggaannnnngccaccnnnnnncccccccnccccncccacaaaaagaaagaaaaagaccgccggcacaaaccccccgacggcgccaaaagnnggcgccggcggggnnnnnnnngggnnnnnnngngngcgnccgngccggcgggcgaatgcacgcccccacaaaccccgcacgacgcagaaaaaaacatcgcccccgcgccgccgccacgggccagagaggcaagcagacgacgccgccgcagggaggccgacgagacgagcgcaggggcgagcgcagcccggagacgaagccgcgacgacgcgacaaacacgcgccccggacggacggaaacgcacaagccgacacgagcgagcagacgacaacagaagagcaacacaacacccgacaa

SEQ ID NO: 6167 - DNA, 1214 bp, Homo sapiens
  misc_feature (1)...(1214): n = A,T,C or G
tcatcacacaattgcccacaactcccccaccacgctaaataactcagacgcggctcgcggtcggcgtccttgatgtagagatacacagncacgcggctncattcttgatcaattnacaaactcatatctccctgacatacatgcgatttccatagtagaagcgatcactctttatatatatcagtgattgacgccctcccctacaacattttaatatcggacgatcttattcgatgagctttgcacatacgtacatacatatcagtgtaacttcggcaatatttagataaagggcatacatagtttcgaattctatctcgcattacacttcttcatgcgcagacaccagatctcgcgacaatcacatctcatgagtctagatccatattgttaacaatgcgtgggaccctatccctttgtctatattctatttacaaattgtgatacattcacatctcgtcctcattagctatcaaatttattgtcttaatatatatatcagatatcagaactctccatcacttcccatacaatacctgtcatttatcttattccccgatctatcgtccatcacccggctccccaattccgctacagtaatccccctgcgaggccttcagtatgcacgtgttgtactgttctcacctctacaacatccanacacttcttatcccttgacgtcctacacccatcatcccgcacagtccttaggtagatttattcgatacatacatactaatcccgttattaatagatggggngcgccggncgggcggctgcgncntccnccttnnnnnttcgcggtctttctacttgccctntctgggagaataagaatatataatacatccncttcnacataaaatctttatttcttaatatacttccttcctgggtggcggggnncnnnnnnccnnnngtataggatctcggtgggcggcttattccctatcttaaacacagccattagtacccataatacaatcacctttctctactattcaccgcactttctcacttcatacctcttaccgctatcactgcgccatgactcatcttgacgagtacgtctatctattacttactggtctcaccactcctctgactcctcggtcatatctaactacatctcactgacatctacagctacttatatatactcttcactgttaccgacgtctacacacatgcgttcgtcattctcgaactcactt

SEQ ID NO: 6168 - DNA, 729 bp, Homo sapiens
cactagaaatcatactgcctgtcaacagttctccacccccacctccccacccccactcttgggaatggactctgacaaactcaccatcaggaaagttgatgtttcccatctaggatggaagaatgggattctgaactttgtcactgtttctgaaacgtcatcagctcctgtaattgcatggttgggacagatctatttaaattgctttgaagttttcccaggaaattcccacaaaattgtgcaacccaaggaattgaggtggaaaaaatggcactggcatcaatttgcttctcaccacgaccttgtgaaggaggcaggtagccactcatatttatgatttaaaaaatgagggatcaacaattaaaggggtaacagttctaggtgcttggactattagttttatcaaaaacacagtcggtataggttcattgacagctggcattcatcatctgaaattagatccccctttgaaattattctttctctcattttccttgcttttacatagaagttttttcttttttttttctgtaaatagttagataatggcatgggatgacactgcaaataggcaatataccatacaatcaattccatgtattaattccaaaacagtttccttattaatgaaaatacaggaagcattctgggatcattattggggacatttctctttgcttttattaaattcaataaaaaattgggttcaacaggttaaaaaaaaaaaaa

SEQ ID NO: 6169 - DNA, 1362 bp, Homo sapiens
  misc_feature (1)...(1362): n = A,T,C or G
acgggagacgcaccgagcgccaaaagagaccagaagaccgacccggagagggcctttgggagcgggacggggcgggaggaggcttcggggcggcgaaaaacccgcgagagaaccacaccgcgccgcaaaaaaaacgaacagaggccacacagaacaagaagaggagcaggcagacgccgcaggcagcgagacaaggagagcgcgccgaaccggcaccgcggagcgagacacggaacagagaacacaccagcgccacccacgcaaagcagcgacgcgagaaggcccggccgcgaacggccgccggcacaggcaggacacacgcacacaccaaagcggcgccagaccagcgcagaacaagaaccacaccgcggacgacagaaacaggggacccaacaaggagagagagaggaggaggcgcccaaagcaccggaacgaagagacgcagagagcgccgagggacgcgccacagcgcaggcaacagccgcgacgagcaagcgccggcacagagaaagcaccggaggaggggaccgcgcgcgcagcgccacgcgcgggcagccgcaagaaagaggcggggcagggccangagcggcgagcagggcgagcgcgcacagccgcgccacagacgccgccgaaagaccgagnagagaaacaacggacggcgagcacnaccgccacgagacacaaaccaacgaanacgacaccnacaacacaacaggcacagagagccgcacacaacagcagagcgaagccgcanagaagaagagaggagaccgcgcgcgcagcccgaagcaccccacacaagccggccccagcgaaccacaggacacacgcgcagcaacgaacaacccgcgcgcagcggcacgacgaganacgagagagggcgcgagacagaagcagacgagacgacgacacacgcgacgcagcgcagagagcgcgcaaaaaggacaaaacacgagnagagcagacgaacgaccgaacgcggcacgacacgaagagcccagccacgcccagcgcaacaggacgcgacgcgacagcagacacacgaccaccacagcgacgaacagacagacacgcganagcgacgagaaaggcacggagcggcacgcacgcgaacanagagcgccagcgacgacaccgccgcagggcgagcgcaaacgcggacaccagcacnagcagaggnagcgcggcagcggacggcgaagcggcgcacgccgcgcggacaaccgcagcgcacacacgaagacgccaccagcgcgcgcgccncacanaccgcagcaaggacgaccacccgacacgcacaagacaacgcacgggcagagccgcancggagagcacacgcacacaccaacacacgcgcacgca

SEQ ID NO: 6170 - DNA, 242 bp, Homo sapiens
cctaggagatcgagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacaaaaaaaaaaaaa

SEQ ID NO: 6171 - DNA, 362 bp, Homo sapiens
cataccatgtaagctgaacaatctgatcttagactatgcatgtcctgacactaccagatcactttagggattctcgctatccgagctttaattaaataaatagcattgcctgtttccatacaaggactataatgaatgtggcacttgcccttccagcgcttcactacctagcatgggtacttaaggatacaatcctgtgccctgtgcgcatatactcatgatctcgaatcagtctacatcttgaaatcgggactaggccctaactgagcgaggtaaactcaccacatgagttaattaacgacttatctcaacactatgggataacaacaggaaagatcggtgctcgcaaaactcaacgagaa

SEQ ID NO: 6172 - DNA, 189 bp, Homo sapiens
  misc_feature (1)...(189): n = A,T,C or G
aatgggnagggagnnnagnaggaagnaaaagngggngggaaagnantacgttgtttttccctcatcagccctgtaaaagctgacatctgaccttgactatgcactcctgacctacaaatcactttgggattcttgatagccgatttttaattaaataaatgtaattgcctgtttccaaaaaaaaaaaaa

SEQ ID NO: 6173 - DNA, 1171 bp, Homo sapiens
  misc_feature (1)...(1171): n = A,T,C or G
gaggtccgacacccgaccgccggtgtctcgttctcccctaccttctcacttatagttctcacctattaacagatgcgctcantcccatatccgacatctcactccctgcttgcctccgtcgctcgtctgtctatacttataccactcactatcccccacgcactggacagtgcgacacgcgggtgttatgacgacatgcgtacggtgacgagccactggaaggtcagctgtcaatcaatatgtctgatgagccggctgtgcgcgcagaatattgtatatatccatccgctatcgtatggtgacgccgcgacctcggcgatgtcaatccagtgtacgattgagcgcacatcgggcgtcgagcatagctcgctccgttgaattacgctggctcgcgcgngagcagaccgcgaatgtagtaggcggtttagcctatcctgtttatatgcccccacaagttacgccctatgtcgaccacgcgccacccactccgaaacgggtataagtacctgaacgacacctccgcatcgtatcgctgatgtgagtacatcgaatgatgggttagttgaggcgcgacaactttgatcttgatagtcccgcgacggcgggacgcaggccccggacagacagcacgaggtaccagccgtgatgatgtattgtcggggtatataaggcacgtcgctaaggcccctggcgcagggcaccgcaccgatgtgctccttggctgacgttcgaccatctaatcggcaaagacacacacgagacactatagtcgccgccgtcatgattgtctcttaaggatgtagcggcaagtctacggaggatggccaatagcacaggcgcgcctccagcggtcatatatcgctgtgtgcccggtccatatctgccctttgagacgcgcacttaggagtagcgaattctacacctccacgtcacctcctgctgtgtttatagttagctgtgtcgcctgcacccacacgcgtcttacacgtcatatcgacgtcaggcttagccaacacccaagttgttgcgcgcccatagttggcggtgggcaaactatacttaaaaatatccatccctgtaatcccgctcagtgacacacaccttctctaaatttcttcggcggccccgagaacacctaccctcctcaccatattatcgacattgtctcatc

SEQ ID NO: 6174 - DNA, 245 bp, Homo sapiens
attgaccccgtatacagaggcttgtcaccaccgtaaccaatgcagacttagctgcagggcctgctgcgatgtccatgctgaggcaactgagaaagaggatgcagcattcaaggtgccatcttggaagtagagaccaggccctcaccagacactgaacctgctggcaccttgatcttgggcttccagcttccagaactagtgagaaataaatttctgttcttgataaatcgccaaaaaaaaaaaaa

SEQ ID NO: 6175 - DNA, 807 bp, Homo sapiens
tgccttctttagccacaaagctttgagaaatggggctaaatattaataataactgcttggattataatagaggaatcaatcaaaacacatactgttgatgaagatgccttgaacaccgtggatgctgtagaataagggattatgactacagcaattcttggctcccttctctgtttgtttaagggttacacatgctttgtttaatatctccgtgtctcagtcctttcggttgaagcacaaggcatgcttcagccacctgagattaactgctaaaccctgcagcaagccagcatctactccctgctgcctctcgtccgtcaagatctgctctggaaatgggccagtggtgacgcgtgggaatgcatccctttgcgttcgtttctgcggctcgatttggaggccctggccacggattgcattcctttctttgaaacttgaacatctctcatgcctttgcgattgaacagacaaagtacaccctgcccatgcccaaaacgaccaacctacacaaccgctcatggttccagcgaccagctttaaataaaacctcaaacccctttcacccacccataattataaccttattctgctttgttccgccgacgtcagtaaaaggaagccagtatttacaaaaaataaataacgtggcttgttggcctcacacgggtgaaccctgaggtcctttttctcttaataaggagaaatctatagaatcctaccaccttgcctccttccccgctagcccccaccgttcgcacaacctgaattcactattctcaaatgaccacacaccttcctcgccataag

SEQ ID NO: 6176 - DNA, 226 bp, Homo sapiens
ctgatttctgcattacttttccctgtagccagcttcagaaggttcttatcaagacttgaatcaaacttcattttaccaaaacctcaagcagagagactcatcctcttaaactacaatctctaagacagatgcacagacataagaatacacctctgtcacgtagttacatagcgatggcaactaggaaaaaaataaaataaaaaatacgaaatcaaaaaaaaaaaaa

SEQ ID NO: 6177 - DNA, 294 bp, Homo sapiens
  misc_feature (1)...(294): n = A,T,C or G
atccnccagatgatgtcaatgaagccctgatcgactgtgctgggatcatttccaaagcctccaggagcaaaccttcttcaattcaacctcaacggtgtggacagcacaccgaccttccaaaattgaaggagctggagtctctcccacactgcaagaccccgttgtagcggtcactatgcccaccaccatgtctgcctttgataaagtctgctttaccatgtttgttaacaaatcttcactgagaccacttagtaggaagaaaaatacagaaatataccctgaaaaaaaaaaaaa

SEQ ID NO: 6178 - DNA, 199 bp, Homo sapiens
ctggatgatgcgttaatgactagcgagtcactatggggagacggaaacactcctgctaaatttcatattgcagggacaccaaagcaaaggacagatctcatgacagcttttattgaaatggactacagttaattttatctaaagaatacgagaaatgccgacagaaataaaagaccctgaaatcgaaaagaaaaacaga

SEQ ID NO: 6179 - DNA, 1774 bp, Homo sapiens
  misc_feature (1)...(1774): n = A,T,C or G
gcagcctcagagaacgtgagtcttatagacagcgcgacgcggcgcagtactgactgcgacactgaggcagcgcgaaccgtanctagtatgacctgagtcagcgactcaggcgatcgagtgttctagacaggactcgactgagcgtccctacgcgctctgcgctcgacgcgatctctgacacacagagagtagcgaacagcgcgtcggcgtangtgtgctgcctactgtgtcttatcacctacctgcttgaccacatctctccgcacactgtncgagagactgggnagacgttcatgcggtcacgcnggcgcggncgacgcacgctagtaggagatgaagagtgtgatctgcctgtactacgcctatcgctcgtgagatatgatacgctgctcgcatgacggctcatagcagagtcacantcatccgtcagctgatcgagaacgcacgtcgacangcgttatctcactgcgncnctctgacacctcgtctctcttggncgctctgtgtngcagcgtcnagataagcgtgcgatcaataacgtcttatacatcagtgccgctgcgcactatacatagcgatgtcacgcgcgctccgcggcgaccgcgacggacnanaacgagtctgctctcgagtgcgggactgagcagagctacacgatatgnaaccgagtatgtacagtaatcgtagacgttcanaccgatagagatgaagatcagcgatcggagcgtgcagcgcntactattactatgtgcactactatcttaacgacgtagatcatagtgcgtcagtgggcgtcaacagcagcagcgactacagcgacatgatcgacntcgantcagcgggtacgactntgnatgcatcaatacatagaaagttatgatcgaaccgaacgtccgtccgagcactgagtagagtatatagtngcgacgcatntcgtcgcgtgcgacgacacacaccgcagctatgcaactacaagcagntgacgatcatactaacgcgtggtgttgtggtccgtgtcgtggcgctggacgctggcatagtacgtctgagtctggtcgtgcgtcgacgcacagcagtcacgactgtgtgggttgcgcgagcgcacgacgccgtgctgcagagatgacatcatgaacgcgctgcgcgcacggctcacctctgcctgagtatgacgcagtcacatcaccattccatgctcgcagagtcagtcactcagatctgccatgcgtacgtctgcagctcntctncntccgncgcagcgacgctcgacgcgtacgtcggcgntattcgcgcgtcagcgtgcgccgcgcgcgcgcgcgtcgctctgtacactatgtctacggcacgcacgcgcagagttcacgagcgtaccagcacgagtcgcgaactgancactgacgagactattggctagcgacgcgtcaatcactcgtctactacatgagatgaaaagcngaacacacgtgcttcgatagtctgactacttggtatgcgcgncaagaatgctgnggtcgaatacaggagcgtcangtcgactctcactatacgcgacacgcgcngctgttccagcccgcgagcacacaccaaacagtctaactatcgcatagntatttgctagcagcgnacgaatatcacgagcgcggcagcagcgatagctcgtgcatgcgtgctgnctgcgatgcgcgtcattacgtgttgcacatgtgcatcgtaccncgtagcacgctgcactagcgtagcacgacgtggagtnagtatagctcacactcgcatt

SEQ ID NO: 6180 - DNA, 1693 bp, Homo sapiens
  misc_feature (1)...(1693): n = A,T,C or G
gcacccatctangactaccctccgcactcataactcntgtctattctnantactatcagcatgctnatccctctgctntatttctctcacgaaattcacctcacntctcgtcacgctgatgtgtgccactactacatgtctattnctgacatgatctacatcaccgagtctacttctgtatnacacgatactctnactcccgcaccctcactcacaatctaccactacgacgacgagcggcgtcgatcacacaatgagtgtatagttgtttcacttcctactatacattctaccgtcgtctcacatcgatgtcgtagtagtatattatcaaatataagtcattcgttcactgagttacgatataccactgtagagtactatgctcctcatactgcacacccaatatcttcctctcctactcattantctctcancngcctcgtcgantactcatttatntctcgctatctactcagaagcagcttcacatataacactatacgaccattatgaatgtatcgccgccggtctcgtcactcgctattattcctctattcctaataactacctcaatcatacatttcatctgacntatatatcgcttcatttgttatacatcctacactgttcaccaccactcttaatctcgatgtctaaccttagcgaaacaacataccttatctatccatatcntatcgtacctcattctacttgtatcactacacanacactatgaacgttcctactcatnctcatgagcataaccacacatcatctgcatcaccatgactattcatcccacattatcctaatatcgcgctctatcgcncacantatncgagcattgctactctcaccgtatcaacttttncgcacaancactaaatatataatttctatcatactatatctctcgatttaacaacataccatcaattaacatagccaaatagtaatatcatactcgactctacacatacgtctcttaanatggtgagtcnataccntgntacacaatctcaacatccacactcacgcatgctatgtacgtatagagatattgcgtcccgcacgtactcgttatcctgatgtactcgcgtctctgacacnatatatttatactgtattaatcctacttctgtctccgtacaactacctactatctctgatcctatnaccacaatacagatacgtggtattcagcaacattcatacattactgtactctacacatactcctacacactaccactccacaatagtctcacccactgcccatctcttatctatcgtcgtacctagctacctacacacaacttatatatcaactcacatataccacacctatccgccntatatcaaatactcttccgatacctcgcaccatacgaccctctatactcacatcactatactcatctccacttatactctttactacttaatacacttacagacgcttgctacactctcttattcaccaatctattcatcatatttacttacgaacgaccacaactatctctacaacgcgcacntncactatattacttgaatgcacatcatccnctatccgcaacaacacgcagttaatcttagaactctctcactacttcttctccgtgctcaattntatactactctcacttccgttatcccacgtcacgtgaatcagattcatacgtctacatat

SEQ ID NO: 6181 - DNA, 437 bp, Homo sapiens
cttggactttcctaatttttctacttgagcatggcttttgaaatttaaaaaaagatgagaagactttggccaagatagattagagtaagtggcccaagattacatggccagcaagtggcagagctggaaacctcagagttggacctcagaatttgtgctcttaatcatattttatagcctcacaataaattagaataaattaaccgttccaagcagaggattttagacttcatgcaacatggcgagtacttctcaaagttgttcaggggataaaacactcagagaactcttattaatatgtttaatttcatcaaccggattcagcaaaatcaccaacagaaaacaagactatgatacatgtggacaaaaagaatcacagatataaatatcctgtgctttctcaataaatgatgctgccttactgaaaaaaaaaaaaa

SEQ ID NO: 6182 - DNA, 1356 bp, Homo sapiens
  misc_feature (1)...(1356): n = A,T,C or G
caccacattttctctattacattatattctttatgtttcaccacggcatccaagcagcaaccgaacgtaatgcaactaccgtcaatagaaatctgtctaaactactccttacctaccctctaaaactctcctgtgagtgagtgaagtaacataatctattgatcgttaccttactgatcatatagcaatctcacacttcagtttgatcgtctcgatatcacaaagacagacgcgccatactactacgcgatcgtgtgacactgctagtcatatgagtataatcttgttacttatagtatcgtttatggtaatcgtgaancttcctccgttagtgtagtatcgagtcaaagcgcgacagatattgagagatcgtatatcggtatgtgaaatgaatgatatnttgactaattttttgtaaatcacgttatcacactnacgcgcgcngagatcatatgcgcanactacactccacactctctcatctagatcgaccgtcagatatgactagtgttatgcgcacaatacgtagatgaagtgagtgttacatcgaattattgcgcacaccaccgtcgtgtggcgttgtacatgtgcgatgtgttgttcctctggtaccgaaccagacaacaccgatgcagcacacacgagcgaacgggagagccatagagtcagaggccggtgagctcagctcacaagcctccatctcatctgcctcttacctctaaaactctatacgacgagcactcgatcctcatccgcgcgtatcgcactcatgaggtgctccagcgtatgccccacgacccttcgcctactacattcgatcatgaatttcgcatatcacgagagtatctccctcttgaacaattcattactaaatttatcaaatttctgtacatataatcatttagtctccgaagttgtatatatatctccatatatacgtcacactagttctcttgtagtttatacatgtaccgtcaattctcgctcctagctattgtaggtcgatgtatcttcgctgtcgacacgtcgtactgcntacctgatgattatcgtatatatagtatgattctgtgacgatggtataaactagtacattatctatcttcttgactcttctcctactctacagtaacgcgancacgcacgccgccctctgccacattatgaatncgtccacactgatgaatcttcagcntctctctctcatctgtgacgttctatcgtgaagtctgctgtcgatctcaatgatagaatggatagagagtgnancatacgtagttctcatcaataacagcatcaccgatntatgtcattgatgagatcgctagtgttttatatctagacacataagtagat

SEQ ID NO: 6183 - DNA, 252 bp, Homo sapiens
ctctgatgcacaagacggcacccttagtcgtcactcgcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacactatttgttaaaaagaaaaaaaaaaaaa

SEQ ID NO: 6184 - DNA, 835 bp, Homo sapiens
  misc_feature (1)...(835): n = A,T,C or G
cactcatgcgagcacacgttcagccgttaagggagagagggggggggggcttgtaggcgacnccccgggggcttccggagaacaacgncaaggagaaaggggagagcatcctcccatccagcctgaggcaccagctaacacggatctgagagaagccctgtcctccactcacctcacccgccgctgccaccatctactctgtgccaactccttgtggaccgcaagaaagcatgactttgaaaaagggaagccattccgagattttaaaatgttttttttctattccatatgaaaagctgatgttgttgtacaaaattcactgatgttcagttgtattcgattcgaccttcacgaaacaagacaggctataataaaacttgtgcgctctacatccaaaaacgaacaaaaagccgagcggacaaaagcatagagttggccctctctggcccgcactgcagatgcactaagggcgctgccttgtcgggagggggaaatgctgcgccccgctccctaacgagatgctcgccggtcgtcgcgtgtcgctcagctgggtggtcacattccaaggcgcgcgattcggcctccgctcgggttggggtatcccactaggcacagcctgcagacaaaaatcctacgctgcgctgcacaatcctcgaaatgatattttactaggcatcgggcaatggccacccgcccacgcgggaacaccacacagatatctccccgctgatatagaggtcgcacctataggagctataaagtaaagcgtacctacatttatgtccgctccggctggatggtgtgtcggatcgctccgttcgtgaatgagtcgtct

SEQ ID NO: 6185 - DNA, 803 bp, Homo sapiens
cctaggtgaagaagaggcccacctcttactgggcattaggaccagacacaacagcgtgtagacagcaaccagcatgaggtgctgccgggccagtcctgaccacacactctgcctttacgggatacgctctgtgcattctccagcatggaggccatagagagctactgctgcgtgtaggactgtcttcagcgatatcacggctactgtgctgacggctcacacctgtgggctttactgttgctttcagccgatcttctgaggattattcattagcctgtaccttcatggctgctgaacagattgcatattagtgatggatcttgtgcctaactttgcagttgacaggcgaaacatgatggatattatttgagaattaagacgacacatacactgtgatttgtttgtcaggattgagagacagagtaggatgctgataggataatgatgcatggtgtgtatgggaggtgtcacagagtgtgatgcagaaaaacacgcgtcatatctgaattgatacctgttctgcactagccaattttatattgttgttataggtaggtgtacattgtatttttttaaccctcttgaggattaaccctgccattaaggtgcctatattcctttgcctgctgtaaaataagaaatatgcattatcgtttcattcccgtgcaagcctgctgatgaatgaaccccacgggtaaacttatgggcctactaggtattgaacaaagctggtattgctcgcggaaattacgttgcatccttaagttggtacaaggctttcttgcggcaattgtccctattat

SEQ ID NO: 6186 - DNA, 488 bp, Homo sapiens
atctttgtatattttagaaaataaatggcaaaatatatacaatgtggagtctgaatctcctcatcatagagtgtgaacgatggtccggctgcgaagctgctgaatatactctttggcatgggcaacagccgtctttggtggctcaggtggaggtggggcccttccaccatcttcacgaaataatggcaataaaccttctccatgatcccaaagcgacctctgccatggtacaggatgcgtttcaggcactggcctcgtcctgaggtggactcagttatatataaattggacctgaattccacgttatggtctatcagtgccatatcttgtgcttttaagagaacctctttaattattttggccccttttttgtctattgaattccaactgagccaaagcctggtcaatagacattcctcgtatcaattttgccaaataccacatcttgtctttgctatattttatttgtcttcggcagtggtagattt

SEQ ID NO: 6187 - DNA, 739 bp, Homo sapiens
  misc_feature (1)...(739): n = A,T,C or G
ctcggctggtaggtgttgggaattgtaacggaaaacaattcacacaaggaacaagctatgccattattaccgccaagcgggccattacccttcattaaaggaaaccaaagctggagttccccgcggtgccgccggcatcgttgttaataaagnaaatatccaacttaatataagtccctcaattaaaaattcccatcaaaaagccttgttccaaatttaccaatgatacgggctataacacaattatttcattgaagtgaatcaatggttaatgtcgaagtttttattcttcaagtctgggtttcaatctggtttaagtgaaagcaaaattagtttggtggtttccttcttgagtcttgcaaactcgagtctaccttgcacaaacatctccatcctgccacggttcggatgactggcagtctgtttaggcgaggcccagaaacagaaagcaagtcttgtgaaagtcagaatctgggagctttgcagatgcgtcaaggtagccttcagattgcctctctgttttcaatgtgtcccttatctcactcttccaaacatcctatgcttttaattcatcaggtatgaaggtcaggcagaaagaaaatgttggtgctacacaactcatctctcagtcttcaaattcctcatgctcttttttttgcttttctctctgactctccaaaaaagggattctttaaattacctccatgagattattgtgaaggaaggcatccaggttgat

SEQ ID NO: 6188 - DNA, 1490 bp, Homo sapiens
  misc_feature (1)...(1490): n = A,T,C or G
catatatatctcacgaatattatcacctgatatctanagtcactactcactgactctcatatcgtactctatacatcactgatantatatctagtactctagttagcgtattatcatactctagtctgatataagactctacatatanatangtctngtcggcgacactacgatcatatgttncgtcgtacaatgcgatgtcacgtcctantcgtcatcgagtcgatgtctntgtgatnttactctgantccgatatagcaggatcattctcacttatagttgcgtcgngacgctctcagctgcgcaggtctgcgtgctcgtgagcgaggatcgcgtatactncgtcctcgctcgtccatcgtcctacattcgcttacgctctatgctgctgctacgtcagtcgtctgcactcaaatacgagtcgctgtaagatggcactagaactgtcgcgcgtcctagcgcgccctgctgattgcacattctcgcatctctcgcacgccgcagatacataccagtctctncgcgagacgtgcgcgcgatgcagtcgtctgcttcatcagaacctatcacatctatgtagatcgcgcacgcatctacgcctcccgcgctcganacggcgcggccacgcctgctaatatagtctgaccgcgggttctgcatcggagatacacgtgggatgcgatagctaatagancgnagcgaaatagcccactcttctctctatcgctcaccactcagcacacgatacaccgcgcccgatccacacctatcttganctctgttnggataacgttcagcgccacatactctcgaatgctctacatcgtcgttccgccccgctactgcgtcgtcgacagacctccggaccgacactncgcttagcgtatgtgtcggtgccgccatcactgacattaaacatcgcaacaactcggatgatcatcggtcgactcctccgcactcactgactaactacatatcatcctcgagttcacctgcgacgccacattcttctcttttatctattgtacagcgttctgtgcgcctgcgtgcgctccccgttcctccacttccatcaaaaagaaactcggggcgngcctcgtggctcggcggccctttgtcatactcttntcacttccgtttgccacaggccgtcttggaggagattgactcgtgagtggtagggtgctgagtcgcgcgctcactagtgactcatcgaacttgtgctttagtatcactcggtatgatcgtctcctgatccatctactatcgcctntcgcagcntatcacttgtcttctattgcgtcgtcgcgggcgtatgggtcgtcccaccaagaaatctcactccgtctccgctttgtatgcccatcgcttagctcgctctttatagagttgcgctccctcttcaggnctgtcttgtcttcagttcaccacagaagcgcctgttgtncgccttctcacactccagaaccgactctgtgacaccttgccg

SEQ ID NO: 6189 - DNA, 992 bp, Homo sapiens
  misc_feature (1)...(992): n = A,T,C or G
tttcacacacatatattccttagacctccctatacgatactaatataaattatactcctaacccacccatttaaaactcaacaccacataatctacccagtggtccacgtatgattcaacgcacttcatcggccctacaactagcccacacgcataccccgtacatactacacgttacataataatataaaccacactataccatatctatttccattcataaatattccatcacactcattatcccatctttatcaataactaatataaaataaacaccaattatanaacaccataccaatacaacttatcttattacaaaccaccaaaaaagctggctcccgtgtatactatttcatcaacactatttctttctctcactatcatcacatcatattaaaaatataataacactacttaaatagaatacacactaagtatacaatactccaacactctattttttatagaatctacacacccccaatccaaaatactatattatattttacaaaatcaaatctctatcatttcaaacatcacacactaacataacaataaattacgaattcaattggccattataataacatcatattattataaatagaaaatccaacataaacaataataaatataataagattatataactccaaaatacataataagatatatataaacttcaagcgtctccaaccttctacagaagatactcccctatctttatacaattactatcaactcacacacatctatcaacgatatatttcgttatctttctctatccccttattctaccccaaccattgctatatataatacaactacatcacaaaagcaataattcctatgcgtcactaagcatgcttcccgtaagctattaacctgccacaggcctctagtcccatacagcctaggtattccccgtaagctagttgtgcgtggacaacaagcctccgtcctaacctcatataaattacaaaaaatta

SEQ ID NO: 6190 - DNA, 574 bp, Homo sapiens
cgcatcagcatttatttttcaagtgtccgaatttggtcatctgattcaggatcattatttccttatcactcagcatatcccattgcaattccactttttcaaaaatcacatataatgtttgtagaatgttcttgtcatcccacagtgatttttatttttttgttcagcgattagctcgtttttcattatttcaagatttcaggccgggcactgtggttcacgcctgtaatcccagccctttgggaggcagaggcatgcggatcacgaggtcagcagatcgagaccatcctggctaacatggtgaaaccccgtctctatgaaaaaatacaaaaaattagccaagcatggtggtgggtgcctctagtcccagctactcgggaggctgaggcaggagaatgtgagaacccatgaggcagagattgcagtgagccaagatcatgcacctacactccagcctgggtgacagggccagacttcgctgcctgtgcagttcttttcaccttcatatttgagggttccatcacgatccttttgcatagtttgtcttgccacctgccgggtccatcccatggac

SEQ ID NO: 6191 - DNA, 1156 bp, Homo sapiens
  misc_feature (1)...(1156): n = A,T,C or G
aagacattgtaagcgagacatatacaacagatcgttggcataacaccacatttgtatttgtgttgcgctcacccacacccgtcagatctaacacctcgtagacagctcgtataacactcacctcctgcangcactgatcatnatagcgcacagagagccgccctcacctaactcaatgtcttccccgaggcgtagcgactctcccagttcgccacaccagtccggcgcagattcgacgttccttatgctggacagagacaccatcacctatacacagcaatgagcctaagcacagctactatggatgcaacagctgatagaaccacgaaacgcggcagcttataatggattgtcaacaccatcacaaacagcgcgcatgagcggaaagaataagcgcagcacaactattgctggtcccccacgcgacgcgcacagtgtagcgggtgtccataacacacgtcgagtgtctacacgaagagtcgtgttcaggacgcgccgagcagtcttttcttatcccctcagaacacggtaacccccgcgcaactggtcccagattttatcaccgaccccaatatctgacaaatctccaccacactgagtagacgagcaatctcgcatacaatagcggactaccaatctgtcagccgcacattatcacctcaacccagaacaccactccacccgcaaaagaagtatatatatacagcagccacgcctattgccaacacacatctacaccatcagattgtcttcgacaagcccacggacactagtatcaataaacatctaccaaagacacagctcacacatctcgaaagtacagaaagtcacaatcagaggagtggtcggtcagctgctctgattcgctgcgccgccacaaacactgtccttgtactcacnttgtactgcgacaataacagaaatacatatataacaccaacgatatataacatcaaatgtcgcgtgatcgcngggggcggtcccgaaaaatagtaaaaaatancccaaactgattactctgggccgcaggatcggtgcatccgaccgcgcctgtgtgcctgtctaaacnnctnttttctgtctcgttcctcccaaccgagccgtgtggcgcgtcctcgctcgctgtgtccttacatgacttacgtacatctctact

SEQ ID NO: 6192 - DNA, 863 bp, Homo sapiens
  misc_feature (1)...(863): n = A,T,C or G
ataatattaataataatacatgacacaatcatcgaaattataattacatatattctctcatccataacataataacacataactaaacaaacagaaatagaataaatgaaacatttcaagagaagtcgtaagcgtaacggccgaattactataatcaaataaaatccctcgcatcttccgattgtcactcaaccttataacaacgacgtaatttagcaagcagagtagngaagataacaaaatatcccgacaaacgtgaataacttaaataaactggaataagaatattatagctaatatcagaaatatacatgcatttgaatctatattttaataaaactaatctacaacaacaacctgtgagcaccgagaggacatagtcctatcaaacaaatattaattagcgcacgctaaggtcagcacgacagcacgtggcaaagagtacacaaactngacaatgcatcatggatcactattaatgaatgctaaaaatagctaacatatacataacgtagtagggagtcaacgagagcaaccactcgaagcacaaagatgaaaaccgtgatcattatgataataggaaggatataagataaataaaataacagtaaacaccaaccatgtataacctaaaaatatcaatcaatgcataagtgccacgaacgaaactgatactacgacataatgcaatataagaagaaccatatantctcataaagacgaagagancgaaactacaagctataatacaaagactaacaacgatagtgatattacatcagaccgaatcacaacacacatagaaaacgacacaatactctcttatatacgtcttcttcgtctctcttataaaaaaaaaaaaa

SEQ ID NO: 6193 - DNA, 222 bp, Homo sapiens
  misc_feature (1)...(222): n = A,T,C or G
ccggtgtaaaaatagttttgccggttgattcagaacatatgttcggtataaggttcacggtgggctcgaaggggggtttgtcccacagcccgctttaccctccgccaaggccgaaatgagtgacctccagcctgaggtatgacaaagcccaagttttctcttatgtttgtagggggacctgggtccggttaactgcaaggttgaatcaagaagagcggtana

SEQ ID NO: 6194 - DNA, 488 bp, Homo sapiens
  misc_feature (1)...(488): n = A,T,C or G
atttagattttacccatgttcccatatctccattcattgcttcttgcagaatgtgcttggtacagggcttgatccccttcttccttaggtcatcttttactagctctttcagcanagagctgtgagtggtaaagttcctcagtctttgtctgaaatgtctttattttgcccttgcccttgaaagacagttgagctgaaagacagttttggttgacaaatattttccttcgtcctcttgaagagatgataattacatttttgtcctctgtcattgctgatgggcttcgctgtttctttgtgggcttcgtgccagtggtgaaggcatgtgtcctggactcctgagctgcctgggtccaagtcctggccctgccattcatcattttgtgaatttgtgcctggttatctacagtcacaattctgcaatttggattgggctcagctgggcagctcttctgctagtcttgcctggggtctttcacatggctgct

SEQ ID NO: 6195 - DNA, 712 bp, Homo sapiens
  misc_feature (1)...(712): n = A,T,C or G
aagtgaagtccccggggtgcgccgcattgcattatctggattatagttagatgccatcacctgcaaggttgaggagtagaacccgatagaacatcttgatggaaaagggtgagttgagaacccaggacattggccaatagcatgctcaggccggaatagcaaaaaggcagaaagatggctcaggacccagagcagggaagaagccaaaagaccaacaatgcctgttgagaagccctggagagcgaggccatcaacgggtgggcaaagaggaagggaaagaaanagcgtgccccagcctgctggaggcatttggagttcacagggccgctcattcgccaccccaattaaaggctttctgcttcgtgcctcgccttgctgtggtttttccagacagaagtggctttgttactgggtgagcaccggggcctggaagcagctgtgagtatgtggacttcctggttgcagcctttctcctctgaatgcttctctgggacctcttggtccggagccttttatctcccgtgtttcatctgattctcactgagtatattctgtaatttgctttgtcaactgccgcttccaaggaatcattctctcttgatctttcactcttcaatccctttttttgttctttccactcaactatcctttgtatgtcttcatgcttgttgcttcatggtccaagatggcagccccatctctgccatcacat

SEQ ID NO: 6196 - DNA, 715 bp, Homo sapiens
aagctcatatttcctctagatccacttaagcccgccattttttcttcccgtttcaacggcggaagaagggttttggaaaatggcagaaccatgaaaattagccaaccaattccatgacaattccggtaagtcagtcctttccattttcgaagtcaggattaggaggttcagctcacattccatgctccacaataagaaaaagaaacatcctcatgcctcttgaatgccctgctgtaaatccaaatgttaaaacatctaagccctccaataaacaatctctttttcaaatgtgtaggattatgtgaaccactatggtctaggttgacagagagaatattcttaagagggacagacctctgaatggtactgctcttctccctctgcccagatgacatctccatcctcccaactggtgcaagtgtgtggaaggcatggatgcagtcaatattgaaagagatcacattctaggagtgtagtgattatagcatgttcctgcatgctctgggtgagatttgcatttttgttcatcaacaatgaagctcagtatcattctttgaaagattcactggacaccactcttcaagggcagcaagaaagatgatacatctttcctggggcactggctaacactggaagaggctgcttaggggctgaggggctgagtggtgctcttaacaacatcccaggaataagcagacagaagctggaggccagg

SEQ ID NO: 6197 - DNA, 725 bp, Homo sapiens
  misc_feature (1)...(725): n = A,T,C or G
tcgcaaggcgcaataccctccttaagggaccaaactggagctcccccgggtgcggcccgcaccgctttattatattttttttctaattttaagttccaggatacaagtccagaacatgtaggtgctatatagataaacatgtgtcatggtggtttgctgcaccaatcnacctgttgtctaggttttaagcctggcgtgcattagctatttgtcctactgntntgcctcccctcgacccccacccctcttaaaattctttttattttcacactgagtcttcaaagtctggtgtgtatcatacagcacatctcaatagccacatgcaggcagggcgcggtggctcacgcctctaatcccaacactttgggaggtcgaggtgggcattggacgatgcaggtctggacaagtgcctggtatattgtgggcacaattcttgaatggacccacgccaatgtacgcgtcgcttttgcctgggccgttccttcttcctagaatgtcctgcttctttctctttgtctaactcatgtgaatgaactttttaaaaaattagtatccttcaaaactgtatttgctcaggcgttctgatgtgaggccctcctgactctccaggtgcgggtgcttctctgctctgtgtctctcacctccaacagcttgttctgcctgcgcactatttgctgatgtgttatctccggggattctcgaatttctcaccttcatccccaagg

SEQ ID NO: 6198 - DNA, 644 bp, Homo sapiens
tagactcctgcattctctctcaatggagcatgaaataaggcatgtcatcatgtcagcgtatgctaggaaggatttgcttagaccccggtccttttagtatgtgcttattatcatcttcaaataccagtaactttcaacgaaggacatatatcccctccgtgttgaagcatgattcccaatgttggaagacattcttgggattttagcacaaaactgtattttaaacccatacctaagtggaatctacttttgccttttgcctgttgtgctacaatttgttacttccaattccttcctctacaacagctagaatgacatttttaatgagggtgattttgatcacatcacatttttgctactatcttctatttttttttttaaatatccaaaatctggaagcggctctactatgtcccgaaaaaaatttttttggccaccatccttctttacttccagaataccatcaagcccaagggtcattttttttcctataaattttccaaagcccattgggctaatggttttttcacatgaatttttttcctcccctggaactggggtaaaaaaaacattttaatcgcgccaagaacctacttgatttccctcaatttaaaaggctttcctcctcaaaaagggtttgatcc

SEQ ID NO: 6199 - DNA, 136 bp, Homo sapiens
tggtatataatgttatggtgtggccattcgcaaaagggatgatagggcgccagatgattgggtggggctttttgttttgctcaagggccgttcgggttccgtttggtacgcgtcagcgaggtcaaggcataatagt

SEQ ID NO: 6200 - DNA, 724 bp, Homo sapiens
  misc_feature (1)...(724): n = A,T,C or G
cacagtaggataagtgttaggattttaagttgtactgttatattcccaggtagtttaactcaagaatggctggatggttctctactgccctccagtggaaaggataaatgaggtcaaagcattttggaatggaaaaggacgtggttaagtggcttaaatatgggacgtaaaatatatggcagaaggagataaaagaactgaggatgttttcttctcagtgtgtccaaaataagtgaactgttgaacaataaccattcagcaccatgacttcttacaacttcaaaaggatattgtaaatactgtatttaaaacnaaggtctcggccaggcacggtggctctcgcttgcctataatcccaacactttggcgggccaaagcaggaggatcacttgaggtcagaagttggagaccagcctggccaacatggtgaaaccccatctctactaaaaatacaaaaattagctgggtgtggtggcatgtgactataatcccagttacttgggaggctgaggcaggagaatagcttgaacctgggaggtggaggttgcaatgagccaagattgcaccagtgcactccagcctgggtgacagagtgagattcgctcccctctggtaaacaagatgccaactctagggtacggtggaaagacatactggatactttcactgtgttcagcaaatggattgaacatggagccaaaaacatgcgaagcactgggacaat

SEQ ID NO: 6201 - DNA, 1119 bp, Homo sapiens
cgggaagggagtaggttaaaaaatatataattaaacatgaagggagataattgggatgtgttaaatctcagacctcttattacactaagtaatcacaaaggcttaaatgtgatataggatatgagtaacgtatataatttagagtaatttaaaagtaaaagaatagttgaataatatactcaaatgtatatgtggagtttcctagtctaagaaaagaggtgtgcaatgatacagagaggatgaccaagagaagagggtggatgttaggtgactagagtgatttgtgtagttactgtttttggcgggattgtaggtgtgtgagtgtgactgtttaagggagagtgagtgtctaatagaacagttataaaagaaattgatccggtataaattgaaaaaggagtaagcgaatcagtgatttcagaacaataataatatattataaacgacgccgtaccagtagagcgatagtttagcaaagacgacaagagatgatgtgaaggagagcgaggatgtaggaaaagagagggagttggatggtgattattgtatcaatataaatagaagatatataaggtgttaagaggtaatacctgcgaaacatattaaaccgtaatgcgtagagtaatgtgatgtaggatgagtgtagtgaagagtagaagagaatggttattatattcgtataagtatcaaatatgaaaatataattaagtattaagaaaaatgagaaaataaagaggagaaaaagatggatgctatgcacgtgatgaaacagaaggacatttgaaacaatggatgatagtggatgtgtggtgtgatgtggacgatgtagtagatgtttgaattagcggctgaaatgttgtctcacgtagagacagcagtgcgatctgtacttctcaatgagtgcgtatttctggactaagaagggaagaagtaagtcatgatgtaatgacgcctcagttatacatatatcaaggacgaattgtgtggatagtagagggaggatgagtggtggtgatggacagtagtaagaaacaggacgtcgatgagacggtggtgccgagagcaaaaatcaagtcttgatgttcgcagtgaagaaaagtattagacacaataagtaga

SEQ ID NO: 6202 - DNA, 1190 bp, Homo sapiens
  misc_feature (1)...(1190): n = A,T,C or G
gatgtgtgtgatcgatcgtctgtgcccgttaacatggttgtgacgatgttagtagttgcctacactgctaggacngcgttatcgtctccacacttccaagacgccgcgccctccgacgttgctgcgtccgcctgcgccactcgagcagacgacgcccgtgtgttttcgccgtctctctccacgctcctgcgcgtggagctgccccgcgcagctcgcntggaccgcgctaccgctcctgtccacgcgctcctcctcgacgcgtctgctcgtgtgtcggtcaccactgcgatctcacgcgttatcgagtgtcggantccttgtgcgtgtgtagccctgcttatgtcggaaccgctggatccactcagtcactcagccaacgcggcggttcttacgcgtcacgctaatgcttggtaactctacacttgatggagcgcctgcgttacggcccgccccgctggcaccggccgcgcccgcgcgccgcactgtgcacgctacaggtgcgagtgtaagcgatgccgaggattgtgtcacgtttgcattgaatggagccgtggagctcgcgccgtcanagttctggtgaccgcggcgctgcactgcgccggctcgctcgtgtctccgcggctcgcccgcaaccgtcaccgtcacggcatgttgccgggttgcactatgaccagcgctaaccgtacgctggtgtgctctgtgcacgctctaggcacactcagcagcggcgatcacggcgccgctgtgcatgttcctggactgctccacaactgtagtgtgcggtatcctagacgcgcgtctctcattacccaactacctacgcctccgtttcggtgccactccggccattcggctccgagccaccgtccacacgctcgcgtgcacaacacgtccggntctacgttcttcgcacacactattccgctctcgcgcgcacgctttgccgtctcacgcgtctagatgtgtccgctacctcgcggcgcgccgnagtccatgacactgctcgtcgggccgctctgtgcgctccctctacggtagacctaactcgcgacgagtctacggcgagcgtacacgagcgtgttccagtcgtgccggtcccggcggtacgacgcctcgcgcacccgggcggagcgcgcggctgccccaggcgccgccagctagcatggnagcccgccggcggacacataaag

SEQ ID NO: 6203 - DNA, 971 bp, Homo sapiens
  misc_feature (1)...(971): n = A,T,C or G
actatgtctagttgctggctttcgttatttcctctcatctatttccttcngctatggaatccgctacaccatctgtgtgcacactgatattggtatactcatcctcttcggttgccacttgtcgtgttttgctgatctcttgcactgtggtgccactcagcactctggtcactgggtactgtacttttgttagggctgtttgttatttttgcacctctctgccactaggtggcgtgactaatgtgtgaatataaaggtataacaatacaactaactggaaagtactccactcttccctcacgggtctaacaacacacccaccatcccaattgtgtgtggtgcccaccatcttggactgaacactggtggcacataaattatatatgataaagtcccaaaccggttgtatataaataatcggtacatattgttattcattcaccattgatttggcttccctgttactgcttggactccttcccccactcctgcccttgaccataaacccaaacggcacaggtcccttgagaccaccctactaggacccggcaaaaataaaggatcacgtgattggaagggaatgtaaaaaatggatggggtaatgggtaccacacggatgggtacaaaagtgtaacaccaacaagggggggaaaaaggaaaaaaaaaaacagaacatgataacaaactgggaaacaaaggaacggggggaaacagcaaaaaagaaacacacagaatgtggacagggaacgggaggaacaaccggagaatggaaagggaagggagacacagggacaaggggaaatggggaacagtatataattttaattaatgctttttgtctaatgggaaaaggggggggacaaaaaggggggtggaaactgcaccttttcaccttcggaacactcagggaaaaaaggaaaaaccaaaggcaatgaaccagggggggacaaaaaaggaacaggagtacaaac

SEQ ID NO: 6204 - DNA, 312 bp, Homo sapiens
attaacaaggtcaagccttgtggctgttgacagcaagcatgcctcctgacttgcctcctgtgacagagactgggctattcgaaacatatgcttcccttctgtcatattcagttatgttgcatgtgatgcctggaggtatgccagctattttgaaatcctgaagataaaagcaacaataaggaaagcagaacaggaaggttaacagagcctgggtttttgatcatgtcatttatccaccatactagccctgattggctcaacccctcaacttctcattgagaaataaacctattacttataaaaaaaaaaaaa

SEQ ID NO: 6205 - DNA, 779 bp, Homo sapiens
gtggtaacaaggaatgaaaagccagaatgaataaaggaagccttcattgttctgagtgagttccccagcctgagagattcacagagacctggcaaatgatattgctgaaccatgggcagtgaatgcagagaacagaaaagggcatacacctttggatctctgagccatcatgtaagaagttcagctaccctgaagccaccatgttggatttgccacttagagacagagatatttgaggaaccccaactgttctgggctccagctgtttgagtctttccagtccaggtacagatctgttagtcaggaggctttgggaatggcctcacctacagctgctgacttgaactatgttgaagaccctaactgaggaaccaccaaactaagctaagctaaccaccagacagggagagaacaaaacagatgattgttactgttctgcaccattaaactcgagatattttgttctgcagcaccaaattactcgcacagaaaaatgtcttattgtggtgactggggcattagaaaaataaaaaaatggtttaaatagtctaaaagttggaaccatgagaccattaacttaaagagggataaatactaatcctcattcactgctccattgcgctacgatattacactgtgaataaccgtcttggtgtgagtcaagggcgtaaatatagttatcgacatatcagtggtattaccccgcaaccaaccttgaatactaatcagacctcatatgcgcacaaactaataatcggcctgatataagccaatttacg

SEQ ID NO: 6206 - DNA, 931 bp, Homo sapiens
  misc_feature (1)...(931): n = A,T,C or G
ccccgcatgcgcctgccgggtcggcgtctatgcgtttttcgctgtgtttcgtatgggccgcttagctgcgngtgtgtcagttttactactcgtaggcgggtgagctttatttggcgttgtgctgttactgtcgttggggcgcgctgtgtgatgtctctgtttgtcgtgtgtcacgcgggcagattgttcgttggcgtttgcgctgtggcgcccgcgtcttgagtgcttcggctcattgaggtggttatattctggtattgccgtgaactggggagtgtgtatgcgctgggctgctgtcgttctgtgggcgttctttgctcgtgtgcgtgtaggcttgtgactagcgcgcctcgtcgctagctcggccgtgctcctgctcggcggtcgctcgggtgcgcgctggacctctgttcctagcccgtgtcgtgtgttggtggtgttggttgccctcgccgcgtgccttctgtgtttcttctctgctgaggtcgctgtctttgccctccctctttctctatcgctcctctcttttacgtttgttgtgtctgcttcttgctctgctcgttctgtgggcgtcgtcccttggtgatgtctcgggcgggcccctcgcgcctgggtccgagccgtcgtgtgcgcgatcccttgctggtcaccgactattttgctggctgtcgcttgccgttgtcttctttctcgcctcggctggggtggcggttgtcgcccccccgtggttaaaaaaaatctcgggtgggttcctcttgggcggggcgcccccgccatctccctcccccgcgtggcttcttgttgctggtgacttcttttgttctgtgtgctttattttgggcggcgttcttctccgtgttcgagaatagaacacaaccccccactcccctaaatagaaaaaaaatatactctaaaaaaaaaaaaaaaaaaa

SEQ ID NO: 6207 - DNA, 943 bp, Homo sapiens
cctcctttggcctcctttctctccctgcgcttgccccttgtacctccgggctctgtggtctttctttcgttctccgtccgccgccctttcctgccgtgggtgtggcgcgcgcggccttggccttctctccgtctgcttgcccgttgtttggtccgtcccgtgcgtgcgccgggcgccgcctctcgcctcttcggtcctgctttccttttggctcgcggcctctggccttgcgctcgcggcgcgcggtgctctctccgccgcccttgtcgttggcgcgggcgcccggttctgttctttcgtcctttccgcgcttcctccgggtttcgctcttccctttcgctcttctctgctgctcttctcttccccttcttgtgttctttcttcgttccgctgtttctctgttctgccggtccctggggcccctctctcttcttctggtcgtttggcctctgcggggtcgcgcttgccgtcgtgtggtcgcctgtcgctgtgcgcgggcttgtgtctccggcccttgccgggcccggggctgggtgtgggttccctttccctgctgtcggccgcggggctctctgcgcccggtttgtcggttcttgcgctggcccgggcctcttctgcgggtttccgtttcgtttctgtctctctcccagcaaaccgcttgttgtcgtgctcgcttggtgtggtgtgcccgctcttccttcctcctcccctccggtcgtgcctgttcccggcgtttgttccgtcgtttccctggtcgcgtgtgttgcccccgcgcgcctcccgtcttcgcctcctctctccgcggttttcctgtctctcccggcgctcgtcttcccccgcggctgttggcgtggcttcgcccgctaccgcggtggtgtcgtgcccccgcaggttttttcttttcttttctcgggccgggctgcggcgcgtgggccgctctcgt

SEQ ID NO: 6208 - DNA, 420 bp, Homo sapiens
ttaagaagtcataagcaaagacagagacgaagaaacctgaacctccaggctgcttctgttccaacaggccttgcctttcatagaagacatgattgctttaagagagtcccaaccagagaagaggacggtggaggagggaagaggggaaggtacaactcgaacagaggctttgattgtgaggctccagccagacccacgcttcctcctgccttcctgcctcaaccctccccggtggacccctcaccagatgaaggtctgttagctgagctgggggatgggggactcataggaacggggctgactttcaagcaaggccctgagtttggttttaaattatgctgcacttgttggcatgaactaaaattgcgggatgatgtgaatgagaaataaatctagtggaaacgcgtaaaaaaaaaaaaa

SEQ ID NO: 6209 - DNA, 285 bp, Homo sapiens
  misc_feature (1)...(285): n = A,T,C or G
cattgttgcatagctttcatgaaccaattgtggncctcataccaacagccagtgataaactgacttcctaagttaaacagcctgtgagaaactcggtgttgccaataaccgctttgtgagtttgaaagtggatctttctccaatcaagccttcagttgagaacacagcccctgggacaacactttgattggagccttgcaatagaccatgaatctgagactcctgtcccacagaaactgtgagataatgggatatgtatgtcttaagccaccaaaaaaaaaaaaa

SEQ ID NO: 6210 - DNA, 2031 bp, Homo sapiens
  misc_feature (1)...(2031): n = A,T,C or G
gcccggcgtcgatatcagcgcacgcgcgcgncacgcgatatgctgcattgtactgctactgctctatccgctcgntatgtactcccgccgctgcacgccgcccgcccngcgctgtgtgctaccgcacgatatcagtatcgtgcgtcagatcgccgcacgcgctagcgctcgtatcatccngtatcgncgncntcgctgacgcacacnacacaacncnacacatcgcccnacgcagtgctgcagagagtcagtagagtgacagtctgntgntgatctnacctataatacactcaanatagtactatctctagacgatacgtgcnctcagcgatnacgatctgatcaatcatagctcngacgtntgatcagctcgatgctaagcgctctgcgatcgcgntgcgcgtgcgtgagagtgatgtgttagaatcagcggcntgcgcagacatgncgttntantagtctgtcatcacgacacagcgatatnacagtngcagcanctgctcgtcacacgtctgctagttntatacactccgactgacatgcngctanccatacgacncgaccgcagtacctcgtagcgtcacacgatatagctgagacagtgtgatcgtcttcgtgagtncgacagctatagagttcagtgctgcagnangctacnagtatagcacgaccgagaccaggncatgcagcacgtgcatgctgcgnattcccgnngntacgcagttatatgttccagtccactgccggtatactgcgacagcaatagatcaatantactntatctncctncggacacgcnacaacancactcagtgcgacagcagagcgagcagagcgatcgatgactgcgtcatgtatacagaatnactncanagttctgntncngctcacgtatagctgntagatctacnanagtcgatatnagtcanctacgtgtgacangntcacaantcatgcgagcacgtgtctganactactactgaccaaggtcttatcgccacanatgaatncgatctgtgtgaccacactcatcgagnagtgctgctgctatacatacagacgatgacaacgtcaggcgcgctatgtgcgacacgctctgggntacacaggagcgatcgcgtcgcgncgtcataacagtaatantcgctacgtagccgcgcgcgtacncatagatgcaccacngntacacatnancagcactacgttcactctgtctcancagattacctnctgcacgatanatatgatatgcagacatgacacacgatantgtatctcctcgagacacnagcagntgntcatttagatcacaccnagcactgatcactatagtnactngcgcacatacgtcatatcgatgctcgatagcagtancagnactcgcgatcgacagcactgacgcgactatcatgagtatatggcgtgtgatcggtctgtgcagctcgtcacagctcgacgagtcgtgtaatatcgtccgacgcatatctcctatcattagtagcagcgcgatgagcgcatggacgtgacatgcgcataacagttacatntaccacgactcganactacgacaatgntcacgacgactatccggtcactctancagncgagcatcagctgcgactcatncacacatcgcatatcanangacatngtcgtcgacgntcgtcgcgacntacccncgtagaccactctgcatatcgctcactccangaagacancacagancntacatcgagacgtccancngtctagcnactagtgtgtagnatagtaccacttagctattcntgctacctagcacagacacagctatatgaactagtatgaacgctnagtctagacgntgatantgtctcgacctcacatactacatgatgngatctgtcattgtacgcactgantactgntcgacaggtctgcctgacgancgcagacaggntcagcgagacgtactatctantaccacgantcgattgcactcgcgncncgtcgagtcatctcacttatgatcgaatcgtantgacgcactcg

SEQ ID NO: 6211 - DNA, 1371 bp, Homo sapiens
  misc_feature (1)...(1371): n = A,T,C or G
cttcttactcctactattctctcagccaatttctcctcctccgcgcntattctcctgctcgcgtctacacgcacgccctcgctcctagtacatctttctgcgctcactcctccctagttcgcgctgatgctactccttgnctgttgcacgcggaggtgcctcanctcgctggcgtgagcgagtgcgccgtgtctcgtgtcctgcgcgctgcccgacgcctgatcgcctcgtcgctcgtctctccccgctctcgtgctgcgcgcaccgtgagtcctccgtcctctntctcccctcccgcgcttctgtctgccgggttggcgtcttgctcgctgcttgcgtcccgtccgcgcgtgctctgtgggtccgtcgcgcggagctgtcccctcggttactgcttcttgtttccaccctccttttatttttctcgctcggcgcgtcggagctgcctgcacgattgaacttccgtctgcccaccttgtcctcgccctcccgccctccccgtccgcccgccctctccttttctaccctgttgtcggcttgctcccctctctacttcgtctcacgcctcctcccaccccgcctttgttctggttctgtgttgcgctcatcctctgctgccgctcatgtctgttcgcggcgcgtctcgtgtgtgggcgtctgttaccgcgcgcctacgggtcacgcgactctcctggtctttccccgcgcgcccgtggctgttcgtgtgcgctgtcctctcccgttcggcgcggggttgcncgcgtgtcggtcgtgcctctccccccgcctcgcgctcctcgcttttcctcgcggcctgtgctcatctctgctcatccaccctcgccgcctgtctacgccctctgctccgtgcttctgccgcccgcgcacctgctcttgccgtctcgcgctgtctgactcggtcacgtctgccctgctccagagaagacagcgcntctgttatcctgcctcgcagcttcttgttctaccctgcgctgcgtaccctctcaccgtgcttcgctcggcgtgtttctctgttgcgtcgtgagtactgctctgcgcgcgacgctcgtgcccggtgcttacctcttctcccttctctctcggcgcgtctcgcgcgcgcatgtcgcgctcgcaacgctcggtccactatctctcttgcggcgcggggggcggccgctcccacatctctcgtcccctttagactccccgttgtgttctgcgctngcccgcgtcgcctctgtctccctcggggtttcttccgcccgtgntgaggggttcnngtgtgctgtgggtcnccacaacancgcagcggtctcgttgctcctctgtatcgtntctcccgtcgcgctgctctgttcctcgtctgcctgc

SEQ ID NO: 6212 - DNA, 1663 bp, Homo sapiens
  misc_feature (1)...(1663): n = A,T,C or G
ccaggctggtctgacgacacgcgacctaacagggacaacggccgcacgatgcgacgnctcactcgtacgactacctcgtcacactcatcgcgacncggccacactcgctcgtcctacacaacgactacgttcatggcgctctangacaactcacccgtctcttagtctctctacactttccatcagccgcacctaatagcactgtcatcagcctcgcctcatgaccagcacgccccctcgacgtgtgacacacatcgtaccgtgatgtgcgcgaccccnncacgagcacgctactcactcncacacctccgtatgtatcatcatacgtctcgtgcntgcagatcgcagcagttagttgccgcggtgcatccatgacantgcgttaacaacatgcagatcatctagatacgaggnccgagtccatcgacgccgccacacgacgtcncancatgctacgcgtagacgtacgcgcggttatatctctctagtagtcttctacgtgcgtatagtgaagccatncacaacgctcatgcgctcacgaaatgatatctccgtgattctatatccatcctctcctacatcaaccgagcgtnncgacatgatcgactgtaatagtattataacatacagagatcaccatcgaganctcagacagagtancgcccgttcgaagcgctcttgatactgtatcgactgacaacacacgaccgcacctgcacacatagcatagagagtgagagagcagcagagcnnnaacaactaatataacaccacgcatcatataganagaacnnnncacgccagtgcgactacgcacacncagcgatccctaccgccctcacgacgccccactcgctgcatctcctctacgactcctcatcgttccttcacgcgctctcgcactcgaccgacaccgcctgctgactcatagcctacaaatagctcgggatatcacatacccatgcacctggtacgtctgccgatgcntgaagtcacgtgatacgcaacggcatctcacctgcaaggctaccacactccaccgctccgacgcgcggtacgttgtcgcgtcgtgactcacncaacatatcaccagatgaanagagtgtngagntgatcgcatgtataaacgcctctacagactcgaggntncaaccgactacaacgcacacgcgctgctnctcagtactcgacactgctacaacgcgagacgcagcgccgcantctcaccgtgaccgacgaacgcgtgtagcagatgagtgagcncatagctctaccctcgatccacgtactcacctcnnntctagatcccctacactcggcgacacgacagcntactcagagcagctcaccctcnacgtcgtaatagtcatgtacgccntctgcgctgcgctcatctcgaggacacctctccatgcgagagtaaggagctggnnntnattcgatagcgcagtnnantgaacagacgacggcgcncangacgtcagtcgacgagcacatgagcgcgcacatntcgtcgagcagcactacatgatcgctatctagcgagatatatacgatcgagangctatacgtctgagagtcagtcatntactgactcacgacggnaggcgacgacatggtggctgttcagcagacgtacacagagcgaactatgtcgacgtaa

SEQ ID NO: 6213 - DNA, 275 bp, Homo sapiens
  misc_feature (1)...(275): n = A,T,C or G
caggcggggacgtccgcacacccaccgaagcaaccgccacgccccacagnccccccgcngcctcaggcccgcnaccgcaccccccccatctaacgcacacggtacgaggcagaccgtttaccatcncacgtcatagaccaagatcctgccgaccgccagactgacaacgacgaccggacgaccgaccnctcccacacgcaccagacgacccacacacgaacgcccgccggacacgagacagcgcgctagcacagaggcgcgancacnaagagact

SEQ ID NO: 6214 - DNA, 803 bp, Homo sapiens
cttgtgtgtgacactttgatgggactaaggtgaagcaaactgtggtaaacaggaatgaaaagccagaatgaataataggaagccttgattggtctgaggatgggatctccttatgttgctcaggctggtttcagactcctggcttcaagcaatcctcctgcctcagcctcccaaagtgctgagattacaggtgtgaaccaccatacccggccaacatatccttttaaaaaagggattgcaccatgggtacaagtttataattgatttttttacataacctattctgtttttgagtggttttaacagaaagtgtgtccttatactgagttcaattttgcctctttgtaatttccaatcattggctttaattttgcctctagcactacaaaacccatttgttttgccacaaaagtcttcaaatatgagtgtgaagttaccatgtaattcctattcaagataaatatatacagatcttttaaaatttcctcctgtacagcttttagaacattcaccattggatgggggtgtttctgacaacattcttagtgggtctaaaagggggggcccagggctattttaagatgagaacttggggaaaatcccattcctgggcctcaccccggattactgaatcagaaactggaggggcccacaatttgcaattagccaggcttctggttgagtattggaggaaaccgagaaccaggaccggttgagtgattccttttttggggagtagttggagatttcaccccgatagaagcccatctgtgtggaggggattagagaatcggcgtgctttt

SEQ ID NO: 6215 - DNA, 1201 bp, Homo sapiens
  misc_feature (1)...(1201): n = A,T,C or G
attactncataaattactcgtcatacttattactctatgcatatacttatattctactaagaccacgtcgncactaacttcaacagtgccgacgtcaccgcgacataattatatatatataatttataaacaaatacattgattgacacaaaactaaatagtcgtacaacgactactctttgacattcatccatcgtctgcgtgagaactgcgtatacactctgtcagatcgttgcaatacgnctactactttctatcgaccgcatacattaagtgacaatctgagattatactttacccacctaccaataagattatganatataaagctagctatctatagttgaaccctacaaggagggaatgtagatttcaccctgaataatataagcggtgggcgcaggagcgtaacaacagatagaaaaacatatctcatatcgtaagacctcacgagaggacaataactctcacatgctaaatactatacctagtacgtctcagctactatatacacgccaacactcaaaacacagacatactacagtattatatnagacatcaacataacacaatatacgcaaaattatatatatacagatcaacgatagaaaataaacaaacttctacgtatagataatgtgtttgagcgcgacgacaggtgatcatccaccnctgtatatactgtagcgcgctcttgtgtagtcggatcgatcaattaatatcttcgaaacacactaaatgatgatacacaccataaacaacaaataatatttaagacgcgacacggaggcgacgacgatatctgtaaaactcatttagcgcactactatccgttgctctgtctcgcgagcgcgcagcgcacaaaaaaaaaccccgaataactccacagacaaatagtaatagcgatagaaataccactctacagacaggatagcagaaagagacgcactagctattcatcaataaangcatcatactcactatacaattagcagacgagagcaaagatcccgtgtgctacncgcgcccttgtgctaatcatcttctcgcccgcgcggcacactatcatccctcctctcgcgtcttctccctttcgctcgccgtgnctctctctctgttttccccccnctaaagtcccccccccctgtcnacaaattaggtcctctccccctcctcctcatgataccacgcacagaaaaca

SEQ ID NO: 6216 - DNA, 1513 bp, Homo sapiens
  misc_feature (1)...(1513): n = A,T,C or G
ccacacagcctcgccgccgctccggatttgtattattntcgtccagacgtaaatgcagaatttcgcgcgctccgctttctatccgtaatattcttatctatgcacccagtcatatagattacagagagtacaacgcgcgcgcgcactnacacaccgccagagtcggcgtcgtgctngtgcgtgtgcgtgtctatactacatcataattacaatcccngtaacactctgtagatgagtcgtcgctnaggtcgcnacgacgacgctagtacggccatcgaccgncgttagtgacatctatctcgacggctcancgacagcatactgtagctatcattgtaccgtaccgcgtgtgctgttntactgctatcgacagantcatacgtgacgtacgcgtagatgcaacgtgtgcagtgagatanangtgaagatgcgangcatgcgtgtatgatcggcacgggcagtgtacacgcgatgatgcgatgcgctattcgaggtgcatgcatgatagagatgtgatgcgtatatatcgcgacgcgttggcgcgcgcngatgctctatatgagagaacgtcgcgacagtaaacncttagcgcaggtagctaatcacttnagaaggagttgagnataanacgcgggtcacatcgcgcagtcgtgtggaggtaagttgttcggatgcgccgtncagaacgccgcggtatatctcgtnttatgcagtgtctgagatgtatacgcgtgtgctggcgctgacgacatcttcttaataatatcacaacttatctggttgcgctgtcgtctatgacanagacggatgtgaacacaacgagcatatcgtagatgcagacgtgttgcgctcgcctattatacgtctgcatacaatagctaacgttactatcgtacatgatcagagattccttctagcgccagaggagcactgctataaaccgcancccacatttgtgttcttactcacacagagtacatcacactaatacactaacggcgtgatcgttcgtactagaggccagttctgcattatgatgactcttcgctagtgtcagcacgacacatcgcagttatgcccgctctgtctgtatcatcgacgcggcgctcagcgaaattacggcataatatctctactcaatatataatgttagcagagtttaatgctagttcctagcgacgagtcagccaagattagaaataggagtagcggcggaggcgcgagatcacgactacgagattacataagtagtgagatcacgactatacgcaccgccagacagcgacgatcacgatatcgcatctncaacgtatttctaacgcagcacgacgacatatgtctgtttgctacaaccacatcgatagcatagatgttatgcatacacgatctgagtctgactacgatactatacgatagatgacggcgcgatgtcacgatactcctaagcagtgagaggtgtatagctaacagctctctgcgtagcagcgcctactgaatgtcctatatctagtac

SEQ ID NO: 6217 - DNA, 466 bp, Homo sapiens
aattccataaaaagttggtagaagtttctgtcattcccaataatttttatttttttttagcaattagctcgttttctattattccagttttcagccggccactgtggttcacgctggtatcccagccctttggagccaagggcatcggatcacgaggtaagcagattgagaccatcctggctaacatggtgaacccccgtctttatgaaaaaatccaaaaaattagccaagcatggtggtgggtgcctctagtcccagctactcggaaggcttaggcaggagaatgtgagaacccatgaggcagagattgcagtgagccaagatcatgcacctacactccagcctgggtgacagggccagacttcgctgcctgtgcagttcttttcaccttcatatctgagggttccatcacgatccttttgcatagtttgtcttgccacctgccgggtccatcccatggacactg

SEQ ID NO: 6218 - DNA, 887 bp, Homo sapiens
  misc_feature (1)...(887): n = A,T,C or G
gagggacggctagcgcaacaaaaaaagagaagagaagnnntaccagcagggcacacaagagcacgcctcnctgggtagaacaggagccgcagtgaaatgcttaaatatacatcatatttcagaaccaagaagctacgcagagagaataaagaatcctgcattgatcttaatatgcgtgaagcccacccataatgagcaggaatttataaaaactaaacaacagggcatgcgcaacacacacacaacactggccaggaagagccagagacaagtgtatattttatagggggggaccatggccttgcacaataagacgatgtaccttaggagctgaagacagcccaaaccagtgaggagatctttaataacctgacctttgtcctgcaaaccagaatgaactgattgacacaaaaacgaatcttcagaaaaaatgtaaaagtcactaagagaaaaaaacggattaactgtctaaatgggaccctcagtaaagagccattataggccgactcctctcaagggataactgaagaccctgaagaacaagaaacagaagtggatgcgtgaaaaacaaaggatgtaggaaaagagggctcgaagatacaaataaaagcagctaatggaaggaggattagaaanaaatcataaatggcgtcgggagaaaagagagaagacgaagacgacagagataccgaaaaaccggtagagcagagcattgaatcggcaggcattggaagaatataacactgccagaagaagaaacgaagtaaattagtaagcagatggtgaagagggagaaaccgggcagagcagatacggcgaacatacctgtagacaaggaagtgagagaggcgccaggaaagagaggagaggaggtgaacgcgatgaag

SEQ ID NO: 6219 - DNA, 946 bp, Homo sapiens; identical to SEQ ID NO: 5980
  misc_feature (1)...(946): n = A,T,C or G

SEQ ID NO: 6220 - DNA, 802 bp, Homo sapiens
  misc_feature (1)...(802): n = A,T,C or G
catgtgtttatctaagtgtcaccccctttaaagctgaaaaatacacaggaacatcatcaacggtgcttagtacttctcatgtggccccatgatcatcatgtttgagatacttctgcaagaagctccaaacagtgaactactgagagaacacttgtgggaatatttgcagagacaaacaaatgtcatcttaaaataccagctactgtaacttacccacaacaagtaggcttcttggtctgtattaaccctgtaggtactattgttgaaataggcatctcccctactcaggaatgtgggcaaatctgatcatgcctctttaaggttctaatttgacagaagcacgtgaataagcaatcatttagaagagtatatgcctccaaatcagagcaattcaaataagagcagggaaagctatttcatttcactgctcattngccaagtatccaaagaaaacacttccttaaagtgtcacacgcattagaacacaaaggagaaaaacaggcagagattggatgctgccactgtacctgggaccctgttatccaccattaatctctgaaagtctgaccacaaacaaacctgagggatgaagctggggaattgccttttcaattatcaaagagctctctaatgcgtaacaacatgcaaaaatggtgcttaccctgaacctgcccacctaggaccactgcagagaatggacccttatgccttactgatataaacctcaggactgaccatgtgctttctaaagctggattgggaaagatgacgcgaccaaggagacaaaaccaggacgccatat

SEQ ID NO: 6221 - DNA, 929 bp, Homo sapiens
agacgatagaggagtaccagtaagagggagggggggggagaaggcttgtgggggaaaaggaaccaacatcctacagcggcagaacatatatcacaattctcttgcagcggacccagccattcattactacagggtgtgccagtgctagaccaatactgctgaagggtgggtgcccggggctccatgtaccattgaaccactgactacggccatgggcggttggacttatcatccatcagaacccggattcattggtgatctaccgattgctttgtacagatctttttatatagacgagcgtcgcagtcattagattatttatcagctgactgcactgtgtgatcagatccttaagttgatgcatgattaatgtctgtgttcacaacactttgaattgcgtgtgataatagagtattaaaagaaagtaatgttacagtatatataaattaatcaacacaatagcagaaacaaggagaacatggggagactcaatacttaggccttgcttcactagtagaaatatgaggggattattcacggctcgatggggccagaccacgccaatcttgtctcttacttacggactcgtgcctctgcctaaaatgtaaatgagatcgagctccatcgtgtcggcacaataagacgataactccaacgtaatgatgggagtaacatcaactcagtcataatgagatcaaaaccgactatcattcatatagttcgcgaatacgagccgtcgtgatcactagaaccatccgcagccctactggctagttgtccgtcgagaggtgtcaactctatgggatataagccgccccactcttgtcactcgacgtcagtcgcggcgcctgccgacggaacgcggacattacacatccatagaatgaatataccagacgagctccggcgtgcgtccgcctcgcaagagg

SEQ ID NO: 6222 - DNA, 1091 bp, Homo sapiens; identical to SEQ ID NO: 5990
  misc_feature (1)...(1091): n = A,T,C or G

SEQ ID NO: 6223 - DNA, 700 bp, Homo sapiens
ggagaactgtaggggacggggagacacgcattgtttatccgatcccaattgaaaatcaaaccggggcatggttagaattgtggcaccggtcgaaaaaaggccctttccaaaggtctgagcccccagcgaccaaggggaaagggtaacccctcccccgcacacaaacaaaacccccggggccgctcggaaaaggtgtttttacccttagtgagatctttacaaagtgttttaaagaggtattggcccctttggccatttcccccaccagggaagaggaatttagttcctccctttcttctaccggatttggcagcgtccctaaaaaaaaattagttccttcaatagcccttttggagggtctaggtctgggaataatcttcaccccccggataaccagggagggccggcatccttttaaggggttaaacgtagaatggggatctcctctgggaaagggatggggaaaataattggccaaaaattttgaggggggatttcttgtcttattaataatgcattgtctgaaattttaagatttattctggattccagttttctttttgatagggttcctgcaaaaattttctggtaaaggggggcgtgtcttttcattttcccaaccacatttttgaaaggatttattcccccctttaaaattttgattaagacaattttgatttaaaccccttttaaagttggg

SEQ ID NO: 6224 - DNA, 748 bp, Homo sapiens
  misc_feature (1)...(748): n = A,T,C or G
gtggcctcctacggggcactgcgtataggacgtggctgattactaattcgatntcctgtgtactgtgcgcatgatgagtctgggcggcctggttagtcttccatccggctctcctgctggccgcggcgtngngttcctcggcgcctggcgtcgtgtgngaccggctcgaggcgggggttatgnggggttgtttgctgcgtgctctgtgggcgatgccgcgggggcgcgggtgggggcgtgtcgagcggcgaagaccctggcggtggcggttactgcgcgggagacacccccgtgttcgcgctgcggtaccgcggcacgggcattagtcatggcgccgtggtacgtgtgcgtaggtgtgngcattcccttganatcggggactttttgttcaacttatggcgtttggaccctgctggcttttnnntttggggtgtctgtgcggtgaaaggtgggnngtggatngtgaggctgcgggaggtgggcgtgaggggggtgctgtcgtngtagtcttnaaccgcgtctcttctttcttgggcgcctaaaggagtcgttaggcctcgttaggacctcgtggtcggcgtgttttggtggggggcttgcggggggggcgggngnggccgccttttttttgatcctgctgtggtaggtanatctcctttctctgtgnagccacacaaggcgtggcttgactaggggaacnnatacactggcaagaataagacaaaggccacaaaagtgacaggaatag

SEQ ID NO: 6225 - DNA, 523 bp, Homo sapiens
cattggaactacagacaagtaccttattgctacaagctttaaagtattagcttatgaaagcgccaaccatgcttccaaatttcaaaacaaaataaccttcgctaagtcaggaagatcacttgaggatgggaattcaccaccagcctgggcaacatagcaagaccccatctcttcaaaataaaaataaaaatagccaggtgtggtggcgcatacctgtagtcccagtttcttgggaggctaaagggggagaatcacttgagcccaggagttcgaggctgcagtgagctatgatcacaccagtgaactccaacaaggatgacaaagtgaaaccctgactcaaaaaaagaaagaaagaaagaaaaaagaaacttggctgaaccatgaggagttaacacttggacattttttgattctgcaactgtaaaagaatcttgctgaatttgttgaacttgtgtctctaacagattactgacatttccttaatgtaagatcacctggggattaaatctcaactgtagcgcag

SEQ ID NO: 6226 - DNA, 1701 bp, Homo sapiens
  misc_feature (1)...(1701): n = A,T,C or G
cttatagtagccacaatatatctctagccacatagacacgttctgcgacgacgcgcactctctgtatatgtatgcctgatgctcatcatcacacactgctaaatatatctaatatgactacgcgncatatcacagacagtctgatgaggagagctagtgtcgaagaggaaatctacaaccnaatgctcgtaccgtgatctcgtgctagtnangaactcgcagaagacacacgagtgagcaggngacacatcgagttatatacgtctgagatagactatacgacgctatgacagctatcctactgtcacatnacgtgangcaacgctcgctgtgagcacgtgcnatacatncactcgacatctacaccatactagctctaaacgcatcatatattgaacgatgctatcacactgcgtntctngaganaagtataatcaacaacagagtatctatatatatcactcacntgtgacangctatcgctcacgaccacaatgtactacgtcattagtagagtactgcacactcgctctattacgatatatatatttctggcgctgtccgcgcacacgtcacgctatcgacatatccacagtatatacaatgacaattgtcttggcgcgcgttgcgtctctgatgtcgccgcgcgtgcgctgtgctgcgcggcgctctcgcgcgcgcgcgcctcatgtgctgtccgtcgtgtgtgtgntctctcctgtcctgctgcctctgcgtcgntcgctgncttctctntgttcgctgacgtttctgcgcgtgttacgctgtgctcctcgtnttgcgttgctgctgcgcgctcctcctcgctnctggcgtgttgtgttctctgctcttntgtctgtggtttgtgctnttgtgtcgtggcgcgcngtcgtctctcgtcgctctgcccgtgctccgtctgcgtcccgtcgccgctcccgcgcgttgtgctcgttcggctccgttgcttcatccgcctgatggctcctgtgtgtgcgcggcgtgtgcggtgtttgctgttcccgcgcctctttctgcgtnccgctccgtcgngcggtcgcgcgtcgctcgtctcctcgcttctgctccctctcgccgctctgttctgcgctncgttcgctcgttcgngtcgtccgccgtcgctcgtcttctgtcgtctctcctgcctcgtctcgttcgtcctgctctgtgtgtgcttctgngtcaangatgcgaggcaagagagtcggtctgtctttggcgtncgcctcccgctctgtgtctccggcctcgccgctgctgctgctcctgcggtgctctccgtttcggctgtctttctgtctgccttcgtgttcgtgcttcgcgnccctcgctcggcgcttggtctgcgtcttgtgtgctgcgcccttctccggccgctntgcgttgcgcggtgtgnnctgctgttggtcgctgnntcgcgttctctcttctcgttcctcgtttgtccgtgtctggtggtgtgcgtcggtgctcccgtcctctcttctctttaaaacgtctccttcttgtctccttctctcctctctcctcttctgtcgcctgnctcnntgntncttncngcnnccncnggacgnnncnccggngggcgggcnngtcncnaacanaacncaagcnncntgtgtttgttnttgtgtctttctcttcgtaagataatagtagtgtatcaaacagacactc

SEQ ID NO: 6227 - DNA, 736 bp, Homo sapiens
ccggctttacccttaatcttccggctgtcattttgccgaattgaaggggataaaatttcccccagcaccagtgtttgccatgattccccaagcggcccaattaccttctccaaagggaacaaaaagtgcagttctacaaagtaacgccgccaaaggcttttatttcctttgcatatatcccccaaagtagcaattcccgatccaaatggaagtcctatattaactctttgaaggaggcttcatccaggtttcccataatgcctgtcctaattccatttccaccaccaggtgcacaagtgttctctttcctttcatcctatccaacgcttctttcttatgtctttttgacaacagctattctaatacatgtgaggtgatattgtggttatgatctgcatttccctgatgattagtgatgttgagcattttttatctacatgtgagccattggcatgtcttctcttgagaaatgtctattccaatccttcgccaatattttaatagggctatgtgttatattgatagttagttgtttgggttccacatatatcttggaccgctagctcttatcatatgtatggttgtcaaatactttctcctattccatgggtagccttttcactgtgttgtttccttcgcatcctggtagcattttagtttaatgtagtcccacctgtccagttctcacttttcttgtttgagctttagatgtcatatccaagcaattattgtctag

SEQ ID NO: 6228 - DNA, 1213 bp, Homo sapiens
  misc_feature (1)...(1213): n = A,T,C or G
ctttcctctcctcgccggtccccccggtcgctgccgccctctcccctcctcttctctctcgcccctctcctctccttcctccctctcccnttctcggcctctgtcccgtgtcgtctcgcccttcctctgtctccctgcttctgcctctgctccctgtcccgttcctttctcatccttgtgtgtctctgcgctgtttctccgcggcgttccgctctttctccgtttcgtctccttgtgtccttccctctccgttccccgttgtccttggttctgcgcggtgtcgttcgggtgacctggtttttcgtccgttgccccccccgccgtgtggtttcttcgctcccgctctctcttgcgtcgcgcgcggcctctttcctctttctctttttctgcgccctctctctcgctctccctcctccgcgtcctgtcctcccttcgctcctcgttggccgctcgccccttctttgtttcctctctcgcgctcctgctctgcgcccctggctggcggtgctgcctcctctccgctctccggtcgcttcgtcgctgttcttctttcttcgctcttccccgccctcttccctcctctcgctgccctcgctcctccgtccttcctgctccttctcctcctcctttgccgctttcgggcgcgcgttctttctctacccccccctgctcccgtctccctgctcgctgcacgctctcgcttcgttcctcccctcccccgctcctcgtttcttggccgctctgtcggccgtccttctcgcgcgccctctgccggcgtctctctctccacgcctctctctcttgcttgctctctngcttccgcgcggttgcctgccttcttgcggtgtgctcctctgttgtgcccgctccgccctgctgccctcgcgcggtggctctgcccggcgtgcgcgcgcttctcggctgggtctcctctctgctgtgcgntcgtgcggtcgtctcttgtnttgtgtctcgcctctcgttcccgcgtctttcttttctctctttcgtcttgcggtgggccggtctgtccttctttgtgtcttgcgtttccgctcgctgtgctctctcttcgctctcgcgctttcttccctttccgggtttgtttttccctttcaaagccttttttcttttcttnggtctctccccaccgagggctttgccgctggtcctgtgtgcctctcgccgcgcgcgtgtgtgtccgccggctctc

SEQ ID NO: 6229 - DNA, 1046 bp, Homo sapiens
  misc_feature (1)...(1046): n = A,T,C or G
accggcgaagagacacaaccgcaaagacaacccccccccaccaacaacaacagagacaacgagggaccagacgctcacggggaggacagggggggggagggcttaggggggggcaaaacgaaccgacagacaagaagaaaaagaaagaaaacagcgcccccgttaccaagcggccagagagaagaggaaaagcgaaaaacagacgccaccgcccgagcgcccccgcggcgaccagacggacaaacgcgcagcgggggaccgaaaangcacagagaggcacgaagagaggaggggggggggaaaaaagcgcgagaacaaaacaaacgagcgggcaaaccggaccgccccaacacacgcggaaccagaacaagagaagcgacgaacgcacaaagcgcggcgcgacgcgcgcagacaaacacggccagacggcggacgaagagggggaccggcccacaaaaaaaaacaacccgcccccgccccgggaagcgcaccgcggcgcagacaacaaaagacaggaaaaggcgcgccaggagacaaagaaacggcgggcgcgcaaaaaaacacgcaggagcggcaacgaaaaaagaaaacaaaaaagccgcgccccgagcagccaagaacgccgcaacaaaccagacacgggcccgccgcaccgccggcaaaaacccgccgaagaagagaacgcaaacacccgaccacggagaccggagcgaaacgagagaaaaaacccgaccacgaaaaggacggccggagaaacagaccggaacgaagccgcaacgaaaacagagaacagcccggaaaaagcccgcgaagaaccccggagaaagaaaaacaaaaagcccgaaaacaagaaaagcgcccgccgagaaaaaaaaaacgcgggagagacgaaccaacgccgcagcggagagcagaaaaagagaaacgcaccgaaaatcgccgccaggaaacaggggcaaacaggcgcaccggggaagcggcgccacaagggcggcgcgggcggggaagaaaggcgccgacggcggcgcggcgtacaggaagccggg

SEQ ID NO: 6230 - DNA, 369 bp, Homo sapiens
catcacttcatacagctcataagctactagagtgaatgaagagccaggcccagcaacagaggggagcctgctccacatggtagcataaggatccgcgtaaccaaattcacccaccgcgcgatcccggtgacagatgcatgtggcacgcatgctgcggcactctggggaagggagaaggaatgagggtgagaggggcacataaggcctccagggatacagccctattgagcctcttctactgggaggctgtcacctgcatgcaaactttgagatattcactgaaccacgttttcttacatgtgtccttaaaaacagttattaaaagctccaaaaaaaacaaaaaaatatggcctgggtggcctcatgagc

SEQ ID NO: 6231 - DNA, 1383 bp, Homo sapiens; identical to SEQ ID NO: 5998
  misc_feature (1)...(1383): n = A,T,C or G

SEQ ID NO: 6232 - DNA, 862 bp, Homo sapiens
  misc_feature (1)...(862): n = A,T,C or G
cagagggaaaattgcaacccttgcctacaaccagactgacagcataatttcttaggaatcaagaatcaatacagggttatttctttagattaaaccttaaaagcccccttggaggctgaagaagcagaggatagccatgcatacacttgaacgtgaaaaatggtcctctttcattggagaggtcttcctcttcagctaaaccgacagagtggtgaaaagaagaagggaccccttgttgaccaaaaggatccagacaaatcaaatcggccctttccagcaaggagtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgtcgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacanattgaaattaatttcagaggtaaaggtcagaatattaccatggtatgtgatttatggttggatggatatgaatatatcaagaagattatatgaatatacatttttgtggttagaagtgaggaccattaactttggtagggtttgaataaattattttgagtttgggaaaaaaaaaatggcctcgtgggctacgggtggactctggggcgttcctt

SEQ ID NO: 6233 - DNA, 189 bp, Homo sapiens
  misc_feature (1)...(189): n = A,T,C or G
aagggcagaagaggacaagcatcncgtcggccaaaccncctctctttaagctgcactgactctctccattagcgcccggtgcagatgcgctgactgcccggcgggtagatagctacgatccgggagggcggacgatgtggatccagtgctggaaggatatcnggagagcctcacgaggggggtggaggc

SEQ ID NO: 6234 - DNA, 373 bp, Homo sapiens
atttgtgttgacactttgatgggaaataggtgaagcaaaatgtggtaaacaggaatgaaaagccagaatgaataaaggaagccttgattgttctgagtgagttccccagcctgagagattcacagagacctggcaaatgatattgctgaaccatgggcagtgaatgcagagaacagaaaagggatgggatctccttatgttgctcaggctggtttcagactcctggcttcaagtaatcctcctgcctcagcctcccaaagtgctgagattacaggtgtgaaccaccatacccggccaacaatatccttttaaaaaagggattgcaccataaatacaagtttataattgatttttttacataaaaaaaaaaaaa

SEQ ID NO: 6235 - DNA, 825 bp, Homo sapiens
  misc_feature (1)...(825): n = A,T,C or G
ctgggattgcaaatttttatcctgttacactgttggaacaaaagtcttccagagtgaagcttccaaagtgttgatgttgctatcggctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacagtgcgggaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagttttttctatttttcaatagatttgtacttgaataaggggaagaatttgacacaacatacaagagtaccattggtccttatatgcgtaaatatttagggacacactgtgacaaaaatgtagaacctataacaaattcttttacaagttactataaagggacacagagagaaaactgtacctttccaaaaaaaaatgacttcctgatgaacagcggggtggggatttagtttggatggattagaactttaatccctccgaaataaaaaaaaaaaatttggccctctgttgcgcccgagcggaggaacttatgatccacctnttcttttagggagggtgtatataatggccctcgcccattaactggtggcgcaggagaatacagaaaggaga

SEQ ID NO: 6236 - DNA, 966 bp, Homo sapiens
  misc_feature (1)...(966): n = A,T,C or G
agggggggtanngaataagatttattattagaaatatgatttagatatagatagaaaaaaaaagttataaagagacaaaaaagaaaatttgaaaaaaaacacanacgcagagtaaataaggaagggatagttggcagaggaggtgcggagtggggggaggatgtggaggttctcttatttttttctgctgaatccacagaggcgacaacgtgctcgcccgcgtgtgtgaggtgctcttctccattgtgcctctctctcaatcttgtctatattcacttcgctgttcttttttccgtctattctttttattctttcgttattctttttaactcactttcggggtctgtgtgcagtgactacacgcagcgccgcccgcgttaactacgctctatttttgttttatctggtcagccttccgatcacacggcgctctccgctgtgttccgcccatgtgcggtgttcccccatcattcttatcttatcctatctgctccctcaacctaattatacgtttttgtttggttcttattctttttttttttttttatatattttttgttcatggttgtgcctggtgtcggtttggtttctctccttttctcgcattcttttttttatttgtttgttatttattttgttatttttagggttttaagtatagttcagcttgtgattcttttgttgttttgtttgaagttttgttctnagtaattttctgccccaagtgtctctttccgatcgtgtatgtctctgttgttttcattaccccccgtcatacataactactctaacattgatcggtaatgattggtgacgcgtgacctgtcatttatcgacacgagccatttaatacctaatgcagctggccgccttatttcctattttcttgtagtattgactctttctataagttattgtaggaaagctgcactttactttgaggtactagtctgcgctcctccgggc

SEQ ID NO: 6237 - DNA, 1148 bp, Homo sapiens
  misc_feature (1)...(1148): n = A,T,C or G
cgtgatatgtatgggtgtagatatgtggaagagaatgggaaagaggtagggagggaaagagttgagaagagggtaaagagaggggatgagcgagggggaagagggtaagagtgatagattggttatgggggggaataaaggtagggagagggaggaggtgaggaggagatggaagaatggagtggagagtagaggagtggagagggagaagaggtatgatgtagggggtggaggggagagaggaagagggaggggaggggagagggtggaggggtgagggggatgaagggaatagaaaatgaataattgaagatatgagagtagtgagttatgtaagatgttctataattagtatatatttgagattaggaaagtagagaggatgaggagcggggagaggaagagagggaaggtagaggaagagcgttagggaggataatttaggagtgtgagtgggtaaagagggaccgataggaggttgattggcaaagagatgagtgtatataggtgaataggcgagataaggagtaaggagaggattagacggatgggatgagagagaaggtagtagaggaactattgaagttgtggagagttatgagaaaganaggaagggaggaagagagttgagagggaagtgaattgaagtaagaaagagagatgagagaagagagaggaggagagagatgataagagaaaaggagataggtgtatgaggagaaggtgtagtgaggagatgaaggtttgatgagggaggtgagggagtgtgaggaggaaggtaggatgaggaggaatgcgtagaagtaacaacatagagtggagaggtgaaagagttgagagaagagaatagatagagaggaagaataagataggtgagagagaagaaagaaaaaagagagaaagagatggtgatgatggagagggagaaggggagtaggagctgtagttgtctagtgagatagaaaagaaagtgcgaggggacgaatgtaagatgtaatcgataggtttggttcgtgtggtcatgagtgtgtgggacttgaagggagaaggatgagggatggatgagtgtgagaagaagtagtatgagcgagaggatgagaatacgaaaggtatagtagtataaattgatttgaagtaggagagttatg

SEQ ID NO: 6238 - DNA, 1169 bp, Homo sapiens
  misc_feature (1)...(1169): n = A,T,C or G
attgttttntatatgttaataatccgatgacctcattagatgtggttttgtaatnaaagactgagtttatgacaagattatcttggtcatagtttactttaattgttngtttagtgcgtattnttatttttgtttgatatgtcgtgttcatttatgaatagcgattgaatgtgctaagtatgatctgcattgactttactctttattttgacattttgtctttgtcnaattacagttcgtttagtgttcctttttctttaagtgtgtgtcatgtaactgcacttctacttgattgcattgcctgtctgtctctcatattatcccgtcccctcgtactatagctatgatcactaccactctcctcttcctttccttttatttttatatttctttcattttcagttatttcttcctctatacttttcttttctaaatcttacatctctcttctctctttatgctctatatttatttttgcatttttattttttatttactcgctgttatgcccttgttttattctcttatgtatttcaatctattcttcgcatttttgttccgtttctttctgtcttcctttcttttccttcttttatgttttcttttctcctatttttattttcttttaatttgtcatatgctctattatatttattttaaactgtctatttttacgcttctcatagtatcttgtgtctccctgtttttgtcctctactgacttcctcgtttttatatcatcttgtctttcgtcctttgctttantcttgctatgcagatagaaccctttacgtattctctttattttcttagtgttttactttgtnatgttatggatgaggatatgttagcggcgtanacctaccttactgtttactatgtccagttcggtcgtgtgccgagacggttatgtaattgttactctctacctntactctatgatccctgtgctcgtggtatgtttcgangtctagttgtctatatttttactagatgtgtgttctcatttcttgatcgtagttatcgtgctgaatatgtttgaactgtgctgctaccgcatcncccctatctcccttgtgtatgcgaccttcgtccttctcgcgcgtcccatcgttcttagtgtgttttttgttgttttctgaggtgcgctctcgattcacagccttcacc

SEQ ID NO: 6239 - DNA, 763 bp, Homo sapiens
  misc_feature (1)...(763): n = A,T,C or G
catgccccaagtatacgacccactttagggcgacaaaggctcaatggaagcccagtagggtcttgggctccagcccattccaagggccaacaagagataccaagaatgtcctaaactaaaagtcctaccccacccaatgcatgggagcaagcctgccatctgaagtagggtgagtcttntgccaacaatcccatcccccttacaatgagcttgcctctactcacccatctgagctccagccttcgcgtgtgactccgaacggtggagttttctcctaaatccattcatcttgccaaaaccctgttcacaatagcaaagacatggaatctactaaatgcccatcaatggtagactggataaagaaaatgtggtacatacacaccacggacaaccatgcagccataaaaaagaatgagatcatgtcttttgcagagacatgggtggagctggaggccatcatccttagcaaactagcacaggaagagaaaattaaatactgtatgttctcgcttataagtgggagctaaatgatgggaacatatgggcacatagaggggaaccccatacactggttcctatcagaggatggaaggtggaaggagggagaggatcaggagaaataactaatgggtactaggcttaatacctgggtgatgaaatcatctgtacagcaaaccccatgacacaagtttacctatgtaacaaacctgcacatgtacccctgaattgaaagtaaaagttaaaaaaaaaaaaaaaaaaaaaa

SEQ ID NO: 6240 - DNA, 1751 bp, Homo sapiens
  misc_feature (1)...(1751): n = A,T,C or G
accgcgcccataccccgtctgaacaatgtaatagtctgacgctagccaagtccgaagcggcattgcggaatgagacagcacattagcgncgttaccangcgacctcgtagaatatccgtacgaacacacgtgtgaccatcgtgtctggctgagattatctagtattggatccacacaataatctagtagacgatagataanatatcatacactcancgcacctcagcgctgcttcgcttcgtacgtagtggcatgattccagcggaccgatactgtatgtnatctcagcgacgtagagtgtcgagaatcgtanactatctcagttagtggtcatcatactcatcatatgtggtaagcgtcgcgcacgtcacacgagcganagacaacgtcgacagtcgcgtcgaatncnatgcgcatctattgctcgcgatgagcacgtaccatacgcgccgctgcgcacgctaactgtagactatcagatatataaatgttgcncagtctgcgntatgattctagatcatgagtatagcgtnantgtacgtgcagnactactcgcgtgtgcgctcgtcatctttgtcacgcgcacatctgtacgagaacgctcaagcggatcgacgcganagcagacaaatgactcacntcgcntantncgtacatcactgcactatatatctgttgatgcacgaggctctcntgcncttgattcacggtgtatgcaccgtgangagcgcagcgtacgcgatagctcgcgcgtgcgtctgtcatcgacgtgtcataatcttgacttcactcggcgtctcgatctcatgcgcacattgcactgattcttcgacacgatgctgcactanactgtcacgantatacgcatcntgntatatatcacgaatacggcagagcacatagccgactatgatatatactaccggtagatacactcggntgtgtcacacagtccgagtacgcgtgacatgcgtagtcgcacgtggtgctgtatagtaatgtantgtgatttgagatctgcgcctgtgagcgatcgatgtgagtacacatgtggtcataggacatctattcgtgagatcaggtatcagaggtataganatagcgattcatgaagacccatactcagcatacactngacacatcagaacatctgcgaagtgcccgtacttatcgtctctcctcagtgttgtgccccattgcagaatgagcgtctatcacgaagatctcagaccactcactgaatnctaaattactcgtttgtacttgagcaggactccctctgttcgaacgcaagcgattgatgcgtagcgatttacacacgtactagccgaacacgacttcgcacaaataacattaatgcatatatcacctccgtttggatccctctctacgtccgactactatcgacgtagatatgtcgtttgtggttgacgccctgtcctagtcctcgtcggcatataaggagatcgtgagtgagatcaagatcttgaatatagttcgacaacattcagttagttcactataacgactcgcatagcgcgngagtgatcaccacagatgatgggtatcgtagagcagtnagaatcgagagcgtcatgcgaactgtcatccctcatcgcgccncanacgtcagacatactcctagtgcgtgaccagacctctacacacacacgtacgatgagtatatgacgatgagagtanactnagacgacaagacacatcncacagacgcatgagtatacaggcgtatg

SEQ ID NO: 6241 - DNA, 1339 bp, Homo sapiens
  misc_feature (1)...(1339): n = A,T,C or G
acgccgatcccgcctccagccaagaatatatactgatgtctcccgatgatcgcggtaacgcgcctctgatttatcgcattgtcttagtacacccatctttggaaccgaggtccaccgccctcaataaccctgcggcgcgcggcggcgcggcagtgttaatacacaatatcagcacgcgccaaccatctcatcatacacacacaacatacagcgnaccgcctgcgtgcgtggtgcttgtgtagattacatcgtccgaccgacgacatatctgtntaaaatgtgatgacaacaatcgtatcgctccatagagtgcacagcctatagctcgaccgcacgcaatctatctgcatatantagtgcattagcatttcgtcacctcgtactcggagtagtgactatgaccgtgagacggtagacgttgaatgtgattattataatatcgccgtacacagccatagaactaagatatgaagtccgaaagaacagactctacgagcaatgggcgccgcatatagtgttaacgaccgaacaagaggctcactcttagtgaatacagtaagaaagtgccgtgactgacgtaanagtccgccacgcattcaacagaactcggtcggactcgccgttagatctcagactagtatagatacaagagcgcgataccacaacaanatgagcatatatagtctgctgcagtatatgacgttgtcgttgtgcgttcgcaagacacactgcaactaatgcatccgtcgcacagcgggtacgatatgcaggccactacatacggtacgaatcactcgccgaacaacctcactaagtattaacacctactaaacgctgttaacaccgctaccgatattagttcgctacgagacgcataactctcaacatatacactaatcatcagtgtatgcgcgacaagctacaaactgcgtatcaatatagaantatctacaacatcacatcagcgcaagatttaccgactatcatgtactcatccatgacgccaacagtataccggcgcattatctatcatatggtagccgacatcctctataataactatctacgaggcgccccgcggagataaatngatgataaacgtcagacgacagacggctatataaagaagacgatcgaatagatcatctatcgtcccagacctcgactatcttctatattatatccgacacgagtcacagcttgtatatgcgcgcggtgcntcatacgttttacaccacctcctcgcccgcaccaaagttatcgagcgatgacgtgctcagcagcacggtacgtaacaagcgagaagcggcgccacgcgagaaacatgtgacatacgcag

SEQ ID NO: 6242 - DNA, 1470 bp, Homo sapiens
  misc_feature (1)...(1470): n = A,T,C or G
cccgcctccccgtcgccgcgttgcgcaccgattgcgatgcgctccccaggcgacctatttggacncgcactcctcttccccactctcaccactacagcgctagatagcacacccgcgcaccgatgtgcggtttcgcgtggatcgctaccgacgggccagagacgcaaagcctatcgctccgcgcaccgtagtagcagtaagactgcggcgtcaactaggtagatcacctctgtccctcgcccacgaaggggattgancgttttgtgctaggcagacatgacgacgaccacctagacgcgacgcgcaagagagaagaganatatgtatagcgcagtaacaggcggcgatacgacgatacgggagcgtgagcactctctttactgnagagtagcgcacatatagaacgcgcactcacatcatattcgcgacatattcgcagtattgtgcagtgcagccgcgcgctagagcacgtactagaggtctgactgctaatcgacatcgcatctcgaccactcgaatatacataagagagtatgtagtcgtgacatcgtcgcctgaggacacggcgcagcaatgcatacggtcagtgatgaaccgcgtggaccatctccactcgccgctcatcgcatatatttttttacacgtcgtatttcgctcacactggtagttgtatacatagcacggcacgatacagatcagtattatcctccaccgacacatcactcccagattatatatttctggatttcgcgcgatggcgcgagagntggcggangagtatgtgacagaatagcgcgcggacgcatgcgtagtgcggcgccacacgcacctaccctgcacacattccacagcgtatgcgaggcgcgcgagtcgttatatcgcagtgttacgagtagacctatacgacgtcccacaccgcatgccattcacgacgagatantcgactcgcgagttctccgttcaggtgcgtcatcacctgcgagcgagtccatgtatgtgatgcagtgacgtatgttgcgtagcacnaantcgtagcgagtcgtgagtcgattatgccantaatggacaggcgctagaatgcgagtcatngtaaagcgatgtcgatgcggagatgtntatatcaggcgtgaggtgagtgtagtangatagtgcatgcgtgngagtagcacnatgtgcgcgagtgtgtcacncacgcgtcctgtgcgtctgcgncagacagtggtgatacgtgtactgcgcgtgacacaccgcgctgaagtgtagacgtagcgctagcgagntcgtctatgagatcatacagcgacagatcgctcagcaccgtcagtctgatgtgacagtgcgaanttctgatgtatagtagcacgctacgcacgtagcatgcacgnantctcgcccaaccgnaccgagatctaggtacggtacgacgagtagtatgagatcacagagtcgctcgtgctgtgagcgacgctg

SEQ ID NO: 6243 - DNA, 366 bp, Homo sapiens
caccctagaaatcatgtctttcagccaggtgtgatagttttcatgtgtaatcccaattactcagaagactgaggcagaacccaggatttagaagctacagtaagctatgattacacctttgaactccagaactccagcctgaacaataaactgagactttttctcacaataataaaaagaaaaaataaatcgagaagctagtcttcttacagtagcacaattcacagttgcggtgtgatgtggaaccaacctaaccgcccattgactaatgagtggataaagaaagtgtggaatatgtacaccatgaaatactactcagccattaaaaagaatgaaataatgtcctttgcagcaaaaaaaaaaaaa

SEQ ID NO: 6244 - DNA, 1250 bp, Homo sapiens
  misc_feature (1)...(1250): n = A,T,C or G
ccccccccccttctacctcctctatcatatcaaccaaacacaaagacctatgctgtaaccacttctctgcgccctcaaaataacttacctcactaaaacagtactggtggaagactaaatctcaagtaaagtctcatgcatgatacagacgagtgctctcggctttctatacgtataggagatataatatctctatgtctcttgcgatcactctcgatactcttctagtatgttagtcttcgaacaatgtcatcagcattacaagctcgcttacatctctcctacatatcgcgttgcttctataacgacccagacgattaatgtgagaccttatctaaccatcgacgccacccccctcattggtttcgagacattaacattatcctgcctctatccaatacaaatatctcacttagactcccgcagtcttgacttcaaacttcaaataatttgtaacctgttctaccgtatccttctcccatctatctttttcgtctacaacctgattcttaccgcacgacaaacaacctttttattatctctatcttttcaccacccttacatcatattttcaccctatacactctcgcatccccccaatatatcatcactcctcttttgttgtttgcgcactcacccgcccccgcatcattcctacttcctcccgccaattcgttttcataccgactgtgccctctcttgcatataatcatcttcacctctatctattccactcccattattatcatcctcgctcgcgatctcatcacgcaacactctcatcagtacgtcaatataccctattctattatctctctaccacattcgctattatataattctctcgatttctcgccgctaacctaactntctgcgtcttctancagcgcatcaccttncatacttcactactcctatacaccttatatgtattcgcgcctactcactantcacgctctctcatccccaccttctcacattctactcgtgcatctcacacctcgcatagatatatatatactccgtcgcgctattgtactaatctactcctccatatactcttcccatccgcgctctgtcattctataacatactncntcaccatcctcctacctacaattcgctantgctcgcccagtcttctncntctcctcacatactctctcgattatatcatctcactcntattatctatctactctatataatgtctctactcctcctacctcacgcgtaccttctctgcttcc

SEQ ID NO: 6245 - DNA, 1197 bp, Homo sapiens; identical to SEQ ID NO: 6070
  misc_feature (1)...(1197): n = A,T,C or G

SEQ ID NO: 6246 - DNA, 818 bp, Homo sapiens
tttactgaaacataatgaagaagatgaagaaagaagaggaagtggaagaggaggaagaagaagaggaggaggaggaaattacgttgtttacagcttttaacaaaattaaaagcttgagcttgtcgatgaaatagtctccagatggagggtggttcttctggcttggacaatcttggtctatacactgaggacaacggtttcctctcataatgagatgctcgttcttcaatttgcttcagttgggcttcccattttctattcattggttcagaagtgtggagagaataaatcctatcccacgtaatatttctatcaattactactaaaaaaaacaacaaacaaaaaggccattaatttctttagttagaatatattttgtttgataaagtttcaaaactcacaacataaaaaataatgatattccgtatatacgaatagtaacataattttgtttaacgctacatccaatgtaaaattggccccctgtggccccaagagggaaactctttgaaccccttccttttataggggggatattcagatcccccccccacatactcccttcccctgttcattcaaatgttagaaacgcgttctcatcctccttaggggggggataccgttttccacacaaatgggggtacaccccccgaaaaaaccttgttataaaggcccaccagtctttataatacctataaagggcccgcgtttgtgcgtttttttatacgctcccccccctaagaaaaatacaataattgcgcgctacgcagtgtgggtgatacccgattaattttaaaaacccgggcgtttcccttgag

SEQ ID NO: 6247 - DNA, 797 bp, Homo sapiens
catacaccttcgactccctgggcatgccctgcctagctggcctgcactcaaccacctgcgtcccagaggctcacaacaccaagtagttgctcctcctgccaggtgcaggctctgaaaaccttccacctccaccagcacctggactaccttgcacttcacaccggccaccaggcgctgatctgttgctcctcacctgctggcactgcactataaagggtggcgtgtttgtgaagcagcaccagacagctccagcccggccaaaccagtaaacatctctgctctccatgtaccaaaccatgtcttctccaagggaagtcttccctatttgtccttccttggatcaagggttgtctgcttaggttgccatataaaatttccttctatcttatagctacatttagcatattttgttcgtcccgtaggtcattaaagaactccctctttaacctactggatggattctatctactagtttgatccagactgctagattgactttctataattacaagtgaaaatcgtcctggagaacattgtggtataataagggcttctacttagtgagaatcactttggagccaagctctttacacacattatataaattaatactgacaaaacatcttatcaagtagagtttagtatttcacattgtagagaatatctggctgaatcttaaactacataaatgcgaccaaaaacacataaaatagttatgtcataataaaaatatagcatcaacgagtagcctggagatcaaaattacattagtatgtggggagcctgacaaaaattag

SEQ ID NO: 6248 - DNA, 879 bp, Homo sapiens
  misc_feature (1)...(879): n = A,T,C or G
cggccggccggaaaactacgagcgtgcgtaaaagggaggggcagcttagtgttgacnctttgatggagattaaggtgaagcaaaatgtggtaaacaggaatgaaaagccagaatgaataaaggaagccttgattgggctgagatatatatgggagcttctaagagagaatactcagctagcctggcggctggcaaagagctgtcagagaatgatgcaggaggctccgctgagacgacagcactgccttggcagatgacttgatatgagtgcctgggcaggttcagggggggctggaggcattccataaggactaattgagacaaacaagattgcaggaaggcacttctgcccttattcaagatggtaataaatttattgcattcgaatgagaaaaatgtatactcttacagggttgactacctactttattgcatagaagaatggcggtgtcaaatataagaaaaagatcaagccgcaagtgtatacttaatatatttgacgcaaccggaccgtgtataggaagatgcagcgtaatagagctacgaccaggagggggatgcgtcggcgagaaaatcgctagtatgtgcaggagaggagccgcccgtgttagtgtgacgtgagaatcagggagtggtggataggttccgggtgagatggatgtaagggcggagaatttccgaagggaaaaaacaagtagaggagagtgggacgagagtgggtgtttgcgcgtatgttgaatttaagcctagatttctttttcagggtatagcaccattgaagtaaaagggggaggatggatacggttccgttagatagggcatctaaagattatgacagagtgccatattgtagttataatgcaggataatgtagaatcg

SEQ ID NO: 6249 - DNA, 935 bp, Homo sapiens
ttcacccgcaaaccacacccaataaattacaaagaaagaagggccgtgtagattaaaggcaagaactcccactgggcaaaacagagaacacattccttcagtggaaccagaaattctagctactgcatatgccaattaaagaccaatctggggaaaggcggatgcactgggctccatatgccattcaaccactgattacagacttgtacggatggactttcagaagcaggaacccaaactcattggggaaatacgaaaactcttgaacagatattttttttttaagaccttcaacaaactcaaaaaagctataaattaatgtatagtgaaataatacattgcttgcattagactatgaatacctacatgcaatccaaactaaacgccaaccacaaatgctaaaataaatccccctacaacctcgccctcacttcacatacaaaatcacataaaccattctaactccaaatgtctacacacaacacaaattataccctacaaaaaccaccacaatataaaactcgaacactcacccgtcagcaaacacatatgaatttcaattcccactacagaccatatatcaacatacacaaaaaaccaactctcgccataaatactgattatattataaccattatattaagtctcataaatcaataacttaaattacttcaacaacaccgtccccaaacacataaatatacacacaatctcccacccatcccacatctccatacagacataataaataccgccaggacaaaacaatgctaatccatatctactaattataccagctccataaaatttaacatgctaatcactacaaacaacaaacacaccgacataaaccacacagacgcaccaacaaatatgaacaatacacatatccaacgacacccttaccacaatttacaaaataataaacacaaccg

SEQ ID NO: 6250 - DNA, 971 bp, Homo sapiens; identical to SEQ ID NO: 6086
  misc_feature (1)...(971): n = A,T,C or G

SEQ ID NO: 6251 - DNA, 806 bp, Homo sapiens
  misc_feature (1)...(806): n = A,T,C or G
cgggggtcgggcgggttttggcttatggggcgtctatgagactctacaagggtttcttgtgagggtggttgtgtgtgagctctaagggtgatatttagaggtatctttgtgggataaagagggattcggccgagaacggtgtgtggtataacagttgtgattttttcgctggttatgaaggtgactggttaaatgtttaagggttaagcgcatacgtgctcgggagatagaacaaggccaaggggttggatatatagcgctttccttatgggggggcaggggaaagagaaaaatggagggctttttgttctggttaaaaagaagaggaaacacaatttcttttggtggacaccagtaattttaaggtcttgggataagtttaattaaaggcctaattgtggggaaaagggggaaggccgggggttccatttggcattttaaacccgtgaattagggcctggtaggggatagatttttagaagggaggaagcctaaaattattggtgaaatagggaaaggtatggttacagaatattaggaaaaataagggcctttcacagttatttagaaaaagttatttttttaaggtaatgggtgaataagtcccctccccgggattgattaggttggtacacaggaccttgaaagggtttttaaagagtattataagagaaattttttcagtaaggcgaataagcatttaatagtagaacaaatagaanatggagatctcattantagnatgtttattatggaccacgagccagaataaaggtgaaatgcaataagaaaaaaaaaaaaaaaaa

SEQ ID NO: 6252 - DNA, 1054 bp, Homo sapiens
  misc_feature (1)...(1054): n = A,T,C or G
ccgctcttgccgctcttctctgctcgtcttccgccgnacctcttggtcttttggccgtcggtgctgccgcgcgggtcggtccgggttctggttcctgcgtcgtggtgttcctcttcggcctgtttgcgccttgtgcgtgctgcgcgcccgctctccccttgcggggggctcgcttgctgtgggcgcgctcgtggtctggtcgtttccggcgtggcctcgtggtccgtgcgcgttgtgcgcggcgccgttcgcggtggcgccgcttgcgtgggcgggcctggcgctcgctcctcctcccccccgngccctgtggcgtctggcccttgttttggttctctcgttcctcgctcctttcctgctgcgttcctttcttccttttctgctgcgttgttgtgttctctgaggtgtcgggggcgtgcttttcgccgtggtgttgtcgtggcgggcttttctgtcttgtggcgtgcggccgcgtggccgtgtttctctgtgcgtgtctttgtcggttgtgtttgcgccgtttctttttcttggtgtcctgctggggtttcgaggtcgcgcgccccgtctcgcgtgccgtccgctctgttctgccttctcggggtgggggggcgcgcgcggtggtgtgggttccgcgtggtgctgtcggtctggttcctttgttctgtctgtctggttcgtttggcttccgcttcccctcgtgcgtaaaaacggcgctttgcgcctccttcctcctcgtttttgtggtgtctccgcgtcggtctgctctcgccgtgctctgcttcctgtccggcgctgtcctggcgtcgggtttcggggtggctcccgccggctgtgtccgtttttccccgctcttgtgtttttcgtgcgctttgttccttttcttggtgcgtgggcttcgagnncggggtgctggtggggtttgttttgttntttgtttgtggttctcgccccgnccaaannnctggtggnggtccgtcngtccgcgccaannttgttctctgtgttgtttcgtttgggctcttgctctttgtctgctgcgctggtccgttct

SEQ ID NO: 6253 - DNA, 1327 bp, Homo sapiens
  misc_feature (1)...(1327): n = A,T,C or G
gtctgccaatagtcgtccggcaattattttagaaagaaaagagagcctttagttgacaacaggcctaccatgctattacaaatggtcttaccagacacccacgagcctagaagacaagtgccaagctctagttagaaagaaagcaacgatgtgcgaggaccctgatatattgcatattcacctagcttcgctcacgcatngtggtgatcgagatggagcacanagaattcgtcgcgatctatagccgcctgccgtcgtagtatcaacaaggaaatgagcacaacagctgcgccacgtgactcaaatatcgttgttcttgtgagcttcgcaggaggaacgcgccgtttcttcttctcatagactagagaagagcatgatcacatcgtccttatgcgggtggatgcactagtgtcgcttctctgcnccgctagtgtccgtcgtatatgttaccactcgtagcacactctctntagngtgtaccaatggctcatatggttctttcgctattagcaggtcatgcacactaatactcgccgacggcagtcattatctgttgttttgatcacgattgttctattctgtccccacgcagatggacgtcttaacaggtncgatgatatagttaggtagagtagccttgagcatttcttcatcatcactggtgaccgggtacacaatgnttcttagggtacctatggtgaacaatacgtcgctggtttttgcgaaatacgtccactcgctactatagtaacattctcatattataatgcacttgtgccgctaagagctattctcgtggtaatataccgctgatatagaggctatatatactcactactgctaggcaccggtaatgttccgcaatgacgctaccatgataantcggcggcattgtcctttatgacttaaaatactgagattaataacacagttgatgtagccacaaatggcctatatattattactctacattacgcgccgcgcgatacgtatcttcacatattttgataaagctgacgtaatagcgtatagcgtgagncgctgaagtcagaaattctagaatgagctcgataagaatatagcgctgacgcgcgacgcatacattatactcgctgatacgattatcgaatntatatnatgtagtcgacgccgatggtgatttacgtattacgacgtgtgtgaggccacatagccnattgttctcgcgcgtgcgtatatactagtgcgctactttgcgtctcttgtgtatttcactgaatctgaacgatatatatgttcgtcatccaacagtctgtgaatttacgtagtaagatatctccgctcctcg

SEQ ID NO: 6254 - DNA, 1340 bp, Homo sapiens
  misc_feature (1)...(1340): n = A,T,C or G
aaaaaagggntaaagagaaaannnanatagaggagagggagaagnnaaagagaaggtgtgggaaaggaggagagagggaagaagagagcttaaaaaagagagaacaaagaaaagaaagaagttttaagggagggnggggcccgggggggcggaaggagagaaacnaagagagaaaagggagaagagaaaaaaggggagcggagggngcggcggagcgcaagggggagagccacaaaggcggccgcccgcgtccccttgtcctctccttcgccgcgccaaggagggcacaaccaagcgcacaggggcgacacgccaggagcntcgtgtggatagacgcgggcaaaggcgtcagggtaggatgtgggtatttaacatgcaggaggggtgacaggcaggtgagggagagcgccggaaatggacggataaaagtccgcagagtgtcaccagacccagcagcagcacaacaagagcccaacccaccccgagcaagcaggcggagggagccgcgcaacggccgacaaaataatgtattatacctanaaaggacacacaagaagagagctatcaacacacagagaaccaaaacaaacatacggaagcactaatctagcaaggggacagcaagatgcaacaaagaggaggatgggagagaagactgaagaggatagcggcgcgggtaagaacaacacagagagaagagagttggatacgggagagaaggtgtgtgggaggagggatgggatagagaggtgcgagggatgtgactggatggaaaagaagttccaaacagcaagcccaaacatacgacacaatcacccagaaagtaataatgtagtgttagggaggacggagaggggagaagaggatagggngaggagatgtngatagatgananacagaggaggatagaggtaggatgtatggaggancaatggaatggtaatggagagcggaagagatgacggaggagagcagccgcagagagagcagcgaggggctagacgcactcgcgagacagcagtatgagtaggagtanctaaaggtcatgcaagcaacagtaagttgaagantgctctgcgactcantgacaatgacaccnacactcacaatgacgagatctccgcggagtnactcgtgtgacagggcggcntcgcgcgcgctgaagaacgctgagacagagacacgagaggagcgcggagagagagagaacgcacggagagagagaacgcatagacagcgagcacacccgtagcagagcgcgcacagccggcacgacaacgcgagtcctcacaactcgctccgcggatgactctagagagtgtcgactctacaggaggtct

SEQ ID NO: 6255 - DNA, 1303 bp, Homo sapiens
  misc_feature (1)...(1303): n = A,T,C or G
cgggggggaagagtggagcagctgacgtatgtatgagtacgcggtcggtggtagtatatgcagtatagttagaggaatcatgaggaagagtgacagcgacgaatgacgaatggacgacaacagcacaacatatgtgcgtatagaaggaatcaagtcagtagctaaacagcggagggatgctttatatggtgtatgggtgggggtaatatatggtgtggaaatgcatcgacgagataggaggcggctgagagggaacatgggagttgaatactcaacgactagtgagattactggtgtatttgggagggnagacatgtataaactgcgaggaagaggatacgatggagatcgggaacatgtggatagaaacagacctgttaaaatatacattaggactaagtatagtgagggagtgctatgaggaatgtgaggagcataataaggtagtgacagagggaaggagaatggggccgaactggacgatancagaagattaaaacagctgatacgattaatcgagcattacatagtacaggagtatagagagaagtgagggtgactctgtctacgagatgagcttaaagaacaagaatagagcgagagaaaaattatatagaggccaaaatttagagggagcggtgagcgatctgggatgaagatgtgctatgagtgtgatggcgagggttgtttaggagtcgtctagctgtgaaagaggaggagaggggaggggcggcgtagtgggggggttgagagaagagaggaagagagagggagggcggcgacgaggatggtgtgtaggacagtagagaatggctgaaagctggtgaggtcgggggggggaggaggggggagagagggacggcaccccccgactatgttggaaggacgacgtgaaaatatgtgataattgtgagcaaggtgnaggggagagaggtgcgggagaggcgtgagcgtgtagggtgcggcagaggtgggaagctcgnaggtgagtgtgttggattggatgngcgagagagaaggagagaaggcagtagtgggtgaggaggtggagtgggacgtagtgaggggatggcgactaacgagagaaggtgnagtgcgggatgtatgtattatgaactganaccccacagcaccccactgaggatgtggtagaggtgaggtggtggggagaggaatacgagacaagaaaacggacgaaggcaaggtagagagggaatagaagaagggaatggtacgataagaaagagagggatagtaggtgacgggagggatcgaaaaaaacagggcaggatgatgtaaagta

SEQ ID NO: 6256 - DNA, 967 bp, Homo sapiens
  misc_feature (1)...(967): n = A,T,C or G
cctggcgttctcctttttcccccttgcgtctgtctttgccggctggggttgggggctgcgttggtctcccttgtgtgggcctgttgctctgcttgtgctgtgttcttctgtctcttgccctgctctttggtctgtggttggtctgtgcctgcgtctcgctcgtgttcggttggcgtttgttttttctttgggtcgtgctctcgtcttcggttcgtgacttcctggtgcgttctttctgccgctgtcctctgctgtctctcggtgttgcgtcctgcttctgctctccctgtgcgcggtgtggtcagcctgccggcgctcctgtcgcccgtgcttccgtttctcggtgtttgtggttgtcttggtttcgtctgtgtttggcgtctttctctctgtttcttgtttgtttgctcctcttggtgttgggggtctggcggttgctcctctctttcgggcgcggctcttttttctcttctcgccgtcttcctcgtctgggttctggctgttgcgctgccgccttgctgggggtgggtgctggggctgtcttgccgtggcttcccgcggtttgtctcgcttcttcctggcggtgtgtcttgtctcgtttccttgcgtgttcttctggtttgtgctgtcggctgtcgcgcgtcttggttctgcgtttggccgtcggcggcccggtgcgttggaacgatcttcgcctctttgcgcctctgtgggcctttggggccttggtcgggcccttgtgctgcccctgtctctctgcgttggtggcctgtggcgtgcgtgcggtggttcttcgtcgttgttttcgtcccgtgtttctccgtcggtcgtgtgccccttttctttttgggtttcggcggtttcccncnntnnnnntnggtgtggtctcgcggccaccgcggggtgtgttgccccacctttttctttttgttttttggtcgtttccgtgttcggccgtgtctccctt

SEQ ID NO: 6257 - DNA, 578 bp, Homo sapiens
ccctcttgccactgaggccagtgactccacgaacccaccaggaggaatgaacaactccagacgcgcctgccttatgagctgtaccactcaccttgaaggtctgcagtttctcttctgaagccagcgaggctacgaacccaccagaagtaagaaactctgaacgtgtatgaacatcagaaggaacaaactctggacacatcaccttgaagaactgtaacactcaccgcgagggtccacgtcctcatttttgaggtcagtgagaccaagaacccaccaattccgggcacactgccgtttgtatgttggtaagatctcttagttataactatgtcctgaaattttggaatgtatttttctactaaggtaagccaggaaagttggaggaacatttgaatgaggtggagccgtgtcacctggcatatgtaaaagtaattttaatttagaaagagtgcaattaatttctctaattgtgtatccaggcatctgattctgggtatggtacagtgactcatgaaatattttcataacgttcttaaataataaaattgacaacccttcaattcttaaaaaaaaaaaaa

SEQ ID NO: 6258 - DNA, 1107 bp, Homo sapiens
  misc_feature (1)...(1107): n = A,T,C or G
aatctctaatacttataccaggaactttttgaggtgctctgtggtgtatctaaatagtcgagatataatcggggngcacttcactgctggacaattgagggggaggaacagaaggctagcgggattggaccctctgttnaaatgcgtaactgcgtgctttgttctgacctgtcccacctagtgaacaggctaattctgtcatggcttgatggtcacgcaacagagcgagtggagagggcgtcaatggaactggncaggagccccagaacctacccgtggtcctagcgctagcactatcatgtnaacctcccatatgaccttcaaccatagtggtgactgcaacnaaaaaatcatcaatataggtaccgactgaacataaacgtaataagacatagnacagaaaacgaaacatgnnnctcttacctatttggaacataggccgcgcgtcctgtgggtcgacggatgtggtatttgtctttgtggnatagttgccttgagacgcgtggatgcggacgatgtaaatggtagccgcaagaaatganactaggaaagagtaactggcagtgcgangcccacgatgtacatacacggnacattcacacagtagcctatgaagcccgccggccggaaacttccagtngatttcttnacttttacatttatttctttcgctaataattatnaccatancaactcccctcatcttccacaacaaataaactctcacatntacaaaatacacaaacttnaanactataataacaatatacattaatataagtatacttttattaagaataaaatatataaaaaatacaaacataatattctatacaattccttctgtctacnataatnnttnntnattctatctctcttnntctcctnnccgtttcactanaatcatttncatcatccacttnttnctttaacacattaacattnaactttcatnngtccttnnnnntgcgtcatctcaagctgnncgcnnnntttnnnnccctttnncaattnttctttnnnctttttcttcntttacacatnnnnnctttccttccttcctttnnnnnnctnnctcctnccttntntnnnncaccttcttctccc

SEQ ID NO: 6259 - DNA, 285 bp, Homo sapiens
cttgtgctggcactttgatgggaataggtgaagcaaaatgtggtaaacaggaatgaaaagccagaatgaataaaggaagccttcattgttctgaggatgggatctccttatgttgctcaggctggtttcagactcctggcttcaagcaatcctcctgcctcagcctcccaaagtgctgagattacaggtgtgaaccaccatacccggccaacatatccttttaaaaaagggattgcaccataaatacaagtttataattgatttttttacataaaaaaaaaaaaa

SEQ ID NO: 6260 - DNA, 897 bp, Homo sapiens
  misc_feature (1)...(897): n = A,T,C or G
tgtctcgctcccttcgtggtggttggcccgttctgtgtctctcctgtttttgtcccccgcggccctctttggtgtgtctggtctgtgtcgggcccctttgtgtcggtcctctctccctcttttgtgttctcgggcggttttccttccccctcgctgtcttgtgtttcgggggtggcggtccgttgtcttttgctcggtcctttcgttcgcttgctgtttttcgccccgggccgtgtggtttcgcgttcgctgcgccctttgtttgttcggcctgtgtgttttgctggtgggtccttggtccccttggcgggggggtggggcgcctccgttgtccggggcccggcggtgtttcccgttgggtctgcctgcctggtgcctggcctggtcggggcctctttctcttgtttccgttttcgggtggggnntttttcgctgttttctttcccccgtgcggggttttcctttttgtctgccttgggcccggtnttgcgttcccnttggcggcctctcgtttggcccctctgggggtgtctgccttctgctgctgctgtttgggttgtggcgcgccctggcctcctgcngtgccgcctggcttgcttggnttgggnggttccggcctggccccttctggtcaaaaaagctctctgctcttgnnccctgttgggntgtttgtcngtgtcngtgcgtgcccggtgggtcctggtccttcttttgtggttcttgttttgccctgcccttgtgttcccggccctgcccttctgccttgtgttcttttgttgcccttttcgcctgtgntcaaagtgncccnccccctnttcgtnctctccctcctgtnnnncnttgaaattngggtgngtcacangaggctcctcctttaaccaaaaaatgttacctttc

SEQ ID NO: 6261 - DNA, 961 bp, Homo sapiens
  misc_feature (1)...(961): n = A,T,C or G
cggtcggggcgcgtctttccgtgtcgccgcccgcgcggcttttcctgtctcttccctctcattgtctcctctcctcttctattctttttcgccgcgtgggtttggtcgccgcttggtcgctcgctccgctctggcttgtctcgttgtggggtgtgtgcgtcctgtgttcggggcggtggtcgccgtttgtgttgtctcgcgggtctgctcgtgtttggggtgttttgcgcgtgtgtcttttttgttttccctctgcccttcgagcggccgcccctcgtttggtgttctcttccccttcgcttgggtgtctggtttgttgtgcttgtgcgtctccttttggcgcgttgctggcgtctggggttttgttcttgtgtttgcgtcggtcggggggacctcggcagttattttgtggcgcgcggttggtctctgtcgttggcgggtggtctcttggggggttctcgcgcgctctggttctgcttggcctggctgttcgcttccccgcttggccttttgtcctctntctttcctccgtcttgggtgttttgccctcttgctctcctgctgcttctcttatagattacctcttgctctgtcttgtgtctcctctcgtcttggctgtcgtcatgctcgctcctctttttggctcgtttggtcgcggtgtgcgcgctntgncttggtgtcgcgtggttctggcttctgtggcgtggctgtgctggtctgtctcgtgtcctttcgtcctgccgctctttgcgcgctggcttgtctgctgtcgtcttgtgtgttgtgttctcgtgcttcgtttgttgttgccttttcgcgccctcggttcgtccggcgtctgtccgtccgtgggttgtgctcccctcgctcaagcgctgtggtctnctgttctccccatagaagccttttgttcttttttctctgctctgcgcctcctttcgtgtagttgtctgggggtcgt

SEQ ID NO: 6262 - DNA, 166 bp, Homo sapiens
tccccagacatttagccgattataaagagagggaagggcctagaggagaactattaaaaaagattccctgatggaaacagaagactcaaggaagagacggcagattgcagcatacaagattatagcagacaagattaaaatataagatcattcaaaaaaaaaaaaa

SEQ ID NO: 6263 - DNA, 175 bp, Homo sapiens
attcgcgcgcaatccgcccgagaatataagtcagagggaggcggcccctctatgcaaacctattaaaaaagatgccctgatggaaacagaagactcaaggaagagacggcagattgcagcagacaagattatagcagacaagattaaaatataagatcattcaaaaaaaaaaaaa

SEQ ID NO: 6264 - DNA, 595 bp, Homo sapiens
cgccgttggggatgaaacagccaaggttctggaaaaacttgcaaagaaataagtgctctcagaaccactgaggaagaggcagttttccattccttacttcatgatgaagactttcttctcatccttcttggctctgatgaattaagctgccacatggcacagtccagtggcaagaaaatgagggcatccaataggcagcaatgaactgaggctttcaatgattgaggcaaggaactgaatcctaccaacaaccacatgaccttgaaagaggatccttccctgtttgagcttcaggcaaagaaaatttgaaatctgagacactgtataacttgaagcagaagttacaatctgggcttgaggaacccaaagacccatttcaaacattttactttcctctacaaggactgccctgtgcacatctgaaagagaagcacaatcttattaaaattttaatggctggccttttttgggcaccctcatacaagagatctctgaactctgattgaaacaaattttggcagtggacaggaccaattttcctggatgtgtaaaataaccccgtgcggccgtttctttaatgagggaattatgttct

SEQ ID NO: 6265 - DNA, 840 bp, Homo sapiens
  misc_feature (1)...(840): n = A,T,C or G
gatagtctgagcgactctcttaattttctcaccgctacagtagagacggggtttcaccgtgttagccaggatggtctcgatctcctgacctcgtgatccgcccgcctcggcctcccaaagtgctgagattacaggcgtgaaccaccacgtccagccgagactatagaagtgacgttagacaaaaagcaaattcgcgcaattttcttattcgagttcaaaatgggtcgnaaagcaggggagacaacttgcaacatcatcaacgcgtttggcccaggaactgctaatgaacgaacgtacagtgcagaggtggcttaagaagctttgtaaaggagacgagagcctcgaagatgagaggtcgtgcggtcggccatcgtaagttgacgacgaccatatgagaggaatcatcgaagctgatcctactacatgagaagtggacaaagaatccatcgtataccattctatgggtgtagagtgtattgaagataattgaatagatgataaagatatattggtgggtgttgtatgacttgatcataaattgacgggatattttggtgttagaaagttcttattgtggttaagtaccggtggtcagtatactatccttaaattggtttattacgttatatagttagaatcacgaacgtgtgtgcccgtatatttgggtggaccagtatcagctttataatctttactttcgaataaagcttaaataaaatactttgtcattgttacaggcatgaactggatgtaatcgttacgaaattaatattttgtggtagtagatattttggaagtttcgtcctttacagttgattacatagtcgaggtagttgttgg

SEQ ID NO: 6266 - DNA, 1507 bp, Homo sapiens
  misc_feature (1)...(1507): n = A,T,C or G
aggtatttagtgaanataggtggtagggtgtngagtgggagttggtgctggtgatgggtnnnaggtagcgggtgtagaatgtgntcaaangagtaagatgnagangaagagaaagagtttttttcgtnggaagtgngaccagnnattccggtgagtatgnatcttgagtgtgtgtttgtcatacgttccnnnagtatgtgagaagtatctgattctgntntttatttntcttttaactgtttttatttcacaggtcctcgatannataaaagcgagatangtcaagagatatcaatatgatntatttatctctccactcgcttctgctgcngncncggtctactcatcgaccccaccaccacatcctcaccgacctataagcgtgcnactaccctaacacaancacgctagaacgtgaccacgccaggtgagcgcgagacatgagagcggcgcactacagagcaccgcgctngtggtcgcgttttagagcgtattagttactaacttactacttcttctntgcgctgtcgctcgatggtctatgtcgcctcggtgtaacgtctacctattcattccctgctccttgtntctgtcgtgtgtgtggtngagaggtcttgtacgggtggagtgtgtcgttgtcagcgcagggaggngctgggagtncgcagagagaggtatgagtatatgtattattatttatatagccaatgaagcgntgtgatccatcatcntattccacatacatataattcgacgaacgtcacgaggcncggcgcgcaggtgacacacgttatgtattgacgcactccgtactgcaggtagagcgaacgcgtagagnactgtagccctgcgcagataaccacgacagagcacnacgcacacgatcaagcgtcagtgatancatacttacatgatatcttctgtagattataatattagttatgttgcctagtggncttacaagtctatgttatagtagaataataagtcanacgacctcaccacgtccctacttcgctccgcatgtccatcttggaataagtttancatcaacacggacggattncatcgtgacttgttttttgtgttgagaaaggnntnaggagaggagtgtgattntatattcgtatgcacgattaatctgcttatcctcaagtgacaacacagtatctcccgctcacacgttccaactcatacccaaccacatcaagctctctacactgtcgtccagcgtagttcccatgtctcacttattcgtcccgcatcccgtntgatcgtgtcgaatcaacatacacggagatggtgcacacgtcgcagcggcacccgctcctcattcacgtccctagtagtagttctactacaccacatgcttccntctcccgaaaagtgacnaaataaatatgcaaattactatacgctnccgcaatatctattanacactacaaaacacacaatagtncaatatgagtacgttgatctcncctcttatgctcgttcctacgatgtc

SEQ ID NO: 6267 - DNA, 597 bp, Homo sapiens
gtcccttcagtactgtgtgtccttggtgctgctgagctctgtctggctctctgatcgtttcaacacctggcacccctggagaggctaccgaggagagaatgctggtgagctgtcaccatgggagctctgagggtatgacagcctgataaacgaactctcaggacacttctaatccaatactgtgctgatggggtataatacactgatgcatatgagaatctcatctgcacatcatatgggcttctagggagaattcatcaaatatcccaggcatggcttccaaaccccaccactgtgtggcccatgcttgtttgagaaaggtgaggcaaatatgtgaggattctccaccccaaggaagcttgatttgcttataaatcatgaggatccttcgtgggcgattaactgctctgtacactgataccattacatgtgctaattatgagtgtaaggattcaaaacacccaatttctcctcgtatacagagttaggtaactatatccataacaatgcacactgtgaatgcatctcattattatgcgtaattcaccggtgtacttttatgataagtgtgtttgctttagattcgatggttatcgg

SEQ ID NO: 6268 - DNA, 1027 bp, Homo sapiens
  misc_feature (1)...(1027): n = A,T,C or G
gagaaaggaaaagaggaggaagagggagtggaggggggggtttggacgggggagagaaggagagggagaagagaaaatttaaaagaaagacaaagaaaaaaacttagaaggcgggggccaacacccagancangaaacgccggcgcgagagggggagacaaagcggcggggggcgccccggcagggagggagcccccgccccggccaggccccggccccccacgcgcggggggcgggggccaccgcgaggagaagcccgcaagcacccagcccagaacccaccccaacgcgggcgacgggccgcagaaaccgcgcggccacccgcacccccccccccacccgcaccaacaccccccggcgagcgagggagggagggagggggaggccgaggcaggacgcaggcagagagggaggaaggagcgcaggtgggccggaacaggggcgcaacaaagaaaggcgagagaggcggccccgcgccccacccacgcagcggcgggcccccacccacaagcccaccacagcaccagcccggccggccgggcgcgccgcccggcggcggaagcgggtcgaaccgcaagcnncccgacaagaggcaagcaacagcgctccaacacacgccaatacaaaggatcccagacacacccgagcgccccccaccccgacagagcgcgtgacgcgacgagagccagggcacagaaaggggaaaagatnaaaggaaagagagggagcggggggcgcgcgcggaaagaaacacaggggagggaacgaggccgcccggggagacggagccgcaaagaacggaccaccccaaaggccaaaagagaagaggaaccggcgggcgtccgccaaagcgcgcgcccaggacagaggcgcacgcccaccccaggcgagcccgcaacacagaaaagggagagaaggcggaacggcgaagacagaaatagaggcagagcgccagagacccagcgagaggccggacgagagagagagcncggaggcgcggggaggtcaagagcggacgcagaggggc

SEQ ID NO: 6269 - DNA, 1184 bp, Homo sapiens
  misc_feature (1)...(1184): n = A,T,C or G
tcaaccaactcttctacgtgaaacggtctaacttaaaaaataacaanngnggnnnngacgctttcttcttcttgaaaccaccctaaaagactttatccaccacacacgcgcacctgaggagtagcatgatacaccggaggcgatatagcatggtggtgtagaatctggcgcgcatcagtcagagccctagtccacacgactaataaagtggtagttcaccgcgccgcaactaaagcatttntagtacaccaaacaatactctcaataacatcgagaaactcgtggggtaatggtgagactatacataaaagacacacaaacgcgtactactgtcgatgcgcgcagggtcacaccagcctcgtaggaactacaatacaccttcggcctacgccgggtgagaggatattaatgtttatagcgtgagcctggctgttncgaagcacaaacaccaccgtgcaagaccctcccagatccaacagcgaggacatggtttgtggtgtcagaacatataacctctctcaccctccgagggaagtgccccgtcagacaggaaactcttggtctctcatacctcacagggcacccgaacagacacctggttctattactaggggggcgcccccgagcgacacctagaggaccgctcctataatagcaccccacggtggagatagaccgtgcatcaaaagagtattgtataatatgttctcccctgagtatacatgtgtgtgaagtgcacccctcgtgcccatcgtgccttacaaacgaagagtatagggcttactagagaggctccggacctattggcagtccaccacggtaaatagcgagggccccccagaactctcagtacgcacagagtgctcttcccttcccaaaagagcggtcagagttgttaaacctaatactttctggttgcggcttatcttccacaacactagcatggaacacctcgtagatgcgacatccaccacagcaggagtatatgaacgcatgtagcacccgcggagctctacacaaggaatcggttctactgttcgttaaatcaactatactgacagataaggaccccacctgtgtaaactcataatactacctacgaactaacacgtgtgcatagttttatcccccggcacgatttgaacagaatcggcattgcgatccgtggtactcatagagcaagt

SEQ ID NO: 6270 - DNA, 1120 bp, Homo sapiens
  misc_feature (1)...(1120): n = A,T,C or G
agtgtaaaggtagagaaggaatgaaatgaataaatgggttgggntggtaangtggtttgtggaggtgtggggtgagtgaatgaggtatggggaggtgaccaggggggacatacatctatacggagtgtactgttccttgtggtgtgagtcttttggttgttttatatattaataaattcttttcagttcggaaatatctgttgggggagggcncctgatggctccgacaacgaggnccccatcctagtcatttcccacgcccacctcgaccattcccacttgggcccagtacactgtgtctatattacaatgctatgctttcactggtcgcgtcggccctctactagaggatgtgacttacgccctcggtcggtcatcgacggacttctttcgttctggtacgtgacctcattagagagtgtcgaagctgcctccgccgccgactcagcgtcatcgggtccctggtcagagtcttcgtttgatggtgatctggactccgccgggatggtggtccgtgatgagtagaccgcattttgtacacgccaatgcattgtattccttctcactcaacaacctagatacctctacacccgggcgaagagcggagaggatatagggaggagaattagtgaatatctatagagatggtgggggaggtcataatggggttaggaggagggatataagcaaagcttctgccccctatccgctgctgagatattattatgaatagagatacaaataaagtaagaggtatagtnctcatgacgttggagcaatggatggcgtgtttgtagtattgaacgtggagtccggtcgagagaatgcccgtacgcactgggctgattaacaatacgcctcagtaccatctctgcgggtgtactgatgtaacccgtagtaactggagtgttcaccggntgctcatttggcacattctcgaggtgagtagtgcgtgctacctgcaatagaacacagtgactgcgacatagaacatgaagcgtgctctgccctctatattactgttcttgtggtccacgcatatagtctccaggaatcgaggatctacatgacgatgggacctgatggtgctcgggtggccagatgccgaacatgcagatgc

SEQ ID NO: 6271 - DNA, 904 bp, Homo sapiens
  misc_feature (1)...(904): n = A,T,C or G
ggacgccgcactcggccgtctcgcgcgaccggcatcagaaccgctctcatccccctcaccttcgcgcccactccctgtccggcactgaggtcgcgatgtcaagcatacctcgggcgtgaaaggaggtaccgtagtaatttcaaaacaaatcatcctcctcacggaaacttggcggggcgcgcacctcgctgtatcttccaatcaaagccacaagattactcttggtcaaaactgcccgttcccagggtagaataagataagtactttcctaatatagggcgtccgggaaaacaatgaacgaactcatcatggaatgggttatttcagcttacatgggccgacataaaggagttgtaaggagggaggaaatcaaaantgccctgtgcacattgggtaaggaatggacatttaacagtaacatagggagaagaaagaaacttcactctagaggttttgataggttacagattatcccaataatttaattggtactaggtaataataatgggaaacttaagtgataatacggggttttaaaactctacatactgcatacctgtgcctgcttctggggttggaagtgtgacttcttacacataaagcactacctaagtaattatctatctgttttgtgccagtggtaaactactgattacttgtaattatgaaaagaaataaagggtgtctatcatatgaagataacgccttccctaagtcacatatcagaataggaagataggccgctaacttataaagaagttcaaaccctgtatccaattttaatgataaaatagccaagaggtatatcgatgatggaaattagccacatgtacactacattttttctaataaagccagatgcggccganataataaaacaaatatatttttttgcggggtctat

SEQ ID NO: 6272 - DNA, 837 bp, Homo sapiens
  misc_feature (1)...(837): n = A,T,C or G
gtaaggaacaaattacaaggaaggggaatctgctcccgccctggtgttgcacccactgactgaacacaggaccccctacagccttgacttacctcaggaggccttgatacttacaacaaaaagattcaaacagtactagtatctaatggacactcactacctgtactaaatgtagaaaaataagtgataaatattaaactctcattattttaatcatttggatgaggaacatcatataaataaaataaaatgcctatatcatgttatattattaagctaaagatcaatatgtagcagatatcagactaaaaaccagtgcaaataacaactaaagcgatattaacatgaatatataataggaggaaactagaatgaaaaaatataagacacatataaagacatatcgaaaacactcttcatcaatagacatatataaattaagatgtaatgtatataatataaggtatttcgataatttgaagagtcgtaacctgtctggtgaagataaagtacaacagagcagtaagaaattaaaagtaaagacaattgagcaattattaatctacagttttagaaacataaatatacatatattatccatgagttttgtcagattatttaatatattaacgtagatgatacttctactatctatctttaccgatttacctattctaagtagacttaggttcatgagaggttacagtaatcacgcttatcttataccacaacatatatagacaaatgatanatgttattaataaattaagcacacgtatttacatacatacaaagttaatcgtgtaatacggtttataatatacaacatatagtacg

SEQ ID NO: 6273 - DNA, 862 bp, Homo sapiens
ctctttctgagtaacacaaaagaaaattctaatatataatacccggtgctgaagaagcacaaagcaagggtcaagggaaaaaaaactgcctgggttcaaatagactttccaatagttctgaccatccaagacaccgggcttcttgaaaaatacattttctctcactgaaaatgtataataagcctatagtggtatctatgtcaggagtgttgtgaaagaatttctgaggcatatgggacttttatgcagcaaatttttaaggcgtgggcagggacttgatgactaaaacaccaggagcaatggcgacagaacccaaagtggaccagggggatgcaattaaactaaagagcttgtgcgacaggaaagaaactaccatgagagggaagaggcggcctacggagtggggagaaaaagttggcggtgtacgcacggggcaaggggtgtgtatggcagaatgttgcagaagaacttggggcgaatgttgctgggaaagagagtggggcgggcccggggacataagtggggtcggtggggctgggtagacggatatgtggggatgggaagacttgtgggtgcggggcgacggagccgctggaggatacgcgtggcgggagggggggcttggagtttggggaagagagggcatgggggtgtggcgcgtgggagtccgggggtatggggtggatgtggtcccgcggtgcgtgcgcgcggtggagggaagagagtgcttcaaaggaggagggacttctgggggtaatggaggccggaggtggtgacctgggcggcacgtggggtgttcgggcgcggagggaggggctttcggtatgaggggtggggggaggaggcggaggtgagacgtggg

SEQ ID NO: 6274 - DNA, 862 bp, Homo sapiens
  misc_feature (1)...(862): n = A,T,C or G
tggggattctacggaggcatttttcgcaaaaaaaaaaaacctatctgcaacgactctcttatttaccacggctaccgctccaacatgtaaataaacagctgacaagttctctctcaccttaagataagcaaaggctggagaaactgaaaataaatgacttattttttacatatcagataattcaagtcaggggaaactacctcttggaaatctggagagacaggatcatccagagagatctatctgaaatcttcctacctgaaatagaattttttttgtccataactggctgaaactctttaatgttaattttgacagactcctcaaggcaaagtgctggaagaaagtgtgagaatttcctgtggactgcagctctaaagggaacccagcatttttgagggctttaccctgacggcgaatcattaccgcacttttgcgaatatctgaaacagacccattcggcttgatgccaggtcaaaggctcaaaacgttcttcgcaaattctgttgccaggcttttggatcacaccgggactactttcacccgaccttattccgctcctgaggggggaccttggtgatgcacaatgagctagtcgggtacgcacactaaagtgagaccacttgacgcacgcaagcgcgcggcaattctagcctacttccctgagtagacccctcgcccatccccgctcggactgctgcgcccccgtacggattgtcgcggtgtatctcgcttaatactcacataccctgggcaccgttgtcccgccttagacgcacgttcgcacttgtcaacgaaaccactccacagagttccgccngttttactcgcgtacctgcccctgctcacgacgtctgccgcg

SEQ ID NO: 6275 - DNA, 1341 bp, Homo sapiens
  misc_feature (1)...(1341): n = A,T,C or G
attgccatcaacgtgactaagnacacgccaactagcaacatacaccgccgcagtcggtgtcatgacaccacgccatcaccaatatgtgattgatagnttacacgtgtcactactgcttcgcctcataactacgacacgtagattcagaaatgtgagttttgtgcgtcgcttccgctgcgcactatactaatacatatcagcgctcactgcgctagagcgttctgtgcgctgtcaaaccaacgcctgtgtgaacgacgggcaattacagatcgcggcaccatcttcgataccaataccgcgcgcccgacccagtgactgagactcgaccaaccgacagggaagcatttcgtacctcgggacaattcataaacaacggcatacgaataagaaaatctaggattaaaatataaataacagccagccgtaactaacaactgattgaatcattactagataggtttctagtgataatttccgtagagtaactgtacacatctcgaatgcgatcccatagtagccgtgtctagattcgactgatcacgttcgttcgctgacgtcgactcatcgttaatcccgagacagcggcatgacgacatgttcgtacgcatacctcgatagtgctaaatacactacactagtgcacgcgacacgactggcgttgccgtaggacgagtcgtcaacagaaccagaataggagcagtacttgatatcacagcagcgctctcgtcgtatagctgctctgaatgtacacggaactgttagactgaactagcctcggtatgaatatatgtattagtatcaactagatcagagaaggactcgcggacgacgatgcgtcaatgatatngccatacttacagtggttcatgcatttgtgcttgtngatcagagctcaccatagataaatatagtgttgatctcgcaccgacaaacatactacngcggttatcttatagatatgctctcttgctccgctctttgctcgatagatacatgccgcgcgtgtgcgctcgccgtgtcatgcggcaagagcatagcgcgtctagatggtcactgtccgcgagacggaaggtataacgaatgcaacaaacacccaggagacgctagacggcagctagtcctgcagccaaagtgagaaaataacttcaacgtatagaaatnagaagaattatgtgggagatgattacgaatgggcgcacaccttcctcgaactgagttnacgattcttagcgtcatcaacaacaactctaatcgtggcttaaggtctccactcgactgagcgcttctcttgctcgcttcgctcctgcatgtgtatcgtaatcacngctagagcagtcgcga

SEQ ID NO: 6276 - DNA, 812 bp, Homo sapiens
gtgttctccgtcgttacgtcctttttctgttgttttgtggggtgttcgtctttcttcggatgcttggttctctgtcgggcgggtccttggtcgcttccgtgcctttcccggcgctccctgttgggtttgcggtcttttctgcggggtttttttggcgcctgtgcttcttcccctttttgggctgcgggcgtggtctcgtgtcgtcgcgggtctgttttgtggggctctgggtcgcgggtggttcgtcttgggtggggcttgttttgggcgtttccgtcggcctcgccctctccccccttcgttttctccgcctgtgtctctggttcgtgtttcccccgccgcgctttctctttttcttcgttgtcttgccccccgtccgcgtgtgtttcgttgagcttccttccccgtgtggtggcctgctttttggggttctgccctgtgtagggttgtgtttttgtttactcggggtgcctctctgcggttcgctcggtgttctcgcgctgcggtgtgtgtctctcgcggtcttcgggccctcctcgtggttttgtgggggggtcgtgcttgtggtgtgttgcttttctttttgccggttcatcccggcgttgttgctctctgtgcggttgtttttttgtctgtgtctcgtcgctttcgcccttggggggctcggggccgtttcccccggggctgggtgcgctcaggccggctctgcctgcttcgttgtccttctggtggttacttctttaaaagttctttgcagtagcggccaagtttttttctcctttttcttcctcccttctcctctgctgtcggtt

SEQ ID NO: 6277 - DNA, 2145 bp, Homo sapiens
  misc_feature (1)...(2145): n = A,T,C or G
aataagttttgtnatggtagctgcgtgctaagccancgtgtantgcgtctaccgcatcacacgagactctactgctcacgctagagcacangagcangacatgngccgagnngcgctacanactgtacgagncagngctgacccacgacgancgcgacgcngtcaggcgcnatcacnctttcatcgtgcgagtgatctgatatcggtcggagggtgngacgtgagcgcagcagnncgngacgcgctggatntacacacngctcatatcacactactatantngtcgatgcgnattgcagttctgtntctattcagtataatcnacctgatngcatctcgatagtangtgcgctgtgatatgacgtnangtatcantaatgagagatagatgtncttgcgcatgcatnnaggatcatatgtgacaccatactgcatcnatcgagcagcantatagtatccgantcgagcagtgcgagtaggctgcgatgatgagctataggtnagatgtgtcgctgtctcgtagtgctagctgntatcngacaccggtacgcatcatgtgctncatcatgtatncttgctagcgtangccggacngctgtagtaggtgntggtatgtgatcgtgcaggctactantacgtatcatcgagcgcatgctgtgacgtatcacatagatactgatacaatccgnacagctgtngacggctgtanagntntacgactgacancagtacnacctactagctgactacacncgtcatgatcngttgagtncncatgctagtctatcgtctagacatacgtactncagctgagtcgacantgtagtntnactcgatacacatnattcaccatcatcncgctgctctctctatnctatcagactantagcgcgtcacgcagacagcgangtnctgcagacgcgatggagntagtcagcaggccagtcctnacgtatctcgatgacgnantacacacaactgtcgatcgatactnagctgntatatgtgagtgttgatcatgnattantnattcgtgnacgatactgtaagtacgaattatgtctgatntgatatagacatgttgtcgtatctatctagtnttagtgactgtnagntcagttactgtgctgtcgtcattcatcncaacanacgataangtnatantatntcnntatgatgcancaactgntagngacgactcanactagatcatacgcgctgcacgatacacacacatncgtatctacagctcttacgcacgtcgtcatttcgtctcttcatcgacangtncgatgcggagagtnctgtatgctgcgctantaacatagtcangtnaatgnactgtattcgntgagagcacatgantgacgagcagctgtgtangtcgatcgtgngcacgagnactncatacgcgccnaagatgtacncactcntgagannagcanatactgctcgcngcgacgcncgtaaatgtgatagtctgacgtatgctaganattacataaantgctntactnagtatcgtagcataatcntanttactcgntcgaggcgntatatatgaccgagacagatgtcacatcgttactctcatcntcgctgatcgtgcatacnaaactagagatctagcttaacggcataggttantggagacgtccaagacgtacgtcgcatgntgctgtcgcgcngagcacgtgctgatcatttcgtctagtgctgtgatgtgatcaggatccatcatctactcacgtatttagtgagtactattcatatgcgactctcanccagatcacgattacagacacacacatgtgagtagtgagacatnacacgcgctcgacgtcgatgcgtatcagcacgtcncgtaacagatgtgagctgctaaatggtcttgacgactcgcacaactacgatattggagagtgatatgactgctctgtgtcacctcgtactctctccacttccctctcttctctcttatattaccatgtatacatatcaaagactctatgcgtctcatctcgctcgactgaacatacttcgcacgtgtcaatacatccgctagtataatagtctgtcnaccactacagagataatctgctcaatatgttggtacgatctataggtntcgcaagtaaatataag

SEQ ID NO: 6278 - DNA, 1327 bp, Homo sapiens
  misc_feature (1)...(1327): n = A,T,C or G
ggttgtggagatcgagttcacaagcacgaagaccgagtgcttggggagggcggcaaggcgcctcgcgcgggggaggaacatgcgaagaaggaggagcgctctanctgacggngaggttcgccatgagtggacgcatatatcttctggcgggagagatggtgacggaatgagggagaggtgatggtatatgagagcgaacatgtatatatctacatgcacaagcgtgtagggaattctctgtcaccagcgcgatctcaccctacagacgagtgctccacacaaatctcgcagtggcatcacgtgtgtcgtatagtgtctgtgttgatatcatatacaccngtcactgacccatctgctgcaaatctaaacgctagtgtgacacaagggtggggcactactgncgtgacctgntgcgcattgtggtggtggctgagcaacactgggataacaaacatgtgtgggagcacatggaaacaatcactcgtcaatatggtgagccgtaaacgacgantgcacatagggggcgaaaacaagggagcacaccaccacgcggaggaccggtggcggggagagacacaacatcctacactatacgtttggtggagtgtgnctcctgtgtgtcacatcacactgntggggagcaacccgcccacacaccacgcacacacgtgagacgggcgggcgtctaactacgcactatacacgtgtgggtgaacatactcacacttccgtgctacatacgcntggctggcgcgcggggactaggtcagtgtgagtgactggantggctgcatcggctctcatgtggtgggagcgtgtgctcacgccacgcgggaggggcgcaactatcgcgtgaggtcatgcctggggcttcgatccatgtgcatatcgtttgcgcgttcgccgtctactcacacttcatatttggtgagcgcattccgatatcaccctagcgtacgctacccaggctgggccggggccgctactgacacctcactgcgaacgggcagtagggatgaccccagcggacaactgggggcggtaccaacctggtggatagcaaacaacaacaagtggggcgggggaaaattgacgtgtaactagccaaaacaaaaagtgcgttactttcgtactcgccgtgccctcttcacgcgctaaaagtctctgatactcttcagcatatgacactaccgactatacctgcccagggtggactcggtcgtggggggaataccaccactgggcctgttagggtgagtcgaccgcgggtgtgactggtcaaacttattggggaaacaaatggtcttcggacgggggggcgaatgtg

SEQ ID NO: 6279 - DNA, 964 bp, Homo sapiens
  misc_feature (1)...(964): n = A,T,C or G
ggtggtatgttagacggctggcgagtgggttggaacgagcncttatctgctacgactctcttaatttttccccgctacacgttaccttgccgaacaagaatctatcactgtgatattaacagccaaggggagagctgtctggacatgctaaaggacaactggagtccgcgtgtgactatgtcgtaaggtctgctctccatctacggcctagtgacatattcgacgcctgcgggaccctttagagaggcacggtgggcgcagggatgatgaccgggaggattaaaccatgacggcgggtggccgcaccctagaaccaagtggatcgatatcgagcggggggtcagacgtaccggcaggtgatgagctctgtaagggagtatgcgaagagcctcggcgtcgcacggccgggcgtgggagaggcagggggggcggagcgacgaggagatgggagcatgggctacggaaaggaagccggtagcaggaggccccaccacgtaccggagggaggtgtaaggaggcaataagggaagccagaggcgggagagtcgaggcggagccgtaacgaggcacgtggccataaagatcgggatgaagtatggcngcgaaagagcgacaaacgaaggccaccgaagtgggaaagtgctgcaggtggatggtccgacatcgagaccgctacccacaccgaggcccgtcgccgctcggccctgaactatggctggtggctatagttcagaggcgatggatatgtgcgtgggcggcgtaggcggccgcacatagagagctagaatcatgcagccctgtgaggtgctctgaagtgagtacacatgagagcacgatgcgtcacgacctgtcgcgtgtagacgacggataggcgagcgagcgtgcagagttcgacgataggcgagtagagggcgtggcatcttcctacttgctaactaaaccttgtaactctcgtctaacaatc

SEQ ID NO: 6280 - DNA, 1842 bp, Homo sapiens
  misc_feature (1)...(1842): n = A,T,C or G
tttaaaggtgaaagtaggatgtattgagagantaaggataatatattaggatntaattgagagatagaattaatgaaagaagaaggataagaattagtaataatttagagngatagtnattcccagagcatgttagtncgagggcgcagtatatataacgatactcatacagataatatttttatattgttgataagaataattggttaatatagtagatttataatagtgtntagaaaagttgaattattcngtgtaaaaggngngacgaggcncgcgagacgagaacacaagacgcacaaagatcgaccacgcagacgctacaactaaaacgcagcancgtctcactacaacacaagattggctctagtctacatattncacatatatattatatctacancacgcacngccctctctcttagcatactntataggcnngcccggaacatcgntagtacacattatnacttccatcgatctatatctcagagctcatacgttaatcgtattatactatactaatatatntacatnantnctctctaagtgatctgtacgacgcatcgccagtgcatataccacatgtctctgccacagcgcnncagatctctaactgcacgctcacgagagcgcacaccctgcatgacactgcgactcttctatatatatgtatgntgtctatgcatatatcctcatcccagatcgacagatagctaagacagtatacacgatnagacctcgcaancgatgaagtgaagtcacactnatcncgaangagatcgaagtctaatgtatcttcntantctagtatanatatactgagatgcangttactgagtaacncatgatccatacgcagacacacgntgcancataaaaatagagtacgcnacacacagcgatcattagtacacatgcacangatagnaacagagcagtatcgagatgcagnncantntntagagtagaantantangtnagagactagtnaatacctagnncnnnnantnatgagtgccgtgcagcatatctatgtgtgattgtatagctnnnaatagatctagcaactangacgcacacactgagacnctcgcanccatagcagcagtcagtgtgaaagnatntcgtagtatnntnttgcggtatcgttgtgtgtcgatcnctgctacgtgantaccgtgcagtgnatgtagatgtagtaagttacgtantanataacaaagagtgtagtctgagagatcatnnanganantnatagtgaatagantaatgangntnncnangnagtantatgacactncatgatgataaagnnntcgacaacgacaggatagtcgcgtgagacgcancgaggatgagtatancagnactcnatcgcgaccacgacccntgcgatcgtataacgngaaatcaggctgagtgatntgntatagtagancgctgtcatcagatcacactcataatgatacactcctagctgcacgtcgtcgntcactccgctagncnactgctcgtcncggcagtgagcagtctgagcgaggcnatgacacggtnacgcngcgcngctcgagtgttcntcatccctgatcacctctcnctcactatnctgtntataantgtacacagcnattcagcatacactcntccacgttagnatagtacgcacatacgagcagatctcanacgacgccacgacatacgacgagntnncgncatgangtagagactggntngacgtgatacgacggtgagtagcagatgagntncntcngngncgtatgatacgtaatgaatgtcgnanaattagcatatatacctacnacntcagcgcacagtcc

SEQ ID NO: 6281 - DNA, 1492 bp, Homo sapiens
  misc_feature (1)...(1492): n = A,T,C or G
aacggcgctcacgactcaagattatntgtatcgcagatcatncaatgctactaatgctcgatacagacgttcgtcatgggatgggtgacagaggcaatgtatctgtatactatactctccaggatgcagtcttgtcgactgatactagcgtatatacatgnatgatgtgcatggactgcgtgatagatgcttgttacgacatagctgacatgtggtgctgaatatctattgtntactctgtactgattactgatatgcagtagatgcatgcgacacgcttcttcactcttgttcatactgagtccactcggcggtcgngcacatgctcagtcataacaccgatcgtgcgaagatcgattacaagatcatcgtagtctttgtgatcgtggtacagtgctacatgtctaatgagatcaagctaggtcgatctatacgatcatacacattatgcgtctcgtactaataccgcacatatcatcacggcagccataaatacgtgtaacagcttcgcttgtggtcgaagatnatatgatagcttgcanantgtaatcatgtatatattaggttgtggcgtcactgactattctactgacacatgtacggaatatataaaacacgtaatatgcagctggtgagaatccgtcgatggcgcactgatgtntcttaagttataacatggctatagctgcgctgtgtggagtgttcgtgcggcatattcattcgtaaatcgtgggatgagccgacaagatgctgcgacagagattacagctccagagcattacgatgagatcatgagggtgacatgagccgctagcagatccgtagcgatataggactaagtggtgaagatgactctaatatcatcaatagctaggtagctatactntgtgtgtgacagtcgacactacatataataacaataatgatacgcggtgcgacagagatttcgttctacgcagactagagtattcttctcatttatgcagatgtgaatagnttactttatcaaatcatatgacgcacgacagctctatatactagctaggtcagattcacgaaacctaataatttgnatcgagtatgtttcaagactcaattgaatttatcacatgaactgctcatcttagattaacagacaacgagtatacctcataatttacactaacgacacgtagacagtcgtctctactatatgcgtgcgagactctcctctgcgctgttacatagtgacttaattcggcccactcgtaactcattgacgaagttatgtagcttagaaagcctagcaggtgatagatattcgtaataatgatttactgaactcctagaataacatttaatacgacagtacagtcgacacctcgaagaatatgtcttggagatctaccgcgcaccaaaaccgagtcacggcaagccggtgttcaacctgagctaaagcacataatnctatcccgctgtagtcctatctagttgtggctattcttgcgcaatg

SEQ ID NO: 6282 - DNA, 1084 bp, Homo sapiens
  misc_feature (1)...(1084): n = A,T,C or G
ccagtgtcgtccgtcatcgacaggtgtggtgataagggttgtatatgcgggcgaggactatggcactcttccttanttcttgtacgggttgtctgtgttgcggtgtcgcctcgtcggtcgttccgcttcaggagtgagttatgtgtgtggtgggcagcgtgtcggtgctgtcatccggccctatgccgctagagaataacttgctgggcgctaggtggcgtgtgttattatatccgagtttgttgccgcgcgccttactttcgcgggctcgatactcgcgggttggtctgctggtgggactgtcggcgatcgtagcggtgcgcgacgtatctatctcaagattttttctgtgtatacgttgagggagggtcgccgccggcgaagcttgaggactgattgtgttgttggtttggctcgcgattttgtgggcttttgttttctatccgtctcgcgctggttttatcgttctttttggcgtcgcattgatagcaagacctgttgcaggcgcgttggtcctggtcgagtcgtcttgtttgctgtacaattctatgcccgggaggtttatggggatatcgcgggggtggtgatataacctggggccacttgtgtctgctattagcgcgaggtgcgtgtttgttatcacgtggtccctagatatgtatgatggatgagttatgttctcgtgacggggaagagggaagcaggtggttgagtggagaaataggtgggggtcgtcgagggtgtgcatgcgttttgattttatgttgttgtattctgggagagatggggagatgcgtagacgtttgtaagtctgctcgactcgacattgtgaggtgtcctttacgcacagtcgcggctcgcccggtggaagggtcgtcggtgtgcgcgctggtccgcgcgcgtcacggcgcgccattgtctcatcttccgcgacagtgtaccggagcgcgngaagggaggtcgcgttaggggcaggaattgttcatttcttttnaaaagtggtatatcgagttttgtggtgggcaaacgcggtggttggttctatcctgtattcacccgactgaacccttgcccccgacgtttc

SEQ ID NO: 6283 - DNA, 570 bp, Homo sapiens
aatccaaatgagactcataacaataacacaagctggcctgtcttcaaaagcactgaacaaaaatatctaaccttgaatacggagttcacatgaattatgacgaaactacgggctcaacaatgtcgattctggacatttttttttacaaaagtcttcggaaagaccggaactgttgctgaagcagaatggcgagtggatgcacgatttcatctcttgaaacaagtttcatgatggcttgataaagtcaattttaggtatactctaacaagaaaggaaggcggtggggactctaatcagaaagataccctttatataacatatttccttttaatcaggttaatttttaggatcttttttaaccggactgggaatgttatctgtgctagactctgtaggcctcatgggcctgtggtaactaaaatgatacgagattgaattggctttgggaccgagctggtggacacgtcatatacctacatttgaagttatgagggaggagcgttatgtagctggggctattgttgatattcggtgattacatactgtggccaaacttaatggtattatagt

SEQ ID NO: 6284 - DNA, 949 bp, Homo sapiens
gatgtcatggagctgttatcagggggagcgcagaggggagggttagctgcacggctctcttaattttccaccgctacagagaacgtcctaataagaagataaggtgaccgaataaggggattacttggcagagatatgagagaactgggttcttgaccccactttgccatgaacttggtttcatctcttaccaagaagtttcttatattatttccatgaattttgttatgcttgcacaacataccgagaaacattctgttggaaaaatgtgactgattaagccactgagaaacagctcgctttctttgattgccatgttggatagtgagtgtagggagacggcgatctatggaggcccctcatttcattttttaactctacagagatagggaatggtggcgtgatgctgggctgtagcctttacgtcggggttatatttttgaatcgcttctacactgagctggctaacactagggctatttgttttattctgttcgccatcctatgctatttctagcgggatatttctttatatgatgagatatgctgggtaattcattattgaataacgtatcattccttttgtttgtgtggatggggctcacattccccatattttggacgtattgtccgtgtgtttgattgctgtagattagttccggtgtgatggaacttctcgagacagactactgtgtaatttccattggtccacgcagcggtaaccccgcttcgctatcttcacccttttaggtaccgtggacaccagtctaaaagtccagtatttcgttacgatgataatgcagaatacgcttggtagatcagcgagaccggcgtgtagtaatgctatgcgttctcttcgcagtgtggaccatatagaattatgaagcatatgtatcatgtgaaagtaaaacattatgaaagttataccgcactgtgtggtattttgaat

SEQ ID NO: 6285 - DNA, 1196 bp, Homo sapiens
  misc_feature (1)...(1196): n = A,T,C or G
agtaaaggtaaaggtgaaagnagaggtgttaggtaaacggtacgtagggagaggtaggatatgaaaggagnngaggggaaggttctgtgcagtggaccctggagagtgtgtgtcgtggcagggaggggtccatatattgctttggtcggtgattaagtaggaggggaagttgtgtgtacgtggtctaagagnagaataatggatgtgtggcgggcgtgcnctcgactcgagtgagccatacgtttaggcacctatatgatcagggcggggggcgcggagactaacgacgaatagccaacacaaagacctacgaatatacatgtgacccgaccccgaacgtttcacatggtcntgcgaggaaacattataactaatataaattctagctanatgaaataccactgcttatcnnatcattcaaagcactcacaatagagtaatagtctccgggaggggtggcgggtagagagaaacggaggagatgaggggntctgttgataggaatagatgacggtgtgtnacccactcgatgtcctccactgtggagacggcgacggcgnccgcactacgttcgtaggaggctcagacagatgggagatctgacttgatctcacaactcgccctattacctgaacattcactaggcgaggagggtaggggatatagttagggaggttatacgatattatgttatgataactgcgttgncatactgtggagccgtaagtgaaataaagtgtacgagatccattgcccctagtagctatgattgcactagatataggtatgggttgatagtggggcgggtgcgtaagagtggtcagattgtggangagatntaaaagttaggtagtggcnaagtgtggattggtgatagaaagaggattgcgaagtagttgttgcgatgcgacacttcgtcaagaggtgcttagttacatanacataattgtacgagagctgcctctgtacaccgagttacaccagaattagtccggaggtaataagacgattatgaagaagagagagttcctgtcgagaaaccagacgtgatgtggtcccatagatttctgtatgagtcgactagccgtcctttatatcaatggatgtctgtggggcagtcgtgttcgtgaaataggcaagagcgcaatggaggcggtctgtgagttactggatgctacttagatttctagcaagtc

SEQ ID NO: 6286 - DNA, 1246 bp, Homo sapiens
  misc_feature (1)...(1246): n = A,T,C or G
ttgttagtggaggatggtatggntagaagagtaggaggagaggtagacagaagtgaatagaaaaggaaaagaaaaaaaaaaaagttaagggggggagcagaagaaggaagggagtggagaagggaaaaacccaaatcacggaaacagtagatntgtgtggcaactgttgagggagaacgtanaagagggaagaagagtgggtgaagtanacgccccaccccaactcgagacgacccgacaccgnccacaacaggcacagcgctgcgaacgagagcgcgaccataaaggacacgagagcgacccagacgatcgccgacatcctatgcacacaaacacaaggacaaagaatacaaaacagaanatcgcanatacaagcgagagtccggccacgataaacacagatacatgcctctcagacgcgctccccacaagagagagagcgcacggccgagagaggggtcacgcgcggcgcagcgtcgcatcgagtagatgatacgcccaagacgccacgagcgcgggacgagaaagcacgcgctctacacgcgcagagaccccacataagtaaaagaagaggagtagggagtgaagacgcttaacgcaagccgccgccgacagaggaacagcaacagtcaagagagaaggaggagagaggagcaaanacaagtgcgnganacatgagaagagtgtgcgaggaataagatnaatagnagaaggacgagacaatatcgtattnataatatacgagcaaccatcaacgtaacctaaccataagttactaatgatatntgcaagcgcgtagggtacgcagttgacgaagagaggaaggagagtgtggagatgcgcggtgaggagaggtggagaactgatagagtgantaatatgcagagtagacacgaagcagagcggacgcactacacgcgcacgcacaacaacgtgcaggcaacggcgcccgcctccaccatanggaacagaggacgacgatacgcaccacancacacacaggaacgctcactggaacataatagagtgcagaaagtaaaccggagatcaagccagacacgagctagacgagcgcgcacccnagcgacgcgacaactataacaacatagagagcacgacacgcccaataatggccgtagcggacgcgacggagagataggcganancaanacangcacgacgaaacatcaacacgctaccgcaagatacgagcagtgcgtgcgcagcagagcacncacagacaagc

SEQ ID NO: 6287 - DNA, 784 bp, Homo sapiens
tgcaacctgaagaacagagaatttaagtaattttcccaagtggcagagtgcagatttaaatcctatcactttggcctcagagtttgtgcttcattttattattttaaattcatctttttttaaaaccaagagacttatgcaaaattgtgctaggattcaaaaaaagccctgaccatgggtgcaggcagggctcacgctgcattttctttacttatttacgtcctgtttggatggagacatgatgacaggagctccctccaccaccgtgcaccagaaaggaaagtgaagagaagcacagggaagccagtcttgccatgtttgagcaactgaaccaatgtcagcctcagcctaccagcacaattaattttaggtgagaaaaacaggcatctccctatttggaaaatcacactggctgcagcagcaaacaatcgtcaagttattcctggttaacattattcctacagccctaatctctacacccacccccccccaaaaaaaaagatgatcctaatgcaggtatttccttttgcattcatgaggaaatggaagaaatatccatatttgacagttggttgggaactgtatttggtattgtgtgaagtattttaatattggaaacatgaaaggtgagaatcctggagaccctatgggcatagagaaaaggaagtacattagagggtgttgtaggaaatactttcattccaggcactgctgtttaactacccccaaacttctttccttaaaagaacagaaaacaagagggcaaagatcaagaacattcctg

SEQ ID NO: 6288 - DNA, 1786 bp, Homo sapiens
  misc_feature (1)...(1786): n = A,T,C or G
aagtttgtgagtntgnnagataatgnntggatggtgngtgtntnacatgtgnaaattttgagagggggggaagacgatagtggtgagatgccaggatgtgtgttnatgtgtcggtggacgtatttcngtgattgttgtanntgtgagttntaatccccnttaattgntacagctcttgtgattnantgacgagtccnaagcantatctatactgacaatatcgtatcgtgtatganagaaggagaagaatacatgacatagagagcgaagcggtgagcggacggaaggacatagttgtgtntnncgtcttgtcatcctnatccgtnncacgcgacgccccacgcgnacggtggtgcangcacacaagggacaccgagttgacnaactagtcaatcacttctacttgactgcgagcgcgcgccgctctcngacggtcgcgaactcttacataggcgcnccgtatcgtctggtgcctaacgtgtgagcacagagagtatcgatcagtacanttctataagttgtatagtacagtctccgggtgcggtccagcgagtgcgcgcgcgccacgctgcacgcctgcgtgaggtatcgctcgactcgcgtgagtcccgaggtcaggatatactcgtgctcgtgngnnnacatacagtaacaccatacgtgacatgactacactcatctcagcacacanaataatagaaanagactcgtgtanttantnaatatagtatgtnagtnatatgtgacattaagaatgnagantgtgtatatacttattatattattatagtgtagctccagtcagtacgcttgcgatacagtcacatatctaatcgtanantgccaaagcgtatcgactactaatgctaacaactctacngcanggtgtgcatgcaccgacgatagtcatngtgtctgagangtgtcagantntcactgccntcgcgaagtacagcgcncacgcgtcgcgcagatcgcanntagancacgactagccgtcaagcgacaccgtgatcatatgagcagtgtatgacanatcataccatagcgcggncgancngttatgagagagcattagatatgtgagtgacacggtcntncntcgacattacacgatacgcatcaatgaatctaatatagctctnctngattcagcgacgagctgacatacgtctactacgcgctacgagagtcatgcgtgatacttgagagtgaactcgtataatgctcgtcgacgctacgtcgttctgtcgtgtcggctatagagtgtgatcagagtacacagtactacacacataagatatagantagcagacagtagatccagtgntgtgtatagngtatttncagagagcaccactataagagagtactgctcacgccagtattctgcgacgtattctatactcgcatgtagagtgagtctcaattctgctgagatgcatccggagcgaacaccgtggacgtgctaagtagtccgcgacacggtgtgtgtgttgtgccacacaccaacagaagagatatcgatgagcgaccggccncgccacgcgtcacggtcgctctctcgaactccacgacacctcgtagatgctctagtttacacacgtcaggtgtctgcgcnanataggagcgacgnatgngtgcgtgcgtggagcgtgntgagcagtcacgcancctcacactgcagacgtnantgacacgcgactagcacactgagcgancnacncnantcgaatcattgagtcgatncatccatcaattgtatctacgcgcgcacgtagccnct

SEQ ID NO: 6289 - DNA, 692 bp, Homo sapiens
gggatgatttggagtggggtagaggtgatggggattaagagaactgggttgggttgggtggggttgagggttatgtgtggttgattgtggatgtggggatatttatgggataggttaatggatattgtggagtgtgcatgcggttttttgtgtagtgtggattagttgtagttggttggttggagtttattggtgttggggggggctgtgtgggatcgggggggttatgtggggaatagttataagcggggtgttggtgaaggttatgtagtgggcggtgggagggtaaataggtataatagagggttgagcgttgcaaagagatggggggtggttggggatctttggggttaaagatagggtggagagggggggcggttatttgatttttttattaaagaaaaatgaattattgtgggagagaggggagaaagtttttttttttttttagggcggggagggttcccccccaatgtaaatttggatttgaggtagggaaaagggattaatttttagtaataatattgtaaaagacgaagggttatagtgagttaaggtggggagaaggttttttttccacctttcaaattttgagatttaggattttggatagaaatgtaattagtgagaataaaaaagagagaggtggggaggtttccgtcgttttgtggtcttttgggtgtgttgaagtg

SEQ ID NO: 6290 - DNA, 982 bp, Homo sapiens
tgtcactttcgcttttaggttgtctcctatctgactttggtttgctgtatcttacattgttttcgttctggtgatgggggtgtgtgcgttcgtattttgtaccacaattatctttgtaatattgatataatagcggtatgatgtggagcatattatccgacgggggtgtctgtgtcgctcacatatactttacttgtcagttgcggaccgcgacatttcagctccttggtggatcacacaatacacatctgggacgttcgctgctcatttgtcgtcgtactggtgggtgcgggtgaccggtgaaacggtagacggcacggatacgggtttcggcaaaaaacactctatttctcagcgtcccctccccctctcaccatctgaatttgtggagtcgttatggcactataccgtctttatccatctgttatcatatggaaataaatgaaaaccgtgttgggtaacaaaacggtattcggcgggggctggactcaattggatgtaacaaaaaattgttctatcgttccttaattgtgatccttgtatgtcacacattgtgtttgttggtggctccattaactcttacagtaaaggtctccctactccctaacgttgaggttgtgctctatagtatcaggggggcgtaaatatcgatggttggtgtgtgtaatctacaatactcgatttgttgcgtaatctttctaacaacgcgagctaactaaatatacgggtgggggatattaggtagtatggcaacaaacatccatgtgtatgtatcgtagactgtttggaaccagtcctcctctatgtgcgattataactatctacggtgggtggctcggggaatgtagttatgttactatacgtactcccttgtcctttcatactatttgtgatctctctggccttgagggcgagccagggaacacagtgaaatcggggggcacgggcgggaacaacaacactagacgcgcgcgcgtggagt

SEQ ID NO: 6291 - DNA, 1405 bp, Homo sapiens
  misc_feature (1)...(1405): n = A,T,C or G
ggggagaatgaagtgggtattaatgaatgaaaggggttgcgancaatagacatctggagaacgaggaacgaaaaaaagaagaaggttaaaaaaggaagaccaggaagaaaagaagagtttaaaagcnccggggcccgggggggcgcgcggccgcccgccgcccggggaaggcgggcggggggggcgcgggcggccngcggcgggccatacagncaacgccccnaaacacgcgcgccccaccgcacagcgaccacacggccgccccggccgggagcgccacccgcagccggcaacgccgggccccgccggggcgcaaccattctacccatgctcccgcacaccgcgaggccacccggtgccaacngcgcgacggcgtcacgccgcggcaggacgggcgcccgtagccccccccgcggccgcgaccagcggtatggaagcgtaaaaagacgcgactggaagagggagcaagcaacagcagatangagagccgagggcagatgtggancacaggtagagcgtttttagtggtgttttataccgatggaggcgcagggccgggagcggcgtgcgcgcgcgggacgcgcgcgtcgcnccgccgccgcgggtgcgcgcgggcccggcgagcgggaagcgcaccaccaggacacgcgcagcccnacagccgccgcgacacgccgagcgcaccgcccggacggcgtgccgtgagacccggggcatccgacacggaagtagcggagcggctagcacagcagccgcaggtagccgacgcggtcgacccaggcggantcccataccaccgcgcttcggtgcgtcgcgcgagacgcncgaatgcacagcagtacctnncaagaacgcgcgcgaggaggcncgcgggcgacgcacagagaagagaggatgagatgatcagnatgtcgtgtagggcgagagcntcgcagcaggtagccgtcgtgnatgcgtttcacgcgtatgcgcntagagcacngnacgcctgggcacgcgctgccgacgcactgagagcgacagtcgacgccaccgcggcgccggccaggcacatgtagtctcgggtacgtcacagacagatggtgagcaagagcncgcacgcgaggttgaatgcacgcgccgcgcacgtcgcgcgcagttcatactggcgcagagcgacgacagtccgcgcggtcacaccgcagcacacccgnaccgcacgcgcacgcngcgcgccgttcatggagtgccggcgaggatactcacgcgcaacagagcgtgtgtccaccgcgctgcgcgacgcagagtgagacgcgtcnactcacggcatgagagactncgaagagcgacgaggacgagacgcgcancgcgcgacggcgcngagcgagagcnncccgganaggnaggagnaccagacaacgagagc

SEQ ID NO: 6292 - DNA, 886 bp, Homo sapiens
  misc_feature (1)...(886): n = A,T,C or G
aaagtgatgatgcgatggaagttcatacgggccagagaagctagtcggcaacgactctcttgattttaccaccgcgtacacgaaaaaaaaatcagagactgtttatactcactcggatgtttggggggaatctctgccccacctcttgtgataacatagtctaaagagttctagacagcctgaacatcctgcagaacatcacattggtcaactccatcaatgacatcatgctaattagacaaggtgaacaaaaaatggctagtgcatttgaggcctctcgtagcaaatgtgcacttctgaaagggagcgacacattgtataattactcctgggcctacagggcctatgaaaactagcacaagcgccagtggatggcatgctacgatatacacaccgaagtgccgctcacttcacagggttgtctgacgccacagagcctatacccttctcccttcggtaagccatatcccccacctgggagtacatgagaagcattagccgaaggatatagctggttatcagtctgttgaaagaaaaaaatggaatgctattcgaacaaaaagtatatggtatagcaaaaaacttaatctcgtgtcctgttagaacctctcttcgcgataactctatcggcagtcgactggaatacgccttcggtggtgtgggggtgtggagacctagtggggacggagtgccgcctatggtgacacgacacgttctgcgcaagctaagaggggacggctnactttggcgaggcatagtggtgttcttggagataaatagcatgtacagatgggcttgcaggaggaggtcgtcttggcggtagctagctcacttagggtatcggtcgtgaggtaataactacaagcttatgttgtacacgccgtct

SEQ ID NO: 6293 - DNA, 2033 bp, Homo sapiens
  misc_feature (1)...(2033): n = A,T,C or G
tgtctgtcgtcgtgtgtgcgtgtgntcgcgtcgtgntgcgcgtgtgtgtgctgtgtggtngnntgttcggtcgttgntcnctctnntgtntgcgngtgctgtggcgcttcgtgtngttgngtgtgtgtgtgcgcncctntntgtgtntgtgcgctctcttcgtcctgtgccgcgtngctcntntccctgtctgcgctgtgcgtctgtgcgtgcncgcgnccgcttnngntcgncgtcgcgtcngggtgcgctctcttcgcgtcgtgttccgncgtgngngcctcntgtctgccnnctcgctggttcntcgtctcggntgtctctgtcgctcttgngntggtcgtctctcngtgngcngcgctgtctgcgtctgtctctgtcggcggtgtctntccggtctcnntgtngcgctggtcgtgtgtctgtgttgtncgcgncntgtgntgcngggtcgtcggtgntgtgntngtgtctggcgtgngtgtnnntcgtctgctggtcgcggtgtgcntngngtgcgtctgtctgtngttgtgtgtgcgncgggcgtgtcgntcgttngtntctntgntgttcgtgntnngtgtcctttgtgtcgcgcctgcctgnctttgngtcgcgcgtttgctncntcccgcnngtgtntgtnctgcgtgctggtgctgncctctntnttctngcgtggcgngtcgntgngctgtctcgtngttnncgcttcgtncgtcgctgcgcgngcggtncgctgtcgggtgtntggcgnncgcgccgctgggtcgtgngcgtcgnggctgtgtcggtggtgcgtgcggggtcgtgtctgcgngtgtngngcgcgtttgcgtcttgtcgtgtgncgtcctgcgctgtgctcgttgtgngtcgtgngncgctgngtgtgcccgctgnctgcgttgngcgcgtcgcgntgctgtggtcgctcgcttggngctgcgcgtctcgctgtgngnnggcgcngggtgtgcgcgtgtgtgngcgtgtncgtcggcgctgcggtggtgtgcgnnggggcntgggtcgnngttcgngtcgcttcgtcttgngntntgtgtgnntctgcgtgtgngtctgcgcgctcggtgtggtgtctcgtcctcctcgtntgtgnngtctctcctgngtgctgctccgtctcgtgnnnntcgcgttgctcggtgtgctgtgnngctgtctgtcgtcgngcgncgcgtcgcgtctgtcgtgngtccgtcgtgcgtgtgctcttgcgtgtttgtcgtgcgctctgcgnctgtgcgtgggtgngnggtgcntctctngncgctgnngggntgtncgtgtcgtcgttgcgcgttggcgcggtgtccgttgtgcgtcgtgtgccgtgtcgttgtggcgtcgcggtgtcgtgtttgggtgtctgncgntcntctnttcgntgattaacnacaacgagaaagagagtatgtgtgtgntgnctcgacttgctggcgtgacgtgtgagggaagtgcgcagtgacgctctgnacttctactcggctcgtcgagtatatcggtatgcagactcgcagtntngagcagtctccttatnaccagtanatagggtngcgactngctcatatgtgccncttcgtcgtcgtgtagtcgtattgcagtcatgctgacnatagtgagggtnttctnagccatgcgagcttctganctnnncctatgtcgcgcgtgtgtgnncgggctcgttcggtgtagcgggtgntgtnnctcggtcctttggctgtntgctntacggtgcgtntaccgtcccttgctngtcgctggtgggtgtagaaggngccgcgcgcgcgctgccttgcgcagtggcgnggnnncnnncntnnnnnngcntacgtntgtgtngngtnnntngattanngtnngnntcgtnctnnnncaagcgnnnttnttgtgngctgngctcngtnnagatccnnagccttngaaaacacagacctctctctctcttcntnttntctctnttgtntggtgagtagagtagnagtngtagacgtgtactctctgtg

SEQ ID NO: 6294 - DNA, 1639 bp, Homo sapiens
  misc_feature (1)...(1639): n = A,T,C or G
gctgcccgtcacagtaacacatcactcgtcacctcctcagctatctcctctcgtaattagcgcacgccaccaacgactcgcgtgcatgtgcttaagcccccgacactccccgtgtcatgcccttcttgtcactgtaaatattatgattactcagtactcgtgctgagctctactcgtctctgtaggttgcttatcatatgcgatatactaagaacgtttatgtacgattacatatatcttactttncacgactagacattacagcccagcgcagcactagacgngccaacctagcagtgatgtgtcgtgtccttacgtgcacacctctctatgacgacagcgtcagtatnctctgtcgctcgaacaaggtacntcagcacgcgncatgngcgcgccgcagtgccgcgactgcctctagcacgttgatggtctatctaacatctacacgtcgcagtagtgcantntcagtaactagancaacgcctactgtgctaacgtaggttgctcaccgagatgcagtgcgagagctnatagctccgattctactcagtcacgtaagtcgctgcgcgcgctctcgcctgtgtgtgtgnccactcgcatgtntcatgacatcacagtggccaggcggatgtgatcgtatgcttaganctcggcacctcactctgtganagatcatgctcttactcgcctgtgtgtgacgatggactangtactatatctatactcctcgtctcacgcgcagtcacgtgatatgcacatcgcatgaccttctatattcgtcatctaacgtgctgnttcactgatttatttaatagtcacatgtntgttgcttaacactcatcgtagagcttcnggtcggnatcgcgtctgatagcgcatngatagtggattataattatcaggcgtagagtaagtagacacgatatcagncgagtgtgagcgcgatgcagtgtgtcgacgacgatataaacantgctacttgtgttggttgcgtaaactctatatatactggtgatatggncgagatcagtactcgtgagtgtcgtcactgtatgcactccgcatcatcatctgcttatctctagtgtacgtgagactacgaggtccatatcattctacgcatncgcacgctactggtgcagcgcgaactaccgcacacttggttgaggtgtgcgcgacntcgagnacggtgtatcgctttantaacattgcctctcatactatagtcttaatgtctgttcntcacgtatcctttgcattctattctcattagcttatacgacgtagcgatctggctacttggtcagcttcacagcgagcgatagtgatgcatttgtatgatacataagcataatatcaacaccagaacgcacttgtctgatgtgtgatatatcgtgtcgctatgtcatgtattcactgcacatccgagcactattcaactacagatgctatgtgtagtggtagtcttctgtagctacttgtatatcgcctatcgcttcgtgtatgnatggctcgcagaccgctcgacgtacgtatctctacgtatncattcgacgcatcgtatacacgccgctctctatgtgtgagtgcgaagcgcacaactgtaatatagaggtgtgtgtataaatctagaccgcag

SEQ ID NO: 6295 - DNA, 1333 bp, Homo sapiens
  misc_feature (1)...(1333): n = A,T,C or G
gggtggagacaggaagccagacccaagagacgaggacagnaaagacaattcggtcgtagagngacccannanaccagggccccttacgncgggaaacaaaccaacccacccaggacaacaccaccacacacaacacgcagccaccgccgcctcgagaaggagagagaacagacaaacacagaaccacgcacacgacaggccgcgcgtgcccgcgacaccaccccccacgaagcaacggcacggcccccaccnccacaggagacaaacagaaacaaacaaagcagcgaaaggagggaggaggcaacacacaacaccgaccacacanaancgcgggacggacgccggcaaacagaacaaaccacgggcccacaaaaccgcccgggcaccacctcttacccaccccgcccggaggcgacacacaacacaccacacggcgggccaacaaacancacagaggaaaacaccggcgggacacggacggacacaccccggggacagcatccggaaggacccacacaagagtgggagctagngagaacaacggaaaataacgaaacaaaagcggggaacacacggggggaacaacaaaacgngaacaacaagggaagaggacacaacaaacaggangcaaaaccgcaacgggcaccaacaaccgaacaaccggacaagacaacaaacacaagcaacccggggcgcggcgacccacacaacgccacagcgatacactcggcgacagaacaaaaagggacaaaacgggaaagaccaaggactgcacaacacacacaacngccgacaacgcgggggggatgggcggagactgcacaggcgcganacacataaggcgaccgcccgccacccggggcgacaaacacaaccaacaagcgacaaacaacacacggcggcagataacggcgcaagaccgcggccccacgacaaccgctgctacgcacacaaaacacacaacagcaaccgatgngcgaggcggagcnacacaacaagaaacaacacaacaantccccggaaaccaagccgacgcggacacacacacacgcaaccacacacagcacacaccggaaccactcaacgacgcgcgccaacgccacacacaacacaagggcgcacacaatacaggacgcggcccaggacactccaccactcacaccaccaggcacaacaccaagaggnacaacagaggagcgggcacgggacacacacacaacacaaacacacagagcgcngaagacaaaaacacaaacgcgggcccggcacacgccgccgaccagcagcacagcgcgcaacacagcggcacacacatcagcgagcgccgacaaag

SEQ ID NO: 6296 - DNA, 1115 bp, Homo sapiens
  misc_feature (1)...(1115): n = A,T,C or G
attattttcgcatctttgtacgcgagacggaggaggaaaagcctaattgggagacgacagcgaaggaaccctccgcgcgctgaaaccgcggcgcaaaccggttggcataagcacgagtgaaaccaatttttcgggggactctataagtttcttcatgttactaaattcttacccatgacatcgtcttcgtcacctataaccagacttgactgtggaatcggcgactataccaacgtgtgtttcgtgcgcgtaccacattgtcacactctgcgaactatgcatgtagtgacttgacaacatctccatgaactgtcatagtatagaagttctatttttttttaacacttctacacccaagcancttaatagaggttgtactttctttgtcctccgcgtatatcatctatcgcacttgacgtgcaagcagttatgtttgttttgttatattggtatgtatctccgtacctccagcaccgtcggttcaccctcgctgctgtcactgctcatacattcatcttgtgtatattctcttgcccctcacttaccaatagcaccactatatagacacttccttatgatttgtacatgtctcgctctctgcctgcatcattttctccgataacttcatgagtccttgcgtgcacaccctccataatcggttctcctcatcgtgcgcactgcgcccacttagtacctcccgagtcctcctaggaccantataccatgcctctcgaccctgtctagttagctagctaccgtgcctggactatatacacatctatgtctccataccagcatctcttaattccagccactcatcgacaggatctcaacttgcaatgtgcctgttctcacgcgtcaatctaacttatcttgacctgtgtaatggacctactcataatgctttcaactcactttgatcgttgttctgctctgtgcactcacgaatatacactatcaccagacaataagatgcatctatactaatctatttcctcattcgtctgcccacccacaattgttctcgttaggatatggcgcatcatacatatcacctattaccgtaatctgcgactgtataataccctaatctatttagttgctttagcatttgg

SEQ ID NO: 6297 - DNA, 1051 bp, Homo sapiens
  misc_feature (1)...(1051): n = A,T,C or G
agtagagaaggcgcgnnnnnnnnnnnnnccccccggttgttgccaacgaaaccccaaatttcgccctgattctttcgagaaccaaaagccagccaaaccagccatttaccagggcggctgattcaccccaagtaaacgggagcccccctataggggttaaaacaaggatgtgttttttttttgttaaaatacagtggtaattacacccgggttacctgcgggggatgccggtataataaaaaaaggcggacggcggggggcttttctgttgggggggggtggtaccctagccacgagcatccagcggacctattnttttaattttacagcgagacgaacgcgcgccctcccacagaggggagggaagaacaaaaaaggnggtgctcttcccaatacttcacaccgcgccgcaagacatctctttattttatagaatcgccgggcagacaactctaacgaggagagcatcttaccgacccacttctaagttgtgagatcctgccttgtgcaccaaaaggtcacatccgcgataagaaaatctttctcggcgggggggtggtgtttctctccctcccgggctgagaccaccaaaaaaatgagggggtgcgacttcttgccgcgaccctgtaccccttataaataaacaagaagaagagcaatgtggcacgcaaaatatacacgtctcgccctgcgtctatttcgaaaagaaaacaaaacggttggcccccccacaccaaccaacacaagagcacacttgcggctcctcctaacttataaaaacaccgactggtgtcgggtgttcgttcatcacgggcaccccatctccccttctgtttgtagtcgacacccacacctcccacctttaatttctaccacacccaccagaaacgcccactaagngcccgcccacttgtattgctttcctcaagaaacaaccagccaccccccctcccaccctatagagtggtgatcccatgctcctcacacacccacccagtcgagtctcgcacgcgacgttcgccaccccccccgacatacagttcgtataaat

SEQ ID NO: 6298 - DNA, 1162 bp, Homo sapiens
  misc_feature (1)...(1162): n = A,T,C or G
cttacttgattgcttcctcataaannnnnnttctcacaacaacacaaagcgccaggggttgtccccaagaaacacgcgggaaaaaggtccctcgggcgtggtttccggggacctctgggaaccccacaaagagccgtgggatcacgcgaggctggtggtgtgtttccggtcgataagagggacgcccccaaagtcgcccgtgatacaacgcagtatttcgtttattttcttatttactcggacgcattttacaaatacacacgggtttcccccagcgcccttcccgtctcatgctcgtcttgataaattgcgcacttcccgctcgaatagggccccaattattcttgcgcgcgtggcggtgtattagacctgcatatcccgggaaacacctccctttntgaacatgggttactgtagattcatatgtgcgaaatcgagagcatccacacccacacccaaggtgggttcgtaataagaaaagagtgcccttgttgtgcttgtagcctcacatcaatgacttggatattatataaggtagggacacactacacgcttgataactcctctcagcgcttttagttatatgctagtgcacagagataaataacaaccctcttcacccccatttatatagacatatctaccacccatccgttgtcgttattgttctattccaggctcccgtgtgtatacatactatgctgtcatcatctgaactgtctacctacgcgtacaacaaactgaagcagaacacccgcgatgcctatactccatgactagaccccacaccgttccgacgttgattatgttataccccatatgatcaacaactactccaccgtctctttacctgtatcaccattattatgtatcgactgccgcgcatacacgctgcctccttcattgtatagccgctactatgtcgtcggtgtataaacctcatctagtaatactactacgttccctgatntacaatccgcacgactctcagctgatccactctccctcatacgttcacagtagtatcggcgactcgacctcgttgtggtctatctctataaatccttacgctacatctcatccgtttgtgtgtattccgcaacccagatctgcggattgcctgtccgcgtcctgctgcatatcaagcagaacatatgcaatg

SEQ ID NO: 6299 - DNA, 1249 bp, Homo sapiens
  misc_feature (1)...(1249): n = A,T,C or G
aatgaaagganaagagggggagaaaaggagagggaagggagagggntaggagagggaaagggaaagaggagaaaagaaaaaaaagtttaaaaaaaagaaacaagagaaaaaaaaaatttaaaaaaggtnccngnccccggcncgagtctgcggggcacgcgcggagagtngggggagaggggcggggggataccgcgggtngacgcgtgggaagaacccacagcncacaacaccggccccccagcaaaaaggcccccgcgccgcccagagcccccgccaccccaccagcaaagcggccagcgcccccggcgccccgcagggcggccggcccacgggcgccgcgaggcccaggcgcccgcacacgccggcgaggcgcgccccgcgaccgcgcggcacgacccacgcacggcagcctcgggcgggccgatggaggaagggtgagaagaagaggaagagcngcggggcagagggaaaggagcagacgccgggctgtgttganatgcctatcgcgaactcancgcgcccggagacgcgcgcccgctggcacccacagacgcgccgcccgcgcgaggtcgggtcgtcacagccgacgcggacggccgtcgagcgagccacccgcccccgcgtcacggcggagccacgccggggcggggcggggcccgacctgcccgaggatctacaagactagtaatagcaggttcgacagttcacagtggaggcggaaggaaaggcgaagggcaactggccgagagacacgctcgccgcccgacagccaccggnagaagtgaggtaanttggcctaggactgacgacggagaggcgtagcgggcgggaagtcgaggtnattctgacaatatacgataaccacgacagcaggnctggagggagtagggatcgaacagagcttcaccccgagacgctccgcgcggcaacacctaacgcgagaccgctcccagcgagcgcgacgtccgaggnggngaccgctccgacgcacggcgccgcgcggcgaccgctcgcactgatcagacggcagcggcgcacacgcgagaagcggacgcccacccgcagccacgggcacacaccgagcgcgcgccgccggcggctaggagacggagagcgaagcnaccgctgccaatactanagacgagatcgcgagacgagaagcacncagcaggtaggggtagagagcggagaacaaagacgaacgaagacaggtcccagcacccacagacaaagcacaagaaggcct

SEQ ID NO: 6300 - DNA, 813 bp, Homo sapiens
attgtggcttatctgaattgtatgacccgactcagatgtgtatccgattgcgggtgttatcggacatggattgtttttattaccaaccggggttgatggcgtcaccgtcgccgtcatcctgtatggtctttcgacttgttcgcatccgttcctggcgttttaataactcggcgcttccccgcgcgttgctcattattatctctgaaggggcagatctcccgcgtatcaattctatcacgagcggggtcctgatacgtcatagatcgaacggtgtcggggttgtatttttgatcgttgcacgaccgctaagtatatgtaaaagctaactcgagagtgatactcgggcgtggccgccgcaccgtgtcgtcggcgcaaaagatatggcgtagggagtcatactactagttatagatcccagatgcggttttttatggggccgggtttatatggttctgtcagtagagccttataattgggactaataaggtgatcggagatgtgaactaggggatacacgggctattcggggagaactgcaatcgcctaggcgagcgtagctcctaacccgtacggaaggatgtatctgtactatgtagcttagaaaccgtcctcatctctcttagcgtagctcactccagtcctaaaaaaaggtccttccacccattccgcataaggtttagttttagttaggtaaacgggtagtgaactcaggtgagtgttgggtttgccgcttctacaggagtggggaaaggtctgtgcagggctttccgctctcacggctgtggctcccctcctttccctctttccccctct

SEQ ID NO: 6301 - DNA, 1093 bp, Homo sapiens
  misc_feature (1)...(1093): n = A,T,C or G
agagtacgtatatggttaataggtcatcggtgtaagagatcatctgcgaggggtagtatgtgtgctgtcacggtgcctctcgatacggatacttaagcggcgtggagactgcgtctgcgtttcggaataggtcggcccgacattgctagacgtgaggatactcttcggtctagctagcgcgctgtgtcttgcatgcatccgtattggaggagctcgctgggtcttgctccctttactcatgcgctatcgatgctgtctttaagttcgtgtaggcttgtgtgtgtgtggagagatcgtaaccgtggcatttcgggctatcttagtacggaggcatgcgtttctccaataactctactgcttgattactgtgtttgtctgataaacgctgactctatgttatacgcaaatgtaatgttatgatacacccgcggttcgtctttggcctacttgtttatgtaccggctcacccgttgtcttgtaatatccgcgtacatttgtaaaaaatctccggcgaggattaggtgactattgccagtctaccttgcttccgcctgagtgtcactaagaagtatatgtttaataacgcgctatctttattaaatcctacgcacactcgatagacgcaagtcggatactcacgatatcaatggtaagtgtataaattatcgtttggtaccgaccgagtgtacagtcacttcgtcgccacctccgcgtagcaataagaaaaaatatctcgcctctcgattctaccgttgaaggcggactcgctattctatgttcacgctcctnggcgctctcatagccacgtcagagtagttacagcgacgacgttgtgcagcgttccatacctaatcgctcgcgcgtctcatatacgcagggaccgaggcgaggctcatcacgtacacaaagggctactgtcgcccaccctccacacatcaccgactcatgacgtcctggttaaataaaaagaatgaaaaacagaaaagaacaaaagaaataaaacaaaataaaaaaaatatatcgcaagttcgcgcgccgaatcttctcttttctttctactcactcacattcccgaagaaatttttgatgtgtg

SEQ ID NO: 6302 - DNA, 1194 bp, Homo sapiens
  misc_feature (1)...(1194): n = A,T,C or G
tggttgttnggggtttgnnngttnnnntagttatgttggtgtttncttgtgtagatttttgattagattaatattaaaaataaaaaaaaattanaaagaaagaaaccaaaagagaaaaaagggtaggggacncnngcnnccccgtcgcngganagtatgtgtgtgtgtggtgtgttttttgtcgctgttgagttgatcatttttttactcttcttcgtttgaggcccgcgacaccctaaacttcatttcgattcctcccgcccctccgtggcgctctttcgggtgtccctttatgctgtatggatcaagccacagattatcttcctcgttttacgtcgtctcgcttctctctgttatatgctgttttctatctattctttctatatctttttctgttgttcttttctttctttctatgtgcttttcttcctccttattcgtncgattgtgtcagttgtccgctcagcatggatcgtgaganaaaatacgttgttgtanggcttangagtgacaggtattcgttgttttgtctctattctccgttggccccactcctacattctttatcccgctttgttgcttaactttgttacgtacggcgtacgtagtgacggtctgcgcttatctccgtcaccntctttactctctctccaccactaaccaaagtggagacgtcgggtgtgcggagggttaagactttgattntctttttatttagttaacttattggtgttngttgggtgtgctttgtttgatgttcttgctggtgctggcgttattccctctctcttttataatttattttnctgttgtttcctggcgggttgttgcttttgtgttttgtggtgttagtgttgatgtggtttctattggtgtgcttggattgcagtgtcacgacggtgttccgccgtctttttgttatttctcttagttgtgtttacctgtttgtttatagtttctcatttcccgtcttcctcatcgctactatttctgtggtgcgtctgggttcttgttttggtgctgtgtgtcccccttgctgttctgtgttttcttctcttttattgtttttgatgttttcgtctgcctccactttttgtattatcctatattaattttgttcccgcttagtggtgctttattgtgttggggtgatatggtgtgttttgaggacgctgtataggcgtgcggagggcg

SEQ ID NO: 6303 - DNA, 1451 bp, Homo sapiens
  misc_feature (1)...(1451): n = A,T,C or G
tccccgcctccggcggcgcacgtgcgccgtctntgtgtagcgaggcggtcgagcgcntgcggtgcgcggtccgtccggtgtatccggacggcgcgtcgcgccgcggcgccgcggcggcgtgtgtggtggacgcgtctgcgcgcctcgtgtggcggcgctgtgtggtcgcggtgcgtggcgtccgcgcgcgcccgcgcgggtnggcgtccctggtgncgctcgctcgtcgagtgtggtcgccgtgtcncgctctgatgctcccccgcagctcgcgtgtcagnggcgntgtcggcggcggcgcgtgtccgtcgcgcggtgcgctgtgctcgcgctcccggagcgcgcggtcgtcgtngggcggcgcggtcgcgcgggcgcgctgcgggtcgttgcgtggcgtcgcccgttgctctaggcgcttnggtctcggctcgcntgtcggccgggctcgctgtgngcggtgtgtgcaggttcgcgcttgtcgcggtcgtgccgtgtgtcgtcgtggagctctctgctcttggcgcgccgtcgcgtggttnaccgacgtcacggggccgcttggctggncgtctgtgnggtcggtggagctctctgcctgttgcgcgcctatttgtcattgtgtggtcgtgtcctgcgagngccgtggcgctcggctgtcgctctcggggctccgcggtnggctcgtcgcccttcttcccgtcgtgtcgccgcctcgttgngctcgtctctggcagcctctccgctgtctctcannaccctcttgccgcgtctgctgtgtcctctcccgcgtgtngcctccgtcccgtcaccctgtggncgcctcctcgcggtnggcagcgctggtctgccgcctcctcgcgnnccgcgccgtgtctcccgcccgggcgcgcgcgcccgtgtcggcgcgtccgcgccgcggcgngtngcgtggcccgtggcgcgcgcgcgcgngtcggcggtggcgcgtccgccggtggctcgcngggcgcccgcctgtccttgttctaaaaacaaaactgttcgtggtctctgntcgcgccttgcttgtttgctccactgctgcccgctgtgncgcctgtgtgtcgctcgttgagcctcgcgggtagttctcgctgtcgtgtcggcnncggctcttggnggcgtggtgcgcgctgctgctttggcgtgtcgtgagctttgtcggtgtgggcctgtntaccttcntgtcggtgagcgcgctcgccctgcgttgtctcgcgtggcgtggtgcgggcgcttctccttctcttcccccctcaaaaaagtcgtgctgtcttctcgttnctgtnnntctnnnnnncggggngcgtnnnggctanaanaaccncnnaaaancnttggtggcgccngaganagttcngtcgggaagccaaacttctcctcttttgntnngtgtgggtggaagtgtgttgtggctgntctcgtccgtt

SEQ ID NO: 6304 - DNA, 675 bp, Homo sapiens
  misc_feature (1)...(675): n = A,T,C or G
gccaatgggtcatgtttgggtagaaggtgacaatctactgaattttacagattccaggtgctatggacctattccatatggactaataagaggacgaatcttttttaagatttggcctatgagtgattttggatttttacctgccaaccctaatgggcccagatttttttgatgattagtnagcattgatttatttagactngaatattgtctccctttcctggaaatttaatcccctccgttgaaaccgtgttcttaccaataaacctggaatgccggccttttaccttttantaagggttaatctcaagatccttcgctctnttacataactactcctccttactctcggtttccagagaaaaagatatcaattctccctcaaggggcggnaatgccgggttttccccacgaattcgggggaaataacgcgaagaaaaaaccatatcgtatccaatgggccagactaatttgacatgctacccgagagagggggcctnttagttggcggctttcaactaggctatccgccgtcctgntaaagccattctactacaccgcactctctagatctgtacgctgccgtaccctcatcacggtctttagcgagttcccaggggtggctccgctatggaagcactacttantccgcgttaatgtgnccacacatatgcg

SEQ ID NO: 6305 - DNA, 1094 bp, Homo sapiens
  misc_feature (1)...(1094): n = A,T,C or G
tgtgcacttgagntctgcgcctaggtaatatagcggaagcatggagaagaggttccgcctctgagcggaagtgcgtctgtatttttcgcagtacagaaccccggcgcgtgaggaggcgcgaacactgcgccaaacctcgactcgatgattatatgattatgttcgactcgcgcgccttcctccgccgtatggcgattcggcagacacggtacgtcgtgttgtccgcgctcgcgccgtattatcgcgcacgcactagattctggcgaccattaccatatttccgcgtgtgtccgtgcagcgttgggcttgacctggtgtagaccacgcgtgatgaggccttcggcttcggctatccggcttccgtggagtaagtggatacactcagggtaaatacggaacacccaagtatgtgaaatacttgccgtgaaccatggacaggacggcggacaggggggttcgctaacgggagaccatggggaaatcaatgacaacaaatggtgaaaatacaacgacaccccatgggggggtggcaacccaacgggcgacagaggggggaatcggtggaaaacaaaatgacaaacaaacacaaatgctaagatggtggaaaagaatggggcacaacggtgcagcgctaatacaggtgggggagtgggaccacaatatcaaagatagaaaggggaacaccatcaatcacacacttaacagggggtgaacacacacacacgtgagtgcggtgacaaatgacaaaggagggggagaagtcaccaacacaaacaacacctgtggggggtacaccgttcgcactcatcgaccgagactctcaataacaagggtgtgggtactattccacctcgacacacacaccgcgccgaatggcacggtggagtgagaggaaagtggataacaacaacagggcaaaaaacaataaacccgcggtggcgggggcggacgcgaggaacatgggcacacaccatccacttcccccctcatcacacctcgggctctctcatgggagtgagaggaagaaggggcgaacaacgaccaaagcggggagagggcgtgctacatcactatgaacccgcgtacactgtttg

SEQ ID NO: 6306 - DNA, 1174 bp, Homo sapiens
  misc_feature (1)...(1174): n = A,T,C or G
ctaataacacatacacataagaatatattcggtatcatcggcatacagcgcggtcgccacacgacaacgactaccagcttctcctacgactctcagctgtagtctaaatatctgcattctgtggaggtgatctgtatgggcgtctgtctgcagtccaattactataatcaccgcgtctaagtaataggtgtgttcgtcatcagtgtgcgcgtcactgccctcgtcggtgcgtgctcgtcccacatgctccgcgcgcgactccgccgtcaccacatctgcgcgggcagagtacatatcgngcnttagtgtgagagaacaattacatgccacacaccctctacgacagctactatggcatatggagagcatgtctcaaaactcgcacctagctcctactcctcgcgctggatcttcatagaggtgctagtaaatataacgtctcgtcttgtcttgcgatcaggggttgacatcgttggtgggctaggctgtgattcgattaatatgacccccgactccggacngacacatccgtgcgcacccgataaactaaaattataaatgtgccgcttgcctgtggtagactagatgaaacaactctcggtctgagtcgtagggactatcactacttcttcaccttcacggcaccctaacgctcagcacatcacggggcttcggtgcgacgactactccttcacacacgacgcggtaatcaactccaatggtgatggaaattatagtaaatgtcgaactgggtgttgtgttataanattgtatatccccctcgtccccagtgtgcagctcgatagtagaactaaagatgtggtgatacaagaanagtgagtgggtgggtataagggcagagaccacaactctattatatacgtgtgtcagatgggatggcctttatgttctatgtagtacgactctctacagaattctactattctctttcttcctgctattgtgtgttagggctcgctagaatatatactttcgatcgtgtggtactggtgggtattcactacactggatagtggtacaccctatcacggagggctgatggggcttagtggtcgatgcgccgtgcacgctacgcctgtcacacctcacatggttcgcatcggtgaggagggaatatgtactatacttgcatgacggggggctaaccaaatgg

SEQ ID NO: 6307 - DNA, 898 bp, Homo sapiens
  misc_feature (1)...(898): n = A,T,C or G
cgtcctagtgaggatgaactgcgaggtggaaagtacgatgccgataatacgttaggagcatatgtggaaccgtccctccgtcgcgctctgctgcgacgatgtagcggaagatagcgttaatggtgtggtaccgcatatgaaaacgagtgaccgccgatcttcgcaatatgggtaccgcgagacctagtacatcgtgataaaaatcaatatcaccgttccgagaacgacataacaagcaaaggatgcagggagatgactaaacgacagtgtagggagcgggtgttatatgttatatagtctcatgtgcaatagacggtgctaagatgtcttatagatatattgcgtgagctcaggggacgacgtcgatgagctgtagtggggatcggcggctctgttttgcatagtgaaagcggacactttccgaggacagtaaataatagaagagtaggagaaggagaatataatagacgagaagagaaaaataaatatatgaaagatatagtactaaaagtggaggagtgtgttacgtaacggaataatgtccctaattttgatggtaaatagtaatgcgctactatgtggcggcggatgatactctttttttgtattgtttatagtgcgcgtggtattcggtagatgtattacagttgatttatcttctatttattatatttctgcggtcgtcgtcctccatcgccctccggagcaccatcaatcttcgcctccccctggtccaatctatacccaagattatgttccttctttttttttttttgttctcttttatatttattcctttctccttccacctccccagccacataaacatataacataccacaatcgccaaatcccttccttcccattttttttctcttttctctnnnnttttataaaa

SEQ ID NO: 6308 - DNA, 934 bp, Homo sapiens
  misc_feature (1)...(934): n = A,T,C or G
cacgtgtggccatttggatcactgattctgcctacaaaacaaatagggggctggggaatttgagggccaaacaaggagggagatgcgtacagagtgcggtgacaggtgacgaaaataggaaaagactcgagggaagagtgcatactggaagtcgaaaagagggaatgcattaacctagatgactggtaggaaaatgctgtcgcatctgaatgagtgtagtctgtttggggaggcgcgactagagtaagagaagggaaatcaggatagaccaagtatgagaggagactcaggaagagtagtaggacgagggagagtgtagagtgatccgcggacggataacagacgggaagctgcgagggatgggggtgtagtacggtataaaccgcgtgaggctagacgacggaggcaatgagaacggtatagactagcagaggcgagcggcgcgagacgtaattaattgaagtgaacaaggaagtaaggagaggtgaaacaagacgagcagtaggctgtccctcgcccctggaccgtgcgctagatgtataaatcgatctagtaggtacgagggtcgcaagaggtacaacgtgtgtaatgcagcctgaagctggaagaaggaggcaacgtggggctttgtcgcgagggaaaatagacaagaagagtgggagaggcgaggcgtgaggacgatgcatgggtggatgttagagtgaaaaggactgagagggatcggtaaggttgttagacgggacgatgagtagtagtaggatgnatgggagccaccggcttgggactcaaaatgaatcacacacatgtgggaggatatggtgtgttaggggggataatgatgagagaggtgttcatgattcggtggtcgtcgcgggggttgagccggggaagcacccagcgaacatatgggagcaggacgaagccaagtactacg

SEQ ID NO: 6309 - DNA, 904 bp, Homo sapiens
  misc_feature (1)...(904): n = A,T,C or G
gataggtatggtatgaagggatgaagtggagggggggnaggaaaatttaagctgcacggactcttctggatagcattttggcaatactgtatcaagaactaaaactgaatttttgacgcagtaattcggggtgggtgtgtgcaatctaagaaaacaaccttaaatatggtggaaagaactataatgaagttgtttattacgctataattgtgataaattaaaaaacaacactaaatgtgaaatgacaaaatcaatgctattaggcaaactgtactacacttgctgggggaggatactaagtacccttcaaaatatgtaattatgaagcctggacaatataacctgtcggggtatcatggaaaaagtaatatgaaaaggaaaaaaagcatatgaaaaattatgcttaagtttttttaaacaaaagctaagaaactttattaaaggggtggcacaaagggcgtgatgggtgacaggggagggactgggggatgttgttagttttttacgggctcatatcaggagggagaggtgacgtaatggtggatacaaggaaggcggggtaaagggttggaggaatgatacggcgtggaggtgttgccggggaggcagggggtgattgtaataagtgaaaaggataacagtgtgtttttagggggggagaggtagtactgggtgatggcattaggggcttgtggacaaggttgcggaagtgggtagctgattcgagaggcattaagcgggtcgagagatgagcaggggggggggtagggaggaccagagggggggaggcaatgaggtccaggagggagaaatagcggggtgctgggggatagcgatgggtgagggacttggggggttggaggttaagtgtgagatgggggtgaaagaaaagcgagtgagggag

SEQ ID NO: 6310 - DNA, 706 bp, Homo sapiens
  misc_feature (1)...(706): n = A,T,C or G
aaagcaagggggggtacaaaaaactaaatctcaacacntttcttaaaaaatcattctctanctaacannctttcaaaacctcaatttncaaaaataaaaccannctttcacncttnaactaaattataccaccaactttcctaatttcccanttggggggggggcatcacaggacttctcaccctacacaacattaaaatgaactgggcactaagaagcagagggagcgtcaccggaacaaccaaacaaccggggagctggctttaataggataaaagccagggtttgcgaaggagggaatactattgttggatccttggggagggagttggtggggtgggcagaggggatgtgcaggggtcatttttgggcatatggataccggggtggggtacgctggggggagagggcgtatcatgggcccctgggaggggccggggcgctgtgggagagatgactgggggcgtaggggtgagggggtaagtgctggcgctggggtgggggccatgggtgcttaggggggtcaggtgggggcatgaaagcccgccgttggttaccgagacctggccgggtatggggggagggggtgaggggagggggctaggcggagaggcgggcggctgagggggcgcgacgtgcggcctaagagggcgccgagagctgaggacgagggcggcgaagcaggcagaaggcccggcggaggggg

SEQ ID NO: 6311 - DNA, 998 bp, Homo sapiens
  misc_feature (1)...(998): n = A,T,C or G
tcaatctggagacgacgtctcttaatcctaccaccggctcaacacacagnnttctaccatagacaggggggaggaggggacttgggtaacaaggaggctagaagtaaattgtgataaccaagaaataacgccttgggagcgtgtaaacagaggtggagcctttcctctcgcacaacccaccgaagagtatatctacaggtcgaaacacgagccatagcgaaggggtctcaggcaggacagccgggcatacaaagactaggagtgtcctctattccccgaggaggggaccgaatatagtgtgccgccgcgtagcggagcgagtatgcgccaacgatatcggggccggcgcgcaacntgagaagagtgcagtaaaggaagggtggtgggggggtcggagatagcggtaacagcacgcgagacgtagatagacggtgcaaggaggacaagcgccgtgagacgggagttagcgcagagagcgaggtaggacagtgggggcgagctgaagggaaggagacggacctaccgacaccggcgcggagcgagggcggaggcggggagggaggagcggcggagaggacgtggcgggggcagcggaggcgggacggagctagaggagagcgcagataggcgcagttgagggatgaggcgcggatgcaggcgacgacgaggaaaggagtgcgaagccgcacaccgctgaaatccgatctcgcgaccgtcggaggctgtgtgatgtgtagtgcagaagatatcgtacgcgcggaaccggcccccagtgccctgaggagagggcggtgaggcggacgagaccgaggacgccttcgctcagactcgacaaggagaggcgcggcgagaggcggcgagcagcccgcggcatagcggcggataggccgccgacacgtcagtccgacgcgaaagaggacagaggagagagaggatgtaaagatgtgactataatcacagagtctaggacgtggacgatctggtagttggtatgtggg

SEQ ID NO: 6312 - DNA, 271 bp, Homo sapiens
cacttttcctgctttaatctcttcaatgcccaactcatagataagtgttcctaaaataacattctcaccatgttgctttcctggtcaagaacctacaggctctcctcatagattactgcatcaagatctcaatactcagctgggcatgatggctcatgcctgtaatcctagcactgtgacaggtcgaggtgggtgcatatcttgagcccagggagttcaagaacagtctgggcaacatggcaaaaccccatctctaccaaaaaaaaaaaaa

SEQ ID NO: 6313 - DNA, 855 bp, Homo sapiens
  misc_feature (1)...(855): n = A,T,C or G
cacttgaaccaccccccctttgcccccagggcttcccaaacacccccgcgtctgggtccgcccccaaaggatctcctccctcccgaggcgcccaaatgcaaacgcaacacctcgttaatcacccaaaccccagattacggcactctcttccttcttctccaaccctgcggtgcacggacggggttaaactttaataaacacccctttttcccccaagccagaattaaagaattaatcctccccccctaggcccaaggcccacttaatatgttgtaatgctatacacgttaagcaatttgatattaatagccttaaaaattaggtgaatagtaccatataccgcgccataccccctatggcttaaaccgccaaaactgaccaagtgcataatccaacccaatattactatgcaaaccaaaggtgtattagggagctcaattatgggtgagtttttaaaatgtaaaaaatccctaattttactcacatgtttatgttcttatagttctntaaccattattttcctcttgattataaatttaccccctatggaaaatgtggcccccacagaaaaatatataatgggaaagnaaaatcantgntgatcccccccccacaatgatagtcactcaatgtatttccaaccaaaacattcattcaaacaagacaaggatcatagctgcatgttactccattgtataaagctgttatcatttatttacccaattgcctattgttggacatttaaataattctccccccccccctaccttatgntgaaatgaacattcttgtacataaacttttatgtatatcctctgattatttccatcaaatacaatcctgtatgcngnccag

SEQ ID NO: 6314 - DNA, 956 bp, Homo sapiens
tagctggtatataaaacgaccccgcagacgtcaagaagaaaaggctaggcggcacagctctcttatttaccaccgctacccagattctccttgagaaaaccttggtggtgaagggcaggagaatatgctacccccagaattcgactatggcataaggattatcttgagctgaagggaattgacaagaagcacaaacaggaacagctgcctgccctctccctattagcctaacagcaggaaatgactccacatagatgtcaactcaaataacacatgccgtcgcggaagaacagtatacctacataaggccatcgctctcttctcctgaattgtttgccggatccaagcccacttcttgagtcccgaacaggcgtcctagtaggtggcgagtcttactcgccctccctaactccctacctcacgcgtcaggcctcttggttttctcacctacgaagtgatgttggcggtcgtggacgatattttcagcacccgtagcctctgattttgtgcgtttgaacggcggtgtccagtggcatctcttcagcgtgacacggacgcggcggactcgcgccgctctgtgtcactcatttatgtccgtagcgcagctatagtgtagattgtacaacttttacggtagcgccgcggaaggctaacgcgccggcagtgcggcacgcagtataccagcccccgcacagtcgcgaagcttgctcgggactcacgccggcgacgacagaacaccactacgcaaacacacgtaatcttgggtctaatctgccgctccacgatcaccgacgatagctaggcgctgtcgtcctcatcgggatctatcaaggtgaatacacattatgtattgcgagcaccgcttagtcaacgccagggcgccagacgtgagactcgagcgatgctgacaccatagagcccgcaccgtagtcagtggacgacatgatcgcctacag

SEQ ID NO: 6315 - DNA, 1833 bp, Homo sapiens
  misc_feature (1)...(1833): n = A,T,C or G
cggacaggtgagactgctcgttacggcagcgatagcgtgncanaatagcgacatcgcgacgtgacgcgcacgcgcgtttacgcaagcgcgacagcgtagatctaggtgctacaatacgcagtgtgtgctncacagtaccacagcgtcgcgcacgctgagtacatatcanccgcttgccagagtcnctccangtgtgacacagacgtnacacgagtagcagcgctancgtcgagcagtctatcaagcctctgatgttangcagagattgtagtcgtgtctntacactccagctcgntccaccntncnacgctgcgctgatgaacgacgcagtgccgcgtacgctggtcagctgtggcatatnctgcggctcgcgtctctgcctgatacatctgctgcntcgatgctgtgtcgacgatcgttcttcagctactatagcgnatagatattgtaagcacgagtagaagtagagtcgtcgtgcgtcggtacgagacactgtgtttttacgctgctgatatacgtagtgacntatgatgtgagcgcngcgatgctgtntctatcagtgtctgatgcagcgtatactagtgtnagcgatgacagtgttngcacgacacgttgcggctatagtgcgcgtcactacagttacgtcaactcgctgacatagcgacggcttagctgcactgatgtatatgagagtcactactctatctcgtgctatacgagactgatctcgacgtcgaacacgcagttatcaatggtatgacaggacgacgtctccgtcaatgcgtgcatacacacatctcgcgctacattagtctntgtatgtgaatactcatctagctgacgtattgttncacgagtcgccatacatattgtacgcgtcgcagcgtctcaagcgtcctctactgancaacgcgtagcatacactacncgccacactatgacatcggtgcacacgtgatacctctactgcccacgcgccacatagcgntgcgtccgctcagtgcgactcactctcntcatttgcatccgcgctatagcctcactatcgtcgcacnatattcganttcttcactatgctgtcgtgctcactctgttcatgatagtactgactntcacncgctcgtgcgcgcgacgttgcaggacgctcgtatcgtagtcatggtgactcgtgtgagtgccgatgattgacacacgctactgcatcnttctagatacgtatgtttgatacntactgctncntgcagatntcaantgtctganacgatantangtcacacantgacgacatcntgcctacactacgatgtgacgagatgcgcnactgaagtcgacagtacacgtaacactgcnatcaaacngacaactagatcgtntnacntacctgctgacagtctggcnatcgtcatagcatgtcgtcnactgcagtcatacgtntgatactgatattctacnacatcttcngtcgttntacagncgctcgtcttagcagatctagctgtacgtnagccgtcgantgttaacagtcnagtcanagtagacncacgntgcnatgtcatgtanacnatcgtcagtctcatgcgctctagacggcgtagtgtantntgcgttacntganctgtgagtcagcntcgtcgtgctgcctctgaacgatgagtgtatcgatgctcgtctagngtctttccgatgtgatcgccagctgtatanaaattagcaataaatcacgctgctgcgatgatgtacagcgtccancatcctgatcnaactcacgcgatacgtaggatcactagcagtatgacgcgtatngatatgacgacgcgcagaagacgcnatact

SEQ ID NO: 6316 - DNA, 1102 bp, Homo sapiens
  misc_feature (1)...(1102): n = A,T,C or G
cacaacaaacacaatgggtggggagccacccaaaaaacacgggtctactggggggaactgggagaaccagggcttacggtggggggtccaggggcaacaaaatgcattaccaatttgatcaacaacgacgtatcagagcgaaagaaacaggaacaaacacaaccaggaactggctgccaaaacgtcaatgtgaggaagtccaccccattgagactacagtcacccacatggcacctgccacatggatttcacgttgaatgggggccaagcgccatcacactcgcaacggacctgggaaccattgcccactcatgtgggacccacgttcacatttttcatatttcttggcatgcaaccctcacgcgttggaagtatcacatcgtagtaacgaaccaagggtggagatccgcaaattaggtggggatacgtcgcgcggttacctgactgtcgggagtaacatttggctcaacaaacctcgcgtcgtgtcttctccgagtgagcaacttccggatcaaggggctggtggttgtactttcgggtcactcacactctcgcgattacctccaccacacacatggtgtggggcacagcgggtaaatgtaaatgagggggagataccccttgggtcggtacatcaggtcgagtactaccgcgcaaccaccctaaccccaactggggaggggtgcttccctcccacacggggaaggccagtcgtctacaaccactccccgttgaacctagcgcaacaatgttacaaggtgggcacaccaatcacagcgactcgtgttatgtgctacaacacgaaccctttatgcgttagggagtgacccggtgcccctccgcggccgactggttggagaaccttcatctgcgtgcaccaccccacgcccgacgcggtatcctaaccatcgtgtacccaacgactctaagacactacctaatccaggtggtcgagaacatgcgaaacgcgcactgtgcacgggggcccagtctgcactacaccccctttaccaccataccgagaacgtacactactcggagcagacccactgagcgagaacccgcggaagncacgaagaacaccacgagtccgcgggcgccg

SEQ ID NO: 6317 - DNA, 1374 bp, Homo sapiens
  misc_feature (1)...(1374): n = A,T,C or G
aggcgacaggaccggaggaggcgcccagggcgccgagggggccagcggggggccctagtgcgancggatgnacaagaagagaagtcttacacacgggcgagacaccgaggaagaggagngaggcggccaagaacaaagacacaccacacacgacaagaaaggacggcggcaccgcggcgcacggcgacgaccaacaagaccgccacgccggcaagcgagncacgagcaccgcgaccagacgcagccggcatcacaaagacgcggcaccggaacgagaggaggggcgggaggcacagacgaggcacgcgagaggcgcgagtcgaccgaggggccccggacgcacggcacacgcaatcagcagagactatcgagacgaccgcacacgagatgagcgcacggacgacgcaggccacgcacagcgaagcgaacgagaggacacgacagcgcacaagacgagaaacagcacggctgacaacgaacgatcgccggcggcacnggacccgacgaccgggacgacggagcgcgcgggcggaccccaggagnctcgccgcgagccggtaccaccgccgcggcngaggtcgagngacagaaagccgcaacagacgaccgacccgaaacacggcacgagcgaaccggcacgcgagcgcgcgagggacacgcgaaacggtggaggaagcggcgtagaggacgcgagacgcgcaccgcgcgcacgccaacgccactatcgcgaccgcggcgcgcgccaggacacgcaccacgacaccgcgacgcgccgctggacacacggcgagggcgacacgccgacccgcagcgcgagaagcgcacagcaaagctcgggacatgacacgcgacacccacgaggacggcaaggcgacgagcagacgcacgcgggcacgaccgcgccgcacgcgaaacagagacaccgaacgcggagcgcagagaacgacaacgccgatgcacgaccgcgacccgcaccacgacaccgcactgcaccacaccgaggcgcggcgctgtcgacgcgcgtagaccgacgacgcgaggcacgcgagnacacgaagaaacgaggactagcggggagagatacacgacaccgagagagccatagatggatcgcgaaggcacctacacacgcgacgcgcgacgngacgggtacactaccagagacgcggagcgacgtgaccggagacgcggcgcggcagcgctcacgccaccacagcacagggcgcacctgtcgagagacatgcggcggccggagcagacctacgcggcgcgcggagcagagcgtagcgacacacacgagcgcgcagcgancggcagcgcagagagacgaggagtcgagtgaatctcgacgacggccgcaaagacagagacacg

SEQ ID NO: 6318 - DNA, 1094 bp, Homo sapiens
  misc_feature (1)...(1094): n = A,T,C or G
cacattaaatccccaaaaacacccacagcnantcttacaggtaacagagcctctcttttgttagttcttcaactgctgccgtgcgtcagagtgcgcaccatctgtacacgtcgcaagatgccggtcagttgagttctcaccagtagcgagtggttcatgtctggtgtgcttgagaacgcaccaaactgggtactttagtgttatatagttgattattatattaggtggtaataccttgcctatgtgctaacgatgactcatttcgcgaacgaggggctattttcagcaggaccgctggaaattatctctaaggacatcagcggagacttcttgtcaaagactaatcattggtagtgtacgatgttgaccgcaccctacgtgacgttgcgaccggtctcaacccccatataccaccatcgtgtctaacatctaatccacaacaagctgagtgtgaatcttggaatcattaggggcgataacgccaccctccggctggccgcgaccgcgtcatctctaggaaccataatatgcacgaagataataggatacccctcacataattattctcgagaatagagaagagcgccatcactcgtactcgtcctcccttcccacaggcacccgtctatgaacggtcctcgggtatttatcgatatcggtgttacacttagaactatgactactcgctaacataatatttacttgtaatnatctatatatcttattgtgatcgcactcctacgccattactaagtattcagccatgcgtccatgactattgagtaaatcctaaccgcgtcgcgcgctactcgctgctcgcacgaccatctagcttatatatgtatgtatttatctacatgtttcctacttagaatacttcgaaatgtagtacagtaacaagcgcgatctcacacctagtgtcactatgtaagtcactcgaacgcagagcgcgaataaaagagacagttaatcttatataataaaaatatataatatcatctaccactaaatgtcccatgagcttatatggaggtcgcttgactcgctgaccttattgtgaccgtaggaaaagctccgatcagccattgccaggg

SEQ ID NO: 6319 - DNA, 813 bp, Homo sapiens
ctttggtttcaggatgatgctggcctcataaaatgaattaaggaggattctttttctattgattggaatactttcagaaggaatggtaccagatcctctttgtgcctctggtagaattcagctgcgaatccgtctggccctggacttcttttgtttggaattcagatggggtagagaaatgacagcttatctcagttcatctgtgccttagctgaaatattcgaagatggggagctgaaatcctctgaatacttctgctctttcatttgagcctacctggggctgccgcttggacacccacacatgacttctgcatgtggcctggatttgctcacaatgtgataactgtatcccatatggctcttcagcgatgaacgatgagtgaggagactagatcctgaaaccgaatctcactgattctgctctttaaatcaattacctcatcattgccagtttgtctctttctattgagacaaactctcactctgaccccaaggctggaatgcggtagcccgattaagctcactgaaagcgccgcctactcggttgacacacttctccatccgcaagacattcccttaaacaccgtaggctgacgtcccatcgagccgagacgggccattgccctccttcctggggcccgctagcccaatttccttttcctacaaaaaaagggttaggggggccagtcgcgccctagttgcctgggtctccagatcctgggataatgtgggcttttatttaacctacccccatagatgcttccttgccccgcgggggccttttcttccctacctttttcagccccctttt

SEQ ID NO: 6320 - DNA, 1126 bp, Homo sapiens
  misc_feature (1)...(1126): n = A,T,C or G
cgcatacgcacacccacccccgcgaactccacacacacaccgagacgaaaaccctgacaaacccaaactagcactctcctcatattaaagccacaccctcacacgcacacaaacttatttcaccactccccagcatacgactcaaaccatgagggggaggcgcgcgcgtcatccacaactacaccacactctaacacccttttaaccaccatataaaaacaaacttacgaaccaccacaacacaaccaccccccccgcaccccccctccacacaaaaaaccacccactcaacacaccataacacactcggccaaccaaccttacactaataccaaataaaagcaaaacggggtggtggcatctccacactatacccaccaaaaaaccaccccaactacccctgcntatcctcgacactctcaccacaaacaccaagcctacatactctatcctcatcacctcacccaaacaaaaaaatccatcccactcaccctccaaactcacccaccccactacaattcctacccatcttcgtccacatacaacaccctacccaccccactgcaccaggnaaaacgaaccactcacataaccacccctgagcaacaaagaccaaatataaagcacatagattaaccaaattccactaccacgcctaccacactccccctcaccacacgcaacatagcgtgcaaatctgaagaccccccccgcgctanactaaatagatcacatcacatcatccaccntacctcctccaccagcccactctaccacaatacctctcttcatacactatccccacatagtaccgccacacccttccatcacaccgtccccttccacaccaaccatagaccacctccccatcctgtacatgacatgaccttaccatcgctcacaacacccaccagcattccccccacgcaactacgtcnccatctccataaagaaagaagccaccatacaaaacctacacaccacataatcactcccctcaatcaacacccagaagtcacaccacacgtttaatataacttaacacccacaccacatatgcgcccccgcgccatccacacaacccacccccacttctacgcgaaaacccctcaaccaccgcagccac

SEQ ID NO: 6321 - DNA, 1016 bp, Homo sapiens
  misc_feature (1)...(1016): n = A,T,C or G
gtacgtcctcctgtccttcctccttgccgggggtgcgtcaggcgatgcgtgggctgtgccgggtcgtgcctcgatgtgtaagcgggggcgctcgagcgtgcactagcgagggatgtgagggcggtgagatccggtacaacggggagagtaccgcgcgcccatgcttcgtgtgtgttatgtgtagctcgtcacgtcagtaccggctcctcgtgttttatgattcttcacagtgtcattcacatggcgctcccagttctatgctactgcagcggggagattgagtggggggccccctcgtcacgcgcagggggttggtagcactcgttcattcgggcatgtgtccgctcttcttggctcgcccaggcgtggccccccgggccagctgggggactactcgcagggtcccatacttcgagcctatcgtcggtcttgtgcttagtttggtgtggacgtttactggcgccgaactacgcttgcttgtgtgggtggaggctggtggctcgtagctctggctcatgactcagagatctgatcgtctcacactcggcagtcggtgagccgacggctcgctcagcccgcgccgccggcctgtctaccatgtggatatgactcgaagcgatcgggcatgggcgtgtgccaacagtatcccgtggaaggatggaaggaccggctgtggtctgtgctatcaagggggaatggtgtctgagcctgtcccgagatccggtgctagaggcgggtagctaggttatgtgatcctgtacctggtcctcactcccctcatcgattgttatgctgggagttgaaggcgactgctgccgagagccaatgctctcggttagcggcgtatattgatctaacngcgctcacgtgctcgatggtggtaggctgtctggcagatgagttgtggcattgtcctcgccgccgctgtcgaaccctactcgtgcgggcgccgaggtagcctcacgggatgtggtccgcattctttccgtaggtgtttgttctctcgtgctgggtcg

SEQ ID NO: 6322 - DNA, 683 bp, Homo sapiens
  misc_feature (1)...(683): n = A,T,C or G
gattgccaagttgcgaggccgaaagcccgtccccgggtggtggcacgaagaagagtgaaggacaatagaggatgacttcgcgaacacgcgcacggatcaagcgccaccaccatcatatcataaggctcacagggacaggtacaaacgtgatcgccggctagagtgggcgacggtaagtaagcccacagacggtagagtctcgaggacagcagtatggtgctgcaggaacgtgcccctccggataacaaaagaagggaagaagtgatggccagagagagagggaagggccgcaaggcggagccgagggtacatatgaaaaggtggtagggcaaaggagcatagaccgatgaggaacaggcgcgtcgncccacgcgaacaatacgcagtgatgggaggcgcggcgccgcggggtccggcgaaataacaagaaggcctaaaaccaatcaagtgctcccagtgtgaataacgangaactcagatatttaggagtggtgctaggtacgcggtgtcgggtgaaccagacgggccggagggggtggcacgggagccatccaagagaagtttacggtggacccaggactccaaggtgtcgtgccttcgggctctgtgttgcccagcatcaggaaggggtgacgggatgaatagcgtcacaggcngtgagtcctcccttaaaaaaaaaaaaa

SEQ ID NO: 6323 - DNA, 2294 bp, Homo sapiens
  misc_feature (1)...(2294): n = A,T,C or G
ctacgctcacncaccacgncgacagcgagatgagagccgctcgcangcatgctgntatgaccngcacagctacgagtanatgtcagnccgcgagttagtagccagcagccagctaccctcccgactgagancgcgccatcacatnatgngnganaggggngtnagatgactcccgngcncngcgccagggtccgggcgatncatgcagccaccgactgatcatgaacagnangtcgantatgcangcagaaacagtcacacagngngctcnaggatgagaagnacagacgaatgagatgctgagnacngatgcgcgagcgcgcagcgacgagngagtgtcgngatnatgntanctgcatagtatagtagcatntagagcgtagtatgcgagncnagtgacgcgactgcnacagagacgagtagagctgctacgagcgnacaggacgngctgtgcagccgacgtcgagcacggcagngcagcncgatgancgcanantagcaggantangctgcanaccacgtcagcactgcgagcacaanctacnacagncngaccatgcgacgagcngntcatgaccangcncgtcanctcccangagcatgtagcggatgnantagcnagtcnacagccgatgncgncgatatgatgatcancangacgatatgatcaattcgncangagnagntaatctgatgtagngacncagnnagacgacagcgctgcgacggtgcagcagcagtacatcngacatgcaagngcacgngataggancangacacngcgacgagnacgacgangaaanntganacnnanngtnatcgaatgcagngtacntaccacagnanngncatgcaccagtccgtgnatgataatttgcnaggcgcagnncgnganngtgatccngtntccgcagtgctacatgcgcgtncccgctnacaccgcacagctgctgctgattcttctntccannacntatnncgnnacagtnanagcnagcccagtcgatcgtattagtagcaatgagtcagctaggncgnagcgcnagcgactagcancganntanatcactgcanagcgatacggngtngatgtgcagcgatcatgtgatagctcgtagcatntgctgcgacgngcgancgtangtcntcagantggctgcgatcgntgcgnaantgatactcagctagatgtacaatcgacatgagncncgtgacagcagtgcgcagcacacgaantcacacagagcaaacagnatgtgngcgcagagtatggcagatgcgatcgtngcgcaaacggacactcacgagtgcgccnatgctactancannacgagntatcatcanacgagacggacagctacactgatatgagtcacggtgacagcgcgccatcgcacgcacgacatcgtgacgcngacnantactaatnctcctatcacgcgcnatgttatcgccacgctcggcggacgcggacaggagagncgcgagcgccacagatataggacccaagattggacgccnctccccnatacacatcncgcaccgtacggatatgntgactgngngtacgcgagacgagcgcganacgcagacgacgcgacagnatcgcaaggcagagatgagtgggacgcagcgagtgtaatggcgcacgagccatgcgcgccagtaggcgagcgcacaaacgtagacggaaggagagcgcagcagatagagaatatccacagcaggtagacaccagccgcaggagaggcacgcgcaccgcacgacgccaatcgtatcctagtagatcccccgcgataactgcagacatgagcacaccacancacgcgacaggacataagcagaagaaatcggcagagaggagcggaagtgcacgcgtgagncgtcgattagagacgaacgcgcgagcgcgatcgcgcacgaaantcagacgacatgancanagagcgcgacgcagagaagcagagagacagacagagagggcgacgcagtgacgagagaagcgcgatggagcgacgacagacgacnagagagaacccgtacgagagacgtcatcacgccgtaagcacgatatcagagaaaancagaatccacgcgcggactggcagatggagagaccaggtaagacntatcatagagagncatcgcacgtaggctgcgcgaacatgntcagctgactctgaagatcaanatccgcgcacgccgagtaacacactcacaacacacactctcncgcgagccgcgctgncagcatcgtcgctccgatgacgaggcgaaccatagagaccaagacg

SEQ ID NO: 6324 - DNA, 1129 bp, Homo sapiens
  misc_feature (1)...(1129): n = A,T,C or G
tgtctttctctggttcatttatcttagttctcacaacatcatgttcgatagttagtattgtanttgtctagttcgacttccatagcggncgtgactcttcgtactaagatcaatattagtaccatcttttgccgttcatgtacattataactactatagtagtcgcaactattctctaccctctagtttcataatattacattttctggttttgcagccacgatagancgtgtctattttctgtagcttaatgtgttcttattgcgcgttatcaggataaatgtatcctgtatatttcctttctcagtcttgtaagtcactacatcaataacaactacattttacagaatatatatgtggttcatcaaggttntcttgttcatactacatnatttaccatatatcataggccgactattacctccttcctccataanaacaaaaattacaataggaatgagggaatatcgatgaatgtacagagttagtttactactatccctttttatgatgtttttatattaatattatatatanaaattattggttagatatataattctagatttattatcttcaaggtcccggggtgccgctctccgttatgcgtgtgtcgctcgttgttgttcttgtggtgtggtngtttctggtggggagggtgggggcgacggctgcgcggnggacgatgttgtgtnctttcttgggttcttctgtctttgttgtccttttgtcttgttgtgttctttcggttgtggtggccgggggtggggggcgcggcgggggtgtcgaaactctttgtgncgtctcgccgggctcggccgcctgctgcgncgcgtgggctcggctgcttctggttgctcttccctgcgcctctcttctctttctggtggggttgtggcctttctttttcttggggggttggggggtcgcgcggccccggcttcgtggttgnncctctncgcccgttcgcctcccctccctcttcctcgttctggncctgtgcgggccttttntttcgtcccncccccgaaacctttttttttgtttttctttaaattttttttttttttttttttttttttcttttctttctatcacaccacaccnaacccaccacatatattttctt

SEQ ID NO: 6325 - DNA, 230 bp, Homo sapiens
agcactgatgcgggataataaggaaccagagagaccgaggggttgaggaggaattatttaattatttaggtgcacagaccgagtccaatgaacatccaaaggactgagccctgaacaaagaatcaagctaccttttaagcattttgtggggtggggggagatttgtgcagggggaagtgtattacagaagtgagaaataaagacagttatttaaattaaaaaaaaaaaaa

SEQ ID NO: 6326 - DNA, 259 bp, Homo sapiens
cagggcctgctatctgccatgtgatgctgtactagaggagaccagaatatgtgaccacaaaatatgcttctttggccgaaggattattttgaactaattattttgaggaagagcagatatgacagaagctctgaagaaagaagttaccctttgtaacagaaatttataaagaaaatctccattcataagactgtctccctctctatactaggaatagaagaatgactctactcacaaaagactcatcaataaagaagga

SEQ ID NO: 6327 - DNA, 494 bp, Homo sapiens
gtagtggcaactactctcttaattttccaccgctacacaagtcagaaaagacaacttctaaggtgcagctttaagagttcctgcatctgatgaaaatgtggaaagctgtcctactgaattcatataaggcactgggaaatttcagtggtgcagttaaacaggaaatgtttgctgacccctgccttagactgtaagtttcaggaaaaaaagactttctgaatatgtaattttctgtttacaattcctaatccaactttgtacttaggccttcttcaataaagaatttcggatgaagtacatgttattctgtatgacagtctgttgtttccaagagaataataacaagctgtccttgaaaagaatggctggtgatggaattagctctagagaatttaaggtagtatttgccaagaaagaaggtcagtctgatattgtgtcaaacatatcctttattaacctgaataagtaaatatatgaataagtaaatataccta

SEQ ID NO: 6328 - DNA, 1154 bp, Homo sapiens
  misc_feature (1)...(1154): n = A,T,C or G
agggagaaggaagntgtngagtnnnntgggnagaggaaaccntcgngcgggacgggagggggaaagaaaaaaaacctgagagggaaaggaccaggggcggggagggctangggggggggggaaccaaccnncggcccaagccccgcggacggcgcgagggggggggcgcgggcngcgaggcggcggaggncnacccacaaaaaaagaaaccacgccacaacacaccgcgccggggccggggcccgcggcgcaccccgcccaggccgccgcccgcgcgcagagaaacgaccggcgacgagacagaagcgcggggccgcgcggagcacgagagcgcacgaccccaaggaggccccccccancccacgaagaaccacccaacaaacccccacacaacaacaccccacagcngagacgagggncggaggaggacaaggggacgagagggnagcacaggngagagcgacacgcaagggggcaggagcgacgcagggggcgggagggcgggggggggggccgacggcgagaggagcaccgcgagcgccccggggcgcggcggccaaacacaagaacgacacgagccacggcgcgcgcgccacgcggagagagcgagccccccaagacgcacgcgggcagtaagaaacaggccggaagaaggaggaaggaggcgagagggnactgccggccccgagggagagggacgganccagccaccgcagaccgagagccggccgcgacgggcaagaaaaaagancagcccggcgcgaggccggagtcggcagcggaggagcgagggaaacgaaaaggagacggaacccacgaaaaggcacgagcgaggaaggcagagcagaagccccacacgagccacgacaggagagaaacacagaaacgccacacgaggaccgaagagggacgaagagaaacaagaaaacgcgggaacccgacaccgcccgaaagagcgcacagaggagagaagagcagagacacgggaaggaacgagaccgataagcgccacagaacacgacgaacgctagcatacacgcgccaaaaccacaaaacgaccacggcaagagcggagcccaacgagagaacgcactcgcacaccgcggagacacacgagagcgcaagaacgacccgaggagaggagacgagacgac

SEQ ID NO: 6329 - DNA, 615 bp, Homo sapiens
  misc_feature (1)...(615): n = A,T,C or G
ggttctagaatctggctatactttttaatcatatgaagaattctcaaaggtaaccagacaactgaagcaaagtgaaacatggttgttgaaaacagcaatgaaatctcagaaagaaaagagagaagggggattccccatttgtgtctacccacatctctgactgaggactgggctgtaatatttagaacaaagcaaagcagaatttcagctaaagcagaatttcaactcacgtaactctgagctgaaagcaaagctaccacccgaaaatctggggttntctctttgtgtccaaattttttttaaatgcctgctcaaaaggggaggaggaagaggaaaaacagaaacatcattactagttgggaaaaataatagaatcctgaatattcgcaactttatacttataatggctaagatataatccaagataccctgggggctaaagaaccaagaaaatgggaaattattttaaagacgaaagaaatcaaccttgttaattcctaaatggacccattgttagaactaccaatggatgagttaatgagtacatttaatggaaacaatcctttacttacatttaagggcttagcagttaattaattaactgggagacctttt

SEQ ID NO: 6330 - DNA, 1352 bp, Homo sapiens
  misc_feature (1)...(1352): n = A,T,C or G
tgtggagggaaaggagagggggngggggattggaggaaagggnagggagaggggatagggagggagaaggaggagagccttgagtggaggactaaaaagaaaaaagctggaggcgnaggngagccggggcgcagaggccgngcgggggcgggagcgngccaaaaatagacagcgnaaaagcgnggcgcggggcccggaggcagaaggagacagagtcccctcgcgccgcgtgagagtaccttccccccctcggcgctgtattagtggtacgtcctgctatgcggctttgtgtccccgggtgtcggtggtgttgttggccttcggttattgtgattatcctatacttaactgcctgtcagtgggaccatgatttatttgatgctttaacacttattttgccaactgttccgactgcgacgcacgtcttttctggtcgctcacgttagtgatggataggcgaagtgaaatggtgcgttgggatgggagntcaccgttncttttatttctattggccccgctgtcccccagcacggtatgcgtcccaaacgagcgcaaccacgacgcagcccccgccggctgcgatgcaatgtatacantcacagcagacatacacacacctctcacaaaccgacgccgcggcacggcgggtgcggcgaggcaaagcacagctcgtgtcagttggctcatatatntactgtagagggactcatgtgtggtattgtgattgattgacggtaattttccagtgttgatggtatctgtgttagtgtgttgagcagttccgagaccgacagcgttcaactatatatcccatttaccactcatgataataatatattagtccnttcttagacatgtgatcgatattaagagagttcaagcncctatagatgtgtatgtgatttnagatagtagattgatgttgtgangctcgagtgatatangaaggagcagtgtgataggatggttgaaccntatatattacgacgcgtccacatatgacgtgagtcgctgaggtcgaccacctactcgatgtctgtcatcccgagctgcgacctcatggcataagntgtctctacantctagttgtcgcgtagtgagtnactgcactgtgcgaatatctagcggagcagaggtacgcgtgcgatacagagccaagcatgcacgcgaagcgcgtgctgaggagagataatagatagtgctcactattcacactgcatatcgagatcttntgcgagctcttagcctaggagtggtcgtccactagagatgtacgangtgtgtggtggaatacagtgtcgtctagtgcggagtcgagttaggaccgactgatgtgagagcngtgcagggag

SEQ ID NO: 6331 - DNA, 1360 bp, Homo sapiens
  misc_feature (1)...(1360): n = A,T,C or G
cagtagccacagatatatcccctcattcattatgcaattaaccccagaacgcgnttgncgttctggcgcacagacatcacgcgtgtatatacacttctcgccagcgcggcgaagtgcgtcnctgagtgtacacatgacgagcaggtgccctcatcacgccacgagtttttacacgatgcgcccgtggtgttcgcaacgaatcgatagacgagggttgtgatgtccccgccattgtgtacccgccacatccacctcgatccggaaccccnatgtatctgacccccgttagagtccccgaatatatatatccccctgaataatggcaacgcagccacgcatacacagcacacaaacacgattgatgtattgtcgcacccattcagtgatcgaggacgaagaccagtaaagacattcgtgtggagtgtggtaatgtatgtcgggatcagtcctgcgcgactattgctccgtagtctatcaatctatacaccgtaggaatcgctacgtagatgaggacgtgaggaccgatatcatgatattgaccacccttcaacgtgtttgatgtttgtgtattttgttatccatccgcaccaccgggcgacccgtcacgtgatgtgttttcgttagtgcgacacacctgattggattacgactcctttatgatctcactgtgagtgccgtattacactcgcgtgtgtgatttgaccacccacccaccgcgctaatatacgacttaggcgttgcgtggtatctgtgaggtagaccacacctatacgcaaacatgcagccactcantcgcactatgtgnacgagacggacggagctctacgagcgaatgtagatcgacgagtgcggacgaacttgataagcgacatgttgagtgagtctatgagtcgtgtcggcgtaggcagcacacatgtaagccaccgccgcccatagggtgaggtggagagaacagaatgtgcgataccgcaagcaaatctgttgctgctacaatattgtaagtaatcctacatgctgagtacgatatatgacaggagcatgaacactacacatagtattatcatgacattgtctcagtacattatctatgctagagactccataacactattttgttcgatcgcgcacgctgcgtgcgacattgtacaacttgagatagtgtatgcgacagttgtagtgaggtgatcgagacaccagtgtagcagccgatagtactaccaggcccttccatatgatgtcgagagggtatgcggactcgtgtcgtggacattgtattgtaccctctccctcactctgtgtatgggcattacgcttatataatccgtcgcatctctccctgcttatattaccatcccctctc

SEQ ID NO: 6332 - DNA, 1105 bp, Homo sapiens
  misc_feature (1)...(1105): n = A,T,C or G
cacccgaacacccaaccgaccctctaccaactacactccaatagaccaatacacgnacaagatccaaatcttatactaactcaaaacattttcttttcttctccttacacccccccaccccctctactcagcactctttctcccaatacacctctactattactcaccaacggaggcgataagagtgtgttgtccgcataaccaatcatatattatacgtcaccaataaccctcctaaaccccccccctacctctgctatcatttcacacatctattataccaacaattaaaaaacacccccagcaacctaaactacaaacgatacaaatcttatcaaaaatctcattcacattaatctttctagagagaggggcataattaatatcccataacctccaaaatcaaaaaaccaataaaaccaaaaactctttgaaacattatatataacctcttaaacataacatcaaccatttcttacacatcaccacgacacaaactccttcatctacaaacccaaccctacatacccggaatacgaattgtgtgcttaaaaaataatccatattcctaccttacaaatccactccacacccgctgacaaaaacacaaaaatcttcaacaatcaaatcacatgtgtaccaacacttgaaccaaccacataccaagggtgcacagcgaaaacaataacaaacggggaatgtaaaccacaatggagaacaaacaaggaaaaccaaatgtgatgtacctgacgaaacacagggaaaaacgcaacaaaaaatacaaaaaggtggacaatggacgggggaacacaagaccacacaaaaggngggaaggacacaaacggaaacacaggaaaggtacagttgaaccaatgaaaacggaaggaaggtaaaaaaaacaaggaggaacaaaggcgacaccggatggtgacaaaacaacacaaacacaggacaggtaaacaacacatggggatgacagtgaaattgaactacaaaaaaggcaaaaagaataagtgggaacaaaaaggaaacaaaaaaggtaaaaaaaatggacgcaatgtggaaggacacaaaggggagcgcggcagaaacgacaaaaacaagg

SEQ ID NO: 6333 - DNA, 1102 bp, Homo sapiens
cgattcccgtgagctccattatgacggatgaggcaagccggaggcgttactcgggcaaacaccgcctaaaaaatttgaccggacgacagccccgggggatgtctcacaccggggcgatcccagcggttttgccgtggcgcccaagcaggctcatcactaccgtgaatagggatatacacaccggctattgttgttttacacataaacgactcgcgaacttcatagttcgccccccgatctttccgcgtctattattaacccgtgagtgaggagtggtgtccatcccgaacgcacatcctcgtggttgtgttgggacgtctcgccggcacgcgaagagaatgtaacaatagagcgtatatgcctgatttttgccttgtacatcggcgcggtgataagtgtacgaacctatcggcaccgcgcaccagcgaatgcagggtggtgttaataagtgtcacggaaaataagatttgggacttagttatttgccccgccactcggcgacaacacgtgatttgatcgttgcccccacgagattgacacatttttctccattgacgcgtgtatccttcggtgttggtgtgacagacggcgcagttgacgcgccccaggtcttggctatggtgggtggaactcgatgccggatcttcgcgtaccaatctgtatacacgacgcatgaaacacggtgtggaagacttatgagatatatcaccgtgcgcggtatccggccggtgagagatagcgattacgcccacacgcccgacgtagtggatagtatatttcgccaaacgggggccccagtggctgatgaatagtgtcacgagatgaggctacctgaggcagcgagggagttgtcgtttaataagagtgtgcactcatgcgtcctcggatgttgttgagcactcgcgagacactgggttgagtagaggaatcatagaattttgatccagacgtgtagggtatagtaatcgctcgccgcttgccgtgtctaagtgtgactgtgtaccccgcgagtaccattgtatgctcaccccacgtcgcccgagtattttgtgacgaataagagtccgccaaggcgatgccgcatatttgcacgcgtgtctgt

SEQ ID NO: 6334 - DNA, 1020 bp, Homo sapiens
cgtccgaattctttcgcttcttcgagggggatacttgcagaaacaacggataacattgtgaaccgcttagcacttgcgccccggcccgtcgagtcgactgcttcgctgctcgatacgttagttgattcctctcgtcacttactcttttctcagctccgtaaagtagtgtcgtatcgttcacttgggaacaagaaataagtgacaccttatgctctacaattcaccgttagatcgctttttattggtaaaatgaggcgctaatattcatcttgtccaatttacccgcacacaaagggagcgtgtcggtcatgacctctgctcgcgcgttgccgctgttcattactcttacgaggtgccgtgctgctatgggaaacaactgggtacacacataagtacgtaaagtaaattatttttgtagatttgacattatccagggaatgtggaaataaacgggatactgtggtgggtgtgtgtacttcgaacacaacgggcatagatccttctatcacccggcacggcgtatgttggtggtgtcatgggacacacacaaaggtagtggcggggcgccggcggacaacggccacaaacgcagccatcatgtgagcatagcacaacacctgttcttgatcaagtgtctgggttgactggttcgtccaagacagtggggcgaaaactgcaccaaactcatgtcgtgggtaacacggttctcaaccgccgcggacgcgcacgacagacatcctacacactgagcgcgcggttttatatgtatgctgtattttcgtcagtcccaggctgtagcgctcatgtgggtatatcccctgtgtggggcgactcgaacatataagattagatggtaccagcggggatgtgtttacccacgtgggcacacctatcctcaatcaccgagctcgcgcacagcgtgcgcacacggtgggctaacttggtgtgcaaatggcgtacacttcgcataaagtgctgcactggacgcaaacgatataatatcgcccgctggcgaattag

SEQ ID NO: 6335 - DNA, 726 bp, Homo sapiens
atccatgctcctataaaaatagcactccacagtcatcatcataatttcattgtgaatcccaacagagagacaacagaaacgacccctcagggatttctatgatgtgtgggatgtagcagatgccatgggcctaaccagaagcccctcctgcccacgtgtctggagcacagcccaccctctaccatgaggcccagaagagtagccctaccagcccgcactgcctgcagagttttgggcacagggccagccctggccaatagcactaataggaattctgccatggactccaaggaaaagatttttttccctattgataaggaatggctgagtaggagaactctgtttttctgctgcatggaaaggccgcagtcttcctgcaaccactgagagtggcatcacagcagacagcagtggcagaggggaaagatgaaaaaccagtggggtccctgaggacctttggagcgaccacatcaactctgggaccacccacacctatgcttttgctgtggcatatcatacatacccttgttctatagctgtttaccttggggcttctttggtttcaatccaagcatctggaattgtgggtggtgtccttgtggtggtggttaaatgttgggtttaaaaccaccttctgggtggtattccctatttccctggtgggggaaccagggaatgggtttttccttgctcctccctgaaagaagactcagaccaattcttgct

SEQ ID NO: 6336 - DNA, 1066 bp, Homo sapiens
  misc_feature (1)...(1066): n = A,T,C or G
tggggttggnanatgttgtgtgnggttgttggttggtgttgatgaggggtgtgtgggtgtgaggtggtgagaaagttttaaaaaaaaagacaggaggggggggggtcagaaaagangcaaacccgannnaacggaagagagagctacaggagcgggaggnagggagaggagagaggggggagaagagaaannncaagaaggaagaggggaacggcaccaactacacacatccgagcgccctgcccccccgtggtccgggcgagtatgcccgcccccactatatttgtgtctggtgtttgtctttgcgttgtgtgtgtcttgtagttatattttattgtgtttttctttattttttttttttacttcttattttctttttgtgcattttttagatcgtttggtttttgttgtgtttttgtatattttcgtgatttttttgtctcttcgtctttgttttgtttccctttgcgacagatactgtgtgcatgacgtcctgtcgcggtatgtgtgtgttatccagattatttattcttttctttccttcttctcttcatatctcggttggtgttttttgtcgtttctcgtgttctctattgtatgatttttatttgtncttttgtgtctgtgttaatcgtatttttgcccttgctctttttcctcatatnaatgattattatagcttatgtgagcatgggtgatattaataattatatgaaatttnttgtatagtttagtgtngattgtggttgatatttatattgtttttgtttctttactttgtcttctcttgtatttctctttatgcgtcgccgcttcctgtctttactctccttcttgccgcatatatnttagtatttttcctacttttgtttgttgttctatttaatggattaggtggtactttttgtgtctctcgtcaggtacgcgttttgtttattttgtgtccatttcccgtcatgtttaccttctgctactctattcgtaatcgggccntggctatatgttttcgttctgcgaagataaactagcaaagctgcatgcctcacttgtactatcttctttttcc

SEQ ID NO: 6337 - DNA, 951 bp, Homo sapiens
  misc_feature (1)...(951): n = A,T,C or G
cggctagattgagatataacttgagacttgctaagaaagtcatttctataacatctcggactgctgccatctattagtgatgatattaagtttatatcaaggcattcagtagtaaagtgaggtgatacgaacatcttaagcagtgatgggtcnaaaatatatttattacatgctaaggagtagtaggattgttaattaattgtatgtgaatagggtggaatgttagaggtaggacatgcgaacgagttagaatggatcataatgtagactgaatatagccaatgactgatggttttnttatactaagctgattcacagtcaaatagtgcggaagagagacatgaaaaatcctttgttaaaagaaatatgagatagtaataaaatgttggccgcatagtaatattggttgggaacaaaaggtatcagacctcataaagatagatttcataatatgatagttggaaatttcacgagtcttggagcagatgtgggcatgcagattctggtaagctgatagcaattgtattagattcaaccccgagagaaactctttgaggctcatttttatcaaactgtcaaagacaaagagtccttttaaagctgcaagggatataagtctagtcacagaaaatggaatcccccatcaaatgattaggagatttgttagcagaaacctggcaagcctgaagaggatgggatgatatactcactgtgctcaaagaactcccccaaaacaaaaaactaccaccgaatactagatctagcaaagttatcctttagtaatgaaggggaaataaagaactacctgacaagcagaatctgagggaattcatcaccactagaccagtcgtacaaaaagtgcttaagagaatgctgcaactgaaagtataaataaaataaatactgatgcgcccagaggtagtttttgtttggttgttgtcagtaagtgtg

SEQ ID NO: 6338 - DNA, 661 bp, Homo sapiens
  misc_feature (1)...(661): n = A,T,C or G
aacccttcgagactgtggagaaaagaagtggtagccccattctaagttatccacctgccatcctacactctggatcttattgggattatcttaattcaggcttagattctggtttaaaaatatctttaaaaaataaatttaattccaagaaaaannnnaggggggaagggaggggtgnnagaagnnntaggggggggggggnnnnnggggggggtgggttgnngaaggaggattgggtggttaccttttcacttatagcgctctttttttcttccgctgccgccgggagtgtttgtgggggggggttttccttaattaggaggcntcaaaggggctacttcttccttaggcgttagtaatggggagaacagattacagtcctaatacgaggcggaggaagatacctccagcaccggtgcngggtgttctgccataaatcatattttttccgtactgggccgctaaatccgcgcaatatgcgtagacagggcgaatctgtgcgttaattgctaggagtcaccataactgaagaaaaacagaatagagtatggtcgctttgagcgaggtgtgtcgtgcccgcgtgggatgtatagatatcccctaatcgcctaatcctgataactacaacttcgatcatatagttgtactcgtagtggagagg

SEQ ID NO: 6339 - DNA, 214 bp, Homo sapiens
tagacatcttcttatctttgtctaaatgtatatgtattcaaccaaaagacagggatgggaagccagggctgagctaatactgagctagtgtgaagagtagcactccaggatcaacctgctgtcagagtaaatggtcatgatgcttaaactttacacctaaactttacaccattagaaacactcctttatttcacaccattaaaataaaagctga

SEQ ID NO: 6340 - DNA, 1840 bp, Homo sapiens
  misc_feature (1)...(1840): n = A,T,C or G
acgcaacaccacgaagcaacgccgaaccgagaaaaaacacgaacagacgcaaacgccgaacaccctcaatgtggggaaaaccccaggacacagacgaacccttcacagccgagagacaacacaaaacccaaagagacacaagagccgcgcgcccgccaaaagaaanagcnacaagcccagcacaccggaaccagcacagacgcgacaaggcagcggcaagngaaaccagccgcaagagaacagacgagaacagaacgaaacagacacggaccaacacgaaacaagacagngngggacacagacaccgccgaagcgacacaacacgaccgaacaacgcgacaacanacacaccgcgaagaggagaagagcaagaggcancgagcacgcgacaaacacgcgacgcacagcgcgaccncacacgacgacacacaccagacagcgcgcccgcacaggagcaagcgaagagaagcacacnacacgccgaccgacgagcacacacagcgacaacagcacacacagagaagaccaacagcacccaagcgacacacacgccagcacccccgaacacgaccaaccagaagacacgcagcagacgaaccaccgcagcaccgcancgaccgacacgcgangcacaacaccncgcaacacacccacanacgccaccgacgcagccagcaaagagaganacacagacaacgcggcacncacaccgcgcgcganacacacacaaacaccaacacagcgagaggcgancagancgagcacacgcagacgcacgangcagagacacaaccgaccacgcggacagacaaacgcgnaaacgaaaanacgcacacacaaggcgacagacagaaccagcacacgaagcncaagcacgcagcacacgaccaacgacaacacaganacacacacccacacgaacccgaacacaaacaagaacgaaagacacncgcagaacgacacaanagcacacgnanacacacaacanacaagagcganagaagagaggaaagcanaagncncgaccacagccgccgcgacgcgacgancgagaaacaagagaaanacagnacacacacacgacccgacagaaaggagaaagcaagaccgcagcagacggaacacgacnacaacacagcacgacgcgaacgcaaaccacgaagagacgacacgcacgaacacaagacaacacanagaacacacgacgcancacgcccgaccaagacaccnaggcgacgacaancacanagananngagagacgcacgcaccgagcgccaccccgacacggncgaccgacagacagncngccaagacgcgganaccgcgcgagcgcgacgcgcgcaagagcacacgagagngccgcgcgancaangagagagcagaccgacaccacacgaggagagaagnacagcagangaaacnggagcacagacgcgcagcncagcgacaccgcggagacgcaagacacgacgacgagagcaagnagcagccagagagcacggagnanacgacgcacgcgcacgcgnacgcagcacgcgcagagngagcancaacngacagagacagcgagcgaacgacacacacacgcgcagacgacacgagagagcgcggcagcgcacnggcnaggacacacagcagaccgcgccgacacgncagcagagcancgacacgcgacacgacgccgccgcgcacggcgaagcancagnacgaacncaaaangagagangnagacgacncnacncgcaacgcagnanccngnncanacagcgagnagcaaccacgacanaccgncgngaaagnacgcanacggcaccgaggacacgacgcacccnacagag

SEQ ID NO: 6341 - DNA, 292 bp, Homo sapiens
tctagggccttctccagaagcaaaatgagttggaaagtagtctcctgcctttagctgaaaatcaagaagagagttttggttctgtgattgtaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtgctgggtctatacaataaaacagatacttcttttgtaaaaaaaaaaaaa

SEQ ID NO: 6342 - DNA, 356 bp, Homo sapiens
  misc_feature (1)...(356): n = A,T,C or G
caaccccttcccacatctcttgctcaatacaacaatataaaaacttncaatattaccactcatctcatcatctacctatcccctcttattcctctctctccactaaatcataccacaactatatcaaccacctataaatatcctaattactcaatatcactatcatccatatattcttcacctactccctcaccaacttaacaccacaccaccacctccccataatatactaaccacactaaataactacatcccttactatcaatcacaaccactacacaacaanacaaaaaaaccccccaaccccaccaatcaaccacacanccaccacanaataacaaaaaaaaaaaaaaaaa

SEQ ID NO: 6343 - DNA, 778 bp, Homo sapiens
  misc_feature (1)...(778): n = A,T,C or G
tgaagaaatcggtgggtgaggtggtggaagtcgaagaaaaaaaaaaaaaaaaaaagctaaaggacctaaaaaggggctagggggggacagggggggggccccccccccccccgcgccccgcggcacggaagcgccccgccgggggggggcggggggccgggagggggggaggnggaggggcccccgagagagggggggggggcggcggccccgccccggcggcgccgccccccgcgccccccaaagccagaccggttgggggggcnnnnnnccncggagccgccgggggaagagacacggggagcgggagggcggccgcgggagaggcgccgccgccgcgggggggcggacagggcggcgcccccccccgcggcggggcggccggaccgcccgagcccgcccgccccgccaccccacccgcccgccgggcccaggacacgcgagggcgggaaaaaggccggacgcgcgcgcgggggcgcccccccccggcagcccaccccgcgcggggncggccagcggcggcggcgggcgccggggggtcgcggaaggagggcggagggaaaggcgaccgccggggccgaaggggcccacgagccggcgcccccaaagcgcagacggcccagccccggccgcacgaacccgggcaccagagggagcgggggggccccgcgagccacagccggacaacaccaagagccggaccccgcagcgcaacgcggagagcggccggcgcggcgccaccagaccggccggacgccgagggacgaaacgcagagag

SEQ ID NO: 6344 - DNA, 857 bp, Homo sapiens
  misc_feature (1)...(857): n = A,T,C or G
aaatgaaatatcaaattatatttctcaattttttaaatattgatgcttatttttgagaaatacgatctgaagcattggagacgcgaaagactaaagctagagcttgaaaggaaagatactgaaatccaaaagctgaaaaacgtaatcactcagtgggaggcaaagtttaaggacgtagaggcacgaaatgcacaattattgaaaatgcttcaagacggagaaatgaaagataacgcacaactacttactgctagttgattgaaacacaaatcatcaacactgtgctccctattcaggtaactacacttacatgcttcattaaaacaagaaatcaataaccggattgtattacaagcagagtccgccgcctacccatgcngacacaatcatgtataaaaactatgtaatccgcccagatgttggagacaccatcaatcctggccagtaactacatagtttaatactaccaaggatttccgtaaagataaaactacatataactactgaatagaatgttaatctatatcatatcatgttaaacgaacatataatcattttaaaaccctaatcgtcctataaccttcttctcccatgccctaatcactgacatagaaatagcccgacatatttaaaaacacttttgttcgcggccccctaattttaacttaacggacattttgaggtggtacgaggacgaaaatatgaagtaacgaacacaccacacttattaattctcaaaacagcccgctgtaattatacccatatacgcccgatgtgcattataacactgaaacatacgatcaatttaatttccgtcgtctaccatctcaccttctcacataatcgttcggaattag

SEQ ID NO: 6345 - DNA, 823 bp, Homo sapiens
  misc_feature (1)...(823): n = A,T,C or G
gttttagggtaaacaaggnctaggagctagctgatgaaacttgcgggatctataccagggggcgtatccagtgattttgcggggattataagcctaccctaactaaagggatgccgccgcctgtgattttatcgcacctgtattgagctagatctgttaggacagtgtctgttaaccacctttacaaacgtcttctttggataagaaccgctgctatatgggtgctgacaagctcttttttgcattgagtaggagggattcccgtggacgcagctgagcacactgctgggactgcacagactatgctgacgactttaagggcgtttgagcgtttgatgtatgctccgcgcctgccctttgatggtcgcactcgcatcttgagacgacagaggagaattgcatattgcgagtaaattcctcgtgcaagccttaaaatgaaaagggcctacaataatgcaaaccgggaaccatccggtcctactataatgttgcaatgagtggagattcagctattaagcagcttctctgcgtcccggagaagatccagactataacaattggttatgtgtgattcggggattaanttagaggaattgcacgggttccctttgtggaacagggatggaattggaactgcctttacccttttaaatagcattgtgaacgagattcttgtgtaagtgtctgaactcagcccttgcagacaatgggatgcatttaagatgcaggcccacctggggccatttgttggctagaccacaaatgtgccaggcgggggtggcgttgtaaggtacatttttttggaaggggaaacttaaacagt

SEQ ID NO: 6346 - DNA, 809 bp, Homo sapiens
gcctgtgggtactaagcctaaaagctacctgatcacactcgcgggatccaaaccacggagcgcatccagtgatttttcgaggcatataagcctacccctaactaaagggaagccgccgcctgggcgtttatcacagcaggttatagcttgaccgtgaggaactgtgatcaatggaccacaggtacgggcccctcactgcagcttcatgaagataactactgatcccggaggggttccctctcgacggactgttgacctgatgcggatagacctaggctcaccctcttaaggtctatctgctggatgccagcctgccccaaggggccaggacctaattgtctggcactcttacctcccgtgcacacaatatctccttcgggaggcataggctgtactcccaccgggaggactgacggaaggcttcccaggggcaagaaccactgccttggcgtgcccccgagttagtaatatggagcccctcagctgggggagcgttcgatacaccgaagctatgcctggaagagacactatgccttcttgctcgcctgaggaagtttcttaccatggccggtctgacccgcttaatttagcaaaaaacatgttcaacaaaaaccaatcccttcccaacctttccagagtaccttttagacgtccctactacttctgggctttgtgacaagcatggacgcacactctcgtaaaaatccaaataaccgcgccattggtttcttcagtcctacctaagaacttcttcctgaggccccctggtctcgagacttggcaaagttctaggacaccacttgcacaaa

SEQ ID NO: 6347 - DNA, 297 bp, Homo sapiens
agtctattcaaaatgccacattacatttggatgccatgtctccttaggttcctgtgggctgtgtcaatttctgtgacatttttgatgatgttgacactttggaagactattgaagaataaatgtgaacaaacgaagaaataccaggaatgagcttgcatagaggaaaaaccatgtgaagacacagcaaaatgggaacaattcacaagccaaggagaaagttttcagaagaaaccaaacctgccaacatctcagtcttgtacttctagcttccgagaatgaaaaaaaataaataacga

SEQ ID NO: 6348 - DNA, 1429 bp, Homo sapiens
  misc_feature (1)...(1429): n = A,T,C or G
tatcgtctatcagctctcactttatctgtctcctacctgtatactaccaacaaacatcgttgagtgtatttactcggatacacgtattctacttgagtacatacgcttattctgagtgtgcgtcatttgaagctccataaacggtgtccatacactaatctgtgttctggttaactggcgtgatcacgttgctctctgtagcaccaactctctcgtcacagcgctgttagccatggcagttggaactcgtgcattgagaggtcaggctatgcagcaggacgataccacacctcaagtgaccgcagtggcataaggtcgtgtatgccaccacgatgagcgtcgtttagtgcgagtgtttctcatccgtacgacgctcaagaggccttgcgacacggtgtcatgttagcatgacacctccgtcctgagccggtctcgagcctagcaccgcatctgtctctcagtcattagtgtggactgatctcacagctgatggactgcacagagagataccgcagtcggcatgaactcggagattgagtctgnatcgtccacgctcatctatcacatcgctgttcaccctcatacacttgcgcgataatgcgctctcgatatcagtatacgtcaaggagtatggtttcctattctatctgctcgcgagctcggcctagcgagttgtgctcgccgatggtgtatgtatangacgactagaagtatcccacctacggatgttaagctatggatcaggcgcatcaggagtgttaagaggtaggggcatcacatgacgaacggagacctgagtgggagagactacgtcctcgagctgagcagcgtgtcgcgtgactatgtaattatgtgattcggctccccgcctcgcgcagatatngagcagtgcgttcagtccgtntcagcgaacataactctggtctcgcgatagagcgcaagtcacacctaacaatcttatacataatagactcgtgatgcgacgtctgtgcgtgacaggccgcactcttcccagtgtgtgatgtagctgacaatcgtataatgactatatcatctcatacatctagttgtacgatactcacgtcagagagagtggcgcgcgctcacctctgtctcagcctcaggtcgcttgcacgagcgcgcgcacgcacggtgatgtgacgcagcggcgctgcgcatgcgccggtcgcactcccatccgctgaccagcgcaccgatctatgcactcagtgtcgacagtcgttactctcgtcacctatgcactacggcagncantcgtacatacacatcctatattacacacagtcgtattactggccctctcgcagtgtcgtcgacatgtagacgatacatgacgccgagtgcgtatacgttgcanactagtatacaatggtcgcatacattgtcactagctgtatacttctcatcg

SEQ ID NO: 6349 - DNA, 2074 bp, Homo sapiens
  misc_feature (1)...(2074): n = A,T,C or G
tctgaagggctacancgtgngtatagtaatcaataatacgacgnagctctactcattgccaccgngccntaggtagactgaagtacctttcatcgngtgcatagngactccgcgacgcgcaccgctgcacgtctncgcttancatactanancacctcngtcanatctcctctcagnacgcgactctctcatatcgttgataagttcgaatgatgtacctgacatcgttcgattgcagacagacgtctcttatgatgtcgnagcactcctcgtcgcagcaagtgcgtgtcgtgtanagtgagagtggntnatcnttcagtcgaattctgtatagagcgatgctctcagagtcanctctatgctgncnagatcgatntgtggtgcgctgcatcatgnnttntnactgatgcaccgcatcgacgcgcaggacgcagcagtcncgcctacangcgcgagacagcacatatatgantgcgtctatgcgacatctgcggtctacagctctatctaacancaccagacacngtgcgcacgtgacacactactgatctcaatctacataatagactgtgcattctccncgaganacagtgggtagtgagtatctatcagtcagaatctacagacactttgtgagacggncgtccatactcatgcgcattacgagagcgtgcacgatgtcatacacacacacacctgtatgatactatctcctgtcgctgctataacactctgttggtanttgtgtagtatgcatanttcatatatcncatgatatggtgtgctcgactatcactactgatgcgagacaccagacaacatccatgcgtattctcgtgctgctcgcgcatctcgtngcccgacatcagactatancagaggnattgtgcacgtctgagagctgttgctcgtactgcatctataatacacaccatactgggcagcgattgtgntgtngtaggtgtggnataataagntgggcatcgatagataagacnatcgatgtagctaggcaataatattcactgctgagttcgtgtgancttacacatntggaatgggttcagcagtacatatanancagtgtgtattactcntatttgagcntcgcgtgcgttatatcaccgtctgagnctntgtcgatggctatcgtcntgtanactgtctgtgcgacgctatcgnaccgctctatgcgactatactcgctccgactgcgatatactgttgtaatatggtaganagtactcgnctgctgtgatcatgatgcatcatcctnnaantacacagacgntatctatgagtcgatgatgtagtgtagttgcgtctcgatacacgctcgtntgcatactactcctncgntcacgacgtatcngacacgtcagcgctgcgctcaanaccnacagctagcngactcatcacatcagagangtgacacacctcacgntcagctgacgtagcaatnacactgtacgcacnatgtcacccngtacantcgtcatactggctatcgtatcatnactgtccgtcatcacnctgatcgcccatgacactctgatcatnctattccgttggagtgcgctcattcacctntcatgtgttactctctcatcngtatatctcntgcgctacactgcaccaaanacactcagctacgngcgacatnacgcgntgcgccgagangtcatnactagntgttgagaaatgagtgtatcatacactgagtaaanctgacnatgaatntggtngtgntatgngttgngtatatagagantactgtcgtncgtctctcatcgcgatcatcatcaacatcaaactgtgtttatatcgtgtatcntatcgctatcatcatatgncgatnacntactactangcagtgtagtcatacacatnatgagcnataacatcatacttnggtcatcggtctantcatntctgtgtatactgatgagttgnagctcatccagancngntgcatcnattcgtactacagcattagtgctacaacatactatcaactncgcgacacaatacactngtatgccaatattaatcactcntgntgctgcncgacnac

SEQ ID NO: 6350 - DNA, 371 bp, Homo sapiens
agacattatctataccgcgacactgtagactaactcctgaccatcccgccgtctcccggactacattgcctacagactaataaattcatattattactcccccttcttatccggccgagagcggctacgtaagattgctctaaacctatgtcgcccgcactttccaatttactcatctgccttcatcactttactcaaacatcaaatacatttctcaatacattatccacatcttaccccaaaccacacatacaactaatcctctaacaactgtcacactcccatcaattattcactaatcaattcacccacacactacttacaatcaaaacaatacctatttacttctttctcctctccttcatcctccc

SEQ ID NO: 6351 - DNA, 672 bp, Homo sapiens
gcgcgttcactggccagagtttaacagcataaaacattcaatgtgagccaaaactgcagaatcctgcgattgcgaagagggggttgtatagttagaaattgagcgggggagaaaaattggataaacaccattaaaaataagaacgtggacagtggataaggaaaattgtgggcgtggagaaaaaaaaaaaacgaatgccacacgagtatgcattaaatgaacaataggatccggacttagcgaatatatgtacgcaagggtagataaaagatcagcaatcggtcgccgggtccgatatagggtaaaatgtacgggaggcagcaggagagggtgaagtaggtggagatcaggatcccctagtttgccagtcagtacgcgcgtgagtcacgtttaatgtaacaaggcggcataaagattattaacccaacgggtcatggcgcgaaatgcgtaacttgcggaatattgaaaacaaaaagtggcggcggaagaagttcaccttgtaaactacgatcacactcgcgcgacccgaggggattacggtggatctatcgtatccagtattgttcgtggagtgagtaattgcgggctatagcgacattacggagatgatgttgaagcatgtctgatgcgacgattatacgacaggcgacatggtgacagatcgcgggctag

SEQ ID NO: 6352 - DNA, 1774 bp, Homo sapiens
  misc_feature (1)...(1774): n = A,T,C or G
gagcatgagtactagaagtagcacgcgtacagcaggagatattaacgcgagtaacactatactagacagatagcganctgcataatntacgctgttggtctatagacgcgtcgacagatanaagtatcgcacgtcagctgcgtgccatctcttcagatcatagaccgtcaggagagagatgttcgacgaggagtagcgcncagccgatgatgccgntagtagtaatgatgaatgaagaacgtcaactctgcactcacgacgtcactctactactaagaccggcagcgccagggacgagactactngtaccatggctatgtatgagtctgtatatgctgccagtagngagcgttgatggcataagtgancacagtgacatatgacngttcctgtctcgttcantccttgctgccgctctcgaagcgtgagcncggacgcgactcctccagctagagatagctaatactacagtaagcatcatgcatacncggcgcgagcgacgccactcacaccgcacgacncatgcttcgcacgtatctatgtgtgtaggtagtatagctacgatgttagangtgcgtatagtgacgatggcatctacgtcacgcactgagacgacgaatcagaagcgagatgatagatgatggtcttgcgcacgctagagatgcgatagtccaaagtaatgtgtatgagcgagacacagactaacgcgtgcgatcgcgcgccagagtacagtatctcagcgtcactacagttatcgcaccagtgcgcacagctgactatatcatacagcatgcacgatagtancagagccgtacagccgtacagagcgtgagagtagaacagacaagcacacacnactacgcnccgtcagattagcgcgtcccagagagatncatcgagtgccacgcctcgctgcgcgtcgcgtgaagtggtttntaacattctgccacgcgcatatgcgagaacaatcaactccatgttcatgcctatcacgatacctcaatgtattcatcgctatctagtgcgattgcacacgcgatgcgcaatgttgtcgtgctacgcgtgagccgatggttcactgtactgcgataaatattcgcacgacggancatgnaatctggaaagttattaagaagtataccaacgaatctccgtaattctgattttgcgcccgctcccgctttgaccnctctgctcgatctagactccagacgcnatgtctctgtcgcgcgtcgtatttatggatcgtatcactacgtgaagtcaatcactccgccatatattatacttntcgatgtatgtcgcgacgctcaatacgccagtatattctntagcgcatgcggtccgtcgatcgccgatctagtaccatacgctctccacacatcttgtcgtgcgccgcctgccgtattttatatcacccacgttcgtccgttaccgcgtgttatgcgccgcatntatctgtatatctatcagtcaatactcgtgcgccaattcgatgcgtctgatcgatactcatatgattcctcgtatgtcgctatacgcgtcgccatatcccatnttgcganacgncctacnatatatccgacctatacataactcatacagtgatagcagcgcacgccnaatcatcgcctatagcttagacacgatcacacnactgnagtgattncgcacaactgactcgacncagcgatnatcccgcgcacatgatgtnaccntcaactactatcnctcacttactactctactactgatcncgcactatancgaatca

SEQ ID NO: 6353 - DNA, 2126 bp, Homo sapiens
  misc_feature (1)...(2126): n = A,T,C or G
aagaggacgaagacacgcagnnggaggacagnagacgagaccggagagcacaanagaagggagggagaagagaaagccccttaaagtggtagangcggaccgngagagngncagcngagaagagccctcacgngagcggcgnggcgaaagagccgcagngacgacgaggaaagcanagagnagnngagagaggngggngagagaagcgaaacagacacagacgcgtcgtctcnagngaacagcgncaggcgacggagcagaganacgcaccnagcgacgacggnacagcagaggagagacggcaagcangaganacnagagacgcggcagggagcacgcaagcgcacncgaccacagcgcgcccgcagcaccacacggcagcgcgacgcaccacggcgcncgcnaccacaagagaagcgcanagagcacacagcgangcgaacgagcgagaggagaanacagcgaacacgaccgngcagananggagcgacacagagngcacggacggacgagagcaccanggacgangcgcgagggacanaanacgagaagcgngaacgacacgnagancnggangcgaggacgagannaaccgacagcgcgagcaacgncccacacgacgacgcnanangaggcgagagagcgcagcacagcgcgcgagcagacgaagagcaancaccgagcggccacgcggcgncgnagacgcannacagcgcacgcgcacgaggcgcgcccacccnncacacgacnagacacnagccacacgcaagcaagacgacgaacagcagacggcgccgngcaganagcgagngngagacacgacgcangcacagaagcaccncacncgccnaggacaccgcnacacacaangcgacacgcagcgcagcacacagagacgcgcaccagcacacacgncaccgncgaccaccacgcacacaacacgaccagacgcgcagacggacgcgagacnacggcgagcgaacgaaggagacgacacgcgtacnacgaacgcacgacgacagcgcgtacgcgcgcggggnacggcagtgacgcacgtcagaatgcgacagagagcgcananacagacacgnagcacagaantcgatgacaggnacagagcgacgcagagcgacgacgaagagagaacgacgagcacgcgactgcgcanancgcnctgctcgcaaagacnagnagtantatanagacgcacacgacacgaagcgcgcggncgcaancncatcagcaccagnacgacgngacgcgagaggcgactacgnacacgacacangancanacanagagcacgacgcganacgagcagaacncgcgcgtagagcactagtaaacnagacatcagagacgcacgntgcggatnaaccgctccgagacgcgacgagacngacgacccatcagacagtcaacgagagcgngatcactnacagcacacgcacgcgcgncgagagcgacacagcaccnngnnacngcgtagnaancgacgagagtatagcgacanacgnacactanacgacagcacgatcggcacagcagacagacgccgatcgcgtcgctctacaacacgagcgcgccgatacgagagacaaccgaacgccngcgcagcgcatcgcancgncgangactcgtngcaganggacgctgcaggccanacgagagancgagagangcgcgcgcatgcnacgagcgntangatcgcgcgacacngcacacacnagcagacagcacacagcagcaccagcacgcagnagcatcgnacgncgnaccgangaaanacgatgtagcgcgcnacgcgtcagcgacgacgacgcatcgatcgcaggaacgagnanngagacgagtngncgtacgacacgcgagcagcagtctcgagagcanagcnggcgnagacgacgcgcagcagncgacatangcgagaganaggcggcancagacgacgacgncagaggcagcgcgngacgtgcannatcctagnctgatacgctgaccgngcngccgctgtnagcactgcgngcgcgnacgcggactgcccacgacancgcacggagacatgcatcagcgacgcacangngnganagcagtaagacgaagaancangacatggnanacnacgt

SEQ ID NO: 6354 - DNA, 434 bp, Homo sapiens
actctaattaccaccgctacagagaggatgggatttcaccctgtcgctcgggctggtttcaaactcctggacttcagtaatccacctgcctcggcctcccaaaatactgaaattgcaggcatgagccaccgcacatggcctgagagttgttaaagtgatgctatcagaatcctgaggccaaaatcacctggtatagtcatgttacatggggctctgagacaatctatctgttaaaaccaaagcatgttggcctgcagctgattgcaagagcttgcaggaaagcatcagagcaaaataaaatactgtctatagatcacaagaaacttaaaatgttcacgattatatttccgtgatgtgctatttcatacaaattggatgactttttgtaactagcaaaagaaccctgaaactcatttcaaagaaataaaggaaga

SEQ ID NO: 6355 - DNA, 352 bp, Homo sapiens
ctcagcaacaggattaatttctgtcattcatatgtctatattaatgttttagaagtgtccttgaaagcatctttggagaagccgtgtggatttcctctgataatggacatgaaggtctgtcttgcaggaaaaagaaaaaaaaaaagaaagaacatggctgagacttattggaagttagaaggagggcagaacatacagtgcacacctacctggatgaggagctgcaagacttgcagagggtgccgagaagcaatgggttttcctttgcctagagtgctatttcccaaattaaattccctaagatgtcaacagatgttaccaaaaaatggtatatgaaattaataaagtgaga

SEQ ID NO: 6356 - DNA, 1299 bp, Homo sapiens
  misc_feature (1)...(1299): n = A,T,C or G
taagcatagaaaataaaccacccccaacaacggcttcttgggaaagaaaccctaanaatttaatttataatacttttctgggatataataaaagggtggctctaatccaggtgatttgatcagggcgcgtagtgagcgctatccctaattaaatgtgcaacacgcacgaccacagctctttaaaccacaacatgtctgagatacttgtagcccctcctgacgtttaatataggtaaaccacccctgtggcaagtaacgcacatctcctagcgcttgcataaaatagaaaatgcccctacgtttgcccccctatgtgatctttattacaaccgcagatattggagggcgcctccccacactgctggttgcgacatttagattgtataaacacaccgataccatatgcagagcacagatacaagagtgtgattatatgctattccttgcataggagagaagataaacactcactcacatacctaacatcatcacgcgctccactgagagagaaccacctctctgtgttatatcatatacacgcgactcgcatgaatgngcggcgctcaattagtctacccgcgagggcgctcctctaccatatcatttggcgcgttggtggaccacacactcgagcgtatatattttctgacgctgcacaggaagaaaaaacagntttcgctcctgctggcagcgagcggaccacctgtaagatagcaaacaccgtgcgagggaaaatagaatcacaacgctggacaccttgggcgccgctctaaacaaattgtgtaaaggaaaatattatcttctcccccacctcaaccaaatcaggggtataaaatagaaccatgcgctttgcccaacgaagacgtttctgtttttgggaagaagaagatgagacgagctcagatatataaattctcgcatcctgttttgtattatcataacagtacaccttgcatcacgaggacgacagcagcgtgaggcgcgagcctctcttgcaggagtattcccgtgtacgtgataaatcacaggagggacgagagggatactgagagaccacttctacacgcttctcgtcactggagagatacccacgaaagntaggacaaagatccagttagacagcncatagagaataaactaatttgacctccattgcgcggagagagagcataaatataaagttaatactaccgcggcgtggaggcgcggagaggctacgcaataaatataacatgcgttcaacatatcacacagtgacgcaacacacacgaacgagaatagaatcagttgtctgtctat

SEQ ID NO: 6357 - DNA, 1719 bp, Homo sapiens
  misc_feature (1)...(1719): n = A,T,C or G
tttagtaattgataggtagtttagatgcgggtacaacaantttttaatgagaaaaagagaactcgagaatagattttttgagatgcagctgaggagatgatgcagcttgtgtgtgctgcagccgagcagatggagntgaactaactgtctcagagaagcagctggggagtgaatcacagtgtgtgacagtggatgtgcgacagcgaagagacccgtgcgagcgaccagtgtgatanagccagatggccntgtctggagtcacagtgagcgangatgagccagtgtcanagagagtgcagcggatcgcagcagagccntccngcganagtgtgtcnancgtacagtacagcaccagtacagcacttagacagagagagagtgcagcgtgaggtgggtgagcttcagcaagcgcacaggaagagtcagccgaatcgngacngntgtgttgcagggcagcaatgatgggatgaggcacagagaaaacgactaagcgtagctgacacgtgtgatngtgcagagcagcgatgcagtgcgcggcacgacagcagggtgagtagcagcagtngncatgcgtctgtggtgagtcctgtacgcgcggacgaagccagtggccggtgcggggagagcataggaggtagtctctcgttgttgatacacnactatcacggttatagcgctcatgtgcacctgtctcctgcccatctcggcgatggtgcaccgttctacggtcgcaacactaacaacggacgagtgtacaccactgacccgagacgcagtgcatcactcacatcgaatctagtacctcatcaccctcccgcgcgcccgtgcggccatcacacacgttctccgtctgcgtctattaccaatccgctaacgctctcgcccacgtcgttactccgcgctcgccgccacgtgcatcagccgtaaactcagtcattcgcatacgcggcgcgtcccgtcgccgacgacatgtagacgacgcccgtcgaccccactcaccgttctcgcacgcatatggtatcgcgaatgtcaccttcacgcctcttgatttcacacgctccgtgcacagcccgaatattccgacagacacctaaaccacacagcgatatggnagggcgcctcgcgacacacgcacagttattcaccgtcacccacctacgctcacccataccccatatgttctcctctctagctcaccactgtatgttccgcgcaccacccgctttgtaccgcatacacattcgtcccacagcgcgatgatggagaccgtgtcgcgcgtcagctttcgatcgcgcactgcgaccgaccgtgttggtctcgcaccgaatttcactcgacatcgctgatatgtgatccgaccaccgcgccatctatacncntcactacccaccnagctacatcctcatctcgctcacctgccgctgttgtacgagcgatgctncnacgtgcgctcagantcgcaatgattctcgcgcgccactataacacacctcactccgccacgntgttacgccgactgagtactccacagccgcgccgcattagtcaccacaccactaccagcnaccgatcgcgcgcgcaagacgccctcgactctatatcaatgcacggcgagttcttcccgtaccnaggngtatcnaccncgcattctctcaccgtcgcgcngcnacgtgcggncgtttatatcggacgacagtcaccgaccgcgataatgtgagt

SEQ ID NO: 6358 - DNA, 731 bp, Homo sapiens
cgagcgcacgaactcccccccgggggggggggggtcgcggccccccgccccccccaaagcctatggagggggcgggcgccccccacgccttgggccggggaggaaccgcgtctggccgccaccgcgccgaaagccctcgcggggcgcggggggccttgtttgggggccgccccgcttgacacctgttctagggacgaacacctctcggggcctgtcgggggtggggccccccggggagagggaaattcctcctctccccctcttttctctttttctgggaaggggggggggctttcttcttgcccgccgggacaacgtttgtaaacggggcgggcggggggcccccggggggccccccaccccagggggtgggggggggcgccccccccgccgggggggaagcccccccctttttggggaaaggggggccccccccccccctggtgatagccccccccggggggggctctgccccccccccccggggggggggggtttttcccccggcgggagggtgggccccaagaggcggcggccccctggggttttcttctccctgggaggggtccccccccgtgggcccccctcccagggattcccggggtttggcggtcattcccgggtttttttttttccccccggggggtttttttttcttttaaaaccccccctctttttttaagaccaaaaagagtgaaaataaaaaaaaaaaaaaaacccccccccaaccc

SEQ ID NO: 6359 - DNA, 797 bp, Homo sapiens
  misc_feature (1)...(797): n = A,T,C or G
tcttggtcttgtcagtaggtggcagcattgtctgtgagttggaagctatttcccaaggggaaccacaacctcctcccatctaacaaatcccctctggtcctttctctttcacccgcacccgcaaagtatttcctccaggcgtaagagttgacaaatgaggaatttcacttcctggaaaagatgaaattgaattttaaaatatcagggaggtnactncccagagccaggtgttattttgcagctctctgcttttggagctaagagaatcaaacattaacttctaatgcttattttttctctttaaaattctaattcttcttaaagggcacttcatacaaattctgattatattgccatatttggggagattgggaggaagaaaatgggaacacttttagtcatacatggaggtatcaatttaagcagcaaggaaatagagctatgttcttttattaccaaagaaaactctagtatgtgtatatattacgtcaaattttatagaggcctttttaggaaaaatcattcagaaattggtaggaatatgtcttattattatagtgtggtattgtgtttgtaaagggagtatcttttattgttctaaagtaatacgttctttacgattgattaaaggctgtgaggtgcaaatcataaattcggctgcggtcgttgacgttattgagggttaccgatgaatctctagatttgtcaggagtggatgatgtttagagggtcgttggattaatctgtattatggagtaatcagtgtgacctagatttagtaatgtatgagaagattg

SEQ ID NO: 6360 - DNA, 791 bp, Homo sapiens
  misc_feature (1)...(791): n = A,T,C or G
aatcgtaagggaactgcctctcttngtgaaccaccgcatcagggtttgcaaattgatgatggcacaataaaaataantncttggggggaggggggtgaccaactaatnaccttcnnnattgaaccatttaaaactaaaaaaatcaaaacacttcattgtgaaggtacagaaataaacagggatgatgagcaagaatcaaaagaagttgaagagactgctacagctaatattgttctgagggggggttctgatttcttagatagtgagggatctgaacttaggactggagctgcagaaggactagccaagctgatggtctctgggcttttggtcagcagcaggattctttctcgtcttattttggtatgggacaatcctgggactgaagaggatgttcaacttcaacattggctaggcggggtcttccccgtgtttggttatgcaagcaggactaatcagggatgctttgaagaaacttttcttccaaccctgcaaacactggccaatgcccctgcatcttctcctttagcctgaattgatatcaccaaatggtgcttgaggtacttggagaattgacaagagcaagggggattaaatcctcagggcaagacttcccaagatataagggcttaacagtacatgagcaattgggtatagaaattgggaatgagatcttaacaaggccgggctcgcagaaattggaggctatacaaaagccttggggtctttaaaactaaggggccatcttgggaaggaccttttggtcttttggaagagaatctggggcaagg

SEQ ID NO: 6361 - DNA, 962 bp, Homo sapiens
  misc_feature (1)...(962): n = A,T,C or G
ggggttgnacanattgccgttcgnngcannatttttggccccattttnnttggcacaagatcttgcccttttccggcccaaatgctgcttgaaataaattgtcctccaagaccaaaaatacagtatgttttctctcaaaaaaaaaacaaaaaaaaataacctcatttctaataataacctcccccacacttctattttatctgttatagttctctacttccttccttcccctcccaaattaccccattttactttcttcatattttctattacctgttattctaactatacaatcatctcttctcatattattttttcctctcactcatactcctactcttaattcctactattccatcacctcttttcccccaccccctccacatcagacctttctcatctactattacttacccatactcctctcctctcctcattaactatcccaactaactattattactcatatcttctctattcaccacttaaatcacacccaattctataccccttacatatctctcctcatatatcctctatcctcaccctctctcctccctcctatcattttatcccgtatttatctcaatcacctcttctctaataccactcccttttctcctattttttatcctccctctattctctaccataccgatttacactaccgataccctaaacatttaattatattattattttttctctctccctccttcatatatctccaaccttcccctatcctctccttcttcntatttatctctattcattactcttctattaatcccatttctntcaacctcattcctcccattccatctcacttctctattccccctatcctattcattttccctactctccttccatatattattctctctatcccatttcctatcacattcttcctcctccttcttcctacatctctctacctctcttaatctatttatttattt

SEQ ID NO: 6362 - DNA, 656 bp, Homo sapiens
cggcgggtggtccggggtcctttccgcccgtggggcggggcggccgccgcgggcgcactgggcggcgcggttctgggctctgtgcggccgcccgtctgcccgttctttcggtgcctgctccaccggggctacctggttaccgctccgcccccgccggctctgcctgccccgccctggcccggcttgctccgctttctgccgggcgggggcgcgctgtccccccctccggtcccgttcctgtcctccttctcccccttcggttgccgcggggagccgcgcggcgcgctccgccggttcggcctcccccatgcggcccgcgccccttccgtgctggctcttcgggcctgtccgggtgtccgggcggccgggggcgggggtgtgcttggcgcctgggggcgcccctcgcccggtgtggggcggcgtcggggtctcggcccccccccggcggccccctgggccgcgcgcccctcgctcctcggcggtgggggggcctccggggccgcgggtggcggggtcggcttccccctcggctaaaaagggggctggcgccccccctgggctctcgggggttggggtggttgccccccggccgggcggcgggggggttttttttcccccccccccccccgggcggcgttcgtttttttcctccaagg

SEQ ID NO: 6363 - DNA, 774 bp, Homo sapiens
  misc_feature (1)...(774): n = A,T,C or G
ctagctaagattggccctttgagacaccttttcagattttctgcatgtctgaccctgatggctccacctggactcatcaactgctcatgtggtcccacccacactcttgtggtctactcagcgcaagaggacaatttcaactcctaatgatttcatctcccatcaacactcctcgcaccctagccccctgcccaccaaactacctttgaagaacccctaacttatgagcttttgatgatactgatttgagtaatgactctgctatgtggggtggctggccttgcatcaattaaactctttctttactgcaatgccatgatctattttgtttgtgcagggggatggaagaaacttttaggctgttacagtatggcttagaaaattggtaagcataccatgtgcacataaaacaaatttgcattctgttattgttgggtgtcgttttcaactaagtaaaggtagataatatttttgtcttattttttctaatagttttattatgtactcaggaagtattaaaaatccattattagaattgtgattgactgtttctctttttagtcctgtcaatttcggcattatgtatttttatttggttcatgtatgttttatcgntatatcttcctcttgaatttacccttttattattatgaagcttacctttttatttccatttttgcaagttatttttaagtttgtttgacccaatattaatatagncggttcagcttttttacattttatcatccattaacttttaacgtatctgcattt

SEQ ID NO: 6364 - DNA, 809 bp, Homo sapiens
  misc_feature (1)...(809): n = A,T,C or G
tagatatcgctctgtcacccatgctggagtgcaggggcatcatctcggctcattgaaacctctgcctcccaggttcaagtgattctcctgcctcagcctcccgaggagctgggactacaagcacgcgcaaccacgcctggctaattcgtgtacttttagtagagacagggtttcagcatgttggcaaggctggtctcaaactcctgaccaagtggactgccactgcactcccaaagttatttaactggtggctgtatcacttctgtttgaaaaatgtgtgaagatcccgctgtgtgaatcggaggacttgaacaaagtgaatatgactacatgaatactgatttattgctcaacacaacggtgtcttaattgaagagccacctgtctagcaaaagtagaactctgttactagatttaccatttaaaaaaaaaacaagaacatataatttttttaaaggtggaaacttgtaccactccttttccttaaaaacagactactttctttttgttcatttgtaaacatacatttttttcattntaccaataattcgaaaaatgtccattattcataactaacttcttattcaanaacctagaattccacaagaatcagagaattgggcanatatatgtaaaaactaatccgagacaatttggtttgatttacaaggaaccttttttcttccatttaaatttatccatgtgcccctacagccatctggtcagtctgggagaatttccaaataatcaaaatggccacaaaggtaaggactttaatttttaattcattctccgcaagtttgaacttt

SEQ ID NO: 6365 - DNA, 1360 bp, Homo sapiens
  misc_feature (1)...(1360): n = A,T,C or G
cgtatattcttgtcttcacgactctgtgtgcggatatactatatgtatggatatcatgttctcgtagcactgatatcattacgactagcacacgtatacgagagntataccctacttcgctaattagagngttacacgcgcatatgcancgtagttgctatatatgtattataatgctantatatctcatacatgcgtatcgtatctgtgatatcaacataagatacagttatctatatagctctanatacatcctcgatctcctccccgatgccgtcatatatgatgtctaatcgacgtcttcncatctcntntgtaattcggtatgagacattactctgtccttatactctcattctcgtgcgcatcactgtgattncttatgttctcatttattgtagtattgcgaatttatgattctctatccgatcactttatnatctcttgttcactttcagttactcatccgttctacgttctccaatcgtatattctagtctcttgtctattattctcagagtagtacaacccatggcctctaggttgcatgtcgatcatacactccatatcctcgtattattacacttagactgtatcgcattaaacctggacccgtcgtataggtacaatcatgtacgtatgcccctccgcgactcctcttaccttgctcgcatctctcctactcacacagtcgtaactgtagagaccttcgaactcgacaacctttcatagatcatctccgtaaaccgttggtagctctcaactaagctgcgtctcatattaatttcgtgcgtgccgatcactacacttacatggtcatagacgcatacattggatatggaagataagtctcaccaacctacatctggctccgcacaatctaaccccgtgaaatctcttcgtctaatcgtatgcatatgcggaagtaaatcgtccgaatctccccctcagggtcgagaggtgggacggttgtatgcgtatatatgtagccacgcaatggcgcggtgacaaacacgctacatggcggtgcacacgcgaaatcatcgggtataataatgctgagatcgatgtgggtgtaacaggtcaagcgcgaccgggaaaataagctgggtgatggattgatcgtatgatcgtaatatggaaagtgggaaatggtgatcgcgtgttggagtccggcatcgcgcgcccatatacggtagcgtggcaatcgatgtatgtcggcctgctaaacgatggtatgcgaaccgttcctccataattcgggttaacgatcattgtcatacgtagttaaatgctaggccgggaagttatatatcacggcgctggacgcggtcgttgggtctgcgtcgtataatgatta

SEQ ID NO: 6366 - DNA, 2007 bp, Homo sapiens
  misc_feature (1)...(2007): n = A,T,C or G
gtatctgactgnagtcgtgatgtgatggatgncgangattgaactcacgaggcaaatagtggagtgtatcatcatagctagatcntcacgagacagtcgactatcacacgatcagcgatgatcacacganaagcgtctcgcangtacgactgagtagantgtcntntgactacttatngatgaggtngttgcgtaccacagcacgagatcagtgcnggtgtgcatctgancagctaaatgctcgactatacaggtcgcacaaaaagctcgangcgatacgatacgcaatggtaatctgagtcacancgcgtagcacngcacacactgtgnctaatcataaaacgacgngcggtatgnacgcgaatagtcaatcagccactcggtcactagccatagangatggacggtcagacnaatctantatgtaacacatgaaggcgatcnactnatcgctgctgagagntcgctgctagatgacgctgtcacgcgagctatcgtattgcntatgctggtgagtntnctgcgtatatcactanctngtaatctctcagtctgcagttcttatatgtcgaagntgctacgagtcatgatgtcgaagtagntagttagtgtnctntcactcnaactagtcncnacaagctatgatcagacacatgtggacaacgcacatgtcacgctgttacgctacgatcatatgtctagctagactacgncgacgtagtctgncatntcgtgcgcgcgcattatngtgnnatgtgcattactantaatcgaatcgcgcgagnnaatgacgnaacatacatgacgtacttaagacgtctagatagacggctagancnagatgcgtgaatagnctcttacncntagtnacatgtcgagacgtcacattactctgagtgatntgaggatctctcaactacgtncagcgnctggagcatangaattacgaataactaggatagtangtagaangagagancaatcacgangagcgtgctgtgncggtgatnaatatgaaggatgnggagtcgcgaccactacgacataagacagcagacagcgcgtggtngtgcgtatgcggtgtctgcacgatctatggntgcgtggatacatcctagtgacgngnggagcagcatcgatacgatcaacgatgnggtacgggcgtgaagacanggtgnagacgtgtgatgatgatagactgagatagaacnaacantatcacacgtactacggccgagcgtacagcgacacgcatngtnctgactcactggtngcgagactagcggacgtagagagagacgtcatgcgactatagcagtactgttagaccgtncgcnacgacgncactangccgagcgcgatgcgctcgagaattacgataacactatacngatgtganggtgatcgcagtnctaggcctancatatacacgtaatgctacaggtaatcgtctgagtccacatcnaaatctcggcacatcacagatacagtacactagcaacgtcctgcactgtcgagcgtcacaacgtcgtccgantgacnccatctgattacaaagtacaacctatgtcactactaccaggtcacgtgaagcagagtgtagcgcgcagcacactcacgcgtcacgtatatttgtgatacgtcacagacgctacaccatntccctacaaagagcacggacgacatgctactcatgtaagatatgtcatgaccagcacgacgtcatancatacgcgactcgcatgtaaactactctactgctcngtcatacanagatcatgaaatgtgaagttcagcgcaagatactgagnatgcttgtaaacatctctccgcgcggcctactggggcgcgtgtcattctcggctcggcgcttgtctctcgcgcgcctgcgtagaaaacgcggcgcttgtccgttgtttgcccctgcgctgaagtcgctgtccgggcgccctcgtctgtcagtcggcgcccgccatatactgacgatatgaccaagtaaggactcat

SEQ ID NO: 6367 - DNA, 1420 bp, Homo sapiens
  misc_feature (1)...(1420): n = A,T,C or G
aaaaggagaggagagnnagagggagaggnnggggnngggggagggaggggagaagagaaaaaaaaaaaccttttttggggnaaacacaacgcncaaagcctctcctccgcggcggggaacaacccccccgccgccccacggccacggggggcgcggcgccgcaggttttgaacgggaggacgccagaaaagccccgagaggggagacagagagcaggggnggcgcgggccccgcggggcgcagagggnnnaagagagcanacagccaccggccagacgcaggaggcgagagaggcggccgccgagcagcgccgccaccgccgcgcacctgctgcgcccgcgctcgaggagccgcgccgcccgccagcgcncancacgcgcgcgccgctccgcacatcacatataacaccgagagagagcgaacagaggctcctctccgngcggagggangaggccgccgtcggtgcncgccgacgacgcgagcggagccgagagggcgacaggccggacggcgcgccactcgcccgcgcgggctcccgcgcgactcgagccgcagcgagcatcaagtgaggaataaccgacttagangcagacccaccccatccagcaccgcaaccncggcaggaacgcaacggcggacgaacgagnaaggtctcggggcggcaggcgaagagccgagcgggggtgccgagggaggcgagcgtgaggcacagcgcagcncggcagnagcccgcagacagcaagcntccaagcgacgaaacacgcgaagaanagcgagagggaggaaagaggagaggnagaagaaggcgcggcggtnccnaggcggtgcgcgggagaggacacgcagaanccgcgcaccacggcggccagcgcgggccggcgcgacgcccgagggggaggggtcgtnntgagcgnggcgcggagccggagaagggaaggngaggaaagggagggaagggngagggagaggaggagggcgtaagggagaggagggngcgaggaagagagagaggacgcagnaggagggntaacacggcgangcgcacgagacagcgcgcgcgagaggntcgcgcgcccncgcgcgccgcggccgcgaggcacacgcgtagagagcagagcgcgagcacgcgtaccagcgcgcggcgcagcgacgacgcgagcgcaagacgacggagacacggagcgcgacaccgcgacgcgccacgagcgcaggagcgcctggccgcgcgcggacgccgagagcatagagagacgtagggagaggaccgactccgggacggagtagcggaacagaggcgcgtcaggggaggcacgcgcggcnacacaggacacggcgacttcgcacgcggcgcancacacgacgccgctaggagcgaggacgcaggaagactctagcacagagaggcgccgcgagagggcgg

SEQ ID NO: 6368 - DNA, 1691 bp, Homo sapiens
  misc_feature (1)...(1691): n = A,T,C or G
acgagaatggaaagtgnaggagggtgggggagtggcgtgggtagggnantaaatataaatacaagaaaaagaaattataaaataagttctgtgtgggagggacagngtngaggggtaacttcttgtcatacgcggtgacaagcaanaaagctgcgatggtgaaaaaacgacagcaacacagaccacnactgtgagttcgcgagagtcaacgtgttagatgatggtacaatactatttttaaatgtctttatgtccgcgaagataagatgcgacaagtgggtgtgggcacccttctcgtcgcagatgccgagtaggctactcctcccgcctcgctcatgtgtncgcacattcgtctccagagagacacgccgcaggagagccgaggagaggggtgttcgccgtcgtgcagcgagtcgtctcgatcgcgcacgccccagcagcatatgtgcgacgcaagcgtcacttcagctagttcgtcggatggtacgcctatcctagttgcgcacatgatatgntagtgaatatacacgagcagagcggtcgatataggactcgagtacgtgtagatggacagagagacagagcgtcggcaggccccttacgtggaatagatttaaatgancacagagaaacgacataaactggaggtcgacgttgcagagtcacggaggacgactcacgctcgcagtcgggcgcgcgcgcgcgcagacatctagtgctgtcaggagntatcatgtcgcacagtagggcagtagtcagnagtaatgtattcacatgactgtgcgtcctcgctatttcatctcgcgantagtgatagcagtatgagtntattcgtgagtgagcgtgaagtnagtcgcgatcgataccacntaatagagtatgcagacacacagtacanagtagtgagntctatntcncagtcgtatgtatcgcacacatatgtgatgagtgacnacacgntntcaancgacagagagatagcgaggacntgcatgatacgcgtttcgagacgacataatagtctngatgatntgtatgntgtcnantactgattatctgtatactcntagtgtcacagcagtgtcgactacgccgtatanatgcgtagagatgcgagagtgtantgcgtgatgtgagacngngtacgtgagtgagangtatgagaggaagagcagcatgagnttaagcgatatgactgcgantatagtacgtangagnagcataggtgatnatgtgagcgagtactgagatgagagacatgagagcaggcgantacgcgtgtcatgtcatgccgtcattcatgtcacacatgctcgctgtatcatagagacataccatgcatncncncacatcaatagtgcacgcntcatcgctcgcncatgtagaatgncgcggtatgctcagggaaggtgagggaggtacgatgcactgtacgacctgancggctgtcacatggctangtcatcagtgtacgcagcatatgcagtgcactcgacgtcggacgacgagccganctgcngcgcatcaatgagagaaagcagctatgtnatcgcgatgcttgtgcacgatcgcagagtgacgcgtacattgcagatgagagncgcatcggagcagtacgcactctgactanccnatactcatatncgtgatatacntacncattatagatggactacacactgtgagagcgc

SEQ ID NO: 6369 - DNA, 211 bp, Homo sapiens
caacacgtcgcgaggaatcagagggccacgggatcaaatataacgggggtgtgtatcacaacaatatactcgatgcacacgatgcgccacccggccggcggacgctccatgcgggggacaggaaaaaagaaaacggacgacagaacaaacgacgaacaacgacggaagcggaacggcagggaacgaagggacggggagggaaaaaaaaaaa

SEQ ID NO: 6370 - DNA, 1283 bp, Homo sapiens
  misc_feature (1)...(1283): n = A,T,C or G
gatgttcgcgcgcgattgcgaccgaatgaagatgaagggactagaaagagggagatagtatgagggaagaccgatacggagaaaacatcaaaggggcgcatgcaaccgcatatggcgcggaaataccgaatgggggcgcgtgaccatgccgcacgcacgcgcatgtccccatgtccagatacatatcccgcatccatccccgcgtttgtcgggcggccggcggtgtacggcgctcgagaccaatatatcgcggattagacgttgacgcagacggtactatagacacccgcgaatcgttcgtacagtatgcgcgtcgacgataacataacagcaagtgagtggaggatagacacaaagcagccaattcgcgagatgaagggctaagtaggaggaagtggaggggcaagtgaaagtaagtcggtgtagcgagtgcactgagacgacggagcaaggacgagtagagaagaaggggaggggagcacggaacagtagcagatgaattgaggagagacgaatgaaagtagaaaagagaagagaatatagaatagaaggtacagacgagatgacaagcgaagagacgaaagatgacggccgaggtataaagaagagagaggacgacaggagaacgaagaagagagtaggaccaaataggagatgaatcgatacaacagaggagaaggantgagggaagaagatgtaggatgactacaggagaggaagagaatatgatgagcagagaggagagagaaacgtaagagaaagaagagagatgcaagacatacgaaacaatgtgagaaaatgtaggtgcaaggagagtaggaatagcaagagtagnagtgtgaggaatagtagagagctgtgcggtgtagtgtgaatatacaggagagatacatcgatgaggaggatcaggtgagacagccacaancgagatgagtagatgacggtgtagtataaanagtagaagacgncggacagaagatggagagagcgacgaaagtaatacattatagacagaagaggacgggcgcgaattaagaaggagcgntactgcgatgngaggaatagtgtagcggatgagggcgacgcagagncagcggcgtgagtgagagatccgagcgatgaaaaggtgtatggacacagagnactcgcatatgtgacgttagtacgtataggagtggatatgaatacggtagaacagaataactaaaatnatgtatgatggcgagcagtggtatatgtaacaacgatattatgatgtgagaagtgagaggataacgatgaag

SEQ ID NO: 6371 - DNA, 102 bp, Homo sapiens
caacaagctgaacataaggggggggcttttatttaccccccccccgggggttaaaattcccaagagaaaaaggactttttgttcttcccaaaaaaaaaaaaa

SEQ ID NO: 6372 - DNA, 1595 bp, Homo sapiens
  misc_feature (1)...(1595): n = A,T,C or G
acaggcgagatatcatgctngacgccgagcttgcacgcgctatantactttaagcttgctcgatctatgacntcaacgncagctatagctctaatctgacacnatgacgtctcgtaccgtgtcgcacgngatatatgacgtcgcaccagagagtantatcgtcatagatcacgagatacgcgtcgacgtcagctggaacatcagagaacagcgncactcgtggtcagcctatataagancagatggtcgagagcgtgacgtantactagtnatatcgcatgacactacacgacacgntctagcgatactcncgncncgcgncctgcgntcgatantaagagctatgtatgntcatatcgcatctgtttcatcctacaccntgcagaaccacgcacagatcgcgtatcaggtatncgctcttctcgctgtgctttgcgtgcgtcgactctctgtgcgtcgacatctagtgattgtatgagaatactagtcgantgtaccgagcagcagtatctacagcagcgnacantatagaagttatgcagctgtcacatctatatgagatcantagtaattcgaatacgcatccgcgttcactacctatgtaaggatacgaaccacacagacagagtcntggagcgtaagaagtcgtcgtgatgctcgcatacganaagctcgtgcgagtcatctacagatgcgcgcatgcactgtcgacggtacacgtacgctgattacgccatcgcagtcacaataggagaggcccagtggcagngtgagcgagtagaggttatgtaggaagcgcgtcacaagcttgaggagcttgtgcagaggacgaggtntgaggagaagacagacaacacgccgacccggcgtcggcgacgcaggtatatcctcactcgccctatgcaccgcttgttgtctctatatcaaaactatcctcatctcctatatctcccatacctaccagattctcgccacccgtcgaacgaactattcagnagctgttcatcctctgatgtaccacgtgtggccacactatccgagatatcactatcaccaattagatcactcagttcgcctaccgctgtgggcaacttggtaaaaaacgcctaccgcgtatcagtatttcccgccatcatccattccgccagtcaatatacacaatacgcacttcgacttgcgctagtggatgtgatcctaggttatacgtcgtcccgttatcattatattaatcatccgctcctcccatattgacgtctcccacgcgtgcgtccagcaatatatatttacccgcaccctatctattacgccgcgcgtttttagtacccgcatcgccctgagccgctcntcatcaccacgantcgattaactccgagacgatcngaccctattactgccatcgtacagtcactattctctcattgcccatcgctccgttcccatatacccgcgagtttatcgctcattgacacgttgttttcgccacctacacgcgatcattcacgatttgatccatttgcactatcatcaccatcattaacactccattatacgcactcgaggccgcggtagtaggaagccagcgcacatatttgtcg

SEQ ID NO: 6373 - DNA, 1036 bp, Homo sapiens
ctgtgaactataatctataaatcacaataacgactctcggctagagactggatgatatgacaacacgctttcgtgtatatacacgcgctcggcgtacttatagtgtatatatcggtgtaacggcggtattcgggtaaaagtataaaccaagcgcggttgcgccaatatatggttgatcaaggtgcacgccctaattaagtcctaattcgaaagagcggagagtagtcggccacgctatgaatataatataaattggtaacgcgcttgagagcggatgatagaggtgacatatgatgaacgacagggcgtaatcatataacctatgcagacgctatcatccagcgctaattatcggaatgcagccacgcgatatggatagtaattcgacaaaatacgaaagtcgcgaaatcagagtgtatctgctctcgcgatatagactatgtgttatatgcattaatatgtgtagcacgtagagcaacacggcgtatgactaagtgcacttatataggtgctggatgtatgactgcatgtggaacggctctgtgatggcatatctctcattttatagtcatgtcgtactcatgctcgcgtcatttacacttatccgtctgtgctagcacgcatgaggtatgaatacgtccgataacaggatagaccaatttcgcacccatgagcgcgagtagtgtacgaccattgaaggctgaagagatttcatttaaatcatgaatgtgagagcgatgagcgaggcgagcaactatacgagtatatccaataaactcccttgatgtatattgatactcgcaacaaattcttaacgttacaactaacgaaagagttgttatgacggtctctcagcagaacgggggtgtccgataacttcttccaacatggaatagtacacaaaccttttgtcctcgattttctacttgacgttttacactgctgctattaataggaaacaacctaaaatattatttctggttggtgaaacacgtcgaatgttgggcccctctaaaattggttatattctgtgaaa

SEQ ID NO: 6374 - DNA, 1332 bp, Homo sapiens
  misc_feature (1)...(1332): n = A,T,C or G
ccgtgtcgtgtctcttctctgttctctctctcttgctgtggcgtcgtcgtcccgcgtgctgctngctttttgtccctcttccgccctcgcgccgcgtctcgtcctgttctctgcgctactggtgtgtcgcgcgcgtcggtgttctactcttcntctgcgcggttcgtgttctccttctctctgtgctgtgtgttgtgctgtggctaggttgttngggtctgtcatgccgctgcccctgctggctcgcgccgtccgcgngtcgtcggttcgcgctcctcgtgtncgtggtctcgccggcctnccccggtcgccgccgccgcctttcgtgcccgcgggcgcgcgcttccgctcgtcgtgtcgtcgctcgctctgccgcttgcggcgtttcgtcctggcctgtccctctcggtgtcctccggctgtcggctctntggccgcgccgggcggctgtcgttcggtcgcgctggtgcgcggcggcgtgtcctgcggctgcggtcgtgcctcgctcgccgtggtccgtgcccggccgggtcctctgtcccggcctgggcgcgcggcggttgntcgcgtctcctcggcgtgtccgcgtcgtccncgcccttgttgcccgcgtgctgctggcgcgggtctgttctctgncccctgccgcccgcgggggcgctcggccctggctctgctctcgtggcctttctgcgcgggggctcgccttctgcgcgtcggcgtgtggtgctggtggcctcttgcncgtcccttcnggggcccgcgggccggtcgcgttccctctgcggtgccggcgcgccgtccgccgccgctgcgcgcccgccgcgcgcctgccgcgctcgcttttctncgcctgctggcggcgcgccttggtctgtctcgtgcttgaatgcgtgttgcttgtgtgtgtcgttttctttctgtngcgccgtcttcgcgcgggctgtgcgcggttgcgnggcgcccgttgtctccttctctctctgtttcgcgttttctggcgcgtttttgtcgctcttctctgttttgttctttctgtctcgtgccgttggtcgtgcttcgctgctcgtccggccgcgggttgcgctggttctccttccccgctcttgttcgcgtgcgtctctcggccgcccggctgccccgatgtccgcccnttctcgctttgccgtgccttgctggcnctccttgncgcggcgtggttgtccgccccctncgcgcagggtgtngcgtncgntnnggttttngctctgcgccacggttcttgtgttgctgtgtcgtccttctggctgcgttgccggcgtccccgctctggttgctccgttctctgtccgc

SEQ ID NO: 6375 - DNA, 889 bp, Homo sapiens
  misc_feature (1)...(889): n = A,T,C or G
cgtccaagagacaggatgaaacacccgcgcccggcgaaccccccgtcctttggcgacggtggttgccacacacgggtaagatcctcacttttagcccgcggggggtcgttcctcctcccaatacgctagtaaaggtcgtaaatagcgcgttgttgggggtcggtggcgggtggcgtgagtacgaatcaacttcactcgtgtggtggtttcgcacggcgggataggcggaggcatggtatattgtaggtgagaaagaagacggtgggcggtgtgactcagatgaccgacatagacatgattatagtggtgttttcccagctaaagccggggtgcgggagagacgtggaggtgctatcgtgctttgaggagacggataggtgcatcgcgtttggtgctgtcgacgggcacgagggaggcgggggaggggaagggaggccatagtgtatgtgtagctacacgcgatcgcagcgcaggaggcgatgcgtgggtgtgttgtgtgtccgcggtgtcaggatctcgcgcagggccgtcgcaggcacgggagtaacgcacaagagtgcgaggggctacagagtcaagtacggggtattataggataggaaaggggagaggagacgacgcgggcggcccgcgccggatgtgaagctgtgtctaaacataacagcgtacgggcgagcgtagcggagagtcgtggatggtggcggtgtatagcggacggcatnggtagtgagagaccactggcggggtgactgccgacgcgacgtgagcaggtaatgcagatcgccggaggcagcaagtagagagtcagtaatcacggagagagcgacgatgacgagagcacgcggnagatgatgctagagtaggagtaggctggctacgagggacgagg

SEQ ID NO: 6376 - DNA, 429 bp, Homo sapiens
ccatcaaattccaaacaggcaaccagagcctctgaagatggccccttcttctggggatcctcacataggcctgggaggaagctctgactgccgtttccccaaaacagcgcccccgtctgcagaaagtggttaagattggtcttagtccttatccttaatctaacgggagttagatatacttctttagacgggggaatgagacagccaggtgggagggggtccctggagaaactacaaccagcctgtctactgaggtggagcctgggaagttcgagccctttgcagtagggaggagctggccttgcctctttctgtgtggaacctgtgatttggacgtctggcggcaagtgctctaccaggggactctggacttgcggaggacccctgttccccccctcatttttccctgtttcacccaataaagcccga

SEQ ID NO: 6377 - DNA, 1046 bp, Homo sapiens
  misc_feature (1)...(1046): n = A,T,C or G
agcgtttcgcgtgctctctcttgacttaatatttgtaagtaatagtcattcacactgctctattctatcccttgnaactcacccatatcaataggtcaatgtataacaacaaggcgtcttatcgtatttttcgaccatacgagtgtacgccctccactaccaacgcgctaacttcgcactttgtatatcccacgtcacagaagggaaggacttgaggcacgctccggtggtcggatgcgtgagaacaaacctacgtgcggtgcacactaacactatttaattacaacatctatagagacttgtgttgactttttattatggtctctatttggagacatatacatacttataaatcctctacttctttcattaattaagtctgagtccccaaggaaccaatttcacgacagtagcaagagacgtgtcgctcgccgacatatactatcaggtctatagnatatattacgtaaacagataatttgagaatgaattatttngtctgtttttttgtgtttcgttcttccttcttctgctctgtgtattctttgaggtacgagttaaatgtatattattgttctttgcttacatgccccagcagggcgggcattaggtctaactcatttttctattgcaacaacatttataataaaatatataatgattgtcgtgtcaatgcctcttccttttgctggtatttccactctcaccacacccgttctctctactgtcagagagagacggccgagggctgtttctattgttgtgatttgtgggtcagtgatattctcaacacacgtctatgaattgtagttgtgtttactgtagattgtagttaggggtgggccttcagggacgtttgcggcctacgttgtggctacgccctagttttgtttactgcttcctcaacacgtacccaaagcaacgccacattgacatcagaaaaaccagtccttgcaaaacaacgccccccactgtccccatctactttttttttcttttcttcttgaaccgaccacatttactattatactccatcttaccaacca

SEQ ID NO: 6378 - DNA, 1529 bp, Homo sapiens
  misc_feature (1)...(1529): n = A,T,C or G
ctccttacacccccaatcattcatcccatcacacgttctcacataaaccaacaacacttatacaccctcacatttacttatttccttcttccacttacctcccataccaacaaaatcccctcaaaaccccatcaacttcctccccttaccttattatcgggggtcattcctttaccaaacaactaaacaccattccccctattcacattcttccatctttcactcaatcccaaccacctagtattttcccaatcttcatcccatttcccaccctctcttcaccattatcttccccngttcttcacctttccatcccccttcacttattttcgcccctactttccattctcttcactattcgcaactctcctccactacacctccnttaaacgagtttgccaacattttcccatcctctaccatcaatccatcactatcataatcacatattttcttatcccctatcacacttatcttatccanacacatatctccactcacatcaatagccatctcataccttagcacattgcaattcataacccaccaattttctatactcactacttcatattccattacatcttccacaaccactctaactcctaccatcatcataaacactaccttaactctctactaaatcattatttaacaacatacatccaatctattactattaatatnatatatatattttcntactacactcactcacaaatcacatacaaaactattactcacactcactganaccagtactaacatccaactactacatactttcctntaaaccccaactattcacttcaatacacgtaacanttgtactatatcaataccataacacacattatattctactnacactcacaattataaagtacaacacacctccataaatatctatatttattataaattatacgactgacgcattataacattatatttcatctgattatatatacagcactacactctatactaccactctgtgattctctatatataaantaatatgtatcttgatactatattatcatctcacataattaataatatgtatataatgattctacaatnctantcatatcgtcgcnctccaatcagatagtnacnatatacatctcgtaacgtatcacatcatgcatatctntnactctctatcgcctcaatcactatcaaatcattatctactcatagancaaaaatttacgaacactcatcatcnatatctctacacatctcacntcattgtgtaancactacaatacatgatgtgcantactgtcatactaattcatctcatantcgcacgcnacatcncgacatganattatttcaccangtcngatcgatcatcatcatcaccaatacnacttaccgtccaanctcactgatcggactctctactgtattagtatgatcacatcacacgacgacacagctcacttacttaatccaacnactnntacttatcacngtgatcacaaacgaatctaatactatcatccaaataangtact

SEQ ID NO: 6379 - DNA, 1461 bp, Homo sapiens
  misc_feature (1)...(1461): n = A,T,C or G
gttcatttcgtcgaacggagataccacacggagagacgagaagacaggcgaaaattctcgcaggcgaagaaaggcaacatacgatacttccgcacngacgagcaagacaggcgaaaagaaaaccacgccaatcgtaacagacgaatgcctcgcccgacattccaatatatgtgtacgggtcagtggcgggatccgaacaacacagtaccacatgtcgcccacatatcccntctatcacattnatatccatcgatcccgcccaccatctatttattcacgatagcgccatgcacgatatagcatcgcccgccagtcgtgcgttataantatccacanatataatcgacgattgccgcacgcactgtatacataatatttgcccaccaccncagcgctgatccgaacgatatatgtcgcatacgcgccagcacccgcatccaccaccctaatataacgagtgggcgcgcacgtgtgccagccgacggtccgcatcttgcactctatactaaaagcacgtatagacatattcgcaaatccacttatttacggtaacgagtgagtatgctacaattaactatgctaaacagactgccggcgaaagtgatagtcatagctgacancaacacaaacgtaattgtagcaatatcgtataaagcgagatgtcgtagaagaagagacgacgctgacagaacgaacatatggatgatgagatgataagcaggagcacatagtagaagtcggagcagcganacaggacacgaggacgagatatgatatatgactacagtgtagtacgcacaactcgacagacaccatgcaagancagagaggtgacgaaaactgaacaacataagccgacctcacgctacgcgtaatggcacacgcgtgacacaggttgcgtagcgtagaagtgtatacacaaagatgaaacacacataggataggcgagttgtgaanattaagatgtggaggctgtgtcgccatacagtaattgcagtctcacgaactgagaggaaggatgtagatacgagcaatatgtgtgacgatacagaacggatagagccaangtgtgtgtgagtgatagactcaataatatgataatttccagncngcatgtatgcgcgagcatctggagacgtggagaggcagagaagagtaagaggcactgcgcgtgagttatgacatcacaccatcataatctacttagtatcatcgcgccaacgccgcaccactagacatgaatataccanataataatatagagttatgatngtganataccagataatgagatagtcgcatatacagntagatttaatagcatactcacacacgtcaatatgacacttctactagaagaccacatcattcacccacgcgacgcatcactggataaattgtagcacgcacggccaagtagctccagataatgcgcacccgccatagtagagacgatattgt

SEQ ID NO: 6380 - DNA, 1272 bp, Homo sapiens
  misc_feature (1)...(1272): n = A,T,C or G
cttcttttcattccatccctgtcgcctggcgggttttcaacgcacgtgccccctatttttcccccacaactagtgttcacgcgaattatactctacaccaatctcacctccgacaatacaacaacccccctcgtacctacaattctcccccgctttccttcattttcaccgggcgatggcggttccaactaaaaaaacccattcccccatttccattttccttacactcttccacccaccttttgtccctacccctccccttttctcctctcccctccttttacaccctttctcccctttcccccaccaaccttgtcaccccccccttccgtccttcccttttccgtacacccccacatctctccatattgggggggggacctttcacccataagactgtctcgtccaacaaaaaaaattttctctccacatccatataatcttagcttcaactttctctctatcttctcaataattttatacatgattttgacgtattctgtcccccattagatatcgcaatacaagtacatctagactacatttattacgataaattaacaaacttctagntcttcataaacatacgatagacgccgcaaacccatctcacaacaaagataattcctatcaatatatacatataaatacgcctatagttatatccagcaacacaactaaagattctcttatcctttctctcatatccacttactttatttaatatactactttaacttaataagcatactacaaataaaaaatacaataatcactcctctatattctacgtcaaatatactagatagcaganagtaatctcataagcagncgaactctaaactcactaatctcatcacgctcatccacatatcccttctctcatattgcacatatcaacgccantcaccatgactacatctcatatagttacatttatgagctctacactatncgtacctaaacgagctagaatttacgcgctgcacacacagtgtccacacttactgacatcttgatacacacttcacacacacntttagatgcgccgcgctcagccctgacgtgcgcgtagagagatatctcatatgtcgatattatatcattctncacacaacaagacgaatatagcgctacatgtagatatagnataatatatgttatctagctctactcgtctcgtctatatctgatactgcactccgncacatctatatgatgtcgtactatcatatatcactacgccacgcgatatcactctccactatttgt

SEQ ID NO: 6381 - DNA, 1123 bp, Homo sapiens
  misc_feature (1)...(1123): n = A,T,C or G
cactcgtctctcctcactccgcatcgtgccggccatctttctcttccctttcccctctcgttcctcacgtgtatgtttccggtcactacgcgctccgttcccgctgccatgtcctggcggcgcgtcgtccatcgtctccccgccccntccgtcttttcacccggggtcccggtcgcccgcgccntcccatgctcccgtgtccttgtcctagtgctcatcgctcccgcgttttcacgtccactcttccttcccccgctcgcgttgtttttttgccgttttcccgtttcgccgcgccccttttacgcccgcgttccgtcgtcgtatgcgcacgtcgctcttcctcgtcattattcacggtgggggggttccaccatctccacattctttctatcgtctcgagtattagttcgctatccgattttgaggtgttcgtagtgcgccggcgcctccatatcacttcgtccttgtcgtgtgtttctgccgtttcgtgatatatgcgagcctggtcgtcgggcgtgtgcagcgcaggtgtatcgcttcgcgggcgnttgtcgtctcagagagaatcggcaggacggtgagcttctgactcgcgttgttggagttagtgcgtgatgtcgggtgggttcgtttgctgcacgctctcgatcgtcnatatcgctgttgttgttgcagcgtcacgaagtgattagattcgagaggtgcgtgtggtctacgtcggacggcggagtgtncgttggttttggcgtgtatgattttcgtggtgcggtgggtcgagttcgaagtgtatggtgagtgggtgggtagaggcctggttgcggctgagcacggtggttgtatagtgccgcgtgtgccacaagggatgtgacttggttgtgctatgacgcgaggtgttgcggactcatctacttcgcatgtcgctccagagccggtcgacgcctgttgttttcctcgtgtgtccagtttctcgttgcccgtctctcgccatcggattttaacgttttgcgtttacatctctccccttgtccgttcatccctttgctattcttaccctccctctctctctcttatgtctccgctcgcctgtgtcctctttgttggtagccgattgtcttcctttatg

SEQ ID NO: 6382 - DNA, 795 bp, Homo sapiens
  misc_feature (1)...(795): n = A,T,C or G
tggtatgagaaagagggagangttactggatacactctcttaatttttccaccgctacaacgagnggtggataccctacacttttgcacacctggtgaacacccaaagctgaggagaagacctaagacttgggaaaatgtaccctatggtcaaccctcccagcgggaactgtgactacagagcccaatcttcttgtttcctaatgtggtgctgaaatctgcaccatgtttgttagtgaccccacacatattgttggctcatttgcattagtttaatggaagataaaatggcctaccaacttgttttggctgaataaatgcaaactttgagtggcggaccgattctccttagatcctagatacactagacactatagtagtggagactatgcagttaaacgcgatcggagatgaagggcgcgaagaagtggggaaggccagaaacgcacgatgcagaatatgataaatataatggatgctgaaactcctatagtacacagataaggcttgcgcgagtcacggaaaatagtcgctgatccaatagtgtcgatgtggaacgcgttgaagaaaatatttaatgagaaggtagtagaaaaggagcgaaagatttattagttcgatgcgtagaggatgttgtgattgcagctaccgggcgacgcagagaaggctggagggtcgatagaggagntgagatactagtcnatataagatacatgattgaagtagagtctaggtcttaaatcgaacactnatcagactgatcattatgtatnatgagtgaaagatatgtagaaac

SEQ ID NO: 6383 - DNA, 1295 bp, Homo sapiens
  misc_feature (1)...(1295): n = A,T,C or G
caactgtcaccacccatcgcgagtccccacacaacaattatctcgtcccgatgccatcttaaatgtggagtagttgaaatccgtatatccaagaaccgaggacaacgcgatagaagagagtctcaagtaagaatactagatacagcgcaaanaccatgtatatgggggcgtcataccgatatccgacaaacaaaagacccatttaaccaagttctcgattcaccattatcgcccatcatccagccgcaccatattatcacctcgacatccactcttaccccacgtcccctcacatttttatcacgatttttctactttaaccctcagtacgcatattttcatccccactctccggtttcgttcctnatttcacatacttccggtcactctatctctcgacatgaccatgtgtgcgccatatacgacccattaaactacttatgagtcaatttgtaatcaagacatatataaccacaaccatgtattttaatcgacagttactacacaacacaccattcatacttgagcatcataatttctctgcggcttctccctagattcttaacgtaagatttacgtctagggacataacgaaacataaatattagattctcgttcaactgaaaacatggaaatatagatgtggttaattatcgaggacctagcatataaaagcatagaaataacctatcgacgaccactaatcataatatgattggatctgtaaaacactggaaataatacacagacaaaacatatactcatctttgagaatcacgacatagaagagagatatcacaatgttgatgtaatatagtatgataataaatgacgttccacaattgctatgagaggatttcaataatataaacataagatattaattgcattcgataaagtaatagtatccaatatgagagatgacttacacatatctgtgagatgatacattcaattatcacactatatctcatattgactcagtatataagtatgatacacaaccgattataagttatgatctaaatacagataacataagatccgtgcttctacagcgttacatattctgtgtactaaataatatatctacattatcaatnacatncaacntgtcatctagtatcgcatttaactntccttntacgcncacttctcacattcacaccgtgtaccacttaatcgcaatatccaatttataactccgcgtaccgacactattactatatacttaacgcacacacatatgacctcactacaagtcgcctccactgttgtattatgtnagtatatgt

SEQ ID NO: 6384 - DNA, 1378 bp, Homo sapiens
  misc_feature (1)...(1378): n = A,T,C or G
gagcggagacagactcgactccgtgtagcaccagcacgaggtaagatgttgagatgataatggtacggacgaagaggacagagataacgggaactattccggcaatcgagcncgacagcgaacgtgagacagcgctctatgaatccgaatcaagtaccggagcgacaactatataatgagcggcatcaatgcgcgtgtcagacacacacagcaccntgtcgcacacatggtccatggtccatcactgacagagcgcanctcgcgcgttatctcacgtcccgcgtgccacgtatcnacgctcgtcgactcacatatgtattcaccagtatagcgtcagtgtcgacgacngtatacattgatgaaccacctcattaccattgcatacatttatcgcgtatcgtccatcgccactcaccaccaataatacagacgtgtgcgccgattacataccattagagcacagaatggtagcagtcgtaaatctagtgtgagatggatcgccagacgcataagtatnagctgggngcgcagaaagtacataacgctgagtaangagtgcgagtggcttagttagaggatcgaagaccgcaatgacatagaanatggagacgcagttagttatgttacgtgtanaggacgtagatagtgatcatgatagtaggancancacttagtgtgngatcacacagcaagtganaaagaagnagtacggcgtaagaatagaganagagatgatcctacgtgacagtaggtatagcgagatgactgggcgacatgacgatatgatggtgtgctcaacagctgacaagttaantacctaangagatgctgctatgcgtgcagctagcgtacacgctgacgtggctattatgtgagagataaacagcgatagcgacagtgtgctcagttatacgaagaagagtaggctaagctagacatataatatgtagtatgcgatctctaactagtgcgacaacaacgtatgagactatagacaactgagacacgaaggtagtgtcgtggactacagaagagtgtataacggcgctcngatgattcgggacntctagacggtggacagcgcgagatgatagagtcaagacagagagtagggagagacagagaatacaatgtagaagatctaggatcacacgtgcgagagantgatatatgtatantagtaataatcatgagaaagatgtggcatgatgcatcgaagtaagaagtgaacatacgtgacagtaacgacgataacagcacantgacactaacagattgcagtatgggaatgtagcgacacagatcaaaccaanataacatcagagacccgcggatagatcatgcggtgttaagcatccacaactacgttctagtatcg

SEQ ID NO: 6385 - DNA, 1029 bp, Homo sapiens
  misc_feature (1)...(1029): n = A,T,C or G
aactggttagcactaagcacgtagcccacagcagagaaanagaggacgcaaacacaccctccgagggggaaacagacacacaggtncttcgcgggagcgaagcacaggcaccgaagaccaagcatacaagatcaatatggcgccgttgctctaacataggggacgatggggtgccaacaagaaacaacattcccaactccattgtacaatcccgacatcctccaccgatatacactatcccatccgcgtcccgccacagactgatttctgcactatatcacgtagcctcgcaattgcgttttgtccccaccttaattcgacgttatcgcacgaccactcttttttccgtggggggtggccaagggacgccgagccacgaaccaccaataatagaatagtatgtcatagactatgataatgggctatagtgcagacaccagagacagccgtcgagaggttaagacgttccccaaaaaatcaagtcgtgtggacgtaccggcagaagagaggcatggcgcgggtagtgatgctcggtgtgagagggtggtgggacgagggcggggtgtgagtagagtgtggtggtgaagggagtacgaaggggggtgggaggatgcgtgtgtaagatagagtgtaagggcgcatgagtgttggggagagtgtaagtcgaaagacacatattagactgaaagcgaaagagtgatataatgtatttgttgatgatagtaaacccaacatatgagataggagaataaaatagtacagtaagcatgagtgaggagatatgataggtaagtatggcgtgccaaggagctaggggagagtagaagaacgagttgtgggacttccgatagcagcaaacgtgcgtcgcggccgggccaaaggagtgtagagatcagtaccgggagacataccgcaagtaaacgacatgtatagaagacagcgcgcaatgaagtagctgaagaattagcaacacacatataagaagaatacggacaaataggcctctatacgagagcaaaataaagtgag

SEQ ID NO: 6386 - DNA, 1063 bp, Homo sapiens
gatacgaaatattgctgtatatcgtgtgaatggatttgcgaatatttggtagattttgtaaacgcttggtattgttactatggtcgttatgctttatgactattttatatgtatctgattgtcttactatataaatatgtatgtaaattgtcgttctttgttttttttttttgtttatttaaaattctcttagattattttttttcttccttttttggtgtatatatgtaattaagaaaatccaatgattactatgtgctttttatacaatatttttttcttattatatagtggtcataacctaataatatatgtttctcttaattaattttttcttttgactaaatttattttattctcttaatattcttaacctctttattattgttccttttatactgtgtctacttgtcttcttctttaaatgtttttattgttcttgtatatttactctacttttattggtaatgtatatatatctagtatgattgttgatctgcaagtggtgctttggttttttttatctgacatggtatcatatctaatggagcatctattctttaactttcgttgctattatatgacggctatgcgttttttctttgtaatcacatttggtatgataacaaaatattataatcatgtattgaatcagttttatggtgctaagtgcgcacccccccattcgggagtagttgaggatgtacgatcgcgaataatgaatgaatggaatgggtgtgataaaaactatgcgtcggtgaaacggaataacgggataaataggagagagtggggtatatgggagggcaggtgaaaaaagtggggtggatatgggagatggagagtgtattggtgaagggtgttgacgagtgggaacgccacgagcgctgaatatacggaagagcgggggcgaattgattggtacattgcacctgtgtttgaacgttttcggatcgtcatgggatatgtctggttactgatatatgtttcgtggaataattggttctgtggttttatttgataatgtgccggctcgtaaataggattgagacgataacgatag

SEQ ID NO: 6387 - DNA, 1216 bp, Homo sapiens
  misc_feature (1)...(1216): n = A,T,C or G
cccatttaagcacctcgtccacagcacatgatatgtacaatataagaagaccgtgcaatactaacgaaaaaaccgtatcgttgcaaacagcgataaccaaccaacgtaaactaactccgcaaaccttattgggctcatccataccacaaacctccccttcaccatatcctcctactcaccctcatccaacccccttattccactctccttccctgtacatcccctctcaaccgtatatcataccgtttatcacctttacaccacttgtactattttcactacaccataccgttcgttcaaatttcgcgtcgtacgacacacacacaccggtggggcaagatcccacgagagaaacaatatccgtcaaacgacgctacgagtggaagtaagcaaacccaaccaaataatctgtgcggcaagtaacaatataggccaatatactcggcaacaatcaataggngatgcgtagccacaaataataacacatcgtgtcgggcaccaaatacacataagaactcaatcaacgcgtatagatagaatgtaggcaataataaaagaagaggaggaataaagtcgagtataatacaaacgaactacgtttgtaaagggttcaaaaaattagtaattaaaatgactgttgactcagacatagacgagacacaacagttattacagcaatagcaacaatccagattatncagaaaacaagagtgcgaatgagcacagaatcatgctcacagaataatatagcgtaagcgagtaagagagaantaacgacatcaatataataatatatgtagtatacagttgaagaagtagacaaataacaacaaatcatagctagacaacatgacaganactcgtgataacacaagataantgtatattctacataactatncactgatactagagtgatgcgagaacgtatactcaattacgctcttcacatggagatgcatcagagatcatcgaaagatgaataactacaagacgaaccgagcatgcaaaataaagtagacttcgatcaagcactagatcacggactacgacgcaagtagcatattagtgacgcatccgttaataatgtatagcagaacctaatataaacgatatgcgctatccagtgactcaccgaaccgacatatgtaaacatacacacaaatgccagccagagtgaagacatagtatatggccggcgaataccacatacttc

SEQ ID NO: 6388 - DNA, 1340 bp, Homo sapiens
  misc_feature (1)...(1340): n = A,T,C or G
tatattagagtaaatgactgaagtgtgagatatagttactatgtgtatataatagtgagagagcatgatatatattatgagtgacggatgtgggatcgtgaatactgtgttatagcagcattatctctattatctgncantgtctgtgcatatatanatgatacatcgcatacggtgtatgtgattgctctgagnataatntacttttccaanattntatacgtgtagctgattattatgtaggttgctagtgatttacgaagntgcgagtcgttttgcgtgttagttattgtgatagtgtatctgaattgataatgtgcattattgtgattaatacgatatctgtgtttactatcttgatcattatttatctatttgtagtattatgtgatatctcttgtatgtgctgataagttgaagatgagcattaaagatatattttattataatgctattagtttaagatacagataaagataattcacattattatatggctattacttcttaatataacataatgaacatatgaatagtgatattgaggaggttggtatncgttatatatcttgagcaatttgattagtagttgattatatatatgctatatagtattaagactataatatatttgataatatgatgataggtagatatatatagtatatgattacaataaatattttactgaatttatacatttattatatgtcatttatatattgttgtttttatcatgttgtatattatttgatattatatgattacgtattatttatttatgaatatatctagaggagctgtagaatattattgattgttattattgtagatgagaggatatggatagaaatattttattgagtgggttaataatatattgttattttacgcgatagatagtagtagaaatgggttgaaatgtcccaccctcctgacttaaggcgtgaaatgtcatgatggacgatagggtaaaattgaaggtaaaggagtggtgaggtgattataatgagtatgtacggtgaatatcgaggtaaatacgggtatgaaacatgaggcgaggggagaatgggaatgggatgtatataagtggggagggatgaagtatgatgtaaaatggtaaatgggggaatggtgttgttgacgaggaaccggcaatcacgcgtggtaaattaggaaaagggggtggaatttgaatggtatgagggggaaaatatatataaggtttagtgttgggtatgaaaaattatggattaacattttatagtaaccggnaagattataagggaagggacaaatgaaaaatatgggggggtggtttctcatgagagggaataatg

SEQ ID NO: 6389 - DNA, 1390 bp, Homo sapiens
  misc_feature (1)...(1390): n = A,T,C or G
catcatctgctcctcacttgtcacatgcaacctagctgcctcatcgtcttcctccatatctcaacactcgttgtcgcccgtcagttatctcctcttctgtctcagtcttactgacccctcctgccgaccccactacatgcgaagcnaacacacatactcctacgcgcaacactcgaatatgctccgctcgccactccatcaaccactcttatctcgccctccactagcctaatcttctctctacccgcgagactctttgcctacacattgctgtgcgtactactcgttatctctccacctcatctatatatagcctgagtgatatcgtgctccacgctgaagtactctcacccatcacctccactcaccacgcactagtcctatcgtcctactcatcagtactgtgcgtgctgaacctatacacgacacagtttctatcaaataattttatacaccccatcactccactctccctgccacccatcttacggtttgnttctattcctagccatctcctccacgcatactcactgttcaaccgatcacgctcgcatctcataactattatcccatacccgaaccactttacttatgggacctattcaccactcagcacttcctagccttaactactacgagttacctcattcatcgtcgcctgcgctattcactcntccctatccactcctctttcacgacttccatcgctatttaccactccatcgcntcacttcttattgagcatcgtcgcacaccaatactaatacgctctatcttgctaaacgaggtcatgcgcactacacctcagcatacgcccaaatcgcgccgcccacacattatcatagccacatcacgatgtgtcacctactcgaccgcgatattgtgaacagtacacccactgcgatttccttcgcacatatacgggacgcgtggnggtcggtcgcgatcggcacgccggacattatggacaccgtaaacgcatagcgtggagcgacgcagatactacgggatcaacgcactgtcgcaaaccgtatgaattanactgtggactataataagtgtcggacggatgcgcgcggatagacgtgaagacggaatcgngaaataaatggcgatggacggcatcgccggtatcgatggtctgaacgtgacataggggtgaaaggtgtattggtatgtagggataccggctatgaagcggtatatatataccggctcgtgcgcgcgcgtaatattntggttcgcattgggttgctctttcaatcgccgtcgcgaaccggtactgccgtcagtcgcgtaaataaactttagccacgtgtcgttcagttactatagcgtaagtacaagtcaatggcacgattcggtaagacgagcgcagcagaacacacag

SEQ ID NO: 6390 - DNA, 1161 bp, Homo sapiens
  misc_feature (1)...(1161): n = A,T,C or G
aacttacagcgtcgctgacaatatacgacaataccgctagcggcgggcgggcgcatttcgtacgccgatagacgtggtgagaccgagctcatagagtgtgcataggagattcggtcatggtcaacagtagacactgcgagcgatcgcacttcagtgcagtagggaaaacgagaaaacggggtgatgatagcgcagcttganatgataagcttcgtggatgcgaggcagacgcgggtatgaagcggggagtcatgtgtgcgggacgagttatatagatgaagtgggcggcgggacatcgggcgtcggatccggtaagaggtagtgcgatgtgagggggcgctgctcggtcagtattcgtgatatgtgaagtagggctgaaatcacaggaggacagaggtacaggagggaagagggattggggaggcgactacgatggcaacaaataagcatagcagggcgcgatgcgactggctattataattcgtggtggtgcagcagggataagatatgtcgcgcagcgtagcggactagcagatcgctcggcgaggaacgaggcataactggcggtaatctggagagagagaagatcgactcactcggcacaccgtcggctgtcacagacagtagagaatagcggaagcgataaacaaggtctgaggaatataaggcagagcgcgtggatatcttctacgcatgacgagcagtaaggacgaagcgagcctacgcgctgtgcgagaggtatttttgtttttcgagacacaaggctagtagggaaataggggccgcccacccccctgtatgatgagaagagttgntgatggatatggatacagagaatgataagaagagagaaaagaaagcaggaagggtgagagtggtgtacattgtggagtgtctgattaaaagacttgtgtgttgggagaactaattaccacgaatctgagaaatctcataagcgatcgcgtgcttgaaaaagaaatatatgtnttgtgtttttgtaggacagccccggcacactcgggagaattaaagtgggnggaagtaaggatagagaagattaaggcggacgagaggggttgtttgttcttagcaaaaaaaagaggttcgtgttggaacttttgctttggcttgttcctctttccggggtctccgcctaggcca

SEQ ID NO: 6391 - DNA, 844 bp, Homo sapiens
  misc_feature (1)...(844): n = A,T,C or G
gtgggtgggcggctgattcttcgtgtttacatccagttgcaagaatgatcgctttgatgcgcggtgcggttgcaacgggtgtcttcctgtcgttggatcttggtggttgagagatcatgaagttgtatatctaagattcgaatgctttctctggaattatgcatccgggatcgttttgttatacggatctaagcgcttgctcattctcgagtcgtctgaagtgttgtgtgggaattcagatttggttgtaaatgggggacgtttgtgcgagtacgtccagggcagtaagttatggggataattcccgaggcgttgagaggggcatctatcggcggatcgtgtacctttttatatggacttcaatgggtttgacgtccgggaagtgtgggctcttcgtctatgggcatgtggggcgaagggcctgtgttttggtgggggggtggagaaggtaatgtatggcctataaaattggagggggtgtatgtgataagtaataggtatgacttcgaggggcggcctctttttttttggttggtagttggtatccaaacagtgtcggcacttataaaaaattttccctgctgggtgccccccggtttttgtggtggtgtcctttggttggggttgtttgggcggggcttttgcggtcttgttgcggccttcccctttgtccccttcgttggttttcttttccttccccgtttgcttggtctccccggggccgtgaagcttttctccctctctttcggccttgtgtgcggttttcccccccaacaatgnctnccgtagcggccaagtcccccttgtttttttttctgttgcgtatcgcgcggtctgtggtggc

SEQ ID NO: 6392 - DNA, 1207 bp, Homo sapiens
  misc_feature (1)...(1207): n = A,T,C or G
cgtcgtctcacgcagcgactgcggggccacgcaaaacagatacacataggtaggtgagacagttagtagatgacgtgcgcgcatactactccgtgtacggacccgaatgcggaggaggggaggcgcagaagcgacggtcgaagcgcgcgcgcgaatccgtaaatataacgcgcgatagcgaatcaaactgcagatcgcatatcgccattgccattgtccatatcgcacgtccgacccccgttttccgtcccatgcaggatcgcccgtcgcgcgattgaagtcccgatgtcacgaggcgcgccgaaccgtatgttcaggcgcgatggtacggccttatcgcgtctcgcgccaccagccgccgaatgtgcgaggagccgtcgatgacgcccntacaagcgtagtcatacttctgaagaaggggtgggagtgatgtgcgtggtggntgggagtcgagagaagagcgacgtgcgtggccgtgtgggggtgaggtagagacgatgcggcgggcgcgtgatacgtagtagagcattcatagtacggttacgaagnatggtagtgagagagagngtgcgagatatacagcgaattatgggaagtgagtcgatcacgaggtagagggaggaggcatgcgagaggagagtagagagagagagaggatagatgaagagagtaagtggacaggagtagatgactgtagcggagagaatgaatagagtgtgtggagagtatcacgaacgtgcgagagcagagagagtgtgatgatgatgaggaggagatagaggacgggatggccggagagagaggttgacagctgaagtgaggagggcggacgcggatgtaggaagggagagagcgaataggatgggttggtgtcgtaggacgtgaataggatggagaggcgaggatgctcacagaagataattactattgaatatatgaatgtacgcatggagagagagaaggcgggacagagtaatggtcaacggtatgagtgggcgtggggaacgaacgagaaagaggtgagcggtgaatgaaggagagacggttaaaaagtgtgcgtccaagctagcgcgacgaggtgaggacgtcgagtagcgtataccgaagcaacattgagaagtcgacaacgcagtatggcggagtgccgacgtagtgagatgacgcacgacaatgacgtgatataagacagacggtatgaggctgtgag

SEQ ID NO: 6393 - DNA, 1587 bp, Homo sapiens
  misc_feature (1)...(1587): n = A,T,C or G
taataaattacggaggaacantcatctcntacctgtcnactntctgtctacacnctcncatnanctctgtncactacgactcgctatgcatcagctcangcgttgctgtctgctctgcccgagcctcggatagctcggtcagtnanactgtggacgcgcacgcgatcagtgtcttctgagtcgcagtgcgctcnctagcactcgcacgagagacgacaagccaccnnactgcgctccactaaccngcagtcagnctgtatcantctgtcctnatgcgtctaccgattaatatantatcntgataacncagacagttatactccaagtcgtatcgcatcatatagacatcgcgacaaatgatatanaaccgtacacgcgtgagntctgctaagacgacatgtagcactagccgatgcgcaactacagntatacgcgaggtgacggtggcgttgttcgcgccactctcagctcacccaacggagcgagtgatcantcncgcgtacgtagtcgtcagangacgtacatcgcgtggcncgagagtgacgctgcacgacgcgttncacgcgncacntntcgtctcatactccagcngcgtgcatactcgtcacccnttnacgtcatccgnccgatcgcgtcacgcacgcatgatccgtacgtcnaanctantatctcagcacaatcgttcgtacatgttagagctagtcgcggatgacgcgattcgtctcatactacttgtatgtgttatgatatctcttcgtacaccncacagcgnacgccgctcnctctcgacagcacgaatgagactagtctgagtacgcgtatcgcgcacaagcgacgtacgccacgagatgcgntaccgcacacgcacacaagtctctgactccccacgctgaaagttgcgcgccactgaagcantcgcaccctcgtagctatcgacatgtacgcggcagatatcagatgtatncgagcgacacgaggagctgatgtactgtttactcgtgcatgtgacgcagcacactcgacccgccaggagagtacgcggcgacgcggttagtagatgtgcggccgtcccacacgcgagatcgatcctgcgtgtcggtgtggcagagagctgatgcagtctgaataggtctctgatcagtnatgagtacgntgatcaacgtcagaatgcgacgcaagtataatgcgatgacgtcgtctacgcgctacgcacacgctccaagcagctcacgagcaccgacaccagagtcgacgntgtgactgcntgctccgccgtgctggatagctgctcgatgcgcgaccgtagtcagcatcncgtcactctacgagtaggatcgcgcacatgagcgtgtgatgatatgtagctgcgcaaccacgtctctagatccttagaccacgtcaatgacactccgcaacacgtgtaagattactattgatagatcgcttaactggcaggaccgtgcatcactcgtatctgaatgaccgtaccattgttagtctaacggcaccgccgccgatgactgttcgctactaccagcgccctgctctgacgcgactcgcatgaagcgcgacaccgcttcccacgag

SEQ ID NO: 6394 - DNA, 1412 bp, Homo sapiens
  misc_feature (1)...(1412): n = A,T,C or G
ttggacaacgaggggttctcggtacatagggacaagattggttactgattggnaanaacggcggcacatccgtgggngagnnncgnacggtnatccgnntnnaagncttcattatgggncncatgagttagtctgtgattgataagttnaaaattagtgtagacggcagtgcagatgggtttntgtacactaagagtggtactggaagtgtaaggatgtgagtagactagtgtttgagattaatgagtgggntgacaggatggatggagatgaggtgatgtgaatgattggatttattatatctagtaggatgagagatgggtgtgggaggcgctgtccgtgaatgtagaatggaaggagttgagggaggntagggatgggggngggagaggaagacagaggcgaagtaggagatgattagagggatggttagtagtgtgaagtgagtttgttgtgatgtgtgaaaagtgatgttgtaggggggattagggagagattgggatgtatatagaggatggttaggtgatgttgatggttatgagtagggagagtgtgttgttggtggggtgattgtaagaataagcgtgagtanacagaggttagtgcgaagtaatgaggtgtgggtggagaaaatggagagggaggggggtgtgagtagaaggaaggagggacagtgagtgggaaggtgatgtgtggggagtgaggggatgaggagagagatnaatagttgtggtgtggtgggtagagaaggnggggtgntgagagttatgtgatagacgacgtaatgtgggntgaggaaatagaaggaagtaaagggatgaaggagagatgagtaaggaagatgattaagtgagtatgagaggatgagataagtatagtggtgaatcggagcgggatgaaagagttagtaagagnagatgtaatgtgatagatagtatggnatntaataggatcgcganagagggtaaatagatcgagattagcactgagnagtgtagcatggatggtagtgaggtgagatgtggcgtagtgantacacgaataggtttacggctcccggctctgatggttgagngtgtaagaggagtacgnacgtgagcaggtgtgagatagagagtgnnaagagggagaaggtgtgtgtagtcgcgcgtatatggtngcgtaaattgagtatcgacgcnatattgacactgagtttaattagagtggagtngtcgacaagagtatgctagcgggngtgagacgaggatgacagtatatggtgctgcaagcgtgngatgtgatagattggnagnatgtgtagatatgtgtacaacaacgtatatcgttacgagtttgtgagagtngcggcacaggctgcacctagatagtcagtccgtcacacacgcgaagaagcccagatagacagtagc

SEQ ID NO: 6395 - DNA, 1199 bp, Homo sapiens
  misc_feature (1)...(1199): n = A,T,C or G
agtatagtgaatatgatatgagttaatggagtataagttgtgaagtacatttttataggatgttgggtagtatatattaaatgaataactatatacgggattgcgatgtttatttgtattaatgtaatgatgtgttgttgttctggtatatgtttgttattgtgttaaaagttgtgtagtttgcggtcgtgtntactgaaattaagggtgttgtacgtaacgcgtatntatagtatgtctatattcatttatgtgtttgagatagaatatttaaatgttaattgctataatttagatactgttcgttttatcttacatttcttaccacgtatttatattaattatattattaattatattcgtagatattatttaatgcgagtgtatattagtagacatactgattagtgattatgaatagaatttagatatattgatgtaaggcgtgtgcgcattcatagcattgtatatatatatttattgaattccgtnctttgactatcgtgttttccttgtctcttgggtgtgtccttcgcttcttagttgagggtagtgatgataatttataaagagttgattattgttataatatattatgtgctttgatatattgtatatattatggttagttgtcttaattatagagagcgaatagtaatggtgggacagagtataggttacatatactatgtggtatggaaatatttaatttttatataaagtgagatagtcggttaattgttgcaattcctcgccctctctgattaatgtaggtttgtcgaagtgaggaatgtataaaatgaagtataggatagagtggtgagacataggatacgaggtgtaaaagtaggacaancggggaaaataagtgagatgagggcgggataggggaggggatgagaaattaagagggggagggatgagtgaatgatgtatgaatgngaatgtgggtaaacgtttgcttgttaagttgcaaacgcgatatcgcccggataaatataacggatgaggggagaggtaatatgtacgggacgagatggaggaaggattttgaggtagagagtagaaggatggagaaagtgagtcttgttttcggtataacgaatctaaacgacaggtgtagtacggaagaataaactgggntcattggacgatgttgggatcgcngtgactagtgtgatcgggagagagaatgagtg

SEQ ID NO: 6396 - DNA, 738 bp, Homo sapiens
  misc_feature (1)...(738): n = A,T,C or G
ttactgttttcaactgtccgacactctcacctcagacgttaacccctgtcctctgtacatgtatactaacattgtggcattccaatattacttttgtacaggcacttacccttgctcgctggtcctgtcttcggtttatctgcttacccttcctgaagccatgtggcactttgtcgctctttgtgtacgttcacactcttactaactgatttgtttctcctaacgcacgttgagtttaattaaagcctctgtaattcgctttcacacatccaatttgttttttcccaacacccaacaaatgtccccccgtagtattctcgcgtattcctattaaagtagcaactataaatccccgtgccagtagagataataaatttttttaggcttgacccctttgggggggattctttattttattcaggcaaagatattgcagaaaataaatcgtttttctggcgctaaacccaaataatgtacaacaataatcgtgacttcatccccgggctaaattcatcattgtataatggtgagatcttgttcatcaacttctgtcccttaagaggttttccttgcaaaatgtattttgttttgtttgttcattttgggttttgttttccaaatcttctctaattctgcaggctggcaacaggtagatcagtgcctctggcaccatttgtagcggtgtgataattaagagatgttctccagcaacnccccttctctcctttgttactacac

SEQ ID NO: 6397 - DNA, 1086 bp, Homo sapiens
catcgttccctcaccacatcgcccacctaaaattactacatcaacatcaactcaggacaaatatatacccaaaaaccaatcttccaaaccacattgaaccaacaacatcaaatccaccattcctaataatcggcgatcggttacaccatattacccttcccctttccatctcaattacctcatccacccgcgtattcacttctctctcccatcaccctctcaccattattccacataaatcccgtttcccctacgcgtccatatttccaccccatctattctcattatcgctcttcgtccacaaccaccataaacgagggccgcaaagacccaatccgaataccatcaacattgcgaaatatatatccagacaatatatttaatatactaatctctacatacctcttatctcacctagacaatgcgaattaagacccgcgcgaatgtatgacatacagaaaataaatataacataatgtcaagcatcacgtaaatatatataacaacataacaatcaatctaacacacatatctaccaatacagacattaaagataaagtacgcaaacaagaaccaatataaaacaaaataaattgattttaaagaactgagatcaaatatcataataaaaatcagaataataagatcataatcgagtaaacgaatgtagcagataaagagtgaatatagcatataacaactaaagaaatgtatctgttatatagagatagagaagagaatataaaatagagaatgcaagagaggtaactatcacattataatagaagatcgacgtaataccgatacaatataatagcaagtaagtaatttactcctgcgtgtgataacacattatacacatacaataatatgatcgcaacaagcttgaggcatacactattaacctaatagaaggaagagtatcgcaagaagagcgacaccaggagagattcatagatatgaatagttctccaagacctattgtctataatcactataatgtactagcttcaccacattcccatctttacatataacacacatattgagcatcatatattcacaccgcatatgtgacatgatgct

SEQ ID NO: 6398 - DNA, 1387 bp, Homo sapiens
  misc_feature (1)...(1387): n = A,T,C or G
ctatccttctattctctcctccatctccatatattcctcgtcccacccctatatttttctatctacccttatttcccacttctctctcacccgaccctatatattctttatcctcatatttactctcctcaaccatcctcattcatcttattataaacactctccacacataccttcttactctccccccgcataccatatatatgggcgcatcattttcctttcccaaaaaataccaacccccattcccccttttcctatcttccattttccctccttccaaccctcaccttatttcccctccacatctcctttccccgcccttcattcccttttttatccacatttctcctcttttccacctcctctttccttaatctcccctccctttcctttctctcctatttccctacttccctcctccttccatcccttttacgctgatcccctctttccctcccatttcccacactttcctcacatatataaaccatattttatattccctcttcactttactcttctctcacgaattcctctctcccatcttcttactattctcctctctatctttcatttcatctcctctcactatctataccatacactacttcctccctcctcctttcattttctcaacatactctatctctatactctatctatatatttcttcaaaatcctctttctcctcccctcccatctcctctaccatacaatattttaattactttcttcatcactctaaatccttatctatttcatttcactactacaattcacagtacaccatcttctctatatctttctctcattactgtctttacatctaatatatcttctacacttcacacattcgtcttatattattanctcctctctatgacttattatatcatccacttatcatacactcttactattccatctcatcaaccatacttctctcctatatattcattgtaatattatctacacttatatccttttccacacacaatatcttcatnatttctatctctcatatntcctcctttcctccaccttcacacatcattacatcttctttacactctcacacctcttatacttcttatctattcatctcttcatcattattcttatacctctctacctattctctcacacatattttatcacctcttattaacctatctcctctctcccctatcgatcctattgtacagtcaatactcatatccgtcacattctgtatccatatctcactctctacntctattatccatatatctcactaacacttatacatcgcacagctctcattcacaatactctatccgatccaccccactcacatatctccatcatttcttactactctccatcatacttctccacttctact

SEQ ID NO: 6399 - DNA, 1025 bp, Homo sapiens
aacagatacatctaagcagtcaaagcaacgacgggaaaagaagagagagccgttagaggggacaaagaaaagcgatttaggcggcgaaacaaaacatgaaaaaatggcaacaaacgcgaggcggcgctctccggaagaacccgtcatccgaacgcactggcaaccccatcccccagtcgctcgccgcgcatgcacccacccgcgtatttacatccgctccaaatccagcactcgcacactttaatcccaaatttagcataacgcggacagaccgatacgcccaaacgcatcgtacctccaatatcgcaacgatcgtgcccgcctcccccataatcggaggacgcgcgtttgagcccttacgcgaattacatccatcgaatggaaatgaagattccagatccatgaacgatcgtaccagcaagcgaggccaggatgcgcgcggcgagggaagagagcggcgccgcatatattgaaaacaatatgtatacagcagagatgcgatgaggagccagaaggcacagacgaagcctggaagggatggaataggaagcatggaataaaaagaggatgggaagagggagaatagagagattgagaggaggaatggaaatcagaatagagaagaacaagaagacaagagcagcacgacacagacagcgtgatgaaaactaagaggataagaagctacgaagaagagaaaagacgagaaaagaggaattagaggagatgaaaaaaagaacgatgttcgcgtaatgcgttgaaaatgtaatatgagtaaagggcaaataaagggagaaagaatatattacagagcaaatagtaaaaaggagagcaaaggaagaaaaaaccgaggagcgcaaggagtgatgccctgacacagaagaattcaaggatctattagaatagagaataagatgttatcatgtccacgcgcaggaacagaatctcatgcaatatctaggcagatgtcaaaaaatataacacgagccaaagacagctgggacgatagcgagggagaagagaag

SEQ ID NO: 6400 - DNA, 815 bp, Homo sapiens
tccccattaaatggcatccgccgtctggggttttaacacacaaattttaaacttagcgcggggtggctcttttataaaaccccacggttcactatttgctccgtgacccggggtggagggcaatggcaccattttggggtattttttcctctacatcccgggaaaaaacgattgccctgcctcagacttacaaggagatgaaattccagggggctgccaccatccccggcaaattaaaccctttttttatgcaaaaaggggctcgccattttgggcaggcccaaatttgaataattatttgaaaggatcgcctgactaaggccccaaaagggcccgggattccaggaagaaccccccaccccggccgggaagacagagattttttttagaaggacccttcggccctctttgcgtcgattttcttttttactgggaggaaaccgcaccttaaatcccaaaacaagggggcgcgattccctttggggtaaagccgcgtttccccctccctactaaaagaaaaaaaggcgcacaatccccaaaggcgaaatgacaaataaataatggcccccccgcgccggggggggaggatattccggtgatctcggcccttttttatccttagcggaaacgtgtgtggtttatgttttttcgccatttggactcacacaaataccgaacccctcctccttttataaggggggatgataacagcgggtggtggggcccccacgcatttgaatctcctctacctatattagaggggaagatgttgtacacctgaggcccctggatgggttgccgaaaagaactaaact

SEQ ID NO: 6401 - DNA, 1852 bp, Homo sapiens
  misc_feature (1)...(1852): n = A,T,C or G
ccaactaatttatacatctccgtcaattcacaaatattatcctcaactcaatccgacatcttnctacaatcaatatacacagcactaatctagatatattagccaacaccgtcacactttactatacataatacacatcgagatctagaactcgctacgncacacaatctctactatattttcatattatatcactnttatgacactaccctatctcaatatacacatactataattgtatcgctcctacantctattctcatatataantgtatgagagcctcantcgatntatacactattatacacacacnatcacacactacacgccgatctacaccnaccatttnatactcatgtcatatacanattgattcacacatccaatcatcatacacgaccacntntatatcatcactcnattactctacatcgaccactcattacgcacncgtcgtcacatactccncatatttntgtctatcncttcagtattccatgtacctacgtaattatccatcacatcctgtcgtattcaattattctcctacacacctccacacatctttcccgatgtcactatgctcatatatatatccntcattatctgtctcaatccccntccactttctccctacatatangttgtcgatagtatatcaacgtatatatatatgcaatcacacctatacagcgtcagcatactgcaacacttatacattatcaatacatntatnttatgtanaccnactatgtcaactagtattatccttattattataccggtgaatacgcactcactcactatactatattcncataataactgactaactctattgtgatacatgatacattcaactttacctttatagtgagcgantaatactctatagaaatgatatatatatgtaagaatgagtactacaactataatatatacatatagtcataatgtacctgaagaatcatctcaatcactataccaaatcacactatatcactacacacctgacatatcaagtactatatcttataaagaaagtatagatgactanagatgctaactcgatgtgacntcagtactcnaacaattatacatcatataaacacantacgtagatgttactagaatatgacacgactagtacgattatataatcacatactatantactatgataaactcgtactactatattactntnagaataactacatgagatagagcactatatagcaagttgattgtcatattacaacagataatagagtagcagccaacctatttgtatatatttctatatgtctcaagagttcanctattatataccttactactatctaagatactgaaatattgatattaactatatctggaatctctatataatcagatatatatatatataatatatttatcattatagacctacatataataagatgactgggtgatatcattagtataatcatcatcactgattacaatgatgaatccacacagactaactatanatgactgatacacagcgtanagnacacatgtagaacgtagtatagtatantncacatacagactatgtgtatctatatggtgctcatcatgtttctcatcatctacttcaatatatatatacatatacatatatacgatatntgtgtcatctatntcgacagcacctaccactattagtcactatttnacgnctatctttnatgcattatactcntcgtaccgcntacgtgccactatgattantactttatctcatacactcatctcgaattaatgtgcatatcatgtatatactgtccaccctncatctataatcgtaccgtactatatctg

SEQ ID NO: 6402 - DNA, 1309 bp, Homo sapiens
  misc_feature (1)...(1309): n = A,T,C or G
gaagagagtaagtacgcggaaagcacgtgcaggtacgcgacgagtcgccgattatagtagtagtggaccgcgggacacgcacgctacgacacgatgggagataagattgagtaaggacagacatttacgcagacaccggatagacgaataacgaatcgatataagagagccgaaatggtagcgatcgaatgacgcgcgcgatatcngagataatagagagcggtcgatgcgcggtgggcaacgtcgcacaaaccacatgaccccgatgtcgcatcagccgtcatgacgatcatgcgacccaccctatgtgtacgagcggcatcgaagttgcacggcgtcgacacactaataagtcccacattatcgacatatcgacggaagaagcgttagtgactcgcagagaatacgagacgtacnaaatacagcgtcgagcgtcgatgcaatgcggcctatataggaggggggcgcgacattacgatcacagataccgaaagtaccagaaataggttacaagtagggattaggcacaataccagatgatcgtaggagccaaagaactcgaggtcaaccagtgacacggatgtaaaagaagtgaagttgagcagcaatagaaagaaatcgcttaantaataaaaatcgaactagtatggcacggaagagagtcaaaaaagaataagacatagagaaacgagcatggaagaaggaccagatcgaggcacgataaagaaaagacagaggacagaggagaagagaggatagatggaaggtgtggggataaggctgagtaaaggagacgagagcggagcgtaggggaggggtggtgaagggagaggagtggaggagaagacgtggaaggggagaggtatcaatgaggagaagggaggacacgaaatagaggagaagatgaaggaggaagtaaagaagagaaagagaagaganagacagaaatgaagaatatagctcaaagaatacacataaatatanataacataccgatgtncgagcgatggagagatgaggaggagagggaatnagacgacaagctcaagagagaagaacaagcagaagaggaaacactacacagggcgaccggtaggagagtcaagngtcgntncgatgagacgagacgatgtgcgagagacgatgttcagccaagatgaaaggtgcgataatatacataaggcacacgctcgatgacacgtgtgagactagcgggtgtatccgtagacacacaatatctagtatgtgtcgcacgagacggcacaaagaactagagtatatgtgaagcgaaatagactaagatatatat

SEQ ID NO: 6403 - DNA, 1284 bp, Homo sapiens
  misc_feature (1)...(1284): n = A,T,C or G
aagaagatcgccgcaacggagcgcacgaggggaagaaagtcgtaggaatgaagaagggacaagacaatagcgagaaaatgggagaggaccagacacaaacgaaatagaccaacgacgcacaaaggcccggaaccgaaaaaacggggcatgaggaaacacagggcccacctgcccgttgcctgttccacatcccatcatcgtcacgcgttattcacgtactatacgctatccgccccacaccccgatttaacgccgatgttcgcgtttcgacatgtgtctattgacccgcaaccgtacggcagaaagcactcgtacggcgagcaaccgcacgtgaaagtaggggcgagcgtatcgacgcgaggcgcgcctaaccatacgagcaatgaagaaatatgatgtcgcaatccaaggagtctgtgccggcgtataggacgtgtgcagacagtaaagcggaggagacgtaaaggtgggtgacgcgacgcaccattgaatgatgggtatgctgtagacgagatagggtgtggatagaactaagggagaatgtgatcagagagagagtaccagataaggatgcgatgagatggtgaggaaacagactaaggcagtgtgcacgagcggtagagaagatagggacatagaatgagcgacgaacaaagtgtaccgagagtcagggagatggtgggaggcgctgatgtaggtggatatagtagagagaatgaggaggaatgtaaagtgtgtgtgagaataagcacgagagaaggacaaggcgaggatatgagtacatgagatagtggcgcacacgcagaagatggacaaagtggtaggactgcgcaggagtgtggagtccgaataatgtcgttaaacatatgcttcgaatatggacggtgtatatcggntgcagcggcggatggtacgagatcataagaagagaggagacagcgagttacacgtgcgagagtgatgatgtagaggtcagacttatacgatcaacgacgcgcgtatatagagaaatccgtgtaccgcatgccgagagtggtaagcgagcgtgcgacgttctatgagcaggtgacacgtcaataggactacgcgaagcggcgctccgcaagtactcagtcagtggagtacgatccaggcaaggacgtatcgccacctccagcgagatgcactataatcgtctcgancacatttgttcctcgaacaacgagagagatgcagtatagagaacagcgaggcgaatgttggctgtgcgttataggcgcgtgctgtgctatactgtcatntgcg

SEQ ID NO: 6404 - DNA, 1061 bp, Homo sapiens
  misc_feature (1)...(1061): n = A,T,C or G
cacgttaccctcacctcatcaacacccccactaaatccttaccctacttcccctatgcatgcaccgcacttttgcgccgtcctattcgtttaaatactccacatcgaccatcaataacccccgcttcattatatcacgcgtgaggggtatcgacagcacaaaccattcccctttccttatcatatactcatccaacccacatttatccctcccatccgcttgccgccgcctcgccatttatcacattttcccgtttcaccccatatactatttcagccacggtcgttgcgctaatttcgcatagaactccgcatacccccatagaagggagggagcgtataaaccataaccaacaaatctccctaggaacaatatatttgccgcgtccagtttgggctctgcatgagcgtatgctctcaatagccatacgcagagaaagaaagacgtacaaagatataacgtaatagaggggtacacagtgagacaaagatttcttatatgatttatgagtataaaggaaataaatagcttgttgagaagtacgtagatgtttggttgcttgcaaggcgcacgcgcggtgacgggtggtgagcgtaattggaaaggggatgaataccgaatatggtattggtccgttctcgttattatatggcggaaagtaacatttaagagaaggaaagataacaaaagatagtatgtaggggggacgatcccttgtagtgagattgcagtgtccgtcagacacagtggagtgtgtgtactcgtatcttgttgtttgccgattgtggcagatgggtgttgcgagttgcatcgagataacatataagaaagagagatacgtagataaacaccaagaaataccggcacagaagctcattaatatgcacttaaacctacgatatgtgtccagctgcgctctcgtcggctatcgaataataataatagtaatatcacatcatcattatctatancaattatgctataatcatacgatgctatactatattatacggcgacgcccatgacactacatttacacaaagaagtcatgagcataatat

SEQ ID NO: 6405 - DNA, 1550 bp, Homo sapiens
  misc_feature (1)...(1550): n = A,T,C or G
tgactagtattgagctggnagtccgggctagtcgagcgcgcggaatgatgtcgatggcgcggccgcgaggttgcgcgcggtgacgtatgtagtatacgcgtatgttcggagtgtccggacgcatcacgggttgtgtgatggcgcgattagcgacgcgtttagggcgcgcgtatccgtatatggggggcgcggggcgcggtcccgactgtccatccgcatgtcccctagtcgcattttccntcgtcccgcggtcccagcgccgcgttagttccggatcggcgtcgcgggatcgccgcgcgtcgccgccgatatgttcgtcagcgtatgtccgcggttaacgcggcgggtctccagttttcggacacgcgccgcttccgtatcggtgctagattcgcgtgcgtcggacgccgggtgccctcctatattgcggtggagcggccgatctactacgcgtgtgccgtcgttgtggtcacgttcgtttagacgatatttatcgtttgcacagacgcatgtatgcgtggtcgtgcgctgtgatagcgtgtggactgtaatgtggtggtgcgtgtggcgtgtgtcgtgggcggtcgagcgtgtgtgcggtcgagaggnganccgcggcgcgtcgaatgcgtgcgtatcaacttgactgtaggctcgcngtagtagngcgatcgggcgtgtagacaatacgctgatgcgcgcacgcgaggggtggggaggggggacagcggcggtactgatggntgcggcgagatagtgatgaagtgaggangatacggcgctgatagaccacaangacgtatgtatatatgacatagaggcggcagtcgactagctgatagagatgagctagtgatgagtctgatacagctctatctatatacatgtagctatatatgcagtagacttgcgtatattatagcaggntagcacaagcgtctgagtacgagactgtcatatgangtcganantgtagggacgagcgcgtgacgagagagatagtgagtatgtgtgntgtngtcgacgctgagcgttagtgcngtacgtgtganacgacgagtagaggngtacgactgagagtgcatgtagcaagtgacgtcagtatgatggtagngcgngatactcacgtgttcgtagtgtgtntagtagtgatgcactatagcatcgtgcnacagagatatcctgantctcgaggctncgtcgctncganttgatcagnnctgagctacggcgctagtcgngacatgacagctgcacagtgtcgatacgatgcgagatgtcngcagtcgcgctgtgcgtgagtgcgtggtctgtgtgncactggatagatacagcgcgtagtgcgtgcgccgctcggcgcgtcgtgacatatagctatatacgatttacaggagtatacggatacggccacagactggatatgtagctntanancggtgagagacagtgttataganacacgacgtagtgtactgtgtgagtatgangnagcancacggctagtgaagagagatttatgactgacgcagagtgtagtaggagtgtgactg

SEQ ID NO: 6406 - DNA, 1225 bp, Homo sapiens
  misc_feature (1)...(1225): n = A,T,C or G
atgctgtacatcccgcgctatcacggttacgcaccgacgacgtagagtcgacagcacagacaacaacgttcatcaactgagatacgtaatcgaaaacacgaaatttcaggaacatcagtcacaatagcattaaaaaaaaaccaatatagaaagacaaataccgaccatttccagtattaagggggatgatggccatgccactcacaaaacacaatcacccgtgtcaatgtatcgatatgccatcatccacccacacattntgtcacccgtcgcatccgctatcgaccactcctcatctttgtagtcccntttatcacgttacaccgctatatactatatatcctgcgcacttcctatcataatatttaccaacgacctactcacacctactataaggtgggaggacagatacaacccaaagcacatattaatacgataataaaaatatgtattagtcacatacacaagataggtagtcatcgtggtgcgcactattaataatgatagtgaagagatataataaagtgatacaaccacgaaaattatagagcagagcgagagacaaacgaacaggatacgactgatagaaattactatatagagaattgatcaataaacagcaagagcgtaattacagtaaaacaagagcacaaatatagtaaaattagtgaactgatcgaactccaaaataatagaaattagacacgtacaattaagtcaagaaatctcaatgaattaccctaagatagaagatatggtgaagtcgcagatcgtatacatacatagacgaantatctagaaatataaataagaataaataaaaaataaattaatcaactgataagacaataaaaataaataatgaagacataaagatagataantatataacaatagtgtcttaattagttcaatatncacagtaataagtgaagtagcagaaaggtgataggcgacatcgtattaatcacatacacgatatcataatcaagcgccatcgcgacggactaagcatacacatactccgcattcatataaatagtagtgcacagagcagactacacacaatgacatatactaacataataaacatcacagcagacgctgacaatatacattatagncgaacacatatgnatacctacaccatcttatgtattatgagatagacgacaangacatgtgatantgagaatntcgatcagacggacatgtcacaaaatct

SEQ ID NO: 6407 - DNA, 1158 bp, Homo sapiens
  misc_feature (1)...(1158): n = A,T,C or G
ctccttttggtgcctttctcacaaagatcgcgggggctcggcctgcttgggtgaanaccaggcggggccctttcgtggcttttggcttgtgtgcgaccggctcaacccgggtctttatcggtcaccttgtcttgggtccactttctttttttccgctcccgtcgtggggtcacntacgggtggcggcccacaaatcgggggcggggggcgggatcctttcattgctgcatggtcctcgttgcggtggctatctatgtaccatgacatgctgtggatcttcctaaatccactatggtggggtatcttctttactttctcgttctaccgtttatttgttttttttcttgttcttgttctcgtggtagtgttatggcgacaccggtatattgtgacactctgctctaccatcgtgccctccacttgcgggttgttctacctccttccatggattctttatctatttcaattgctggtatgtctggtcgttgccctgttcttcctttgtccttatgcatcctcgttgttcacttgtcatgtaattttgttctttggtatggttgctccacatattgtcgtttgtttcgttgctttcagttcccactaccttccttgctctccatttcgtcggtactactgctagtgtttgcgtgttgccgttgctttgcctaccgtgtccctcatggtaacctactctatttatctctccttctgcgcctttctgttctctgctcgtcgctattacgtttccgggtcacttcgtttccctttcttttgtcttgtcatctcatatggccggatttttcccctatccgtctcctccatcactctaattgattgtttggctctctctctcttcctgctccagttctaccatcattctatcttattttctctcgattctctcgcttggtcgctatctcggcgctataccacctttatccgtccgctctccccgaccgcgtttttttctttctcgttatgcccgttatcaccgtcgctgttgtcgttttgctcctcaactgtcgttgattcttcgcatcttttctctccttccgtgtaactctgtgctacccttgcttgtttgacattcgatgtganctgcttcatctctcgactcttctgtgctacattcgtatcttcttcatagttgttctgtta

SEQ ID NO: 6408 - DNA, 576 bp, Homo sapiens
  misc_feature (1)...(576): n = A,T,C or G
ctccactgctgatacccaggcaaagagggtctggagtggacctctggcaaactccaacagacctgcagctgagggtcctgactgttagaaggaaaactaacaaacagaaaggacaaccatgccaaaaccccatctgtacgtcaccatcatcaaagaccaaaggtagataaaaccacaaagatggggaaaaagcagagtcagaaaaaccgaaaattctaaaaatcagagagcctctcttcctccaaaggaatgcagctgcattcaccagcaatggaacaaagctggatggagaatgactttaacaagttgagagaagaaggcttcagatgatcaaatttctctgagctaaaggatgaagttcgaacctatggcaaagaagttaaaaaccttgaaaaaaagattagatgaatggctaactagaagaaccaatgcagagaagtccttaaaggacctgatggagctgaaaaccaaggcatgagaactacataacgaatgcacaagcttcagtagccaattcaatcaactggaagagagggtatcagtgatggaagatcaaatgaatgaaatanagtgaga

SEQ ID NO: 6409 - DNA, 1061 bp, Homo sapiens
  misc_feature (1)...(1061): n = A,T,C or G
cgggtgtgagactattaattgtataagtcgaggagcggattttctgcacataaaaatgtttttggattggcctgcaatccatgtcaggccgcctccttagagaaaaacacatcccgaaaggagggacgtgtgtgatcatttttgctatgtgaagtgtcagaaagttgctttgcttggatgtgaggcttccgctgttgtaaggaactgggtcatatcggagcctttaacacttagataatggggcgatcctgtcggcgttacacggtatatagaaagcctggtcacatagatttaacaattaattcctcgggggggggcgctgtctgggacgccagtgtgttggcaagaaaaaacctgccctcggcgagcgggtaatggtgaggtggtagtagagggttctgttgtgtcgcagtggaagtgcaggaagacagtacgtccgttagctctaacaggtgtgtgagagctggagagctcccagcgctttgttaggacgtgagaggatatgtacgagcttatgcattgcgagtttggcctagatgttattccgtatggccggttacccgctgttaagcgcgtgcctcatatgcgcgaccctctgagcagtgtgaagcggcaggagagtggagatgctaggcgcgcctataggtccatttcgtatcctattggaatcaggcggctcgatgcaggtgaggagctatcgcagccatcagtgtctgccctcagcgcgagatcgcgcatgtgggcttttgcgacgcgtgaatgtgagtcgcgagcggtcgcggtgccccgggtacacgatcagctgtacgcactgcgacccgtctgtggcgatacgcctgattaactctgtctgccctaagtttctatgtgtttttgcccgcggtgtcccggctagattcgccnccggatgagcggatatgagtgaggatcgccatccgtgcgccggggctacacacgcgtcacacaatgacgagagtgnaagtatacaggtaccggcaggcgatgtaaacgcgtgtacgtcgacgtgtaagcgaggggtatgtcagcggttcacgtcgtgt

SEQ ID NO: 6410 - DNA, 551 bp, Homo sapiens
acagagtttcgctcttgtttcccaggctggagtgcgatggcaccatctcggctcactgcatcctccacctccagagttcaagcgattctcctgcctcagcctcccgagtggctgggattacagactgcttcagccattgagccatgtctgcctgtatccttcagctagaaaaccccagaaaaaaggcaccaagtggaaataaggagcaaggaaggggacagctgtgaacactggcctccttagtcaaccacgggtgtcagagaacttaatggatggagcagatttcaaggaaagaaatcaggcagaatcaaagaccttgcacttgatagatcagctggcaccacccagatcaataaactggctcatctgatcttgtggtccccacccaggaactgactcagcacaagaagacagctttgactccctgtgatttcttccctgaccaattagcactcctggctcactggcttccctttactcaccaagttatccttaacaactcatttcctcaaatgctccacgagactgatttgagtaacaataaaacccga

SEQ ID NO: 6411 - DNA, 1475 bp, Homo sapiens
  misc_feature (1)...(1475): n = A,T,C or G
tctggtgtatgacttatccctcacaagactacatatcgtagagagtcgattcacacacgcacacacgccatcacacacttctactatcatatgataacaccgtctctcaaacgatgcgatattattaattatatattcnantataacatcgctactcctcacgatcccgtcatgttccgatattacacagtctaacaacacgtcatcaacttatatatccacatcatatctcgacgacattaatcgatagtctcgttatcncacgctcataccgctctatacatactaagagaaacctggcgatgcgtaatcaatatcgtttagacactctctccttattcatatatatcgctcttgatttaaattatagtcttctatganttcagtctgccgctcgcctgcatacgcgagtattaacaatatcttgatcgacacctcacgagtcgacagcctccgtgatcattcaacagaacaatcgtccggtcatatataattggncgcgtcactcttcctcccaatgctatactatactatatataatacatccgtaataacatgaggcgtagagctctaacacaaccaatcgcctctaaaactcgactcataatctatctgagtagaagaatcatgcccgcgtagactatatcgacacaccgcagactcctaacaactccgactccaacgcgatgcatcgcattcttcttcggtgcgaacgtacggcccatatgtggtggtatacttacgtgctccatccaacantcccacgaatcaaggagcccgtataatactcactgatctagattatgctatatagacgaccttatatcgatcgtgattcacatcgacgcaaggtgttacgcattaggcnactttgtcgcacacgccatcaccaacctcaagcttaatcgctagatatccgctcattattaatagccattcacacgcggatgaatcgcacccgaatagcgaccacaatgcagtgttctacaatttctcaacgtantatcgtacactgtcaatcacatatcagtccatatcaggattcgctatagcgataagccatacacgtgtacgcatcatgatccgtaacatacgatctcacattactcgattnacgataccatgcatcccgcatatcgccgatattccgcccattaaagagtagccgatctcctaccgcctctcgcctccgtctattagtccatatatcncttttcaggccacgtgacccgccagcatcccattaagcgccatgatcgcacgactatcttcaactgtcctggcgctcataatactcgcactgtatttccctccacattacacgtatgtcttgtatcgattcacgaccatatagctcaataatgagaccgactcgcgcattatgacactcactactgtctcagtacacaacatgccagattgcgcgctagcaccccgatcatgttacaatatgcacctccgtccatccaccttct

SEQ ID NO: 6412 - DNA, 1308 bp, Homo sapiens
  misc_feature (1)...(1308): n = A,T,C or G
attatacatctcgtacatctaaatccctgtacgttcatcatcacccgaggcgagctttccatgatccaccttcgatacacgttatctttgtatcttttcgtacccccttctccttaccgcaacattatatccaccaccaccaccctcgctcctgagagactatccggcggcgaggtgagcgccccacactataacacaaactaaatgcttgttggatacatagagcggcatctcgcctctcgaacagcataactaccacatagatgtgtctgcgattggccataccgcacctcacagctctctgacaaatcaccagagcagtaggagcaagagccccgcgctccgcgcatatctcctctaaagatcgaatatatcattaccaatcgctttaagctcctattattattctcacgtgcgtgggcgcgtccacaatagatcactccacacaccggcgacctcgtattattcgcatgggaggctctctcgctagaatagtaagtatgttagccagcgtcacctacagctacaacttgccatcgacccactcatcgtcgcactaactcaccttactcctctcatcttcccatttctctcccttatcaatatttcattacatatgactcacacctccgcttttctcatgtcaccaaatcnccgtacgagtaagtacgctcagatatccgccatccattttactgtatacatacttatagaccatcatatcactttacacacacacctcatatctccacgcgcactcttgtnctgtcccacccatcgtcatctatgtgtcagtattcgcaatgtatgacgccgcgtantctctcactagtactcgtagacatgcgccgatcgcgaatgacgtgtactcgtttgtccgcgttcccattttcgccgcgagtagcgcttccatctaccccacgtatatccgtctcctcagacgcataatgngccgcatttccgcttagtatcacgtcacgacaacgaacccaccgccacatcccctaccgcacgagccacatccattatcgtcgtaatgtctcgctatccacaccatcagccgatcaatccacattctatccctctcgtattctcactctatcattacgcccgtctgtatcgcccgctcactcgctcccactatctgactgtctgtacgttgctcgtgccctctcantatatcacacgcttgcatcccacgccaccagcagtntaacccgacgcagcaacaccgtcggccgacccgacantnacacagccctcatcccgacgatatagacagtnatcacacacacgatgcccagtgta

SEQ ID NO: 6413 - DNA, 1179 bp, Homo sapiens
gaatagagatgattaggggaggtagaataatatgtgaataagataggaggagttgatagtagtgatatagggtatgatgtgtagagggagagaggaggtgtgagatatataggtgaggaggtggtaggaattgggaggatgtgagaagagaataggagataaaagattggaagtttgtgggggtaaatagggatgagaaagatggggagatgataagaagtaaaagggagggagaataggggtatatagggaagatgaggggaaggcggtgaaagtgataggaatgaatggaaatgaggggggaagggttgggggaatggagtaaataagatgagaaataatatggattaatggggttgaaggtgtggtgggggggagaatgtgtgggatgtagagagggtatgaaggggataacagggaagagataatagaatatgtgaaatggaatgggatgatgtggggggggatagtagagagagataagagtgtgaataaaataaaggggggggggagtaggggtggagaaaaaagggggaagggaaagagggagaggaagaggaaaggaagagaaaaggggggagtaagaatgagagggaaagagaaatggggaaaagtggaataaaaatgagggaggggagagaaaggagatggagaaaagaagaggtgggaaaagatggtataatagagtggagttatgttatgataaatagggaggaggttatgttatgaagagggaaaaagttagaataattaggttgacccataaagaggagtaagagggttggggggatgggaggtggagatggagaaaggaggggataggggagagagagaaagtttgttgagattaaaaataagttgagggaataaagaaatagatgataagaaggtagagaataagagagagagagagagagatggaggtggaagtaagggagtgaagataatgtgaaggtgaggttagttatgtattttgttaagggaagaagaaacacctcgaggaagtaggtaagagtagaaaggaggggaatggaaaaggttataaaataagagtgggtataagagaagtggacaggagaagataaaaggaaaggtaggtgagaatcgaggagagagggaaggaggaggggggagggaagagaaaggagaggaagaataataaaataaaagaaaaaaaaa

SEQ ID NO: 6414 - DNA, 811 bp, Homo sapiens
  misc_feature (1)...(811): n = A,T,C or G
attagtgtggtggttgggtattttttttgtgtgggtgggggttttgttgtggtggtgtgagtttggttttggtggtagggggttgtttgtggttttgttagggtggtgagttatttttgattttttttgtgtgtaggagtatttgggggtgtgttgaaatggggtggtttgggtatgggtttattttgggtggttagggtggtgtatttaatggatttattaggttttggagtgttaggtgttggtttagtgtttgtgattgtggggtttttttaatgtgattgttgtttttaggtgtgtttgtaaggggtgggtagaggggggttgtggggggtttaaaggggatgttttttattttaatatggatgggaggagtttttttttgttttggaggaagaaaggtgtgttttttttttgttaagtttttagaaggtttttgggggtttttgtttttaaagggtgaagttgaggnatttttttttttgaaagttgggggaaaaaatttgtagtttttgagggggggttttttttttttttttttgagggtgagtttnaatnnaatccccccccccnattagagaagttgaaggtggagntttttttttggggttttattggggnnngaggnnnattttttgggggtttattagaggtttttttttgggggtgnnngaggtatttttaagttntaggggagagggatntnnagatttttgttgagggcatcttctcttgnntnaaggngtgggattaaggaccttgatcanagatgggtttgtatagaatgatcaataaaacgtgatgggggcag

SEQ ID NO: 6415 - DNA, 1740 bp, Homo sapiens
  misc_feature (1)...(1740): n = A,T,C or G
cntttctcgtcgagcgcgctgcgngncgtcgtcgtcgctgcngccctcctgcgntgcgcgactttcgtcgcgntccntcntgtcgctcgtgcggagtgcgcncactttccgcttctctntgcctcgcgcgctgtgcttcgcgcgcgtctgctcntgnccgtcgtctccgtcngattctgctccggtctgcngcgccgctcgcgatctctctgtactcagcgctgttgcgtcgtcgntgtcttctcgctcattgcatcgcgtgtgcgctacgtcgctcgctgcctcgtgtcaccgtncgntcttgtgtcgcgctcgcgggtgtgctngccgacgcttctctgcgtgcgcgnctgtactggtcgctcgttctcgcgtggagcgcgctgacgcgctcgcgtgtgcgtcttcgtatatncgtgccggtgcgtcgcctgtctcttcgtgagacgtcgtctcgctctcgtctgcgctgcgcgncgcatcgactgcgtgcggcgtgctgcgngttgcgtgngctgcctgttcgtcanttgtggcgcgggtctctccctatgcgtgcgtgtgtctccgcgttgttcagctcgtggtctgcgcnctagtcgtgcgnttctctcngctgcggtgccgcgtgctgcgtgtgtgtggcgcgcggctcggttcttccgtgtcgcgcctctgtgtgcttcgtgtgcgctgcgtgtgctctttgttgtgcgtcatncgtcgcggcctcgtcgctgtgttcctgtcgtgccctttgtgcgtctctgcctcttacccgtgtggttcgccgctctgccgtcgtcgtctgccgctgtcgcgttgtttcggtctcgcttatgctcggtcgttggctgtcggtgctggtggcgtgtgtgttctctgtatcgctgtcgcggctctcgcctccgtgtcggcggtgtgtagagcggtgctgttgtcgtcanctgtcgtgcttatatctcgcgtcgcggagtcttgctctctttgctcgntgtgcgcctcgttgctgtgncgtcgctgtgtctctcgnggctttcttcgctgactctcgtctcgggtgctatgctatctttggtcttttcttgtgcgtgctctggctgctcggtcgccgtgcgtcgcgctgcgncggtgttctctgcgtctgtgctctgcgtctcgtgcctcgcttgcttctctcngngcgtcgctttcttgcgttgcttgtgtgtgcgtgtgtcttcggcgncgtntccgcctgcgctgggtcctctcgtcgtgcgcgtgtccgtgcgcggctctggtcgcgcgcggcttctgctngntctgcgtctcttgctgctgtcttgctcgcgccgtcgtctttccnctgcgcgctgttctggcgcggcggtggcggcccgcgggttccctctttcttctcgtctgctgcgcggtcctcgcgctctttntggctgcntcccgcttcgctcnctcttccgcgtcttctgtgggtccgtctcgcggcccggcgtcgtcgcgtcggtgtgtgtgctcgcttcgtctcttgctgttcgcggtcggtctctgtgctgtgttgtctctgtccgtgctctctcgcgtctgcgttcctgtgttctctctccctcgcgcgtgcgaagggtttggcgttncgctggggtttctcctcctccgtgagcgtgtgttgttcctgtntgnttctgtgttcttgtcgcgctgtggcttcctctctcggcatctntctctcggcgcgtcctcctc

SEQ ID NO: 6416 - DNA, 1479 bp, Homo sapiens
  misc_feature (1)...(1479): n = A,T,C or G
attgtattttcttaacaggacccacaacccgccagaacaaaacttttttttagcacaagaaaagaccacagcactttttttgtatgagagaaaggagaagaccccgccgggcgcagagccgcgaagtaccggcgtgaatgcacttttctatatccacgtcaccatcacagttccatacacacaatacaatcaattactaatacacctttctgttcccatacgcactaaaccgtgacgggtaccggttatcgtcccgctttccctcgttgtgcggtcaccctcagcgtgtccctctcttgtttacgagtacgcatccccgttatcctaacacgcagcttttattcccagtcgactaaccataaaccttttccgcgcgttctcccccgtttttgtttcatccccgctcgttgttttaattttttcacaatatttgcattcaattattcactaaattatccaaataacccattcctaccaacaccataaagtgtaggtaggcggacctcactttgcgtgtcacagcgggctcttgcactaccacgaccactgattttcccccccgtcccggttgtttccacactgcgtcgatcgcgcgtgtaacatatgatagttagtgaaagtaatattatggtcttttccgcgccggatgtaaacagaacagcaaaatttgtcgatggaagtctggtagacttctccttctatcgtacggacaaacacctttgcgtcctaccttatctaaatgtcacgtgcagtcaagatttgacactgtatatctatctgcactggacacgaatagttacttgtttgttatatttaacattgagcggcctttagagtgggtcaagacgtgagaccgcagtgtgttgttataacccgcaggtttttttcttcccacaccttttctctantatcaccccacaccctcctcaccttagttgtccaccaccgttttcttactcttcgcctttactacgccccttctttttacccaccgccaccagacattatacacacacatctccgcgtgtagacgactangtgcgatgcgcgcgtccnttaacctcgcatgattatagtagctccagacaccacacataccctgtagtgatgcgtacgtctataatcaatagaataccttcgcggtataatagacacgactcgtataacttgcacaacagcgtgtgtcactacatccgcccacatcagatgcgcccccaccgcatgatcgacactctcacgntatataatacaccacctcaaccgcctcgacaatcctacctccactatctgcgnccgtcgataccacgcttcgatatattgagcgtttacgtctcccgcgttattgaatagaagacattactcacaccgcttcataccacgattccgttaaccgacggcccgtgcgactttggtggtctactctagatgcgntacgntctacccacgcgtctttggctctgtgttagcactacacagcat

SEQ ID NO: 6417 - DNA, 1718 bp, Homo sapiens
  misc_feature (1)...(1718): n = A,T,C or G
cagaggaccgccgcgcgagcgcgagcagcggcgacgcagccgcagaagaagacgcacggacccgcttacagccggggcggacagccggggggggcgggcttcaagaccgggagaagaaaaccacacgccancagacgcaacgacagacacagcagcaccgcacacagagccagagnagaccgacagccggacggaagacgcgcgaacccaagacacagacgcgcacccgcagacaagcacacgacgacgaggcaacaagccgagagcacaagcgacgcggcgcagggcagaacgcagagcgcacaccgcagnagagacacacggccgancgcgcnacacacacacggagcgaganacgcagcgagcgaacggcacacgcacgcacangcgcacagaacacaggcgagcgcccncagnagagcgcgcagncacggcgcgcgacgcacgcgccagacgcacggcaagcaagaggacagccgacgacacagacanantagancagncgcggcanacgacagaagagcancgcagcanggagaacgaccagccaacgcgcgcacaaacgccacncgagacgacgacagacgcacggacgcccgcgcngcaggcgcggcccgnacagacgcacgcacgcngcnagcaggcagagacgccagacgacgnagcacgcgcacaacaacagcgnaacgcacgagcaggagggagacggcggagagcngagncacgcgcagagagacgcagacgagagcagccgacggcagagcacacagcgacgcgacgcgcaagacgcacacggacngcagcacacgacggagcgaccgccgaccgagcggcacgagcgcacgcgcgangagaccnacgcaagcgcagagagagaggcaagcaggacggcagcggacgcgcggcacgacgangcgcnagagacgagancgnaacggcnncagaccgcggcgaagacgaacagcgccgcgacnaggcgcacgagcgngacgacaggcgaggacgcaagcggccgagngagcaagacaggangccacangacagaaagnacgcnaacgagacgacgcgcgagagagananacgngcagcagcganccacgcacacggcaanagagagccgcgcgaggcgnagaccgcgacgcgcgagngcagannagagnacgcaccgngaagccnacacggacgcagngacccgacggcacacgaacganacagcgacacgcgccgcgcacaacagagcacgcagcgacgancaccaccgcgacacgacacgacgcgccnacgcagccgacagacgcgacngnagacagacgcgcacccgcagacggagagcagngcgccacgncncgagcgagcgancacgcgacgcaaagcgcacgcacgacagcganaaggccagcangangacaacgacacgagcagacacgagagaagcgaagacgagacaagacggcacacgacacgcatctcagacagaacgagcncnacgatggcgacacacacagcaacgagcgcgacgaacacgaacgaagaggngacgaggtagacgagagcactcagccgcaagggcgcgcgcgcgcccgctccgacgacagatcagcgacgcacgcgcancnacgcaaacgcaaancatngcgcatcgcgagacgacgcacgcgntcancgtgcgcgagagcgcgcgcagagacgcagcgacgccgcctcgagagcgacagact

SEQ ID NO: 6418 - DNA, 1872 bp, Homo sapiens
  misc_feature (1)...(1872): n = A,T,C or G
cgcgacaactccccgcccncgcggctagactctagtncggatggctgtgcggctcggattcttcgcgngtcgcgctcgcgcgcgcctcatatatgtctcgcgatgtgtgtgtgcgtgatcgcgcctcgttgtcataatcaccatgcgaccacttctccgtattcgtaccccatcgccgcgcgtcgtcggggtctgtgcgttcgtttttatcacgataaatgagacgccccccgtctcgcccttatatcgtgtacctatacgtcagaggagagtgacgcgcgcgcggctcgcatggctgttataagaatactcagtagctaccatggtatcagtacgcttgtgactacagcattcgaccatccgagcattctcagaacagctaccatacctgcttcgcattatctcgtcgggttcnagtcgtatctcatattcacgtatcaaagtcgtgatcgacggcctccacgcgtatcgtcagcgcnacgctcgngtgacacgacactncgcgtgatctccgcagatgcacatactagatattgtgcgatatgtattactacgtcgcacgttgcgctctcagactcagantagcgtgtgtccgtgacggtcgcgtgtcaggatatactctgtgtactacacagcgtgtacgcgtgcgcagctgacgaccgagttntncanagcagagctagntgactagcttcatcagtcgtgtagcgcgagtgcggacgacgtaatacagactgagctcgtcgcgntgttgnanacgcgtgcgcgcatctgatgacagatgtatcgaggcagacagatacgtctccatgtctctgtcgacncntcgtctacgcaccgaacgtgcgagatacgcatgccactcactcgctatatactcgccgatgcatggtgctagtctctctgactgtatctatcgattgctnctgtgcgcangtgagtgagtgtacgtacgtgagagtcagtagactgatactagtgattcnctgctatatgagcgtcgctacgncncaaggttatgcgcgcgcgggattgncactagtagtganctgactgntcgtanctgnaggcgtcagtctaggcacacgtgtcacgtatatagagtatccagcagcctcgtcacttgtacagctgttcgcgctcgntcgcgcgcgaggtgatatantgacacgtagctgctgctntctcgcctgtctgcgcgactctcactctntactacgatcggagctctatgcacggtgatcgagtcgataccgcgcgagcgtataattgacgacgttatntcatcgagagtacacagagatcacgcatactgatgangntaatatcgcgcnangaatntctgattntcacatcatatactgtgtagtggtcgctcacgatacgtccgtgagccgtatagtcantgacgtgttatntccgcgacgactgtngccgcgcntagtaccgccacgatctacctcgagctctcgctcgcgcgcgncgttanagagtgntnacatgcatgcacgtcgcnatgtacgtcatcactcgctactggtgtctacatagtctcatatcgcgtcgtgngtagagntgaagtctgagtcgcaaacgatgcagcatncntcacggcgtacgatgatggtgtatctagatgacgtntgacgtcacgctccgcgacngccgatcacatgtctagctcgtctcgcgactagacttgtgtctattcactcacacacgcgtgtcgccggcgcganactcaccncgacgtatgcactgaccatgccacgtatcgatcgcatacacatgcacagatcgtactncagagtagacaggtntcagncgctctctctcgccgacgcgttcgctcgctcatatgaacgcatcgcg

SEQ ID NO: 6419 - DNA, 1529 bp, Homo sapiens
  misc_feature (1)...(1529): n = A,T,C or G
ctcttactacgcttgatgtgtctatcgtacgtcgcgaggtacaatcacttcctngactccgcacggacttctgacgcgtcntcacgactcganctacngctgtgcgtacatctctccatctctatatttaacgtgtgctggcgtgctctctgtntagcacctgtatcatntgcgtcgcgatatactnttcgntgtcgggcctgcgngtgcggaancgtccactccanatcttcnacatcgcacgtacgtctatgataantcgatcggtgtaccatagcgcatagctgcgtctgatcatgcgcgattgacggccgcgcgcaacacctgagcgcgcgcctacactgaatcggcaactgcctgcgtgtgcgacatcggacaacatatgtcgcanaacgcgtgaaatagattgtgaagatagtatgtgtcgtatgtgtcctgtgctgttcatcatgatgtgaagcatggtgacaacgngatcaatcaacaacccgcgccggacgccggaaacggncatggctccggtgcacgcgtcaactattcagactcgtgcgngcgggtctcatgtggccggcgtggtagcccgctcactgtacggacggcgcgtgcgtacacgacttaatacgcatggcatagtganatatcgcgccatcgtcgtncatgcacctgcgtatgtgtgccgtgatgtgtcgcctcagcgcgctatacatttaagcncgactgcgcgtggtcttcgtctgctcattcatagatttcgtattataacgatcgtgcgtcgataacgttancatactcacgcagcgagctaccaccggctgtcctgtgtacaactcgcacttgcgcgtatnacctatacggatgtggcaccgtacacctcttaatcacgactgaaatcgtcctccgtcgagctcaccatctcgctaccatagcgttcataattatcattggcggtacgtctgtcttcttctctctcttcggcatcgcgctgcgactctcntgccgtgatctactcgtcagcaaccctctcctcgtctaatcggccgggcaaacttatctaaagtagatctactcatgtgttactatcggacgtctgatggatatcgtcggggtgatgtgaatgatcgaccgctgcccgccactcgaccctctcccgatactatacncgacgcgataccgaatgtgcgtgagaaaaactcacgcatacatgggctacaatatgggaagaaacgtgggtaacgaactatccctgcgtgattatagtgctgtccatgtgatctacggctactgtcggtcagatctctcgctgtctgtttactattcgcggcatctgtcgccgaacgcgcggtattgacgtgtgggttattatccttgattgtggctgcgggcggaaacataatcggcgggggggtgagaatataaaataaaaaaaccttatctgtgccagatgttgacatataagaacatgcgatatcattggcgaaaatatcgtcagtactgcgcggaggcactgttgcaaacatctcgcctctacc

SEQ ID NO: 6420 - DNA, 1550 bp, Homo sapiens
  misc_feature (1)...(1550): n = A,T,C or G
ctgcgtcgtgtctgcttgcttctntgtgtctcgctgcgtctgtgcgctctgtcgactctctctcctcgcgccgctcctgtgcacctctctctcntcgtgtcnctgttagtgcggcgccgcngtatcgtcttctcgtctgctacactggacgttgctgtttcttcttcatgctagcgattctgtcgtctgccgtgtctctctcgcgtgttcgtgtggtcgctgtgcctcgtgtcggctcatctcntgtgcgttcgcgtgtgtcgtgttctagtcgcgctaccgcttatggctgttcctgccttcaccgcgtgttctgtcgtccttgtcgcatctgcccgcccgcgcctgtgcncgtctgtcgctctcgggtcctccctgtccgctctgtcgtgcggcttctcttcgnttctgcctgcctgtctcagcgtggantcgttcctcgccgtnttctgctgcgttctccggtcccgctcgtgtctcctctcttagtcgctagnccctaccttctttatgtcttctgtcttctgtctctcaggctgtctcccctgcctcttctcctgtgttctcctcggcttgcctgccgcgtccgcgcgtcttgtcgtgtctgttcctccccctctccggctttcgtcctcgtgtggcgctgtcttgcgctgctttgtctcttcgtcgcgtgctctctctgtgctcctatgttgttatcctctcgtcgcngtttcgtggtgntcttcgtcggcggtcgtacgtcggcccgtcgtcctctctcgtggtgtcccgtctgtgtcgccgtcgcgcgtgcggccgttcngggctcgggcctgttcgccatgcgttgcgcctttgctcctgcctcggcttctgtctgcttgttcttgctagttcgctgtcccgtgcgcgcgttacgtcgtcgtgtctgttccgtccggcgctgcggcgtcgttgtctcgttcatttgcgttgtcgtctactcgggcgtgtctgcgattgtcgcagatctccttcccctcatgtgctctcccgctctttcctgcttccgctttcctattaagtatcactcttgtcgtcgcctctgcctccttcgtcggccgcttctctgcttagccgctctggtgcggccgttcgcgttgctctcgtcggtcgccgcctgctctccgccgtgctgctcgcgtgctctgcgtgtatcatttctntctgtgcngacttcgttcgcgtctctcttcgttcgcgaccgtcgcgccactctctcatcgtccgcttcgcgcgctcgtggtgtgggtcgnctngtgtgtgttctgtgtgtggctcttcctctccgntctctctccgtcgtcatagcagagatctgttgctctgcttgtctcgcgtgcgctgcggcgtgtgttcgtgatttacttgnttctattggtggcttcttctgtcctcgcgcncnctgacgcgnnccncngtngngntngnntcaacgtccncangctnaacgaatggaaaccnngcgtccttcttctntntctctnttcgccgtgactatctgctgcgtggtctacgtacccgct

SEQ ID NO: 6421 - DNA, 1290 bp, Homo sapiens
  misc_feature (1)...(1290): n = A,T,C or G
gtcgcgcctgctctcgcgcgcgcgcgcgtcgcgcctactgttttcgtcgctgctgcgtccgtgcttgtgtctgttttctcagtctctcgcgcggccttgtgttctggttgtcgccttcctcctccctcgtgccccgcttcgtcgtcgtcggtgcgctcgtgctgtcttcgtgagtgtgccctgcggtcttgttctgctgttgtaccgtctagtatgctcttcgctcgccgtcttcgcccgctcgttgctgcgccntcttgcgccgcgncccgcgcgctctgtcacgcgcttgcgtgcggggtccgcgcgcggcgcgggcgggcgggtcggtcttgcacccattttctggcgcgcgtcaggcttgtccgcctttcccgtctactttgcgcggccgtggtctcgctccgggtgcgtccctgtctgctgctgcgtgccgggcgtccgcgtgttggtcgctcccgctgcacctcccgcgctcgcgcgtgttgcgtgtccgccgcgtgtgcgcctcctcttgccctccgcgctcgctcctcggccgcctctggttgtgcccctctccgttctttgtgtcttctggccgccccctctgtcgcgtcgtatgctgtgcgtggtgtctgcgtcgtattctgccggcgttccgttgtcggctctttgtgcgtgcctttcctgtgttctgtctcgtgtgcgtctcgtgtttctcgcgtgtggtgttccgtgtcggcgcgcgtcttcgtttgtttggtcntcgcggtgctgcgttcntcgcctctgtcggtcgctccctctccgtgttgtgcgtgctgcgtctgtgtgtgcggtggcgtggtgtcgggctctcgtgggtcgttttctcggttgcggttcgcgttggccgtctccgcgccgtccgcgcggctgtcgttggtttctggggtgttctggcgcgtggcctttgttgttgtgtgcgtgttggccttgtggcccgcgttctcgcgcggctgctctctggcgtcggcgtggttcgtcggttcgttctcctcttgtcttcgtccgttctggcgggcctgccgcctgccgtcgtggggcgtcgcgggttgtttcctcgtcttgtggcggcgctctgtgcgctccggtctccgctcgtctgctgccgtttgtggttcgtgtctggttctccgccggtcgtgtggtgctgggtttctctccttcctcaaaccgtcgcctcgtcggtttccccctcccaccggtgcccgttgctgcgntcgtgtttcctcgctcgcgttcccctgcggcgctcctctcttctcc

SEQ ID NO: 6422 - DNA, 343 bp, Homo sapiens
ccccgaaatatgggggatagcagagcatatcgatggaggccccggaccgccaggaatcactcgagtaggagcaaccatagtgagcgcgctggcgggatatagagcgggcgcacaaggaagaaacagatcgcgcaagagcgatgctgttttagcgccgggtagggagtgcgtgggggtggatcgcaggaaggctccgccgtccggatgagcactatgctgaggaccacgtgaggcataggtgagaggcggagtgatgtggagggaaagcttacttgtgaggagaaagtgctgagtggacggagagggacgaaacgcaatagagagagaacggcaccgaacggcg

SEQ ID NO: 6423 - DNA, 184 bp, Homo sapiens
gtgcaatccgcgttaccagtgcagagagaatcgtcttataggcccgaaagatcggcggggctgatgaaaggagtgaggttgggcgctttggcggtggaagcagggcgaccaatgtaagttaaaggggggaggggctggggcaggggagagggaaaagtggaggagcccgccacacggcccggcg

SEQ ID NO: 6424 - DNA, 1375 bp, Homo sapiens
  misc_feature (1)...(1375): n = A,T,C or G
cgatgtttttatttccttggctatgttactattggtaatcagttttattacccatctcctctcgcgttgccccctacataagtatacattatttaattaacattatcgacgctcgggtatctggtgttactgcgatttaggagcagactcgagcggacacgtctctatcgtcggccatacgatacagtcagacatgaactacatcaatatttctatacatctgctcatgcgtcttactttgcattgcactaagatctagtacgtgagctggtacgaagacgtgatgtgtaggcaggtgaccacttaggctcaatacagtagtatagatttgagcagtatcgtctgaaagtgactgtatgttacagagcgaatatcaaatgcgcaatattggtccgattcaacgattactgtgtctcagtaatcactctagagactctattcacaaactcgcatggttcgaatgaaaaaccttgaacccgcagacgcagaccaccctccatcatccccgcatgtccggagcctatggagacggactccacacacatnagatagatgagcatagaanagaggcggtgtgagcgatagctacatcaacgatgaacgacatggtgtggcgatgcgagttgtcgatgtcgttgagttgtgtttgatcatgttgtagctatccgcactcgctctactctcgtactctcagattaatggctcgatcagcgaaacgatgtaactataanctctaagagcaccgcggagtatctgaactcactatatcacaccgcacgctgacgcaatgtattgctcagctgatcgcaatctcttcccagcactctgcgcgtctcctactatactctccatgtgcataccgttgccgctaccgtgatagctactctccgcanatcagtcctcgacagtgactacnaccacacatgtgacgacgtatagtagagagtgatgagtgatgtagcagcacgtgcgacgcgcgacgcactgtaagcacgagcncgctctacatgatctgttcgcaagatgtaccagaccacgtantngatataccgtnacgcagtcaaactcgtataaatctcgatctacacgtgcgagagtagagctactgacagactctctagctagtctgcagcgcgcactnncntacanagcagatatagcactcgtactcgccgcgcactacggcatcacgcaccattctacatatgccacagcgtacacgncgtcaggcgagcgcacaaccgnagaggancgccgtcacaagacattagagacatacatactncaacatctcgctcgagtgctaccactngtaacttctacgtgacctgtcagatagactgctgtcagtgtgatgattacacactctatagat

SEQ ID NO: 6425 - DNA, 1496 bp, Homo sapiens
  misc_feature (1)...(1496): n = A,T,C or G
aaggtaggaggtgaagagaaggagngagggaggangagaganagagagagagggtggtgncgagggaggaagaagagagagaggaggaggagagcggaaagaaagagcttagagagagaggangacccataaacangaaacaganctttagcagagtgnaggngnagaccccgngngnnancgcgcgncgaagaancgagngancngnncggcggancacacaacaaaagnacgagagagnnacagaagaangcnanacacnaggganncncnngggcgggngggcgagcgnnggggcggcggnnaccgctgagagggcagcggcgcgcagtcgcagcgagnaccnaccaagaatgccgnccagccgggcgcgcgcgcagcgcnagccagtccgcacagcgaacgacaccccncggccacgcgcgcgcacgggcgcacgaccagcgcgccgcgcgcgagagcgctgacgcaacgncgccgatanatgcgagagctcgtgccgccgagcaccacagcgagacgagagcagagtacgacgaacactcaccagtcngagcgnatgcatgcgacgcggcgacgcnacgcgcccagcgtccgcgcgtctcgagtgacgcgcgcagcgtcgcgacacgcgctcgcagcgcccgacgtccgagtgcaccggcacccgaggcagcgggacgtgagaagttatcacacatactgtccanccggccactcgccgtcgcgctgcactcggacccgcgcacacgcgcacgattaccacccgaacaggcaggacgcgcgccagggcgagacgacagcagggcgccgcgcgcgcaccgcgcgcgacacggcgngagcgcgacgcgaaacaagccgagagagcgagaggatgctggtggancgcacggaggggngnggagaggaggcggggagagagtcgtaagcagaacagggaagggcggagaaggcgnagacgcgattcgcacacagcacggancgacacagcgccccgccccggagcggcgagcgaagtagtggcgtgaaggaaccgcgcgggatgacgaaccgcggggttaggaaatnntagagaagnatcaaagcgtgcgagagtgaggaagacggaggtgctgggagagagacggacagcgagaggacgccgccgacgacgccggcaaaccgcgcgacccgccggacaccgagcacgcagcgacggaagagcggcggagacggcgcggcaggcgctgcgagagcgcgtcgcgcgcgaccggcgcacgcagtaagacncgcggtcgcnacggcaccagcagagcgcgcacactcgcgccggcgcgatggagcgcagcgcacgcgcgacggagtgcacgcccaagccacatcgtcccaccaagatctcagcggccgcccaccgcgcganccgcgngaggagtgaatcactagacggtcgcgacacgtcggcncacgcactcgacgacgtgcgagcacgccgacgagcagcccagaccggcggcggc

SEQ ID NO: 6426 - DNA, 1442 bp, Homo sapiens
  misc_feature (1)...(1442): n = A,T,C or G
gtttgttggtggttattttttttattattttttttgtttgtgttttattttttgttatatattttatttntagataaaaaacttaaaaaaagaagaacagaaaaagaagagaggtttaaaggagcgnanagagaccagggggggncnggagggcggacgcgccagcgaccaacgcccgaccgttaatagccaagcagccaggccgacagcggagaggcgctggagaggcgacaaggcgcctgcgtcgtccgccgtccctgccgctccatcctgtgttcctttatttttttcttatctacgtccttatgttttctgatcgttccttagttgtttttctactccgctttctatactgcccctctcgcctttgttccgctcccctcccgccgccgttcctagaccgctcgtcttctccttttttctgtgcgcttcgtgccgttctcctctgttcttctattctgtctcagcatcggtcttttacatttatttgtgtattgttttagtangtttctatgtttttggttggtttttgttgtattgttttgttngctctttctgttctgntcgtctctttgtcctcgtctctgttgtttcctgntgtctgtctctacacttcccgtcgtgtgttcgtctgttncttcgtantatcattacgattcgtgttatctgtctgcgtcccactcgccaccgcgctctctcgcagcgtgtgtcacgcgatggtgacagctgtgtacttgtgtaatatgtaactacctgattcntcgtattgctatataatatagatattatatcttcttgannacttatattatctggcgtgattggtgtgcgctgaggtgcgttttgttgccggtcgtgttcctattcttctccacgctccgtcttatttgttagttgtgatattgtcttgttgatgcggctggcactcctnatatctcatattccgtgtgatgtgtgataatgttattatgattagtatgntctattcgnttctgctatatgtgtggacagtgtgttttnttgtatgtgtctgttatgaatgaagcgtntatgagtcgcntacnacatctgcgctcttctgttagtttagtgtgatntcgtgtatcctgtgtttgtctcatcttgtgtctctgatttactcacgtctaacctatcagtaggtcagctcacacgtgcnactgtgttctatgtagaatgcgattgtcgttagtgtcgtatgtttatacgtgtggtgtgctcagatatacacgcgaaagttgacgatcagtgttgtcgtgagtacacgttcaatgttttatcnactcttcatatgttgtgagacgtcgagagcaccgctatcgtagtgagtgtcacngtatagtaagattgtaggagtgctgcgcatatgtggtgatgnttgtgtgtgnanntgtatgtagttcntctcctatagttctatcacc

SEQ ID NO: 6427 - DNA, 1837 bp, Homo sapiens
  misc_feature (1)...(1837): n = A,T,C or G
tttaaaannntttnnttnnnnnnnntgnnnnaaannnnnnnnnnnnnnnnaaagatattnatgngtangaagannngnanannnannaangttantnngnnnttnnnnnnnnantnannnnnnannnannnattnannanatnnaannnnnnnannnngnnnnnnnaaanatgttntatatgantctgntnttnnatnatnntnnatntnnnnantnntagtgttnnnattatatattntgtnnttnnnnagaaccaggttntnnntnnatgntntagntnnatgctnatttnntntttattggattattnnatgttntaannnatagtgtgngttntnatangtntnattnngtataagttttgatagatcgntgactgtaagctngtntnagngtcgtgagtcatatctgtgtgntttactagttnatatgatatgctcctgcgtcatgatattgctctgtgattgtgtgtaatatatgcgttcattgtattttnangagctatgttagtctatatagatcnctgtanatagtatccgnttagttcancanactntactgagctagtncgtgtcgtntctntagtagcattanttatatatgttatgagatttcaatagtgtaagtnanngtattaatanacattagattatacnctccannacccctgtgattcagctnnntctcgtttannntntntanatnatcaccagttcatccgtagtgcacttctcagcatccacacactctctactccncgcgcgctactcctanacctactcgcgtccgtcacatcgntactcacgtcacacactatcgagctatctatcagctngcactcctctcttntntacttantctctctatatagccgatctatttctccctatgccattactgtgcattctatagatantatacncgtcgtcctcgcttagtctctattcntnctgcttcctagtcctccactctatctctcgcgctcgctcactgctanacgcttctaccgcttatacntcgtcatacatatnatctcatntctccctactattctgatctgtctccacttagcactactctcantctccctctcncacgtgctctctctctntgttactagcacacctcactcgatcgatacacgacgcgtcctcgacgcgntcacatgcgcgtgaccgacacctgcgtcacgcgctcctactatcatcagataccttgtctaccctacgacacatcatctacgtcatatccatccttactctctactcgccgacatctccacacatccaccacactcatacatgtancncancattgaccactctgcgantgctgtattagtcnatgaccacgatctctccttcctgccacgtatcgttgctcactngttcgtcctgaccctatctcactcgctctcccatgagcctcgcatacgctgtatgccagtacctgcatctgactctntattcgctcgacaacaccgctcacacacaccatgttctgtaaccgactcacatgcgtgttcctcatgtatccacacaccatccggcacgccgtcagcctgnccacagtgttcgcatctcgcctttactatatcctgttactcattcgactctcagaccntacacctgtcgagcatnatagtgtaatcacatcatagcgctatgtctgccgagataatatgacatcngtttctcttgcgcatctacacgcctgcatctctcactactacacaccagctcacgtnacaccacgcactccacatcgctgtccgaccacctcagcacgtcgncgcaacgcggtcgtgctcacncagcagcgtcgnaccgtgtcnat

SEQ ID NO: 6428 - DNA, 1153 bp, Homo sapiens
  misc_feature (1)...(1153): n = A,T,C or G
tattttgggggggaatnnaaaanagnaaaatgtaaggggagtaagttgttgtaataaaagttaagaagttaaaagaggaagagtntagctggtttttggggggagagggcggagggttgttgtttagtggaagaaggtagggggtgtttttatgagagatgtngagagaaggaaggagggatggtgcgtctgtgggatctcgcatacatcgaggctgggctccagaagagtaaagtaaggccaccaaaaaacagacacgagacaggccgaaacaaaacgccatcaagaccactaccgagggtgtgccgcacacggatagaataacacacgtatatgagcaccccgccaggacatgtatcagaatatctaatatctaataatatactacgcgacctacgcaggcgccacctaacattaaacatcgctagccacgtatattaataattgaatcccaccgcggtgcctgtgctgtctagcagagcgggtataccgtatcaccgcccaccccantccgatccgcaacctacnatcgcccacccattctccgtcgcgcctcccccgcgacactcctcccgtcccctcactccagcatgacccactaccccgtcgtcgcttcgttgtaattctactcgcccgccgctgctaattgcctctactaaggctccctcgctcgcaccgtcggctacgacccgtctcccccctcttgcgctctacttcgccttctgtatggcgtgcgctgacgcacccatcatcacacgccgccaccacgacaccgacgcggccagtcgcttagttacactcccgcacggccgtggtgatttcgccggcttgtgcgacgtacctccacccgcgcgtctgaccgcgtcgcgtaggtagaacctctggcgtattccgatggagaggacgcggacacgtgctccactattcgtcttaccgtaccaccgaccgcgctcgccttggagtcgtgcgcatacgtcgttgctactagttacccgcggtaacggaccggcgtatgcacaccacaaatccgcgcctcgcttcacttcacgacgccgcccaacactactcatagatcacacaattactcgacatactctccgtcgtctcggtagtgagtcacacacggttctcgagccgcgtaccgcacctgccg

SEQ ID NO: 6429 - DNA, 758 bp, Homo sapiens
gcggccgagaaaagtggggcctctacttgtattcgccccttctgccgcatatattgtaatggtcgctcttggaggcgagcgggtttccatcttacttggggcccgtaatcgtccgcattgccggcgcggattggcgtaacggcaaatgagtggacgtgtgtagcagggcgggggggggggcggtggttggagcggtggtgagacgatcggatgatggtgtgatgtacgaattcggcacggtaagtagggagaatagtcgtgtgtcaggatactggcaacggaggattagtgtttagtgctcgacaaagagtgggacgggatgggggtgttgaggggtggacgatgcggaggtgaggtcgcgtgcgtcgtgggtgcggtgagtggatatgtgacagtggtggtgggtcggggtgcggcgagttggtggggtggggggatgtgcttgactgagtggttactaatgatgttggagactgtgggtacagagggacgtcaaaaggatttggtgagagggtgagggggccgcgttcatacacgtgagagatggtatagggcatactggacgatagtattgtgttgcggaggaggcaggttgaatgaggggtgcgctgagaggtgtgcacgtggatgtggatatggaggggcgtagtagccggcgcagacagggtcggtgacagctcgagcgtgaacgaacaaggatcaatgttgctgatattaaacttcaagagaggggtgcgaagcggtgttgggtgaaggtt

SEQ ID NO: 6430 - DNA, 932 bp, Homo sapiens
  misc_feature (1)...(932): n = A,T,C or G
cggtgctgcctcttcgctggcgagtcgctcttttttttccttcttttcactcgtcgtcctcgaggattcttactcgtctgcatccattttaccatttcaaggttgtcgcgtctctctctttgcgcactttactattttctattctattcttaccctccctcgggtngtcgcggtcgctttcactcttcttgagtctctctaataatgttgctcttttcatattatggcaccgctccgcccgcatcctacttctaatgtcttcttcgacgcccattcgtcaggcttcctcccggttgtagtggttgtttcattgacccgtatgggccttaaaagtctgcgccccctctctctctggtgggtggtagttccaactttatttcttctgtcttggaccccggtattcctgttggattacactaaattctgtcaattgttacgtgtctctcgctccactcgttcttttctcactatctttcatctcctgcctagcgatcagcccgttgcttcttttcatttcttttttatcgttactaagcgattttcgcatttattctttcctctgctgttgttgtctttcatgcggcctcttatctgctcgcctcacttctgtttttgttcattccttcgttggcggcggcgattaaatccccccgcagtagagggatggttgttctcttcttccgattgtctctgtccttaaggtcgtccgtggcgccctctcccttttctcctctggtggctagtccgacgttagtaaacggggcggggggggggtttaaaaatggctgttgagatttgctctggcgcccctaccccaagaagtatataaaatagtataacaacaaaaaaaacaataggtatataagaaaaaaaaatccacgtgatgcggccagactatttttcttttttttattatttcgcggttttctttt

SEQ ID NO: 6431 - DNA, 916 bp, Homo sapiens
  misc_feature (1)...(916): n = A,T,C or G
cgctgcgcctcgtcgtatcctctgccctcgcttgtcggtgtacgtatgncgctcctctatcgttgcgagcgcgngncggtcgacgtgctcctcctctattgtgtcgtgtgcgcctggtgctcctcccgcttctcagtacctctactctcgttcgtgttcgtctctctacgtctgcccgtacgtcgtcgctcgtcgtgtgcgcttacggcctgtcgcngtgtctgctgtctggcgctctccttcaggtgtgtgtgtgtcggcatgctctcaggatgtgtgatgtatctcacgtctgcgcgcgcgtcgcgtgtcctatacgtctactgaccggcgcgacgcgtccggctctcactgggtctgagtgtcgggattggcggtctgtcctgttatgtcgttggtgaggtgtggtgcgctggtcttcgttgtttcgttccccgcgttcgatcgcttagtgattgcttgcgtggtgcggactcgggctcctccctcctgcgcatgctcggccgctggcttcntctttgncctcatgtagtctccgtctgtncgctcgtcgccggtcggctttgtcggcgcgtctnttacaaaaaacaaaagttggcggtcgtcgctgctggtggcatcgccgtgggatctgtcgcacgtcgntcgcggtgtacgctctgccctcgcgcagcgatgtattgtgtcgtcgcgttgccggtcctgttctgcttagtaaggggtgcccgtcgcgttcgcgccgttctgctctctccgcgccggggcggtgtgtgcgtttcattcgnagggttttctcccgcgccccatggcaaaaggctggttccgcgactcctctgncatgcgcnatgttgtgctggtattcaccccgnccaggctggcccccccgggtcngcgaccacgacccttccccgcggcc

SEQ ID NO: 6432 - DNA, 725 bp, Homo sapiens
tgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctggatgccgaaatgagtgcacctgggggcaagcagagaggagtgcagcgctggggaggcgaattgaggggaggaacagcgtgggaataatggggttgctgtggcgggccaccatactgctaaaaacgaggtgggcgggggaaaaaaaccagaaccgaacgatacctgtgggaagggtgagggcaaatacgggtggggggtgggaaaacggggaggggaatcggggacaaaagggaagggggaatggaaaaatggggggacgatgggacacaagggaaaggaaaaacggggtgggagagagaaggaaatgggggaggaaaaaaaataaaaggaagaggcgggaaggaggaggggggagaaagaaaaaaaaaaagaggtggggggagaaacaacgtaaaaaagaataaagaggacggggagaggggaggggagaaaaagaagaggagagagcg

SEQ ID NO: 6433 - DNA, 476 bp, Homo sapiens
  misc_feature (1)...(476): n = A,T,C or G
caactcgaatcaataaccacgtccgtatgaactgtatcagtcagccagaaaccaagagatgctgcaatacctaagtcgcgccgactctcgagctccaatcaagtacacaacgacaagtangagaacgagtgaggnnagnnnncagnnngngngcgnnaanccctcacagcctgacgctcttaatctcccacacatccgaacgcgcccaagcagacgctcacagtccaagatcacaacgggngcataataacagcgtacatatattctactctcaaacttcaatcgacccaatattacctcctctcaacatacaatatttaaaatacataccttcccattcaaaacctttaaccaaaccaaccacatcaccactctattcaacctacaatctcctccaaacantatcccacccaccccccacaacacacccccacacacacaacatccaacccacaaaccacaaaaaaaaaaaaaaa

SEQ ID NO: 6434 - DNA, 242 bp, Homo sapiens
agatggagtttcaccatattgcctaggctggtctttaattcctggtttccagtgattaatctgcctgcctcagcctcctagagtactgggattatgggcatgagccactgcacccaccccgcctctttactggaatgacactatggttctcctgggtctccagcttgctgactcgccctgaagatcttgggacttgccagcttccttgatggtgtgagccaattccttacaataaatctcga

SEQ ID NO: 6435 - DNA, 1045 bp, Homo sapiens
  misc_feature (1)...(1045): n = A,T,C or G
cgaagagagtggctcgcacatctgattctccaaccgcnngngcccgggctagtggtgacacgagcccccccccccttgncgccgcgtagacgctcgcgctcctccggtggttgttcgactggaccgacttttacataatcgggggaggggggggcgttctataacaccccactcatatgagtgaccaatgtattattgtgttttataaccacccccccccccagaagcccccggcggatctcacatgaatgcctctccgccgtcttcttattaaaagttgtctcatagacaaaggatgttacccccacgtcgcgctcttctctcgtggagtggtgcgtgacgacaacgtgtgattcaatggcagagacaggtagagttcattacacccgatagggacggccggatccacacatatcgcacgccggctagaactatactatctctacatagcttgtgtcagtcagttttcgagagtcgacgtatgttcgaccgcccaggtgaatagcccaccttttgatatgcatatattttccaaaccctatataatagagcgtttgccgtattcgtcgagcctaagtcaattccacatccgtaccagctgaggcttgcattatgaatttgttaacgttttgtcaccatgtaattattaacagagaaacagcacatcatgaataaccgtacaaatagttttattctatttgcctccccgttacccctactacgaacgtactaataatctcttcaccactatattatacatttatcctaaatcgtgtcaatgctgccccaaagggcctttacaaaagatcccgagcttccgcacacagttttaatcgcacacaaaggagtggccgcaatgagcatactaccatatactaatccccctatcattctcctcgatgatttgagcggtgccagggtgattaatgaagcaggtaggacagagcctactcgccagaaggagagtagtgcgagtgtcgaaaatatgatagagaagtaggagacgccacagcgaaatactataatatttgaagacatttatata

SEQ ID NO: 6436 - DNA, 1454 bp, Homo sapiens
  misc_feature (1)...(1454): n = A,T,C or G
gcatatatcaccaatatatccacgcactccattgatcaataaacaccccagaacgcgagataagggctccgctcgggaggtacaacaccgcctcgngaaacatttttccctctattcgtatcaccctccggggcgatatacgtcagaaagaccggtgcgctaatatcccacacggcgttttttctccttggccctcgactgtgccgcaatccactacattatgaagagcgttagtatcttccgccaccaccttgtgattgtgctttaacacgagcacctactaacctctgataccgcgatatagacgcggcgacctggaatatgtaccctctataatattattataccccacctcgttatacgacgacgcgtttgtgtcatcggagggacatcccgtggtgtccgaggaccacatagactctccaagtaggaaggtactcgagattagtcgttacctcgtgggttgtagcgacaccagcgagctagcatagctccccgtagtattatgagaccgtcgttattcggaacacgggcaacactacactgttgagacctgcgactctatactgaggggagcatatacggatcgtagagaaanactataatatatattgttccaaccacacagaggctgaggtcgctcgttgagttgtgtgtcttacctaataacaacacaccgatcacgctgagccgtaaattgatatgtaggatgagaagacattgctctacctacgtcggtggttactcgtctccgctcagccggccggtattgactnaacatttaagcgtcgtgtgtgtgggagagcgctcttgttgttcatccgtatcacaccacatcgcacactctacacgacgtatacctggcacgacgcagatcgacatatgtagagtgtggacggcgagcatatggagcgcatcgaccatatgatagggtgaagtgatctcgtagccgtatntgctcgacagattcgtgcactgatgtcacacaatatcctaatggtggagcagcggtgtatgctgcgcgctacagccactcaccgtgaggcacagtagtcctctagtgagagcattcgtaggcagatcgaacgcgctgtgtggcgccgacgtcatgagccgntgtgactatcttcacatnaagagtagtctatcgctacctagcgcagatgtngctagcggaggccgcgtgcgcggtggttgcggcacgagtgtagatgatgcgacatgntatgatgatgatagttatacgcgagctacgcaacacgcgagacaataagtnctgacgcccgccagtcacgcaataatgttgcgcgtatgcgccgactctcctcgcaagcggtacgacctagntgttacctccaccccgcacctcgagcgttttgcgacgtcgctcgcaatttggattacgcgacacccgttcatatccgtcacgtttgtgttgccatactccactcacg

SEQ ID NO: 6437 - DNA, 868 bp, Homo sapiens
  misc_feature (1)...(868): n = A,T,C or G
tcacanttaaataacgcaggtcagtgcgtccgacaccacaaaaccngaacctaaacgggcggggcctttttttatttaaccacccgtacgaggggctgacctccccggcgggttgaaaaaaaccccaaccgggggggggtttttcatttgtggcccccaggggtttatgtgaacccccagaaacccccccctcccggggtcccaatttttataaaaaaaaacccccccccccgaaaggggcggccccccaaaaaagggcccccaaaaattttattccccccccttcccccccttttaattaattaccgggaaaaacataaacaaagggggggggggnnccnncnnnnnnnnnnnnnnnnnnnnnnnnnggnnnnnnnnnnnncanngaangnnnngggggggggnggnggggggggggggggggngnngggggggggggggnnggggangganggaagagagggggggangaaggaanggacggaggaaagagaagaagagnggaaaaaangggggggggggcgggggggcggggggccggcggaaccgaacgcggggggacggaagacgaggggggaaagcggggagggggcgggggcgcgcgggcggggccgggacaacgggagcgaaagggggacgaggggggggggaacgacgaggagaaaaggggggggaagcgcaaaaaggggggggggggggagcggaaacgggagggggcggacacggaaacggggaggggggaaacgggggagggacagacacggggggagggaacaagggcgggggggggaaacgggggggcacaggggggcgaggaaaacaaaggacagggggggaaaggggggaacaaaaacgggggggcggaaaa

SEQ ID NO: 6438 - DNA, 391 bp, Homo sapiens
  misc_feature (1)...(391): n = A,T,C or G
cccggcacacgacgcacatctcaccgcggacgaccaccccaaggaaggggagaaaacgcgaccggcgcaaacccacaacaacacggccccaccccgcgcgcaacgccccacaagcagaaccaaggagtcacgccacgcaacagagcgccccacacgggaacagcaaaacagagcagaggaacgcaaaggacacggaaaaacaaagggagcagaaaacacaaacacggcaaaacaaggagaccacccccacatcccaccgacacgggaagccaaacaccgaaaaacggcggcccagtgacagcggcacaaaaaaaaacaaaataagccgaagggggggaagaggggccccccttcgaggtgaccggtatagataagatcaaangnnnaanna

SEQ ID NO: 6439 - DNA, 692 bp, Homo sapiens
  misc_feature (1)...(692): n = A,T,C or G
gtctggggtcctttccccccaggggtggagaaaaaaaattttcttttgacccacccttttttggggggggtttttttcccccaaaatttcccgcgccgggggggtttttggggggcccttttaacaacacactgtgtggggctatgggaaaaacaggaggccttttgtcctctgggcccttgaaaaaaagggggaaatttgtaaaacaccccgggnnnnnnnnatananaanggaagggnnnnaagnaaaaaggaaaaaaagagggaaaggggaaaatgggggggggaaacggaagggggggggacgtgaaaagggggaaagggagaaacaaggggaaaaacaaaaggggggggggaggggggacaggggggggagggggaaaggagggaagaaaacaaggtggaaaaaaagacgggggggggggaggaaaggagaaggaaaaaaagaggggggcaacgggaaacggggaagaatgagaacagggggtgggaaaaagggaaaaacacaggggggggggggggaaaaacatgacaaggaaaaaacaaagggggaagggaagaaaacacgggggaaaagaaaaaaaggggaaaaaaagggggaaaaaacacaaaaggaactgggggaggggggggggggagaaagggagggaaaggggacacagggggaaagggggcgaaaaacaaaacaaggg

SEQ ID NO: 6440 - DNA, 786 bp, Homo sapiens
  misc_feature (1)...(786): n = A,T,C or G
accacaaagtcgaaccttaacgtgggggacttttttttttaaccccccctcccgggaaaaaaggggggcccccccccctttttcttttttgaggggggcttaaaccacctttctatgtcggggcttttaaggagaaaaaatttttctttttctttaaaggggggggggggggaagggtgtggaccaaaaattttttcttccatttttttaaaaggcaagggggaaaaaaaactttcccccccttccccccgtggaaaaagagccgcttctctcgggannnnnnctacctcgacnctacgttatgggnnnnnnnngncatgaagagccgcnannggaagagaggggtgcgtgcccanncgcggggacgagggaatgcgtgcgtgggagaggccaagaggagtttagcgggacaggggcgtgctgcggttacccggtcagggggtggggcgcaaatcatgccgattgtggccggtggtatggctacgtgggggcacatactttaggggggggggggatacaaagggactgggactcctgaggggggggatcggcatctgggaggatccgtaccatgggggacggagaacaaaaaaatagagatggggcccgttggggtgatgaaggtaaaggcctgaccctcggggggctgggtaggaacgcgtgggggggacactaccacaggggggaccacggggtaaagggggggatccgggatggggggatcggggggggccaagagggaggaccggggagggaaggggggacggggaggacacgaagggagga

SEQ ID NO: 6441 - DNA, 1093 bp, Homo sapiens
  misc_feature (1)...(1093): n = A,T,C or G
gcgctacgcgctcaacgcccctcatgcgccgcacaaccgatgcgagcgctggtagggcacgcctcatcgcgagggtcgctcgttgtgttcatatattggttgtttgttgaggtacttgttgcgtctgatcatgctgggactggtggacgacgcggcgacgcgcgcgtcaagttctcgtctcgcatttcactgcgtcgcgctagctgcccgtaggggtgtcgtagtcacgtaggcacataagagatctacgccgcggataaactcgctccatattacatcggccaatcgacgtgcgacgtgatccggcaacacacacaccacttacaaacgcgcatccctcacccgcancncactacacctaagtaaagttaccatagcgtgccccagaccatgtaacatatatcttgttgccgcgagggnataggctggtcggtccgtgancactgttacacatcgcgtggcatagggctacgttctcttacactacttctcttntctctctcgtatatcacaacaagcacctactgtgtcgtccagacggacaccggcgcacccctcctctggggcatagcgccagctgggacaaccctcatcaatgctggcgggtcttgctgtcgttgcgccacgctgactccgtcgcgcctgagactgttaactgaaaaaaaccgaaccgcggctccctttcttgacgcccgctactcctttctccagtcttcccaccggccgccgccggggcctgacgcgataatcggacgtagccaggacaacacatgatgagaaagtccctatagaatacaaaaaggacatatccactacacaacgacacacagtgcgcctcggcccgtccctccgttggggccgggcgcggccgtcggccggggggcttcttctgggtctgtggatggccgcttactcccaaggccgtgagagacgagagaagttattaatataattcttataccgccccaccctcgcacggaaagaagttctcagcggaaaacacaccgctatcagtattctattcaagtttagcataacaccctactaaaattaatancaaaatctataaaaaccctccctccatcccctcacc

SEQ ID NO: 6442 - DNA, 1952 bp, Homo sapiens
  misc_feature (1)...(1952): n = A,T,C or G
acgacgctgctctcgctgagtnctctgacgatanatcgcctgtcgtgtagncgcngctancgcagactactgcgtgtcgctacatcgatcgagcgcgagtgtgcagtgccgcgtgttcgcnatgtgcgagagcantnatgtgcgatagtgatagctctctgtgacgcgttgctcactgtcntactgtcggcgcgtacgacacancactcgcactctcgtgacccaaggcgncanctgcgtcgctgtattgactcacatgctactgtgcantcangcagtacgtncgtgtgagcaagcgacggcgccgagtgcataggcgtgatcgtagagtgagancgatgacgctcgcgcgcgngtgcactagctgtcatcatatcagctgntactactccttcacatattctctctctcgtatcactcncngtgctaccgcgtcactatgtagtatgacatcatgactcattagtcatacatcgagtcgtcataccactcatcgctgtcgtcntcagtacagcctgcacctgtatactgcgctgatgcatatacacaagctctctncagacgncncagccgcacactatagatgatggtgcacatctcangcagcgacactagtacatagctagtcnctctgcatgagatctagtactgacgatcgcacatggagcgtgcacgctctcagtagctcgnctacagcactcgtgtgagcgtatgggcgtgctactctgtgtacttctactagtagcngncgagtcaggcgtatgcatctgatcgcgcgangagcgtcnangacgcatnatcgtcgcnctgctactacgcntngncngagtgaccgtctgcgcgctacgcattgantagtatctggtctatcgtacctgacacgctttacgtcagctcttcgcgactgtacacttcgaacgtagcacgttgcaacntgctggtatgtctncgtctgcgcacgntgatcgactntaacgatacatatcacatatagtagtactacacacttnactccacacacactctcgcanacgtntcacggcacgcgtcggcgacatacgtctgngcgatcgnctantctagctggttgcggtctcncgcaataatactatactgccgtgtcgcgctcagataagtcnactgcagnctananagtacacgctagatntctacatncaatagcnagtagacgtcgcgactgacacccatggcatgantctgcgacgcatgcgcatatacgatgagagtgatagacgtcactgatctagtcatcgcgcggtatangctatagatgaancatagaacagctatgtacgnagttatcagtccgcctcagtctctgcatactcgaaccaccacgtcgaaccactatcactgntcgatcgcngatgaatacacgtcactaccgctcatgtctgaccgccgcatgagntgcgacgcggcatgctagtgatgacgtcgtgcgatgacatcgaccgancggcagacaacacctggtgagtatagtgcggcgtgaaatgatagtgagtggcggctgagctggacgccagcaccatctgtctcgacatactgcagacgaataggtctatcacaggtcgtagantngcgngcaactacacactcatgtgccacgactaatcagcngtacggtgntggataatgaagatgantatcgagacgtactgattgacagtactatcacgagtcgtcgaggatgtaaagtgggaggactatacgnaggtcgctatactagnaaacgatatctgcgncactgtcactgctagtatgtgcnggacactcantagtcataacactcgaccgactncggtacgtcatggtcgtgccacatacgaggtgcantagagtgtatgtaggctgtcggtagttgatcgtctataattncgcgtcatgatacgancnctagtacatacgctgaactctccagagcacta

SEQ ID NO: 6443 - DNA, 759 bp, Homo sapiens
tcccacctaaagggctatcgccgccacggcttatgtcacaccaagtcgatatcttatattgtcccaaatttcttatgtaacaacccctttagttgcctgtgttcccggctgagagttaacccctttcacaagagggcttacatttaagacccaatgttttctttgtcccctgaaaccctatctcacccggtacaaaaatttctccgttagtccaacctttttgaggggcctgaatcctaattttccttcccctttaatcccccgccgtttctttttataaacattttctgggggcgcttgattagaaaattacaaccgctaggggcttgtctttttttatttaccggctcgtcaaccttttcaacaccactgggggggtggttaaagagagggggaactgctgcccttgcccctgaagaaaggttgaaatattaatacgtcaattttgttttcgcgcccccacgagtttgggggacaaaagatactctcgggtctaaacagtttatgctttccgaataggaaaatacttacaccacccaggttgccatcacacatacttgttgtgccttcgtataggtcggagaggttctcaatctggacactttagttttccccgctgggcgggttgctgttagacggagaagaggccctgtccgcattattcactattgacgtgcgcccccgtcctttattcgcgccccgcatagattattatatccgtttgctggcgttccttaacctcggagatacacacaactc

SEQ ID NO: 6444 - DNA, 995 bp, Homo sapiens
  misc_feature (1)...(995): n = A,T,C or G
cgcgattgggacggaaagaaaccatttacgcagggtttttttatacggaaaccatttcttggcgcttcccccgggatctttgggcaccccccaaaaaccagtgatttccccccgggggggggggtgtcccctaatttaaggtcaccccaaagatccgcgttaaaccacaaccgtctttgttctttcgtttttgtgggaggtctaaaataacgcgcgggacaacgccccccgcgttctatactttcatgggggagctccaaattttaccatattcacacgcggggggggggtttccacggaaaccggggggatagacgaggaataatttacccgacgaaatctacctctcctcgtcgaggtcaaaatgttagcgcttccctcggagaaagtagccagcgntggtcttgccacagatccagccaagcgacgtcaataaaacagcgttccggtagaaaatagtccgtccccgactacgctcagtatgtgggtcggaaacaggctaagagatattaacaggagtgaacacgccgcttattatattgtaagggcttactccttgggatagagtggcgcggaatttcggttgtgtcgagaaaggatctcgatgaaattccagcgcttctattttgtggcgctacgctctctcatgtggttctaccgattgctacttcggtcgttcgccagcgtcctttcagacaacgcctgatcagttcctttatgggctccccgctacaggtagagtgctgctgtgagatccaatgggaagataggatgtagacagcatactggaggtgggagcagggggtacaggtgagatatgaacgcacggtgcagcgagatgagtataacttaatgcggtgggaggcggacatggtgagcggcgtgcccatggaatgtcgtttgtagacattgaattcacattcattgttaaatagaagtggcgtacgccgtgcttcgacagatgtcagatgaccacgagaaacgtaggaaccagc

SEQ ID NO: 6445 - DNA, 1385 bp, Homo sapiens
  misc_feature (1)...(1385): n = A,T,C or G
tcagcgaagcagaagacaggagagacgaaacgaaacacacaacaacgaacaagacaaggggagcgaggagaagagaagagacgcctanagnaccggagaaaggccgcgcaggcgagggagaagagactcttgtgacgagagagagcgaagagacccgcaaggagacaaaagaagagcacgaacacgacagagacgaccacgcgacgcaccagacgcacaggagagacgaagaacggcaacgacacagagggcgaaagagcagcgggagcgacgaccgaccgccaacgaacaagcgagccagagcgaagacgncgaacacgagcgaagagagacacaagcaagcgagcagcgaagacgcgcacagcgcgaggcacaacgccccgcgaagaaagaangacagaagacagaccgcagagcaagagagagagagagcagagcagggagcgcggacacagnanaaacacgcagagcgaagacgagcgcccacgcacacgaagaagaagacaggagaggagacgcagtagaatcggcgccggcgccgcgcgagaccaagccgaaatacaaaaaagacacgcccacaagaccgagagcgcacaagcagaccagaaaaacggcacgcgcgccgcccagaaaaaacagcgcagaggcaagtaacgcgaggaggaggcaggagcaagcaagaagaagagagaccggccccaacgcgacaggagaaagaaggcgaaaagagaaacaagccggcaagcagacgggacagaagagaccagagagcacagaaaagaagagagcgcagcagagcacgagaacagaacacaagccccgcaaaaagagcaggcgcgacagagaaagagcgaagcagagcagggtgaagagaagagagcaggaagaagagccgcgcgcggacgcgcagaagaaaggagaaaccgaagaacacgagagcgaggaagtcgagacggagacgacagcgaagaaggcagaagcagagagcaggacgcacacgcgcggaacgagatagcaaccacagcgacggatgagcgacgagaacgacaggagagcagacgacgcaagctacggaaagagaagaagacagacaggagaaccacgagcacagccacggggaagcaacggaaagagggcgagagagggacagagacagaaagaagagggcagacacgaaagcacgaggcgaaggcgcgacagcgaggagagggacaacagccgcccaggcgggcaagtcacagcagcccagagngcaggaccacaggacgcgagactcagagacgcgaaaaagggagacgaaggaacgaaggatatagaacgaaggaagaaagaaacacaaacaaantacatccacgcatcacagagaagagaagagaaagaagaag

SEQ ID NO: 6446 - DNA, 153 bp, Homo sapiens
agtatgcaactgatcgaaggaaaaataaccttagagtagatactccacggcatgctaatatggcgtttttaggtcggtgcgaaggtacagcgaaggggggtgtgcgcatcaagggggtcgggcgtccacaggttaaagacggcagtgaagggg

SEQ ID NO: 6447 - DNA, 865 bp, Homo sapiens
  misc_feature (1)...(865): n = A,T,C or G
acgggtttaacctaaaccgcggggggcttttttaattaaacccccgttcaaggggcgggcaccccccggggggggaaaaaaaacaaaaagggggggggggtttccttttgggcccccggggggtgaaaggaatacccggggaagcccccgcgccccccggggtccccattttttttgcgcgaaaaaccccccccccgggggggggggcggcgcgccaaaagggggccccccaacattttttcgcccccccccaccaagccaatataattaatccccccggnnaaccnnnnnnntctgcactggggttttccaacccataaaaaagaagctggtaaattnccaaaaaaaacgagagggggaatttgcaaggacaaaataccatcacaagaagggatgaaataaagaacagaaattgtgggttggttcaagctaagggcagggttttcctggttaattttgtgggagcccggttgggcccgggctgggaaaatcccatttttgtatggagataaaagaattatatggctggggggaagagggagccaaaaggggcgtaatgcctgggggggaaataccatgaggggccttggggggtagggaaaataaaaagtattccagaagatgttcgcgtggggaggcaagaaaagggcgtcccaggttttttttgatgaggggggagcggagagggtattggaagggtgaaagaagggaccaagggggggtgcgcggcggccccccgagttaagtgtggggaagggtgggccgaggggggtgacaggggggaaagcccgggggggcgggggggggaggaaaacaaaaacgcgggggggggcccccgtgagggggggaacccggacgcggcggg

SEQ ID NO: 6448 - DNA, 316 bp, Homo sapiens
  misc_feature (1)...(316): n = A,T,C or G
ccccgtccggggcgtctaaaaaattcctttgtgaactcctatccccgccggttttggcctaaaacccctttcccaaattttttccggcgttattttccctttttttttttccccggcgggggaaacaagggaaaaactccccccttttaaagggaggccccctccccccccctctgtttttttttaggtccttttncnnnnnnaacgtcacaaananaacttcagggcacctcattttctgccaccaatctaaagcatgtgctgctntggatgaataaattgtaatagtctcaccttatcctctccatcctattgg

SEQ ID NO: 6449 - DNA, 370 bp, Homo sapiens
aactctttggacctcgtaatcacacccgcgtcataacatgggggggtaagaacttaaataaacatactcgcgctcggttgtgggggatgagaagtattggggggaaggacaacgatacagctgaacggacaagcgacgatataaacgtatacatgactgtagaaaggacggaacgggcaatgcaaaaaaaaatgggaataataagataggcggacgcaaaaaaggaaagcgcgaacggcaatagaaatggcttacggaaacgggcgcacacacacgatctatcccataaccaccggagcctcgcggcgtctgattagcgacacgatgggcataaaaatcacccaacccgaaaggagagattagaacggac

SEQ ID NO: 6450 - DNA, 252 bp, Homo sapiens
tgaagagcattatggcctttacaaactcatttcgagggggctcacactccatctccgtaggtcaatctaacccaaagcatctaaggaggtgactgaaatggtgaatggatggcgaggattactaaaagcggcgtcgggaaaaacggagcccatacacgcgggtaataggtattcctaaagggtcgaattgggacccggccccccctttaaggttgaagggaacgaatagttcatatgcccatataggctatc

SEQ ID NO: 6451 - DNA, 1286 bp, Homo sapiens
  misc_feature (1)...(1286): n = A,T,C or G
ggtatctgtggccgtattgagcgaccatttacccgcatcattaggtacttgtttatgctcgctatggtttcatcgtgcgtagactcgtgttgcgttcaatttgtaagtgtttaatctagtgtggtaaactgattatactgacgaaagtacgtgcgagtgtgagatgtgtatctagcgttttgcctctcgtcattatgacctggtagtgtcatctccggcgcgcaggtgatattgatgagttattttttgtgtttgtgtttgtgagaggaaacgttgaggtgaagattgtttcaanatacatattgggtagttcacttactaagattttgtgttatatattatctcacagtgcttaatctctctccacattaatatatatacatacattttctcacatatcgacccgattatctactctagcgcattcaaccagataaatattatgttacttgacggagggcgggtatttctctgtgtgtactctgttcctctctcgcgtctctccgctgcctttctcntccctttaatatatcaaatatttaatagaaacaccttcttgttgatgtgcttctctgttcttgtctgtggtnccttctgtgtcatctcgtgtctgttcggctactaatcagctacacgtatatggaaatgatctgccgttgatagagtggtgaatggtttgtttctttgccttctggatatttcttctgagccgagataggtcaatataaataaaaaaccccgttcatcacncattttggctttatattccccttgtctaattcgctgtcgttcttgatggctatgttggtctaagattgnacacgtggtgtgagttatacgatttgtaattttaggcgagactaatgaaggtgattgttattataggagttatttgttaatttttgtagtgtcatctatctgttgttgttgggactatcattgggtggagggtggggattgtgtcggtcttcttggtgtgggctggtctcgttggcgggatctccggcgggcctacatccacttcactcttgtactgtgtcgttatgatgcatgtatatagtacacaactcgattagtatgatatattaaaacattctaaatacatacccggaacacctcgttgtgtttctttatcataatgaagagttactatacttatacgatggtatactnnataaataaaactttattattatctnataccaaatatctattnaacttcttntannnncctttctacatattttacatattttatatttttttanatcttacctatctacatt

SEQ ID NO: 6452 - DNA, 1478 bp, Homo sapiens
  misc_feature (1)...(1478): n = A,T,C or G
ataggagtgtaggacgtgtcggagattaaagcaaacccctacgacggatttctacggcgaaccccgggtgaaacatttaccctggatattttttttagggactctttgatagcaccaggctaattcctaggtggtttgaccgagtgcatggttcgtgtcatttctcgcttcaanctcaaggtgcagagggccgccacggcgacgcgncgatggtgngaagataagtgacgtgtgttgtgggagtttgtgaggtatgtanttacgacagtatacagaacaataagaatcaccaggttacatgcgggcgcgttgcgctttgtgtagccaactatcgatgtgaccgggccaccggcttcctaccatatcacgtagctatttgtctcgaaagtggcggtcgccgatctcttcgactacgtgctgcgatctactgatgagacgtattatctatggcatgtggaggctcgataatagctatatcagcacactagacgagctttcgcccaccgctcgagncgacgcatatagtagcgtatgccgctcgtacatcacgagtgagagtctgccgtgtgtagantcgcacatctcngattgcttcatgctcgtctctacatggagacntgtanacgacaattccccgtccgttggacgacacgcgcttcntatccgcggtctcgtcttctaagttctgtatctcggtgcagcggaatggagtcgcgcgcacgtgcagatgtcgccccgctcttagtgatatgacngncgcatcgaggcgcgcacgcagcaacattgtgtggattcggccggcatatcacgaccgctgttncgtatatatnctcacatntctgttctgatagntgtatactagtactctcgtcatctcactgctcagtcttcctagcaggatgatgacgactgatatatgacgacgctggggngtcgttgtgaatctcgcacacgtgtagtgtatcatgtgatgatcgtgtcgtntatacgcgctctctcgtagttcgtcgctangtgcgnagcgagcgtgactgtgtgacttatatgagcgctgtctactantctagatagtatgccacgcntgtcgctgtcgcgcacattacgtagtgcttgcgcgcnacgcgtatgtcgttttgctgctctgctctgcttcgagncagncntgtgccacgctngatacatcgtcgtgttaaggatgagagcgtntatagcgctgacgagagagatcgtgacgacggagatgagangactatctgncgagctctcagctcttangataccgancagcacttgtntagtcacgctcacgtacatnacgcgtcacncagntacgtcagtacgtctcacagcatccgtgtgacacgcgactgtcagctgagctntaggttgcntcgcacgcgactctgaacacacgctatcatcgaccgagtancgtcgctcgacggacaacctaatatatacttgtgagtgctctagag

SEQ ID NO: 6453 - DNA, 316 bp, Homo sapiens
  misc_feature (1)...(316): n = A,T,C or G
tttgnnaaaaaaggcgggaaataaaaggggggggggtttttttattaaccacccccccaggggggggggggtttttagggggcgatttttttttgttgggggacaaagggtttttaaaaaccccccgcgggggagaaaaaaaattttccccccataagggggggggggtaggggggggggggaaaaaaggggggcgtctttttttttaaaaaaacccccttttttttgtggggaaaaaattatcaggagggggctcccccggggggaaattntnnntnaatatcgagcgaacgnnnnnnnnnnnnnnnnnnnnnna

SEQ ID NO: 6454 - DNA, 626 bp, Homo sapiens
aattgcaaattgactgaagagagaacagttgactctcaagaaatacaaagtttgaactgaatgggtcaacttatctcactgactttctctggctgtgcctaccctgagacagctttatcctgataggtctgtcgctgctccccctgagaatgagtaaggttaggggctgtttgtgcggtgattagttgtcaggggatagaagagatagaggttgtagtgattgaatagcgtggctccgcggccatatgcaatacagaggtgtcatcacaggtcgcatggaagttacacgtgactaggaatggcgggttatacgagagaagagtataagatgaatagggtggagcgattaactatgtatattatattatttggcatttactttacccccgccgaccgcctgtcagtcgcagcgtgcgtgcgctctagattattgcccctctaaattctgtgctgacgagaatgacgctcattacgactaatgaagaggcgcggtgataagttatggcgaatgttcagtattccgataccatgagcctccagccatatatgtgtacacgagcgaaatatatctccgagtgcgtataaatagtcacggtattagaaagagagtctattaattaagagat

SEQ ID NO: 6455 - DNA, 546 bp, Homo sapiens
  misc_feature (1)...(546): n = A,T,C or G
ctttttgccaaaaaaaaatggagnactataagggggggggcgttttttataaaaaacacccccccggggcaaaaaaaaaaagggtttttttcaacaaattaaagggggggggggggaggtttttaacaaagaaaggatttttttttttttaaaaataaaaaaaacnaaaaaaatatatntttttttttataaaaaaagaagcnagggggcnccttccttttttttgggggggggagaaaaaaagatttctccttctttntatatttttgcgtgaacgccccganctcctttgtnnntaagagacggtctganannnnannnncanaatnnntttnctggcancgggcatgccanntaccannctgagggatcatggtgtgcaaatantttggccttctttcattcttctacgcgaggaggggctttaattctcttgcgaaggagaatttattgtagttctttgccaggaagagaatgcacttctcttggccatattcataaattaatatggaaaaaggaggcgggggacaataaaataacgtggga

SEQ ID NO: 6456 - DNA, 814 bp, Homo sapiens
aataatgtctatgtggaaaccaagaataatgccacaggttgaaccctctaataaaaaatgacacatgacgatggggcaaggcgtataatagttaaatgtttttcttcgcctaagcgagggaaagttggacctacctccaaaaaacacatgagatttttttttaaatcaatacacttaccaaccgttgtttttgaacgtcaggttatagaaatgggttaagaaaagtttgttccagtatcaagaggttttatttcgcgctttccggatgaaagcttattttattataacaggtggcaactggcaaaaagttgttaaccagcaattctgttatatggacagtggtgcggcttttaaatcctattagacctgtttcagaaattctcacttttgttgcttgccgacatcaaaagtaagggaaactcaagatattaagatggctgtatcagttcttaaaatatacagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcaggggcaccca

SEQ ID NO: 6457 - DNA, 1057 bp, Homo sapiens
  misc_feature (1)...(1057): n = A,T,C or G
tatatatatttttagcgtcgcgcttcatcagcggcaaggcaaaacgtgtactgtctagcggtgcgcgggcggggaaatagataaacgtgcttcttgttcctttaacaggtatcaggggcggagctactgttatgagaattcctcagtggaggtgctattagtgtgcttttccatgcggctctatatnccnctccncttccactccnctggcgcgcccgacggccgcctgggcacgttagattgtgggttggcngccacatctctttttccaatcatcatgcaatgctcgccctccctcactccaactattgaattttcgctcccttcgtaattcattataccgaagtcttgtggcgtggtgtcgtgggcaggcatactccgtcacttacagttctcgatcacnggcctcactatcatgacgcgccactgtgcggcgaaattaatcagactgtgcgctactttataccgcttactcgctgccggtgggttacacacatatcgcgtgcgcctcgtcgcgcgtccgggggctcagtctcgggcccgaccccattattgttactcgtagcaggtactcatagtcggtcgactgctgtcgctcgagtgtctcggtgggtcatacgtgggcctcgaaatctgcgcgtcaaatcttggtcaatggaggggtcatttgggttggtagtggataggtgattgggtcgttgcgtttcgcgtggtggcggtgacgatggagtcgctcgaagagctataatgctgtactgctacgtgcctttccgttgtatgtgcggttcatatatcacacatttgattagcggtagggcagcggcctctctctgcgtgcctgcatatttatgctatagctcttgtgttgcccttcaattcacctttgtattgagtggagcgggtgttgtttttgtatccgcccgctcccacgtcagctggggacgtcgatgctagaattttcttagatgttctaggtggtggttagtgttcaattaaaatccgcaacaaaggtctggggttgggattcggatgattgaccggcggtctgtcttgccct

SEQ ID NO: 6458 - DNA, 175 bp, Homo sapiens
tgagactgagctagagttaatctgtggcgacgttctggatgtactggacaaacacctcattccagcagctacaactggcaagtccaaggttttctattatgaaatgtaggttctatactaacaattaacaagtgtacttcaataaatttaaacattctccggaaaaaaaaaaaaa

SEQ ID NO: 6459 - DNA, 1199 bp, Homo sapiens
  misc_feature (1)...(1199): n = A,T,C or G
gttcttactcctccattatcccggatatgtcagagcagttagtagggttatacttgccctccctcgattttctttttacatgaatcgacccgttttggtgatacggccttacgcaagaatgttattgagcgcataccgggctactagccccacatttttatactctatgctctagatctcgcacagatgtctcatgaattaaaggtaaagggagcacaatcgtgtgcatgttctcgtccttacaaatcgtaatcgtgttgttatttatagatttatccatggtgagccttttttaagcttcggacgcaacaccaaaacacaatgcggtgggagtctaaaccaaatttgggtgccaccacttcaaatggtgtcaaatatatttggaactcaccacgcgacatcacccaacatagtgggtaacactaacctgcgataggattacatacaggcttgatttaaaatatatggcgcggaatacaacatttaaaacattggttaaggatgtaatgcgtaatgcggggtctagaaaaataggcacggtgtgagagataatcgagtcgcatgggcacaaaaaaaaggagggggtgggggattgtgtgtacgcggtgnactaacagatatcccagatattacnatgcgctattaaatttctctacacacatccatgtggatattgatgaatcttataagtacatagctgggggcaacacctaatctgcgtaattgctggtggtgaacataacagagcacacgcctctgactaccggaactaataccgaacatgcttgtcgcgtggaccactcnttctgcgcacgatagcgcgaggcgtggcgcaacacnacagcgaggcgctataacatgtgctgcatccgggatatcaaggtgtgataactgtgtgtgtgactccggatcgcactctgatataggaacacagtggtgcgggtgatagttgtgtgtatgcacaaactagaagaacatattnggcggaggagacaagacacaagtctcgaactgggagtgaacatcgagacatgtgcctgactcacagagaccgagccggtagnacatacactgngtagcggntagcactagtcacggggctcgtatgtatgacacacattatagcacacattgagtggcggagangcngatagctagacatcacagagctaacttgtgntgagaatataatatngtag

SEQ ID NO: 6460 - DNA, 1050 bp, Homo sapiens
gttcggtcacccccactatatttcagaatactatcataatagttagtagcgcttgctgaattaccagagtcccactccttttattttttttccatattccttattggactaattaagcgtcaccacatcgtctgttttctgccttgtttgtgccacaacgcagtggcgtctcggtgtgctccatcgcaacattaaatccttcatccgataagtagtgattctatttatttgtcttaacatcactctatccgacctggaaccaatgaacggcggctccctggtctctatttcaccaccactgtcagaatgctcacccccccagcgagtccccaagtggaagtggcccataatcctacaatagatgggtggatgcattgacacctggttctgctgtttcacccctgtggtcccctcggggagaagtgcatggagggggcacaatccttacggttgtttcttaatgttattcccactcacagccacattgctaaaccaacataaacaaggagagagggatcggggtacttaaaaccacaccgcacaatgtaaggggacgtggcatgcggcgccttcagacctggctgggggaaaataatgtacaataaaaactacggcgcgataccaatcgtgggttaataatgaaggggaaaataaaggaacagatggtgcatatatattaacgaaaaagcaacaactacaaggttaagtaatttaactcaacacacggctcgagagggaaccgcagacaacatgggactggtatttaaaataacgaaggatacatttcaattgtgtccatggacatcaaaataatgggggacacaagagaaaagtgaacaaatatggagcaaagacaacggaaccaccccagaccccacacctgggataccgcgcgccacaatgtacatttatcactgactctgtgttcatggagtcaatatcatattacatttgtatggtgaaaacaaaaagggacctgacgaggtgggatttcccccacccgttcacatctgcgtgacaggactccaaactgcaacacaaactttcacc

SEQ ID NO: 6461 - DNA, 457 bp, Homo sapiens
gcggcgtattccatcagtccacccccccgtcgccgttgcggtaaaacattaatattaacagactcgtcgccggactctgccgcatcaacaccacgctctcgcgctcgtatgggttagtactctcctcccgttacgacttagtgtcccgtaaatcgcgactctatagaatgctataataagcttgtatggcgcactatgtctgaatatatcgaattctttccgtagctggcattatttgaaagaaggtttatctgagcctctcgctacttttctttcaaattcgtagcgaatcggtgcgttcggccatttccattctcacattcgatcacgttcataccacactagtcctggatcggggagcaatcaacttaccgcacctgtcccaccactcgcactacagtaccctatttcacattactccgctagtacaacacccaccccagccccataccaaccc

SEQ ID NO: 6462 - DNA, 1718 bp, Homo sapiens
  misc_feature (1)...(1718): n = A,T,C or G
tgctccgtctgtgctcgtctgccccgcgtggcgctcgctgcgctcccnccgtgtcgcnccctcctctcngcgcggccgcttcgccgccgcgctcgctcgnncgccgcgcgcgcgcggccgtcgngtgggtcggnagagcgcgtgcgtcgctgcgtgtgcgcggtcgccgtcgcgtcgctctctctccgtgcggcgcgcgcgcgcggcgcgcgatctctctgcgcacgcgcgctctcgcctctcgtcgcgcgtcgcgtgccgcgntcctgtcgggngcgcgcgtgctgcgcgcccgcggtcgcgggcgcggtcgcggcgcggcgcgcgctgcgcggtcgccggtcgatgcgccgctgcgcgcccancntcgtcccttcgcgctcgcgtcgttcgtcgtcgnggtcgcccacgtgtgttgtnctcncgcgtgtcggcggtctcctcacacgctccgcgtgcccgccgcgccgtgcngaccgtgcgctctctgctgtacanangtgctcgtctcgcctccgcgcgtgacggcnggtggcgtcgccgttggcgtccgtctcacatctcgcgtgnanccancctntntcgcgcgtgtcgtgtgcgtcgcgggtgggcncacgccgcgagcgcgtgcgtcgccgctgcggccgcgccnggcgcgtcgcgggcgcgccgtgctccctcggntctgcgtcgcgcgtgcggcggngccctgccgcggtcgctgngntgctgctccgcgcntctgtctccggtcgtncgcgtctcgtcgtncgtcgtgcgcgcggccgctcgctcgtgtgctcgcgcgcgctgcgggggtcggctcgtgtcgcncgcggcgcgtcgctcgngccggcttgncgcggcgtggnngcccccccgcgctcncgcgcgtcggcgcncgcggggngcggccgcgtcgcgccgcgncccccgtcgcncccctgcgcccgtcntcgctctgcgcgcgcgcgcgccgcgtctctgcgnggcgctgtgctccgcnnctcgcgggctcggcgccggncgtccccgngcncgcgcngnncnctcncgccgcttgctctttcnccgngntntcgtctcgcccgnccgtncncnccctncncgccgctcgccgcgnnnntnctcggntngggccctgcggcgctcgcgcgccgggggcgtngtggtgttgntggtctggccgcgcggtgcgcgccgnggcgcgcgcgtcgcgcgcgncgggcgcgcggggccgcgcgcctcgcggcgcccgctgtgtcgngggcctcgggtcgccgcgcgcgtctgcgtctccgcnnncgccgcttgncggctcgngcgcgccgcgccgctcgnctcnctcggccgggccgcgcccgcggtggttgcgcgcctgggtcgggggcgggcgctcgcgggggggggggcgcgnggnngnccgcgnncccgcnccctcgtgggccgcggcgncgggnncccgcggctcgctcgcgcgncctcgcgngccgcccgcggcgcccggcgncgcgccgccnncgccncgngngntgggcntgnctgttcgccccgcncgctctcttctaaagccttcttcttctntctctttgttcctttcctcctattaagggtcttcttctctcttcttctctctctcccttctcctccccccgcgttgctccctccaccgcccaccnncgcccnccccgtctttctgctttntaccccgtccacag

SEQ ID NO: 6463 - DNA, 578 bp, Homo sapiens
cttttaattctataaaatgtgacagtttgggatatgatataagggtgttatatttaacctcttcactcttgatgttgatgttgtaaaaaatgattgccatgagtgaagccgggatgccaggttaaatctttcactatgagtcaattatctattggactctgtaggactaatagtatagatttagcgagaacggtgagtttagtcggtcataataggatagaagagtattgacttagggagggcggcctggtagcgtggatgattaagtagagcgagaggagctagttggtttgtgtttggaggttggggctgtgctgttggtgtgttaaagtagaggtttgtagaacagttagattatgttggggggggaggagttgggtgatgtgagaaaaattgtgaggaagaggcgtggagtgtttctcggagcttgatcattatacattggccgagagtggtgtgatggcgctgcgaagtgcggtggaaagtgtaaggaggagggagataggtgagatagagccggtgtaggtgtagaggaactgtggacttatgaagtgaagctactattgatgtagctaggg

SEQ ID NO: 6464 - DNA, 741 bp, Homo sapiens
ggcccatatcatatgctacatgccgtcacacccgaggtttgcttccgcccccttatccgacctcccggacggacccttttcaaattacaccccgcacggccctggcccgacaaaatccctggccccccccacaccccgggattcccctaagtagagccccactcccgcgttaaccccccacccaatgcctggactcgctttccccccaagcaaggttgtttccccccgttgcccaggcttgaactcccccgaaccgaagggatccccctggcctggccctgccccacaactgggaatttctttttaaaacgccagttttgagatggtatttgtccactactcacttataggtgagtaagtaggcccagagagattacgacttggggtggaacagagagttttttgttgaggcagttcagatcatgtaattttggataatatgttctttttttccttgagccacatgttccttgaccagcaaatgagtggtccttaacattctagatgtttatattctgcctagctatgacccaactccagagaagtcatgtttaataagtgaatgaccgcagataattcacctgatctacccactagtgctgctatctatgtctacttcagcattgtaaactagaacctatttcagtatcgtaaaataagagccttcgtgcagagggactagtgcctgataattaacctaattgaaacatagtctttgaagaacccactagcaaccaaata

SEQ ID NO: 6465 - DNA, 154 bp, Homo sapiens
  misc_feature (1)...(154): n = A,T,C or G
aantttgaacttaaacggggaggacttttttaaattaaccccgcctcaggggaaaaacccatacataatctccggggggggggcggggcccccccccgggaaaagggcccttctaaaagggggaaaaaacccccaccccttaaaaaaaaaaaaa

SEQ ID NO: 6466 - DNA, 721 bp, Homo sapiens
  misc_feature (1)...(721): n = A,T,C or G
acccccttccaggaaaaaaattttaaagggttttttatgggggggaaacatccccccccccctcccaatttttggggccggggaaaaaaaaccggggccccggaaaataaaggtttttccccccccctcttgggcccaaacacccccggggggggaaagggaaaaacccccccaaaaatttcccccccctttgtagggcccgggggggaggggggaaaaaccaacgtnngncngggcaacatccttccttgggacnnnnnnngnnnatgagacgcggggggggggtgaggggcgcagactcgccgggatccagatactacggctctcataggatcagaaaacacagccccaagcgcaggggttagcgggcctggcacataaatggtgctcaataaatacttgcggaaggaagacaggataaccagccaggtgggaaggaaaaaaatcctaagggatatggccatgagatgcaagggagggacaagggactaaaccgttggggggtggaggggggaaaaagatacggcatacccgaagggctacggggggcggggggacgcgagaaggtgcaggggtggcgcacgcggtggttaggcacctgaggggagaaggggcggggcgggggcgacagaaaggggtccggaaggggggagaggtggggtggcgagaagggccggagcattcgaggggggaggggcgcggtttacggggggggtggccg

SEQ ID NO: 6467 - DNA, 834 bp, Homo sapiens
  misc_feature (1)...(834): n = A,T,C or G
acatcctgagtgaaagtgggccctaatccaatgactggtgttcttacagaagagcagatggaaatacagagaccctcatagaagagaaggccatgtaaaaatggaggcagatgttggtgtgatgcgtacaagcccaggaacaccaaggatgcacgcatccaccatatgcggggaagagtccggcggggcattcatttggcacttggtgcaatgtggatacttgtagatgattctttattgggacatttgaaggaaagaaacacccccacccttaatctcagtaacacggaacatgcgaaaatacatgtactattagtgggaggtgtatcaaaataaacggcgaaatgcaatagttatcatgggtgggcggggagataatgatgtgttgatgacggtctggtatcaagtaggatggagcagccgaccgggggatttgggaagtagcggataatagtgaggtgtaggtgcacgtgtaatgggaatcgggtaggtttgtgttgatcaagaagtgatgaggagaatagttggggatatattggggaaaatggttaacaaatttggatgggttggaatatggggggggtggtggtagtggggggtaatggtggatgaggaggagcgtagagcggtacagttgtgggttgataggtgtttatcttatatggtttcttatatgggttgtggtatggatacctgtaatcaacaacgggtcgcaaagtgggggataaanaacttacagacccaaggatctgtgatctcggacagtatgagtattgggtactaggagtgggggggaggagatgggaagaaaaagaggtaataccaggtgagggg

SEQ ID NO: 6468 - DNA, 866 bp, Homo sapiens
atatcaatttaatacattgaaactctatgtaagttggcaacttccgatataaaaaacgcggaagggaatgtatgatgtgaaaacgatccttgctagtagtgaatgtacttaagcggctgatgtgaagtatgtaacgtaaaactgtatttagataaatacgtctattaaataaatataatatagacagagctggtttggacagaaagaggtacccccattcaaacaagcgacggccgtatgaattatgaatattatagtacacaagcgagacgaaccctttctggtgattcatgaaagaaagataaaaggtagagggtgattccaaccgcaaccagcaccaaaaaagcataactatataacagaaatgtggccacattgttttatacgcccggtcttatgtatcaaacctgagcaaccacacaaaacaacaaggaaatgggcgcagggataaatgtatgttgcaggagtaaggttaaagggtatacctaagcagacaaatgtcgtgtacttattaaaagagagaacaagtgtttttcctttaatgcccaagaaacaagttatcgctcaatctgtgggaaggaatattggcttcctttattggacaaagccaatgcagagcacagtgcatcaccacactcagttatcaagaaaaggccaatattatctaatatacgtgaaaataaaacatgaagatatatggcattattttcctttgtgcacaaaaacaaattttttttccaaagtgcgactgttttactaaagaaaaccaattattatttacctttactcttaaattaaatagagcgggatgggggccgaataaacctaaaataaaaaaattaattattaactaaatccacaatctt

SEQ ID NO: 6469 - DNA, 224 bp, Homo sapiens
  misc_feature (1)...(224): n = A,T,C or G
ggggctttntttaaacaaaaaagggggggaaaattaagcgggggggggggttcctttattataacccccccccccccagaaaaaagggggggggggttttcccccccccaaaagaggggcggacccccccccggggggggtgtttttctttttctaaaaaaagagggttggtgttgtttttaaaaaagggggagcccgccgcggggtgtttaaaaaaaaaaaaa

SEQ ID NO: 6470 - DNA, 929 bp, Homo sapiens
  misc_feature (1)...(929): n = A,T,C or G
tccagacatttttttttttacttacaatacaaggaaaacaaagaaaacaaagaaagaaaaggcagaaagagaaaaaacaaacacacacagggaagcagaccacagaacaaagggaagaccagcccaaaccaaaaaagagcaaaaagaaaaaaaagaaaaaaacaaaagagaaagaccaaagaagagaangaaagacaaaaaaaaaggaagaagacaacaacacaaaagaaagaaaaaaagagaaccgcgagaaaagaaaanaaagcgaagaagaaaaaaaaaacacacaaaaacaagacacagaagaaaaaagagaaaagaaacaangncaaaaaccgcggcggggcggcgcgggcgcggccggcggcggnggcgcccgcggcccgcgggcccggccggcgggccccgcggggcccgcggccccccgcgccgcgggggcgccccgccgccgccgggcgcgggcggggcccgncgccgcccgccggcgcgccggcgcccccgcgcgcgggcccccggggccggggggcggggcccggccgcgcgaaaaagtccccccccccccccccgggcgcggggggggggccggggccggggggggggggcgcggcgggcggggcgcggggngggggggcgcccccangccagnttactcctgtttttttttttttgcagcccagagcagggaaaaccgcagaaaaaagagagagagggaaganagacggaacagaggcaacagaaagaggnngnggngccgagcgcgaccgcgagccgcncgcgccgcggaacgacgcggggnngnnngcgncgncggagccccggaaaaccccgcccccccccccccngacnncnccncncccccccccccnnnnnnnnngaagcccnnttatcgnncngcncagcgncccggaggnntatgttcaaaacncaac

SEQ ID NO: 6471 - DNA, 924 bp, Homo sapiens
  misc_feature (1)...(924): n = A,T,C or G
tctttaaccaacaagcttgaacctttaaccgggggggagctcttttttatttaaccacccccttcagggggttttaaaaagggaaccccccaaaggaagaaatttttaaagggggctttttttgaccttaaacctaaccccttttttggtttgtgccccttctcctttttctcaagagagagggtggggcgcccaccaaaacataataaaatatcctttgggtgtacaccaaaaacaccttttttttttggggggggcgggggggaaaagaattaaaaaaaattttatttttttataccccccccccccccaccctcttttttttaagggnnnnnnnnnccnnnccggacaagggaaanngggnngnnnnnnnnnnnnnctgaggggnngggcnnaaaagggggatgggggannngggnnngggaanggggtatngggaagggggggaaggagggcgcgaccagggatgggaaaggaggcaataaggaggtgggggactgaggtatccatggaccctggtgaaagtaccaaaaaaaacccggtgagtggggaaggggtggtgacggaaacaggaaagggacaatggggagatggtggaagacgggggaaagagctggaaaagggacagaaccgggggggcggatgaaggaaggaaaggaaaaacaacggagaaccgggggggaaggacaaacacaaaaccggggggaaaagggggaaagacagggggggaagggaaaacggaaagaacgaaagggaaggtgggggaaaggaaggtggcggggggagtgggggaaaaaaaaagaagtgggggaatgagggggcaaagaccggaaggaggaaaaagggggggggaacaggggggggggaaaaacaggaaaaaaaggggggggaaagggggaccagggaaaaggggagcggggcaaa

SEQ ID NO: 6472 - DNA, 614 bp, Homo sapiens
  misc_feature (1)...(614): n = A,T,C or G
ancaggaaacccaatgggttccccaaaaccnanaaaaataatcaaaaccnngggggcctngntttgggggtcaaaaaaaaaggtcaaaaanaaaagagggcantggaggggacaaagggatttggcaagtaannaatgccccatantgccttccccagttacccgaagaccacatcagtggttacaatagggtttgtgcaagaatcggggcccatccaagggctgccactgactggttaattaatgtggggaaggccaagttcccatccatcggttactcagtgttttttatttccacaatcacaacgactctacctgccctactcatctttaagatggttataaagataaaaatgggattccagcttgggcaagttttccaagaatgttcaaggcttgttgttggcggctgcctttgcaagcttcatgcaggtgatgagaaggtgcatagggagaactttgaccttcaaggctggatactgacagaaaccttggtctgtccctgtggctgcagctatcactaaggcatgtggtctccacccaaaatgcaattaatcactgagcacgggcgttacctcttcagacttggaataaacggagatcgnaagtntnaa

SEQ ID NO: 6473 - DNA, 169 bp, Homo sapiens
  misc_feature (1)...(169): n = A,T,C or G
gctaagtgggtaagggtctatcccacgccnccgcgggtttcacggccaacaaccgccttaaatgtgattgataacgcttgcgggatacaacaaacggggctcatccagtgattttgcggggcttaggggccaaccccacctaaagggcacccgccgcctgggcttttat

SEQ ID NO: 6474 - DNA, 1292 bp, Homo sapiens
  misc_feature (1)...(1292): n = A,T,C or G
acgagtccgcaagacatgccccagacgaaatccgattgacgccaaaggagaggcttattcgggggaacacaggcccaaaaaaagtttagcgaaaggaacgcacatgnggggatctatacaacaggtaggcatccacccagcggaccttttgttggggcataatcgggctcccaccccgttctatatttggagaacggatttcagacgcatatttgtaaacagacagatcgccgacactcgtaaccctaaatggacacctctttattgaacacacgcgcttccaccggtattagcatccaatgattacaaggagaataaaacggcgtctgcgaaaacaccatagaagcctcacccgagaacgacaaagaagggctcctcatgggggcctccacgatcatcgcctttggggaatgatagacagggggagcctacacccaaggaggaagccgcgggcgaccgagggagtgcgatcaggcgagcccgtgtagtacgtatgtgtaccctctgcgaactggtcgcgcaccagtgggaggtttgaaactcacgcgagagctctcatctgtggggtaagttgagaagagaacagtgtgttgtgttattaccacctcccccttgtattacaaacagtgtatgtggtccaaagagtaaactctctcccagacacaccaatagatcatgttaagcgacgagagactaacctgtttngttcatcaaaatagagaagcagatccacaaagagcgagtagtacgcaacacagagcctcttatcaccccggcacgccccagccacgcatgcacgtgatgagggaccgcggcgcgacagacgatacgacagcaatataagagncacgagagggaggtgagcatcgatgtagtgcatcactagcaatcaaagttgcgcgcgcagtgacangnggcggtacgacaaagagcacaatgaactctgaagtacctaatacgacaacgacgctctctcgacntagatccgtcaagagggtgntatagttagatccantgcagcagttcgacgagaggagacacggacnagagtatgtgttcgccgcaggagtcactgcgaacctcgacagtngatgcgatcacgcagcgctctgtgcgaatcgngaatagtncacatggtttggacgcgtcatgcacgcgctcgactcgccgcttgntgtgcacatcagctaccacaccagcccncgtgagtgcaagaccgcttccgatgtcttatgtgtcgccgagtcaacaagctaccctggcgatatatctactccacaccacacacactg

SEQ ID NO: 6475 - DNA, 1383 bp, Homo sapiens
  misc_feature (1)...(1383): n = A,T,C or G
cgagcgagcgaccggtcgcacgtgtggtcgtgtgatattnattaacgaggcagcgaggtggtcttatccgcgagaacaaaacgcgggtgtaacaagtttcacattgggagagatggccccctcgcgtgacctcttagtgggaatccgtccatatatcgcagtgtgattacaccacgcgcggtgtggcggggtttcntccccgagtctatagaggggtatacccccaaattatctcgtggtgtgtcagcccgcaatcggtggtgttgggtgtctcctcagagcggcgagaaaagggaccgcctcgtcagatatatgaatcagacgcgaggagccaccgagcatatnatactcgtcgtgtaatggataattctgaaactattgatttcgcatatgacgttacgcaccaatacgttcaggctagtcgatcagtgaggaggaggagggcgcaggtngcgtgaatacatactagcgacgagatactgtattggcggaccttcagctttacgaatcccatataatagctgtacacgagaacagcgagctcatatttcacncatcatgatgactcgttagtcgatatataatctctcgaattacatcaaccgtatagatctagatcagccncgatcacgccaccanatctgcgtgtcgaatagcgctcaggataccggagtcgtatggtataaataccattttatgcgtcggttgcggttaccgatataatgatgngtgcggatacagtcggtccgatctagatagttcctgcatgtatgcatacatagcaagagagggagtaacatactctatgagctcagtctctctcacgcagacatgcgcggacaacgcgctactatataatagacgagcagtaggagtgaaatatctacttaagatgtattgcgtaacgcattatgttatagctctatgagtctcgatgctctacggactcatattattagactcatttccgaatctagagcatcactacgcgagagacagcatttaagtagtggtgggatcgtgactattgagtgtatttgatcccaggatagtaacacgggcaggagcgaatagagtcgtgcgtgatactcgttgggnatttgtgatcgtttcaatgttgggctacgtacacttcgacggagttctaatagtaccctgcttatacgcatagattgtctctgagagagttatctagttaagtggagggcggatgtgaaagtcgatgctgactgctgtatatagatgagtctcatatcgtgaacaagtataagactacgagtgtgagcgtcgatacatgtcgaggatgagcagtacggtgatggcaaacgagacacagctcgtaatataggagaacgggcgcaaggctagcanagagtgcagcag

SEQ ID NO: 6476 - DNA, 764 bp, Homo sapiens
  misc_feature (1)...(764): n = A,T,C or G
cactaacctggggggatctttttattaaccccccctccaaaggggggctccttttttttcccgggtggggcgtgaattttggttacccaaaccttttctttcaaggggaaaggaaattttttccctaaccctttttgggtccgggggtttaaagggttccccccccccccccccaaaaaaaaccggggggcctttttcttttaaaaaaaaaaacccttttttacccccccccccttttctccacggnnnnnnncnnaaaattccaactcnnggggnnnnnnnnnncactgannnnnnnggcnangcggggggncaaagggggggggggcagaacatgaggggggcagggtgactgggggcgcggggacgatcggggggagagagacgaatgaggctggacgaagggcaaaagggcggcggatccacaaaaggaggggagaacaacaaggggagaaaaacagaagggggggggggggaggccacgagcaaaggagacaacggaggggggcaaaagggcaagggggaaggaaggaggacagggggggggggaagacggggggaccaaaaggggggggagggaggggacacacaggcaacgggcgagaacaaaggggaagggcaagcacaaaagggggacacgggagacaggggggaggccaagggggagacacacacgacggggagaaaagaggaggggggggggggagaaagggagggaaagggggacaccaagggggaaggggggggggaaaccccaacagggg

SEQ ID NO: 6477 - DNA, 1713 bp, Homo sapiens
  misc_feature (1)...(1713): n = A,T,C or G
agcagaagcgaggcgagggtgaacggagaacgggctggggagggggccaacgaggaacgacagcgctgagagccgaagagaaccaagaccggaaacaagaggctttaacgcgcgcgacgagaaccgtgcgcgagcgcacagcggccgcagcaagacaagcaagaccagggtgtatgcgtttgaggaggtgaggtaccgggaagaccctccggcgcgtcaggcggcgctgaatgagagaaggcgcaccacgcgagacaccgcagacgaacagaacaccagacactaaaaggatacgcacagagagaagacgacggagcgatcgaaggaccaacgaggaagaagagccaggaccggcatgctgcaagagaagatgaatatcacagaagtctgctgcatgcnacggtgtcatagctgacagacgagtcatacatgacataacgcatccagtgctcancaccacacgacaccagcgacttgaaagagacgaataccgaaccagacggtcaaccacgcagtcgcctcgctgcacaccagcctncgcagtccacaactctacaccacgacacacactagacatcaagacggcaccatccaccacacactgtagtgatactcacccggagcacggccgcagcacnagcaaccgagacacgacactacatcgcgcagagagagaggtgactaatcacctcagtcgatcaccagcagagattagcacgagctgactcggcctgagtcacgngcatnctnacgctacatcggacggatcaagcaacgactaatacgagtagacggtgaaancacgaagaagaggactagataagagatctgtacgagacgtgatatatgcangnatgagtcgtacgctagtagaatgagagtagaggtagaacgagacgtgctactaccgcgacgcgactacgccnatcaacttgtgcagcccgcacatcaagtcagnacgacaganagagcacgtcacagtcgacgcacaagagcntatgagatgatgagagcanctacactctcgtgtctgntcaactgagagnagacgagcacagagacnagtgacacataagacgcgtatagcacgatgggacgcntgagcagacaaagagcagntccngnngagcgcngangaatatacaggaggataacgagcacatggggagagacgtgcaggcgtcgatcgtactggcgagagcgagatacggtgcagactgtatccagtgcacgagcanaatactagaaccaccgacgtacagcaaccggcgtggagtcggactgcgcgcacgagangagtnatatatgaataacanagagtcgacatggacgcaatgtagtagagancgcgcgaaccanacagcacacaacatcngtcacagctcaacangcgcaagacgtnacgnaccnatctcaanctacgctgaggacgcagatcgcgtgagacgnacagcnttgtacatatgtgagtggacgagatcgagatgtagatntcgtagatnnntcantggctacganggcgctgactcagccgagacgaganaacttgtcatctagtatatatancggtgctagatgaagcgagcgccgtccttctactgacagagtcacagtgtatgagtanatctacacaaagcatcganaggagctgatangnagcgaagnagagangcagtgatgcgcgacgacacgcgcgatagacgngnaccggcg

SEQ ID NO: 6478 - DNA, 784 bp, Homo sapiens
  misc_feature (1)...(784): n = A,T,C or G
agcacgtcgactgcccgctcgtcggggggtgggcgccccgctggcgtgggggcctcgctatggagtccaccgtggacgctgtcggaggtcgtcgcgtttcactcggcgcgctggtaggcgtggtggcggtccgcgttgcgccttacttctcgtttctgtgtacttctgagggctcgggggggcgcgtttcttgcctattttccctctctgctctttctgtcgcggtggcgccgcagcggtggccggcgcgggggttttggtgtgcgcgcgctggggtggcgcgcggacgtcgacgccccgcgcccggcccttgccccgtggccccgcggtcgtgtgcgtgccgcctgcaggggcggcgggggccggggcccacagatgagggttggccgcgggatcgaccccgctgtttctccccctctcttttttcatgccacttcgtctgtgtttgctcctgtaagttgttccttcgctgtgtgctgctccggcctccccggggcgcgccctgggacgcggcgaggggctgccgggggtttgatcgtacccctgcgccgctgccctctgccctgccaacgccctctctccctctccccgccctctatctcccccttttccctttctctcttctatacctcgcgagtcctccctgtactgcctccagatgcgtcgtgagactgtgtcgtacggctggccgcaccccgtttntgccttttcatttttcaaagaatttctcccctttctcactacttatggaatctttgcttttttttgaatattattttttttt

SEQ ID NO: 6479 - DNA, 1118 bp, Homo sapiens
  misc_feature (1)...(1118): n = A,T,C or G
ggagtgcgtgctctgccgctcggggtcctatctactgttataacgccgtgctagcatacgcattccctcgcgtccgctaacggcggtttcaaatggacgatgtcagtgcggtcgtgcatctacaccttatacacgtatcctgagccaacacgccctccgacacggtactgcttcgccgcccccactgagacggtgttatcgcgctggaagtgatgcacgtcggacctggattaacctcgtacgggtacatctactcgcgtcactacctcgccatcgagcgcttaagttgaaatattccacaccatcctcactcactctctcatctggaacctctctcatctcgtccgagcttgcgcccgctttcgcattactactatattaatcgtggcacgcgaagagtctggtctcgctgagtcnatgctacgcttccatccctcctgtgtgtgcttcataaaaaatactattctttganccgtccgcgaccattgcgcttatgtggtggtttgtggatgacgtgaagatgagggatgcgcgttacggacgagtacaaaaaatagctcacactcgtcccaatcacggcgggcgccacacgggcgagcgggggtgggatgtggacaggagcggcaaacggaaataaaataaaataattacattctcaactttctcaccgactgtgtatccatacttcatctgtagtgcacattttggtttgctcgtgctggggcagtcggggtctcggtctggcgtcctagcagcgccgtgtgtcaacgggtcgtgtggtgggcttttgagtccgcgcgcctctcgtacattacctgttcctcatcttctttggcttgcccgtgtaatcggcgagccgaggcaggtgattgacggggcgtgataacgtacagaacaatccagcgccaaacgnacctcttctactctgacgccgtcggcgttcgtcccggngtcgactgcgggcggttnccttcgctcccccgaccgcccctggtccccccctccccaaacctcttcttttcttgttcttttttctaaacttccatcattaattcagacgcattgaaaaaatanaaagaagacngcctccctctctctaacctaccttaccctctctc

SEQ ID NO: 6480 - DNA, 778 bp, Homo sapiens
  misc_feature (1)...(778): n = A,T,C or G
aaacttaaacttaacctcggggactctttttatttaacacccccctcgggggttggttacaaacaaataaaaaggtgttttaatttggggggggtttaataaaaccataattttttacttttttagttaaacaaacgcggggagttttaaagatttttctccctttaatggagtgggggttccaaaaaaaaattttttttttttttttttaaaagaaaagggaggggggggttttaggaaatatgaagttttttccttttataaatgggggcctgacaacatancaanaaatnnantgtacacaggaaaanncttgataatgggttgaaaaacgtgnaaagagccaatactccaccaaggagaggagaattgtctgagggagggaggggattctgcattctacttcctgagagaaactttgctctgacttctccattttgtttgctgcctgtctctgaggggccggggcagctttcattaaaacactctcctaccagtatgcgatgggagaggaaatcaaaattttcttctagaccggatgggagttttcaggggagcgaaacccaggcttttgggagaattttccttagccttatgcgggggcggggccaatgaaaggcaaggggagcctggtagaaaatagtggtttccatgagcaaactctatgaggaagagggggtcaagactttacaggggggtagaaaccggccttctccttcggagagggggtttccgcgagcttatatgggacagcggacgttggtgggttttagaagaa

SEQ ID NO: 6481 - DNA, 724 bp, Homo sapiens
ctcggaaatatggtaataaaagtaagaatgtgtgacctcgaagcaaagaggtgtggaaggaagaagcgtaaaatatcaaaacagataatcatagactatcaaaaagaatatagatggatgtttgtagagtgcggcgtcgtgacgaattttaaattttaacgaatgtaattttcaaggagggatgggaatataaactagaggaagagaaagaataaatgtcaaacaaaaagaactgggttgaggagaacgagataactgccatcaaaagttgagaaaagaagcaggatgaatgagtataccaatatgtatatttactatgttaaaggatccagagctagtttccaaaaagaccctcttttccaaaaaagagatagaagctagatctagagttctttcgagacataaatggtaaattctcagtgagaagatgccatgtgttctgtgcattatttatctttagcattatgcgctaaagcagggtacaaatgaaaagtctaatggatctttgttgaatcagttttgatttacaagacaaaatctctatgagtaaagaggctctccaagaactttaacaagggattgaaaaactgcacctgtacattcatgaaatttgttctttcccctagtcatttatattgtaaacatacttacctttgtttggtctctttaagaatgaaaagaaattataagaggtaatataacttgattaaaaatatttttgcaa

SEQ ID NO: 6482 - DNA, 768 bp, Homo sapiens
cataaacccacaaagtcaaagagaacaggggaaaagatagcaacaacaaagcgtaggaacctggaaagcaacggcatgagaagccggggggcttggcagatctgagagacctgaatccctacagacagcaggggggaaagccagaaagccactcagcctcttaccctgcaaaacctctgaagacttagggattggcagcacaagaaatatatgccggagatggaggactcaatatgggtcctggtttcctggggggactccgactgataataatggcatgaggggcaacgtgggataggcgaacaggaagctctgcttttagaaaaattgggaagattcaatgaacgggagttgggtaaaaaaataaatggaatttggtattggggggagcattcgtaaggaggggatagaaaatattaaatccgggaggcgggcgggttgcctttaggggaggtgagataaggatgctgtgataagagagcgggtggggtcagggttatgggtgcggaacggtgtagtcgggtgcggagagggtgagagtggggatacccagaataggggggatagccgcgggggggggagagggcgcgggtagagggatacaaaagagataggggaaggcgcggcgtagaaggagggagaagcagaggatatagatcagtgagggtaagaggagtgagtgatgtagatgcagtgttcgtatgtctgactcgcattatagtgggggttgttgggctccgagctgtggcagtgcggtcgtcgccctgg

SEQ ID NO: 6483 - DNA, 1905 bp, Homo sapiens
  misc_feature (1)...(1905): n = A,T,C or G
tcctgtcacgtcgtctcactatgtatgttgtctgatatgattatagtagcttntagtcatagngatntgtgtgatcgacgacatcagnatgtactgtatgagacagtacgtatgtgatatgcattgagcgtcagcatctcgcatgtggtccggctcactagtatctctacnagcactatcactaacactcnatatacantaccantagcactacatgangacactcgcagattgacatgtgatcactgtncgctgnactatgatcgtgcggcatgtgnatagtgacgcgatacgcgacatagnatcgctacagagaagtgtcatgtcgcgctcgngctctagcacgcagcgcagtacgtantcgatacttgcacatccacngccgcttctgtatancactcactgtatccacgctcgtcatcacatagaccgtatantatctgcatgagcgagctcgtcgtatgatctnatgaatgcgtgcgatacgcgcagcactgcgctcgattggcgactcgcaanacgtctagtacgnacgcacagtgcataactggncgggctccgagtgctacaacactanctattctacnantgtgtatcactaatcgtgtctagtgagtccgctatagcgangagtgcagcatacgtcttcatcagatgntgccngcgctgtcgtagcgacgcacaactgcactctgcgctcgtgcgcncgcgatatgcactcgagcgctatcgacgcacgtgattaaacgatgcgacactactgaattgagcatgctatatcacgcatactacattcacgatagaggctgtntntcactgacagcagtactgantgagatgattagtgagtctacgtnatgactacgacaccacactcgcacacgtctcatgactagctacnagacacgactgagctcacgccagctcctngacatccgactatatgagtctcgtgcgncacacccgcgtctctctcactcatctctgcactgtagcactcatgcgctctacgagagattgtgtagtgtctatgatactatgcgacgtgtgcaagtagcgtangcgcacgtgttcgaatgtcgagtgcagcgctcgacagtcgtagttaacctaacacggacacgtcagtctctcgcgactcacatctgtacgatcgctccatcgtgtctccgagtcacaagtcatgtcgcctagagtactgcgttcacatgatcctacgatatcatcatgctctatgtgcatactacagcaagactctacatacacatcgcagagacatctccttgtaacactctctcatattcatgtctgacacatactgctagccncttcgcctacacgacatctaatatttttactcttntatatcntcncagcttcacaccgcatcgaccggcgatcacgacgtgcgtgtcgctgtcagtgcacgtcgntgcgcgctcatctcatgctctatatcatccataggtcttatctatcacatatcgatcggtcagctcactcgcganctacaccacacctcctacgctgcgattgaacgtatgtcacgacaccagacactcngatatcatcgacgtttgagctatagcaccgtcatacgcgatgacgcgcgtgaatacatgacggatactgagtgagctccgcgtatcatancacaggtacaacactcacagtagacggcatatgcgctcagcgcataaagatagtgtacnagtacatattgcacctgacgacgatgcatactgtgccgcgctattctagtcacgctcatcgtacctcacctcaactcgtntgtcatacgtatatatcgctaacctcttcttcatgtcgcgtgtcatncgtgctgttcgtgtagatcgatcgcatagtcacacagaggtacaatatcactcatacnttaactat

SEQ ID NO: 6484 - DNA, 243 bp, Homo sapiens
  misc_feature (1)...(243): n = A,T,C or G
cgtttaggtcttagtgtagacgccaacggcgctcacgactaactncagcatcatcttcatcatgagaatcatctatttccaaaaaaatggattcatcgaatgaacctttggccaacaactgttcgagaacgatgttaatatcatgcgtgggaatgctacgtttcctagtatttgacatttacagcaatcgagaattactgtattttgtaaatggaaataccactactaaaaagagagagctat

SEQ ID NO: 6485 - DNA, 1255 bp, Homo sapiens
  misc_feature (1)...(1255): n = A,T,C or G
aaacggaancgngaacaaaaagaacacacgaaaaaaaccctgagctgtagcccncaaacggcacgcgctggaggggcanncaacagcgaccgacaggaagcgacaaagagaggagacaccaggctgaccgaaggcggaacgaaagccgagcgcgaaacccgccacggcacacagcgcgcccgcgggcggcccaggcgggaagcaccgcccccgcgagcgccccggcgacagccggggcgacgcccagacgagcacaccggagagaagcggcggcggcgccacaacacagacccgcagggagcgaccgcaaacaacaatttctttctnacaacaaggcggacgagagcgcgcacccacacccacacccgacgccaggcacagagacgcaggggcagcgacgagaccgcacacgaccccgaagggagagaggagaaagaaggaggaggagcgggcgcagagaacgagcacggcccgcataacgcgacacccagcaccaccccgagcgacgcacggagaccgagggaaacccgcacaacccaaaggggcagagcacggggcgcaccacccccaacaccgcgcccgcgggcaccccacaagcacgacgacagggggagaggaggcgacgacgagagacgacgcacgcacgacaccacgtgagacacgccacagccagcatagagagcgaggaacgcaccagccaacgcaactcacancgaacaccaacgaggaaacaagccacacaccgagagagggcaaacgggaaccacagaagagcagccccgacaggagaacacgagacaccgaccaccccgcagcgacgacccccgaagcaaccggcgacaaagccgccacaccgacacgacgcagacagacgagctgcagccgaggcagaagagtgaacccgaagaccacgacgagagacgaaccgaacacgcgcaccgacacgcgccaagcgcgcggcgcgacacagccagaganggagacagcgaggcgacagcgcagcgacgcagcgcgcgccgcgcgacgacacggagaggagcgacagcgagncagaacgccgcaccnacggcacnacgcgaacgacctactcgcgccgcggacacgacgcacgtcaacacgcgcacagacgagccagccangtaacgaacacggaggacagtgcgangagagagcgggacagagangncagagagcgatgaacgagaggncgacagcgaggcagcatacgacagagcggacagacgnggacagacag

SEQ ID NO: 6486 - DNA, 904 bp, Homo sapiens
tcgtgagttacagttttgctctcttgccgagctacagtgcaatggcgcaatcttggctcaccgcaaccttcacctcccgagttcaagcgattctcctcccacaacctcccgagtagctgggattacaggcacccgccaccacgcctggctaattttgtatttttattagagacggggtttctccacgttggtcaggctagtctcgaactcctgacctcaggtgatcctgtctctattggcatcccaaagtgctgggattacaggcgtgataaattgaccatcttataccaggaagccacatgagaagacatcagtaaaactattctggccaactcatgtgttatttatcatatcttcatgattaattgcttttcataatgccccagtctgtcatggccttcgtggcacccggcaaacgcccctgcttacacttcgatcacactagcagcggggttttatctattgaataagacctcctgcctctctccctataattgccctgacacttgtttgatcacgcgcacccctccctctactcctactttgactcatatttcagtcgtacaccaccccctccagccacaccacatgaccaacttgatttacccccaccaccccccctcgccaatccacaaatcacacacacctcggtgctcccctcgacccctagaacgctttttcccataatctccacacttcttcattcttcttgatctcacattcactctaactacactcactcccgatgcctccgccctgcgttctatatcgttccccctcatccctccgcccgtttcctctttacgataaacgatatctcactctccattgcgtttcaaataatctcccctctcctccccctcccaccccctccgcttatccgccggcaacaacttaattcatg

SEQ ID NO: 6487 - DNA, 855 bp, Homo sapiens
  misc_feature (1)...(855): n = A,T,C or G
tcgtagtggacaagacttccctnctgctagggtgacgggcctttctgggattcagtgacttcagagaacctttctgtgttgcttaattcaggagatgcatacaggagctggagtcaaagctggtgagcgatccaggcttatgaagatgctggacagacttgttatttcctgtatgaggactatggacaaatcagtggccagaggtattggagacacaaaccctacctgtgtggattcttggcctctgtcccatatccaatagagataagcctctcccaccacattccatcttgttcaacttgcttgataaaaacagtggcgcacttcgagagaatggactcccattttaaaagaacttctatcgggcaatacacgctctgcacacagcattgactgctcatcaaaaccttccctaacaggacgactcccctgatgtcgcagacttccctgtcgtctccgcttaccatcttggccaacccgcccccactttattccccacttcatatgcctcacatctatccaacgacctctctctccacaacgcctgcctcgatcaaccctcctccgaccgtctccattcccttcccccacagttcttttttttcttatctccccctcatttctaccttctcgctcccccacccatcatgcacagcttagccatctatcaatcactcctccccacaaacctactctccacctcgcgtcctattctcacaccctcctcccctacttcccctgccactccctcttctcccacctccttcctcatcctctgccctccacatacctgctctctcccgctcctccttgcctcaccactttcgcctgccccccccgcccccaaccctaccc

SEQ ID NO: 6488 - DNA, 933 bp, Homo sapiens
tattgttaccatactattgtttacaacacacccccccccttttagggtctacagctcagcaagtgttagcataaacactccggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttgttctgaagaggtgcacaaaatacataccaaagctgaccagttggataatagcaaacatttgtaactctattaatgaggtctttcaacctttcataatttttaaaggtccgaatctttcctaatgattcataccacacttcgatctagattctattttctctctcttataaattgagtgacgaatctagatgtaaattgcgataaacattacattgaaacacctttgcttagctctgacttatggtcattcaccgctcaccaatcaatctttctgctactatctctttaatagacggagaccgctcacagcaaactggctatttttatctgtgctcctctggcgatgccacacttacctctaattcctctatcatttttaacattcctcatcatcacgctctcatcttttctacccccgtcccgctaaaattctattctttcttctgttcttatttctccgcccttactcccctttattttactggttagtttgtatgttatctcattgttcaatttccttactacctacacgcccgtcactaaattctacgtggcctctgcttactccaattttattttatatccatccttggccgccaccatcacctatcatgtattatcaatgcactcccattttcaatattcctattatcaccc

SEQ ID NO: 6489 - DNA, 356 bp, Homo sapiens
cctcagtgggcactcccaagttgactctggttttggcatgtgattgacaacaggacatcagcaagtatgatgcaagcagaggtttgatggtgcagcacactgggatgctccttcctggacccagccacccactgggaaaagcctaagccacgtggagcagctacatagaagagggccggggccacagctacagccagcagctcctgccagccacgtgagagagctaccttgatgttccagcctccagagatctaagagcttccagacatctaccaccccagccacaccacctgagccaatgtcccacagagtcatgggagataataaaaggctgttgttctccaaaaaaaaaaaaa

SEQ ID NO: 6490 - DNA, 1033 bp, Homo sapiens
  misc_feature (1)...(1033): n = A,T,C or G
atattttagtgtaactttcgcatactctaagtgctttgcgagctcgcggcaacacatcatgcacacgtatgcagacaagtagttccttggaggcccccatccaggccagaaggaccaggggcacccagcagctgcccgcccacagctgccgcctcacctcgaacatgatgctcaaagtactctttatggaccaccatttgctgatgcgcagaaaccggtttacttacacggccacacccttttccttctgctgtgttctgacccgttcttcaccccccttgccccatgtaccccacgtttattcgctcttgattaccagcccccccgcgcgcgcgacgcggcggtgttcgctggccgtccgccgcgcctccactgccggctccgacccattcttacctacttctcctctctccggatcctcctcgtatcgtcctctccctcctctatgtccctacgtcagccgactcgtctctccctgccccccgctccttgcccccattaggcttgtactcccctagccgcctcctacatgtacactagagaaattgtagtgcaaggcgtccccccctcctccgaccccctcccctcctcttcccccccgtgcgcctcttcagcccctcttcccgccttggtccctgctccccaccgacagtcgtttttaggcgctccgcgccctcgtttgtcgtggntactgtatttcttgtgccacattacttcgaagactgttgtggagtgccagtgggcagcatccaacgggctaacgggaacagctacccactgtgattctttgagtcgtgccacgcgtacgatcccgttggcgcccgatgtggtggtgtgtattttgctgcgacctgccgtcgcccattcaatgtctagggcgctgatggtgtcttgttatagggatgaacgcacgcctccnctatgccacgactactcgagcggtgcttctccttttatgctgtttccagtgcgcaccgcccgcctctatatgtgtgacgtatatttaagcccgactctcatacagcctagacgc

SEQ ID NO: 6491 - DNA, 1127 bp, Homo sapiens
  misc_feature (1)...(1127): n = A,T,C or G
ggtggggacggctgtgtgcggactgtagatggggtggtgcgggcagctgtccgcgagtctcgctgggatgtgtcgccccccccttcacaagctanctatgttaagtgctgttgtgattgcatgccccgcatccgccacatcgcgtggaacgcaggtcgaggcgacagtggtgcgaccgtagcgccgagacgcgtgacaggctccgccnatatacgtgcggggtccggtaagtttacactgacgaacgaccgggcgtccgttgagagccgtttgattttgccccgcgcgtctccgacatgctgtaacgcgctatgattggcatgcactcctttacgtattcgtatgtggctggcgcagagctacgacgacagcagtctcgtaggcctccgaccgagtttaataaacgcttaagtaccgcgccgactgttattatgattgccacgctctcactactcccctccgcctgatctactagtgtcaaatgtgccactaccgatcattcacgatatcgaaccactagtagcagtcgaccaaccacgtcggcttaagccggtctggacatctcacaatctgtgtcgtccgggagttgaattttgagtcgatctactcagcccgtgactagcgctcattggtgctgtaacgggtcagcgcgcggcgaaccgaatcacatctgcgcacgtacgagcacacagtcactgcgaggtgcgacaccgattaagcaatcgcgtttcttttaatcccgccccagcgcctgctgtacgaggaatgtcgacgctgccacgcgcgaatatcatctcataagaagtagagaggagattagagattaatggcgtggcgaatgatatggtgagtgagacgagtaggaacgtggatcccagctccgtgagtgtgcgatgcccggtcggccagagtaacccgctccacgccgcatagttagtgagaccgccgcgcggattagccgagatctatcgttagatatagtaacgccactcccctctcctcaccgtcgccctacagtacaacgtatccacacgcgcgccccaacactataccttcatgtatcgccgtcaccacgaccaagatttgcgtgtgtgcgttcttatgctctaggggttgggtcgggcgcg

SEQ ID NO: 6492 - DNA, 951 bp, Homo sapiens
  misc_feature (1)...(951): n = A,T,C or G
aggtaatggggtaaacaggcaacccaacacnccttaaggtgcatcggccttanaagttttcaacaataaatatgaatgtcccaaacaatttctctttacaacttgagtgcaatttgacacaacaggatcggtgccatcatgctcatcaccaaagaacactcttaattgagattcctgacaccttacatagtacttttgggtttgaaggaagtttatgttgttctaactacaatggggataattactggaattacctgatcttttaactatcaaactcgaggtctgcacgggcttttatcgaccacacgtcttgcagggaaaggcatccctgcttgtttactgaacacacaatcgccccggacgccatagccttggcggcttgtctgccttcgctacctctccttcccgacccgcacctcctccccataccgatcccgcggaccgcgggcaccgcccgcgcagctctcgccctctttagttttcctcaacgccccgcaggccgggctcggcgcgctgtggtgatcgctgagattcgtcggggccacgcccgcgcccggaccgacacgcacccctctactacgcccactcacccctctacctcatccacaagcccggtatcgaatcccgtgcgtaccactcagcggcgagtgcctcgccgtcctcccccgcgctggccgcgtcgccgtggcgtaagtgtatccgntgttccctatttttttgttagttgccgccgatcccgcagtcgtctgttctgcgcgtcatccccttactatcgacgcgagaggtaaggccctccactcccccgtcctgagctcccgcctcgctcagctggcgttgcgctcgcgcgaattgtccatgtatcgcatctctcagcggcccaccctcttacgagtcgcgggaccccccgccctgctacgagcgtgcggcatgcccggccgacgatcgccgtgg

SEQ ID NO: 6493 - DNA, 1553 bp, Homo sapiens
  misc_feature (1)...(1553): n = A,T,C or G
tagcaagcttagcagaccatccacacggactctcgcgcggaatcggcacgccgataccggttcacttgagtaatggtaccccctcatcttgttccggagacacgagctggagagctgacctgtgtttgttgctctccangtatacttctcattttatctactactatctattggtatgtttatcgactcactcagtgatccctcttctcagttacgtagctacacgcacacatacgtgaccgcattgggttcagacgctcaggtcgagagctagctgtggcgctatatattatatgtcgtgtttatttaccaccccgccggctgacgtccgccgagagcatgatgaccgacgacacacccaagtacccgcctatcgtaacacatgcgtctatcactattcaactctctatttccctgtctcttatctatacctctcatgtattcttagtgatgatcagcgacaataccnagaggaggtgagcacgcgccacgcggctccgtgtttattgttgtgtacgcagatcgtacgcccgcccncgtacggcgaccctactacgcaccnctactcagtggtctctacgaggttctcatcatgcgttcctatcaactcccactctactatatgtacatatatacgtcaggtcattgagtgtgtgtgggcagcgtgacantggggtttgctgaactcgacgtgacgcgtaagtaacaacgccgttaagcgaggtgctattagcgctccgaccgacacgatggagcgaggagcgtttgtatgcgtcagtgtacggttgcgggttcgactgtcgtccacgtgtcggagcgatgagttgagactagatgacgtgcgnctcgacatcgcatactgtgtagctcaagacatataataatagnccatagttacacatgtgcgcgcgaatcggtgtgtcgatgancgcggggagtagtgttntgtgtgaagatagtgagagatacgcgtcgacgcatctgctccacatgctcgacgcctatcatcgcgagtacgactnctatgcactangcagaacagtcgcgcgatcgacggnacgctcacatgtcgtacgatcgatcagatcangcacgatatctagtgcctagtctcnccgcacaccatttctgctctacnaccgtctaacatacaacatactgcagtcanactgtcgtcttatgtcgcgcgttacctcactcgtcgtcagcgtcgacgtagcacncttccgtcgatctnctatntctagttgtcacgacacgtgagtatgtatatcacgctccagtccactcattacangccggtgacatcggactancattagagtcttctcgatctatctatatacagtgtgcactgactcgcacgctgacgcanagctgcagtgttgtccganccttagagtgtgtgtcgtcataacctacgcgatgtgcacgnacgtcacgtgatgaatatagttctatgtgcagggcacccgcgcgcgacgcgtgattgttatgatctcnctacgcgtgctagtagtagcggacgaccgtgatatatgagtacgancgag

SEQ ID NO: 6494 - DNA, 1990 bp, Homo sapiens
  misc_feature (1)...(1990): n = A,T,C or G
agacgatgcaccactacgaggtctcattcgctgacttcgcgttagcgcatctcgcacttctctgctcctactctgctcacgtcgtatacagatcatcttcgctatgtcatctacgcgccacctcacntatatgttatctgagctctcatactcgttggcaatcgttgataatgtgatatcgtaatacctatgtaccacgtgtcatgcccgctcagaagtatccgtgctgtgggcagttgtgacgatcaccgcncncacgagtgtgcacgcagccatcancgcactctattcaatctgtacncgtcatcactgcgcgcgacgtcgtgcgtcgccantgcgnccgacntgatctgctaactattcgctatggtccgtcgacgcgagtgatgcgcttctacgcgaggatcgctgcatgcgngnagcgtcgcgcgctctatntgtcattgtactcacgctcgcctgctcgcacaggtagcgcgcgacgtcntacatgacgcactcacatagaatgctcgcagtcgctgtcaatccgcgatacacgaggntgtatnctcacatcctngcaatctancgactgtaattcgcgtgacatcacatagtcggtcggagacgtcagaatctcacatagcntgcatagccgtnacgactgtcgcgcccagctcctcgagcgngngcgctctcatcgcgcgccggatccgcagctcctgatgtgtcctatatttntctcgcagcnacgcatacgctactgacgagctngnccnactagcgctcacgtantgcacncncagcagtangcgtgtncanctgtataaacgcactcactcgatcgagtgcgangtagtagacccagagctagctcgantgcagtcancgtgcgaatgtgcgcgtantcagtatcaccntgccacgtaactatcatcctcgtcgcggtgtcagtatgctctcgacatcntatcntactgcgttacgtncagtaccgcgcgtctctgcggcgttgactgcgcacgtccgangctgcatncgcgcagcgcgacctgatagngtatcgattgtgtatcagagcaagccatcgcagaagtgtncgtctctcagagcatcatcgtgctcangtgcagtctagnctgtcgtcatcgtacgcatcgtctactgagcgactgttcacaccgntacgctctcntagcgtnagtgagatcgntnantancgtgtantngatactgagantagatcgtcacgtagatgatgctgantcgttgcacgtagctctgcatctacgtntctcatgctcntctcntaggctgtctacacacntcctccgaaagcgcagacatcaagngagtagtgtatatgattntgttctncttgntagattnagcgcatntgncgacgtcttctctngacgcgcttctcgcgttcgatgcagctatctanagcagtacagagagtgatgantgtgaggagagtgagatgctgnnggcacatgtgaagcgctagtgtcgctgtgtntcggcagnagccgcggtacgcgtgccagacacganactagcgtgctaagcacagtagctcggacggatangtacgctcgcgagtgatagccgacgctgtgtcatngngctcgcgtacangctagagncgncacactagtgtcgctcagctgtagtcgncgcacantgaggctctcnangcactagtgagtgtattcacgcttgattctcacacanctcgagtcacgtgtacactctgcgtctacgtcctccgagttatgncgnanantcgagtgtgctgagcatacggtatctcgtaagtctacgcgtagtgttggacgccataacgcacgatatcncgagactatacgtctacagcgattacgatcacacnatacttctttcatattctatcctctgtcaccagctgcgctcgcgctacgcttctncagtctctcgcactcgacaacagactcgactagatctcgtagctctgtcgcacgtaact

SEQ ID NO: 6495 - DNA, 1620 bp, Homo sapiens
  misc_feature (1)...(1620): n = A,T,C or G
gcggcgctgtcagtcgacagtccgtcgacactgtccgtgatcgtgctacgcactcagtatgagagcgcgcagcgcgcgtcagtaagagctgatcaatatctgatacttcgtatcnctaacccacacacgtantgtctatatgacatgcaatatagatgagaagagagacgatagtgctgttgctgtacagctcggncnggtccgcgactcgcagagcgatctgatcacgtctctgtgcagcgncatgcncgtgctattcgtagccgcctcgcagcgcgttgcgtggatcgcttgttatcagagcatcactacctgcatctctgtatgcctntcggcgtcgcactcgacttcacacgtatcacgccancaaacactagtacacacgngaacaactcgctgcgctccatgtacgatatgtagtgtccgacgttttctaattaagtcgcacgcacgcaccnaccgacctcactgtaacgcgtgagtgcacccacacctatacccgctcgntactcctcatctcatctacacttcgcaaggacgttgatcgcacgcgctccgcgagagctacgggagtgcatagcgtatgaaggcataggcaagnattaaggctacgcggctgcagatccgcacacacaccggcctcatgctctatcgaagcctcctcaatgattgatattaaggtgagcgctgatatacggagcatgtctcggatcgcggagcatcagcatagacaggtgtggtgcgtatcgttatcacactacaatactagtcgttctgaacactcgcatccgtgtctctgacgccgtgtttcgttacactgcgccactgcgtaagtgcgcatcataggacgactgcgtgaccgtcatgctactgcgagacagcagagacccgcgtatatanagtgtattattatgtcacatacgctcaggtgttaagagtagagcacggctgtggatgacgtcatatatgattagctcgagacgtgcagacgacatgcagatgatcgaccctgacgagagcgcgcgaggtctgcgcggcggagtaatcgcacctcgacacgacactcttgtggagctcggaaccactcgccggccgcgctatccgttctatcaaccacccacgcgctagctcccccatccgtcttccgtgtgctcgcagctcatgctcctacgtcgaaggtcacaacaacngagcagcggagagcacgatatatagacagacgagcggagtgtctacgcggcacactcgaacagaagcgtatgtgcatgagacgcgcagtatgtaatagtcctagcagacggccgtgcggattcgttgacgcgagcgtatcggcaccacacattatatttcattatagtgantaccgtgcgcgcgcgatactgagatactgtatcagacctatagcatagactngctgctatatggtctaactgacatctagagangttacatacatcgcttcgagagacacctcatcatatgaagtctnacatcagcatcgctacgctatcctacagtatttgtactcactgcacttcactcgcacagcggcagtaatgttgagtagtatgatgtatggtatctgtgacgcgccantacatagttcaacatctgcacatc

SEQ ID NO: 6496 - DNA, 540 bp, Homo sapiens
  misc_feature (1)...(540): n = A,T,C or G
acccatcatcagctcaccggggctcttcattgttattgtatgaccagctatgcgtagatgtgtagtgtcgcgtagtgaancagatgcttcctcagatacctctcgtactaatacacagaggaggtcacggtatggttataatacgcacggacacgtcaccccacaacgacgctgtcgtggtctttgcacctgtctcaacgtcggtcggtcacgagcgtcagcctcagacaaatcctcaatgctactctatgtcatatcacgtctctatctcgttactccattcgtcttctantactacgaagttcaatactcatgtacactctagtaaatatattaatttcatgaatatgattatttgctaatatagagaatgttcttctgcgtcggcgccgctgcatagtaaagacacatcccctgtcgacaataggattttacgatccaccctcctgtgcatgggatgactaatgagagggacggctgcgaaacagccaacgtggaagaagtaacaatcaactgcacagctggcacgcgagtctgccg

SEQ ID NO: 6497 - DNA, 661 bp, Homo sapiens
  misc_feature (1)...(661): n = A,T,C or G
acgtcggtcgcgcgaacgtcacagcgcgagncacagcaggaccacgcgcgctctcctcttcaccgtagtgccacgcgtcatgaagacccctacgcggtgtgcagcgttatgcagtctctgcacagcgcgncgctacagccccacaaatatacttactcacctgcagccgccgagacgcgcccnactcagcgtcgagatagagtgggtgcaaagtgatgagggcgacaggcagcgtgatgcgagttaccgcggcgtaagcgatacgcaacggaggctcgatgcgagcgagagaccaacataggactcagctaggnaacatgctcgcctatacgttcgacgtngccatgcactgctccgcggctcgtgtgtacgtctctatctatagcgagtgagctcgcatcactactgtatncgtccgctgcgtcgccgctcagttntcatcactcgctnctcatganacgagcgagcgcgacgtgcagcgcgatcatggcgcnaagtgtgcgcagaacagcgcgcgatgtgaacgaccgcantccaccgccngactagagagagagagtgtcaacgaatagtgtacacagatgtcatacctcgcaaccgagctgtgtatgacgcaggagccagaggagatcagtatagacatcatgattagtagttncca

SEQ ID NO: 6498 - DNA, 691 bp, Homo sapiens
  misc_feature (1)...(691): n = A,T,C or G
tatagatgtctaacacacgacgtcttagcagtcgacagtcgcgctcagcccacacgtgtctgacggtttggtacatcgtatatcgctgatcacgaacactactcgtacatcctgtcgcgtcatgtgcngagctgtaggcacgcgcgacaggtaccgcgtagtggagtgagtgtatgcncgtacatcntcgtattaagacagccgtaatacatgtacgcagtagaacagtatgtatantncagcgacgaggcgacctactctgctagtagacgcgtcgcaccagcataagcgcgtcgctgactgagccgagtgacgtcacgtcgtgacatatcacaccacacactccacgacaccactggctcgtgcgccgagagtgcgcacgtatagacgcgtatgctgcacgatnacacgacatcgtagtacagcaccgatgtgatctctatgacccatatcagccgcagtcactctctcccataccacgagcactgacgngctctagtcattgctcatgtgcgccgtctgtgngactgaacgcgtcgccgcgtacgcgagtctcgcgctcacatcgtacnacgcgcacatgtcagcacatgcgcatcaaactacatgatacatggagtcatggtactgctgtagtactcgattcagctgtnatagctacacacagcacctcgaattgacgagtgtatgt

SEQ ID NO: 6499 - DNA, 398 bp, Homo sapiens
attgaccatggctattctttactatcacccccgacttctgcggtgttcgggggcggaacaacggatcgtaaaaagatcactgagagtgaacacagtatcgacgaaatacgtcatgcaacaaagatatcaaataaaacacacctcgggtaacgcgcggagaggggacaccgggactccctaaacagccctttgtggacgtgtggctcacgacttcagtggaactcgctacagtgcacttcaattaattaccgaggtccccaccagagagaaggagtgttcttacctcaccccgtaagcacggttgtatacggcagggtgattattggatcaatataaaatttgcactgacgcgctgcacaacaacttactacacgtcttacgccggccagtgaacgcga

SEQ ID NO: 6500 - DNA, 899 bp, Homo sapiens
  misc_feature (1)...(899): n = A,T,C or G
tcgagatgtagatccaaanaaaaaaaaaaaaaaagctgctccggacgcccgattacttgcgcgtttcccctgattgtggggagttcctgctccccaattaatattctacctttggccctgagtttgtggatacaaattgcccctctttaaagagagggtatttctcaaattatggtgaagtcgcttcctccatttatagagggtggaattcactcaatttctggggtcccacctcgccccttttgatcgggggggaccccttttatgaaggggggcagggccccccaaactttttcggtttttatcccccaataatttaaatatgtggaacaccctcccatcggagggggaaacatttaaacccttaaggatcgggggtctcacttttacatgtgggtccccgcccccaaaaaaagggggccccttcccccccttttagaggggcctttttctccaaaaatttgtgagtggtttaacccccaatttttttttttaccccacggaaaaaacctagtgctcctgagaaaaaactggttactgtaaaccaaatactttttttcccctctcaaactgtggtcgtgtgcgtagatataacccccaccaccctagcggaggtttttgttaactataaagggaagtttttttttttcccaccaaatacacgcaaattagagtcgcactccacaaaatacacttatctctttcatccgtggcaaaaaactccggtgacacttcatctttaaagagtccttatcttacagtaaaactagtcgactccgccccccgccgaggggtggcgcagccccactatttgccttttatagtgatggtgcttccctctcttcaggtcgacggattaataagactcgctctcttaaacccctgtgtgttggtaccca

SEQ ID NO: 6501 - DNA, 1600 bp, Homo sapiens
  misc_feature (1)...(1600): n = A,T,C or G
aaaannnnnnnttttnnnnnnnttttnttatgtgaggtatgtnnntnnnnngnggannnagangtggagantannnataaataactaannatatgnnntttgttctccnntcntcnttcttcatcgaacctgtcncagtagcgacgtctgtgacgcgagggcacgccgaggcgcaccatcggcgtgcttgtctctctctcgtctnctccttgngctgctaaataaaggaaccgcgaggacggtgtatggtaggctgcgcgaacgagtgcgacgaggaacgtcacgtacccaccacgtcgctgtgtntcnctctaccataantgtaacgtaacgtgacatgtgcatctaggccgtgattggacgagtggttggcgcggacgtccagatgtgtatcttcccncgcntcgtacgcggacgatgagctcagctagtaggtcagctatttgtgtgcgtctaggagggacccacgctagcgaggagaggcggtgaccgccacactcactactctgagagtacagaccagccgcccacgcggcgcgtccttagttaaattatggacgactgaaggtggtgtggctctccagcgacgtgtctctttatctcaggcaggcggaccgtctcgtcgagcttctgtgtagacgtctgcgtgaggttagcccnatcgatagccagntccgcagacagcncntaggcgtacgtataatatgaagtgaccaaancaaagatagacgccagatagggatgtntgccntcgctaagacacgagcagacgctcacgcgcgnaagccgtgttattggccggtcgagtcagagacacgccgacagcntgaagcagtcatactanancncnacagcgatctgatgatactactatgttagctgncatggcacttcgcagttgcgataagaactgtcgacagagagtgatgcggatcgagatcgaggcgtcgcttgcgtcagtgccacgcggcgatactctatgtctgcgcgctcgtgaacgatatcagcgagcgagctgaacgagcgtgagtacagtgatatctactgcggcgctgactagagtgcgtgacgacatgtcgctaagtcgcgagataccatcaccacncgcgctcctcgcccgacgagcacttcactgcacatctcttcggtcgcggcgaggcgactccagccctctcctgtcatctcgtttctncttgtaccgtgttaccctttacatcgcacgccgaaacacnttnnacggtcgttatgagcgcgcgcggacgcaaagtcgcgtccggcatatagagacatagactcnaaagagagagctagacggaagtcgcggtgagtggaaatatatcgcgacagcgctganacaccnacccgcagaagacagatatagagtcgagtccgtataggggcgacacatagcgactggacagagcggctgcactactgcgcgggtgttctggagaggtcgagtggtcgagatggtatccgttccggcgggagttgaccgcacgcgatgggtataggagtcaatgtctgctcacacatatggaacgggggaggttngtaacgggcgaaggcgaaggtagacgacgcgcaaaggagagtatag

SEQ ID NO: 6502 - DNA, 215 bp, Homo sapiens
  misc_feature (1)...(215): n = A,T,C or G
tctaaccaaacaaanttnaaactaaagggggggaccttttttaatataaccccccttccggggaggaaaaacaaacctctcccagggggccctccttcccccgggaaaaatttttccgggggggggaacttttgccatttttttttttgaaaaaaaaaaaaccttcaaaaataaccccgggtccctttttaatgggcggaagaaaaaaaaaaaaa

SEQ ID NO: 6503 - DNA, 1425 bp, Homo sapiens
  misc_feature (1)...(1425): n = A,T,C or G
gcgggcagagagatagtatgtaaaattctcataaagaagaaagaaaagaaaagagggccatccgttgtgtaccagngacacaccccctacgctttgtcagacgagagataccnagggaagcctcgatatagaccccataaggagagacacacgcagcagcggagagaagcgacaagacagcacacacgagaggagtcacgaaggcggaacgcagagacaacgaaaaacagaagagacagagcacaggcgcgatcgacagtaacgacaangacagaaacacggaagaccacgagagacaaagcaacacacagagagcaaaagaaactatcaacgaacacgtaccgagatagtaggacgagagtgacacgaacaactatgggtntcatgacagagcatggaggtaggacggacggagcagtgcacgacgaatattatgttttgagaaagcatagggtatgaagagaagtcacagacgacatagantatacgcagntgcataggagtagaacgaggcagacgaatgcatttacacttgacactgtaggaagattagtgaagagcaggaaggcaggacttgtgaggaagtacgtagtagaaaggagaagagacgaacacgagaaagacacatggacaacgtagagtagacataatacatgaangnagcagcagcggaganagaggacacgatgacggaggacggcgtatgagtgagtggngtgaggagggatgtgtgaggcgacacgcaagatgacagtatatagcaggcatagtagcgacgataatacgcgcgaagaagcacgacgctaactacaagagtatcgacagncatatgagacgttgttgcatgttggcgtgagacacagagaatcaagtgtagagcaagtaggagtcaggcatgaggagatagctagatatgatggtacacatgatgcaccgaggaacggtgaatcgagagcacgtagaggtcgaatcagatcagggctgcacagaacaagagcaatgaggcgcgatcacgagaacacgagcaagcactgacttcgcagtcagacgcatcaacacaatgatgatgtaatgaggttatattgtctcctgacaagtcacgaagatacgaaccgcaatacgntcagtcacatcgcaacagtnacggatcatgaggacgaaacagaagagatcgaagacagtggatagacatgagatgaagtctagagactgtagagttagtacatatatggatagtagcgtgtgctaatcgatgcaacgcggagtcaaatcagagtagnagaagagaatggagtgcgcgtacgtatatatatataaacgagagacatatgataagagagaatgacaagtcaaataagcggtcaccggagaggcgcagaagagtaggagaatggcgcgacgcagaacgaangagcagtaggagtg

SEQ ID NO: 6504 - DNA, 955 bp, Homo sapiens
caacaaacaactcaaacacccaaagcgggggggaggagaaacttatggggaaccaccgaggcctatacactgaaccgctcgcgcaacacagctaccgaccaccactagtctttcgagcgctggtgtgacttacacttataccggatgcggactttccaatttattgcgaaaccatgacttttataactgaaaatgctatgaggccactgtgtcctatacgggtaagtgcaggcataggctcaaggcgggtaataagtggatcttataaccccagggtctctcgcataaaattatggcgcccggtcaaaccttgtgacagatgggactcacaccaagtatcgccataataatttctattgaatcccgtccgcgtggcgaaacgggtaaacttgacttccaccccaaacatggaccgaccctctcaccgcacggcgtaacagggaaaataaactactcgtccaactggtgatcttctcagtataataccctagccgggggggaaaaaaaaagggcggaaaagaaaaaaaaagcaaggaacaatatcgacaaaaggtgtgtggaaaaaaaaacgcacaggcggcaaacgggaaaaactggaacccaacccaaggcggtgataaaaagaacagatggggtaaggtaaatgaaaaaagcatatttacacggggagacactaatgggggaaacaaaaaaaaacttggggggggaggggaagaagcaagggtacacaaaaaccacacacacaatggggaaaagaaaaggaaaaacagggaaaaacaaacacggggatgtgggacaacaaaggataaatgagtggaacggggggacatcaacaaaaatacacgtgaagatgggctacacaatccaccgtaccgagccatgtggagcgcaaatgtagagacacggaatacacaagaatagagaatataagcataggaacaacaacacgtaagac

SEQ ID NO: 6505 - DNA, 1444 bp, Homo sapiens
  misc_feature (1)...(1444): n = A,T,C or G
gctattgcgtgcgtcacgctacaggcttctagtctcacttctcgcnantccgcgctcacgcccttcgcagactgcgccacacgtcacgtggcgctccacactatcgtgatctgacatgtgntacatagttatcgatggtagtgcgataagcgtagtgctgnttattagcgaggatgacgagagcgtagcaggcgcgacgccgatggtggtactgtggctgtcgtgtagcctgtcgcgcgtatncacgcgcgtgtatnacgagagcgagctagtcagtgtgttggatgcgtcgatgtggcgagtactagtggcgtgcgtcatcaacgcgtgagcacatccgcgccgcgcgtgcgtgtctattcttacgntaagttctctgtctgcgcagtggtgctctctgtacggtcattgatctgttgcctgtcaccaagatcatatctcatcaggttctgctcgctcctgncgggttcttcatagtacgtagatgtatgatataatcgtattgtctcagtgngagtgtcgtgcgananggtgntgcgactttgaagctacttaganaaacacaggatagagtagtgagagcatggtcatcttagatgcgtactggtgatgcgcgcctcgtaaacggtcgcacggcgacgccgcacgcgcgngcactatgctatctttgagtgacgagcatacgacactctccgttgacggcaatctcctcagagctccgctcgtgcgcgggcgggtgggggcggtgtggagctgtgcggacagtgagtcgaggtgatccgcgtcgcggcgagcgcgngcgggacgtcttggcgggacctgctctatgtctccctgcgctacgcgccgccggtcggccaacaacaaaacgcccactagtctctggaccgtgcgttacgatctgccagattaaatacattaggggtaacaatcttgatgagggatggtgggcagggtgatgggatgtcgggtgagatcttttaaagggtggggcttgttaggcggatgggatgatgtatgccgtagagaggcgaagtgtgggggtgggtcgtgggggcgtggcgctcgtgtgtcgggtgtggctcgccggtgagcgcggtggtgggcgngggcgcgcggggtcctccgtgttgacgtagatgangcggccgcgcagtgtactcaggatgttgancttgggctgagccgcncgccacctgtacacctaacatcatcagtcgcgtgggtccgggctcagcggcgtggtggacgggagaaggcgagaaagtggttngctgatgcttgctttagaaaatcacatgtcgtcagccctctgggtncatcctccccagtngaaggtcttctntctgctctaccttctatgttgtagttcgaactancgcctgtncttcatgcacagaccatactatcatantactacnctctttnatnncnacttggacta

SEQ ID NO: 6506 - DNA, 202 bp, Homo sapiens
agggggggatttctttaataaaccccccgggagggttttttttttcaaggggtgcaaaaggggaagaaacctttttttttttttcaaaatagaaagaaatttggggggggtttttcaagagggaaaaaaacactttttttggacccccaaccacaaaaaagggggggggggggggattttttcccccccaaaaaaaaaaaaa

SEQ ID NO: 6507 - DNA, 511 bp, Homo sapiens
accacacaaccaataatcacacctcacacgcggacgtatcacatgcctcaccggtccgataggaagtacccgacaccgacctctatatgacagaacaactcaacctcacctcctacacacgcaccacaattaagaaccaagtctgacaacacacctcaacatagcatacacaacaaaaaatccggtacactccccaaccaaaacacgacccccacccccctccccctactccgctctcccactctacaaaccacccagcttacgatcgacaccaaccgacacgactgcacccgcccaacgccacccccatcgcagcctaactccacgaccgccacgacacgacccgccacgcacactcaaccccaaggaccccacacccaccaatcgatcccggaccagataccatgcaatacgcaatactagacacccaacaagatcagacctccacaccgctgatcccacataatggcgttggcaaccctattacaaaaccgccggccagtgaacgcga

SEQ ID NO: 6508 - DNA, 1269 bp, Homo sapiens
  misc_feature (1)...(1269): n = A,T,C or G
tgtggtctgagtcggcacacaatgttccacaaacttttcttttctcaacttgaccggaccacaccccccaccatccggtgcgaacgacgcccgtgttacacctattctacacgagcgattggcgtattgtttatccccgtgtatatattgacacctccgcaacccactgtatcactcgcttagatgttagcgcatagagttaatagttatgctatgcgaaccgcggattggggtactatatcggtctacaccgcccacatgatgcgttggggatgttatgcatcgcgagtaaacggactgcattgtgtatagaatagctcgctgcctctaatgtggtatggtgactgagctatgaataaaatttagccttcgaggacgtcactacacactgtgctcgcggttcccggagttttgagaattctatgtagtcaattttcgccaacacctaacgggtcagtgtatgtctatcattaatcactatacagccgtgtgttcgcgaacacgacatgtcagcttagagtattaggtcgtctacgatagagtacggggttactccctatcccgcgtctattctcttactcacctgagtatgctgtctgacacagcgtcggcgacataaagtcagcgtgtaggtcgagtatgctagttctggcgagagcgacgcctgcgcgttacgtcggatgtcctacccgtggttagcatgtagtgcagagagcggttatgacgcgcgcggtggcaagaagacaaggatgtatgangtcacgcnactacatgcgcgctgcccactgagctggcggtctatcaagccgcntatacgatatatgagacacatacgtgccagacgacagttgtccacaacatcaattgaacactcgcctagtgaagacggcgcatgcctctatatcatcgaccctcgtacttccatagtatgctattacacgtggcgcaaccgagacagcggaggcgagngaatgagtacgagagtggttgtctgatgatagtctcagcgcagaggccagctaggcgacacagagacgtagcggcgtacgaagtgaaagacgacacaaccaccacatcccgtgccgcaatcgtatcgcttgatggtgttcgancgctcgactcacaacgagtagccgcggcgtgtctcgcacgacttaccgtctcgttcgcgataancgaattcgtttgcatctctggcgtgcacgagtgtactagcgtgttgcgcgtgagcatcactgtactatatcacaaaacaattatggcatctac

SEQ ID NO: 6509 - DNA, 827 bp, Homo sapiens
catttattgttaaagagtgagtaagaggggacgattgtggggaaagcgaggaggtttgaaagggtgagggtgcgacaggggggtgggtgtgcgtgcgcggtgtgggggataagccctgaggcaaaagaaaaaaaataccacagctacgggcgggactatctggggacagttggcaagagccagcggagcaatatgatggagggtttgatccagaaaggaaacaagggtgctggtgggggtaaggaaaaaggggggtaaaaggggggggcgatattccccaaaaccaggggggccccgtgttgtgtgtgcactaggtaattccgtaagagcgaccctccgggcggggcgggcatattgaaaaaaagcgcgaggacagaactgggggggaccattttttgtgagggggcgtttgaaagggcgcgcggtaaaccaaatcgagagggttgggcgtttaagggcaccacggagccaagcgcgtttaaaagcgcctcaaaaggtttttcgcaagggccttgggggaaaagaagggggggggaaaccaagggtttttttggccataagggggcattcccggtaaaactgcaacccgggagggggctcgggacaagaagttttggggttaaaaggggggggctttttttattaaacccccgggcaggggccctgttttttggaaagaggggaattcccccgggggcgttaatttgagagttgtcccccccccaagggggggatttttttatgaagcccctggggtttgagaacccaaaaaaaatttttttccccaccttggaaattaaaagccccgataaaaaaaacccttttgg

SEQ ID NO: 6510 - DNA, 1186 bp, Homo sapiens
  misc_feature (1)...(1186): n = A,T,C or G
tcctatatcttcaaattataaaatattacatttttataataannnnnncccggngnccttaggcggngagaccgactgctctttattttttccacccccctcccacccgctcttccttgttttcggttgcgttgagaccccacatacaaaagaaaatatattttttgtagggagggaggtgctgtttcccacatcaaaacattccctttttcgttttcttctatactataaaaaaacaaataaaaacaacaaatcaacctcctccacaattgaccgccgcatatagaatatgaagctcgcggtcccccgcctacgtctcttctatcttacaagataataatatcattcttctccgccccccctactatatccctacccttttcctccggggggggtggaatcaatttatattatattccctctatattcatatccaatagtcccgatccttttctctctccctccccctataaaatattcttatttaaactttagctcgcgtgaccacttatcaaatatatgtctaattacgtaccacaaacatttatgtatatttctacctattttatatcgtccccgatacaaccagcccataaagtacattgcccacatttactctgaccgctgagacttcatctatatttattcncagccacactaaaaagttattttagaaatcatctctcattaatttgactatgtaattttactaatgcatatgtttccactccgctcaccancgagcaagttttaagacaattctccacgttcacagacagcnctctattatattacagtatttaacaaaaatgtcgtttctatttccgtattctattgtatatacaactttagcaacgacacgtttaccacgcccatacgactcttatccatctctatatcacgtgcgtactcgatacgccagcataagtagactcatatataacagttacttcctaatcaagcaaaccgaactacactacgtacaatcacatctaattcttcatctccatatacgccttctatgaacatcaccatctcatcatactataccacgcaccatatacaactcgcagcatccgattacacatatcttatccattattacagtgagggtagatttcactcttaaatagattatataccataatctaatcacatacaatcaacctatttcacattattataa

SEQ ID NO: 6511 - DNA, 1178 bp, Homo sapiens
  misc_feature (1)...(1178): n = A,T,C or G
gaagtggtgctctcgcacgttagactgtggtgtgngacccggtttagacccagtagatttgtgtagtctctcatcgttttgtgatggacatattgataacctatgatcgcgncctagtatcggcgcgaaccactcgttctcgtttcctagcgtcgcactctctcgtcgatacntccctcacacatattatacagtaatantcatatatcacacatctattcccccttctgaagggcgattcctgttgtgtgccgtctctcttctgtgtggtctccctctctcactcttcaccattacanccgcgccgcatctatgttacgcgccaacgctcatctgtgcctgcttgagctcctcccatctccacgtctcatctctgcgcgctcccgtgcaccgtgtgcagattccatgcgcccgcgatcattgatatgctatcgtattcatacctgctattcgttatatgcatagtgtatcattactctctcttcataagagcgtggggtgtgtgtgattagatacgccacagccgcgcgnagctctctctccataatccctatctccccacatctgttatatgcgtagcgctattccgatgtagtcaattattattctactcctcaccgtttagcactccatactctgtttttattaacgttggcataatttactccgcgcaatgtttatataagtgatgtcataagtttaaaacatcaaatatattatagttaatcaatatacatatcatgtccgtacgccttcctcagtactatgtctattatccctcagtatacacctctcaatcgcgccataggtctcattcttcatttatacatgttgcgcgttaaacctcgcgcccccttcacataaaaaaaatgcgggcgcgcataaccattcagatctcattctcaccttacacctccccctacagatgactcgccctcttgaccgttctcgcccctagcctctccccacccccatcgcacagggctattaccaccttgtgggggccgggtttataaaaagtgggagagacacgaggggtatatcagccccctcactccatttgtttgcacccgcatgggtgatcccaagccagaatcacctctagctacagtaaaagataattaacgcagtattgctggcagacattttaacatttttttttttttgcggtctatttt

SEQ ID NO: 6512 - DNA, 1393 bp, Homo sapiens
  misc_feature (1)...(1393): n = A,T,C or G
atgtcatgcgtgttcttcgcacgcctcccaccccccgtctctccacctacgccgtctgcgctccgtcgcgcgtgtcactctgagccctctccctctactgtgctatgtataatatcgcgcctagtgtgccctgctcgtctctctgnacaccgactctgcgcgatcgcaccgcgccctcggtactccgactttcctcgcagcgcccgcccgcttgtgcctcgaccattcggctctccactggcggtcgcctctccctgtggtcaccctcctgtagtctctgactgtgtgcctcccggtgtcgcgcctgactgatcgtgctgtcgcccgcatcagccacttggccgctctcccttctaatggcaccttcgcgctctctttcgctcttacctgatctatactcagttatatcgctatcgctacgtcccctcatcttctgctcgcgctatcgtgctccccacgctctctcgctggtgccgctccgataatacgcggactactctcggaccgttgtccgcgtacggtaatcgctgtctgtcgtgtacgcgtcactctctgcgttatgcttacgtctgcctacatagagatctactatcctcatcctcagtctgcgtgtgagtgncagagcgtgtctaggagcttgtcgtctgctacgcgcgtctagtcgctatcctcnctgttcgtntcgtcccatgtctaccagcttcttcagtgccagcctcccgtttcactctgctcatccgactctcgctgtatcctcctcgtctcagtcactggcgggtgtcgtgtgtcgccgtctccctccgttctctgactagtgctgctctcccatgctacggcgcaccagccttctctttcttgctactcgttacactccgcaccctcgagtcctttgtacaatatgcgttcgcagcgtcgtcatgtctcccgtctctgtcgcttcatgaatcgttctcctgtcgtcctcttcgccgctggccgcacgccgccttgcccgtgtctcgttcgccgccctctggccggctgccgccacctggtccctgctcctccctctcgtaagagcgaggagaacgcgctgccgcgtcggggctgcacacccgtctcgtcggaccctgagctctccaccgagaaacggcatctcagcgtcaatgtacgtgtcgttcgtctcccgtctctgtgtcactctgtcgctctctccctccccgtccttcttctcgccgctcgtctttctccccgcctctcttctctcntcctacaccgctttccccctcgccccctcccaaggtcttctgtggtgtctctcnntccttacntncgcnntgtcntggttnnttgcctnnntaaaggnnccccggcggtcnagannacaatgaaaagagcccttnncacgcgcccc

SEQ ID NO: 6513 - DNA, 878 bp, Homo sapiens
  misc_feature (1)...(878): n = A,T,C or G
ggccttttttaaaaaaaaaaacttaaaataaagggggggggctttttttataaaaacccccccccaaaaaggccccacgggtggcccccccaaaaagggggaagttttaaaagaggagtgggccagggtgttttttcccccgaaaaaaaaaaggggaagggcgggtgtaaaaccccccccccccaaaaaattttttaagggcgacccgttttttttaaaacacccaagaaggtggattctccttaaaaaaaaaaaagcttctttttttgggagaagaaaatttttnncccgcactacctcatcttntnnnatnnaggatnntggnngtgatccannaatcggcctttttnttaatggctacaggcatgaaaaattcccataagagaggggagtgggtacgttgcgggaacttggaaggatgcattccgctcgtagagagaccatcgtctgagcccgaaataaagggagagccgaaataaagaggcggggcggggcggggccctttgggggagggggaaatggaaggatcctgcgctcgacggagctggagtgcggctacggggcggttggggagggcgggcgagggcggtatgccgggttcaatgcagggggcggggggagggcggggaggcccgggggtcaaggggggaaagtgaagggggtgggcggagcggcgaggagggggcggaggggaagagtgcggcgggggggggggcggcgagggcagcgggaggagggcgagaggtgggcgggaggggcgggggggcgaggcgagggtgacgagggaggaaggaggaggcgggggccgggcgaggcgggcgaggagacgcgcgagacgagcggggaggacggtggagagaacgcgcgaagagagagga

SEQ ID NO: 6514 - DNA, 476 bp, Homo sapiens
  misc_feature (1)...(476): n = A,T,C or G
caaataaactcattacacaggaataccgccagaccgaaactccaatctcacacaatatgataaacgcattacanaatatctctctctattcaatatatttacacatactctctctaacataacgatacacaagttattcatactcatcttgtcactcgtatagtaaaaacaaagggtatgaacgctcccctaacctcatccacctaccccacctatcacgatctgggttcaattacgacctaattggtactagctatagccacacatctgggattacatggcaaccgttgcataagcaagtacatacagactcacataaatcttaacaaaatgataaatagtaacacaacaacactatggaagggaaccgccacctcgcacatacgtgttatgctcatcgcataatattcacaactaactactcatgattactactaactatcgctatctctaaaaactccggccagtgaacgcgc

SEQ ID NO: 6515 - DNA, 1807 bp, Homo sapiens
  misc_feature (1)...(1807): n = A,T,C or G
acgtcactgacacctcggtcacgngacgcgatgttacaacgagtgtgcacgtgtaacggacgctgacatagaaggagctgtatagccggggcgagagaacacaaatagacggacaccagtcnaaacatactgtggagcgagtgctgcaggcggggtgggagtagacgtgcgctataanatgtgctaccgaagatcatacgaatcgtcgcaccgncacacacggcgcggagactaccgcaatatgaacacaagacactcgcaggcgcgtcgcgtgtatataacgcgaccacatgagacactancatagcgggcggacacatacagcnggcggagctgcaaagcgggaggcaactgcganacatgctctacacatgtaactctggtggggtgatacacaccgcgtgctcgctcattaatgtgatatnantgacaacaatacgctaattaatgcgggcggtatgactacaaattcatcgactctactgtagtagtcatatgtctacgacacactgtgngtacatgtgcgcagcctcaacacacacacgcgtgtgtgcatatctccactagtcgtcanacatctcacctgngtgtgcaacctacgtgngcctgtgtatgtcacaacacantgctgtcacngcacatactgagtgcacctgactcatagtgttgtcactattgtaatatgctcacatcagtgtgtcatagcaaatactaatactattatgagaganaactgagacgcgcggagtcgtgtcagactactcatctaccgatctngaatacctcaatctaataccagaagactctctatgtgtgagcccgagagagntggtacaattatatattgtctctatcgactcacaattgctctcaccntgccgatgtaccatcacacatgcttttctgtacacaatctactatatatcgatagtacataagctgtgactcaccatctagtctttatcatctcttctacttcacacccgtgcgtggtntgtacactcactccatatataggcgaggacgtagtcacacatcgcactccaactaccgactcatgtaacatcgaagtctgatattgtgattgccggattattgactctctatggcatttaccacaacaagatattctgactgttacgtacgtatgaagtagtttgcgatggtgatcgattgataaccaactcatctacaacatatctgtatngaggngacgtgtgtggtacaacaaacgacacatatagaggacangtaaacatccaccacgcgcgttgtcgctcgatagtacaccatgtgagtgcatcagtatggactctgataatattatacttagagantggtgtgtgctgcgtatacaatctatcacgtctgtagggacnacgactctatgcngtgtaacacactcgtctcctaacgtgnctncagatcaatacgcagtatgatatactgctgntgngatatggtagngtgagcgctaccatcactctgctgacattantgcgtgtcactcctcacgcctgtgngatgtagctggccgtacatctacatcaatgaangaaccgangactacacgtgtncattctatcacatctcatatgtagcgatacagtgncgcagagtgacgcgagcgtatacagcgtcatcagcacacacacncactatactatagcaactnatgtgcctgtgtgagntgactgtaatanttatcatataactcttctacactacatcctatcacactcatgccgccccngagngacacagcggcgngacacagcgcncncgcagatgtatagacgtctcactg

SEQ ID NO: 6516 - DNA, 1199 bp, Homo sapiens
  misc_feature (1)...(1199): n = A,T,C or G
ctgggtgtgcactgatctggcgcatgccacgcccttcccgtccctctcatcgatggcaatacacacgttttataatattcactgaccatacatgcagaatcgacacacgacggcactaactgagggttacgagtatatgcatcatacgcggatatccacccgtcacgctgccacacgctcttcaagttcacggaatcggngtgcgtcctcatcatnacttggcaattcgatccgatactgaacagcattttgcgcgctcagcgatagatctgcggctccgccactaatacacaggaacgccagatctcggacgtgtaatagatgactatgtctcgacacgncggagacagctactataattacccgtcttatttggctaatctatcggaatggatcgcggcagcgatgtgtgaggagtagggtatgcttcactctacctgacatatgctatgcgaagctcgactcccgggcacgcgctctctaatatgcgcgtgcgggatcagtatcgcgtcgtacattctgaggttggcgcaggcgtatatatgggagggtctactgtatgtcatggtcaagttgtacgtgcgacgtatatgaacccacagacggtgtgtatgagttgcattacgggattaggatgtacgcactattgtatgtgtcgcgccgaggagtnccatactggtggtgcgtattatgagcatacgtggtcggcagatcggcgggtgatatcttgggcttcttcnctaagtcggtgtaaacttgtacacggcgtatatagtcgtgtccgtcttgctataacggctgagtaagattagcgatttataccagtgtaataagccaaggcgagatgggcatatgatatcccgataggtaaaataatgtggaacaatcgcgacacgacgccgttgttacgtacctgcgcgccttgctctttccgtgtcgatgtacgagcgcacgcactctgactgcctacatggcaccaagggtaggtccgcgtagcgacaatgtagttatgcgattgcttgggggagggatattcgtgcataataaatcatgccaaccgtgtaccacgaacgcggcgggccatgtgggtcgtcttgttctgttctacaaaaatgtggttgccgacctttctctccacgtagcgctgctaatggcgtcacacacttgattgagatggtaggagaagccgagggaaagcc

SEQ ID NO: 6517 - DNA, 1494 bp, Homo sapiens
  misc_feature (1)...(1494): n = A,T,C or G
ttttccactacctcctcactcttaccaaatcatcaccctcacaccacgctcatctggtcttcgaatgtgtaaatgtggtagagaggggacggtcgctggctgtgtaagtgcgatccgcataccgtataacaaccaatcgctccatctataaagatagcgagtcgagtcggcagctcgatactctttcgcaccatgtaagatccgtcgtcctgagctgcggcaccagacatcncatagcatgtacacgtcgatacagcttgtgtcgcgcgtagtgtgtgactgacgacatgtgagcatacgcactcgctgagtnacnaggtgtatcgccgtagctgagcgtatangtaatcgcntactgtcntctacccgctacgtcgtgcgcatctgtagtcgacgaatagtgttncagcgtcntcgtgtgtgatggccggctgcgtcagtatagtggctgtgacgcgacagacaagactcatgtcattgacnctggcgcagtgtgtatgtgtagctcggtaactgctcgtaccacactcattagcgaatcttatgtgcatctgaataagttcacgacgaccgactacgcaagagtgttgaacgtgtgcgatnacgaggagcagaagcgagtcactatcatctcatgacgttagatatggagcgccatagatgcgtaggtacatcgcgttaatagagagagtgagcgcgagaagatcgcagacctcctcaccttctaggtattcgtgccgaacgcggtccatctacgtatctcatccggagtctcaaccgaatctaactttgcatcgagagctattgcggaattatatattgctgtgtcgtcagagagtcgcgatcgcagttaagataaatgtgagagacacacactgcaatacacatccacaatctcacgttcatggtgaggatgggattattgcctcgcgaccgttatgatgcatagtgaggtgaaagctcatagacagtcaatgcatttgcgcggtctcgccggtcgcggaacacgctgagttagtctagtacactcagtagtcncatnatacaatgcagtcatatgtgacaaagtacacattgtcatgtatacaantggagtagtctgtctatgctcagcgcgagtgcgatagaggcgcaagatcacacgnctgatgctgtgcgacgtatgacgcgccngagcgctctgcgcgtnacgtcngtcagaccatatcgcacgatgtcgtgtgtcgcacacnacacatcacgtgtaacacgagcagtgcacagagcatgngcgcgcgttcagcgatatatttagctatgtttcaatcattattctcgctagaacagagcacgatgtcgcactgcgctactantgagatgtgcgtactaatgtatactgtggcgcacttaagcacgtgngattgtctgttncatcgcgtggcgttgcggctcgtgcgctgtcgcnctgcagctaactgcgncacgcaccatgccgaacgtcgctgcgcgccagcg

SEQ ID NO: 6518 - DNA, 305 bp, Homo sapiens
  misc_feature (1)...(305): n = A,T,C or G
tcacagttaaatttgctaacgcggagtccggccccccttccctttttgaggggggaattataaaacctccccaaccaaaccccatccccccccgnnnnaaggggggggggggcggtttttccccccttaaagggggggatttcgggtttcccacaaaaaagggggaaccccccccccgggggggggggcggggggggttcccaaaaaaacccccgtctcccttccattataacatctcttcttcnctccccaaaatgtttggctggttctcccttttcttattgnnnngcccccccctacccccc

SEQ ID NO: 6519 - DNA, 181 bp, Homo sapiens
  misc_feature (1)...(181): n = A,T,C or G
cgtagtagggaggggaaaaaaaaaaannnnnggnnncctaatcactgaccaaagttttacattgtgcctcttcccctgattgtgtggatacaatggacctcaattaacaatttaccttagggcctgaatttaccctttctaaaggcaagcggtcacatcttcgttatcaatttaaatttga

SEQ ID NO: 6520 - DNA, 928 bp, Homo sapiens
  misc_feature (1)...(928): n = A,T,C or G
tcacagttaaanttgctaaacgccagatgccgggcccccttccctttaggagggggggaaattaaaaaaaccccccaccataaacccccgttcccccgagggnnggggggggggggggggggttttttcttcccctcaaaggggggggaaccgcttttctcccaaaaaagggggggaaacccccccctctttnnnnnnnnnnnnttntttttttccaaaaaaagcgggggggatccttcgcgtctctccctactaaaaacaaaaaaaaagccccccccccccccctcccacccacacaatcatatttttttttntttcttccggnnnnnnnnccgctcaacgtctccctcncnngngngnnggggggnnnnnnnnnnccnncccccccnnnncncnccccnnggccggcggccgcggcgcggccggggccgcnccccggccggcggccccccccgccccgcccgcgcccgccgcggcgggcgcgcgcgggcggggcgcgggcgcgcggcggggggggncggcgggccgcgccgcncgccgggcggcgcgcgcgggggcgcggggggcgnggcgccngcggccgcggggcncggcggggcggggcnggcggcccgcgccggcgccgggggggcgcgcgcggngcggggggcggcggcgcggggcgggggcggccgcggggcgcgcgccccggggccgcgcccncgcgccgggcggccggcgggcgccgcggccggccgcggcgcgcggcgggcgcgccgcgccggcccgcgcggcgggcggccgcgccccgccgcgggcggcgggcgggcgggggggcgggcggcgccggcgccggcggcgcgcgggggccccgccgcccncggggcngngcgcgggcggcccccggggccggcgcgcgccgggccggggccggcggcgcggcgccccg

SEQ ID NO: 6521 - DNA, 587 bp, Homo sapiens
tccctggccgacgttaaacagttagaatcctcctctgaatcatctaggctattttgggcggagttgaacccttattctcccttttattcttggggaggtatatgttgttcctttccgtttcttttggtattaggtgtgatgaattataattagagtttcttaccgaagagaataatagttttcagtacttaatggtaatcttcaacgaaaatgtgtgtttaatttttgtgattagttgcctctttctttttttcattgtactattctatgtctgggtgtggaatgcatggaggcgttgcgtagtcgttggtccgagaaaatacttttataaacacggagtgtttattattagataatggtataaaacacttgaggtgatatattcggatactccgtccaagatacgccgcttcgctacatactattatggactcaaacgtttatgatgtatggatgctcactaggacatgttaattaataaggatagttggtgtcataccctagttggggctcgcaatggctacatttccacgcgccacggcacacgaacgcgccggcgacgacgcgatatatgccatatacgaacg

SEQ ID NO: 6522 - DNA, 301 bp, Homo sapiens
atgagaaaggaatagaggacataggggagactggggggaagacagagtcgaagatgatactggaggggcaggagcgagaaaaggaaaggaggagaaagtaaggggaagagggtaccgacttgagggttcgataattggagtgcaattatgttgtgagagcggacattaggcgtgctaccggaacagacacggaggacgtacggacagtggagcacccaggccagcaccgggccagcgaatacgtaacagtgacaaacatccgataaagggacagtccagtgaacgcggtgtaaaagagcaa

SEQ ID NO: 6523 - DNA, 570 bp, Homo sapiens
  misc_feature (1)...(570): n = A,T,C or G
gggagggaggggggggcggggcaccggccccnnnctcnnntncttgtcgcgggaccgccgtttcacagttnnnnnnnnnnccnnnnncnnnnnnggncnnnnnanncccnnnnnnnnnnnnnnnnnnnnannccccagcccnnnctctttttaacaaaacaaaaaggcnnnaaanactaataagaggggggggggggtctctcctttttaaataaaaacaccccccccccacaaggggagaagaaaaaataatattgttctcctctttttgtgagagcacacccgggggggcggccggggngnntttnttgttttttataaaaaaaggagggggggagagagggngtgggggttgtttttgttggggggggggggggggggggcgccacaaacggattaaatttttataaaaaagcgggccgaaagaacacccccgcggtcgtcaacccccccccgcccccctgttcgggtgtgtggggnggnncccccctgccgacccccnngggggnnnnnnnnnnnnnnnntnnntttantattccannttccaatggaggaccccccaacggcagc

SEQ ID NO: 6524 - DNA, 2454 bp, Homo sapiens
  misc_feature (1)...(2454): n = A,T,C or G
ccacgtcagagcagcaatagtaggtnctgtgtacatctacgcggcacgtcacanagatactnangtganangnagnaagagaaagagggaaaaagagaggngcgcttcagagtgacnacgtacggnagcacanacagtcagcagtnnntatagtaaactnagcgcttatcngcgagcagcagncgagngacacaagcacacacagagagtcagagagtcgncgtcntctgagcgcagangatagaatgcagtgcagcagcgatacatcgtcactcgacaggctnatgtctnaganaactgagaccngtggacgagtatcacnatgntcatanatgcnagatgcagaggnatgagcgcatctgacggcatacgtactgcgtactgcgacacagcgcatgtcgaggcggcgctcgcaanacactacgagacgccggcgctagcagtatngcgcagactgcgctgtggcgacgctgnaggaggccagaggttatgcagtatctcacnacacgaatgatggatgagagatcactcgtgtgtcgagaacagactcatcagcgaagtctagcgtcagntgtgcgatcagcacatgccatgctcgtgctagtctgcgcgntcgtgcgcgtctctacgaagtcnactctcttctacgctagtcgcaggtgccagcacacgagctgatctcgcntcgtnctcagcgntactacgacgagcgtcnactgantcagctataggacagcagtgctagagcggaggcgtaggagtcgtcagtacgtganacgagcntgcctaccgctcgagctcaacagcgacgcacnggtcgtagcngagtcatgtacatagcatgctgntacgtcacgactcgcgacnatcatcanagatgcgacgatcgcatcgangcgcntnatagaganccnngagnaacgncacgacacgtagtacagacgtgncancgtnagcagccgctngactgatgcgagcgactcatacgtgccagtctatgctgcagcacgtatacntngtnactangagaagcagacgacnacncagtagtatgnacatgtagtgncagtcntntcanntcntgcagccancacgagcnacgcgncagcacagctgtgngcnanctactatgctnancntgcgnctgtcngtctnctacgtctgnagcnacgcacgtcagtgcagacggcntnatcatccctgcacgcacgctagcgatgacacgtcatntatcagctacgacgcatcgtcatcagancgctgctagctntctaccagtcagggtcatcatcatcgtgagctagtagtcgtgtgnacgtgtcgactcacnntcgtagatggncgaccagncgtagtgtacgantgcatcgacctcgacagctgcantactantgcacgatagatagatcgtntanactgtcctcgantcagcatgacgtcgtggcngcanctcgtcngatcnctggtcagtaggtcgtgtannctcgnctcaggnctacatctgnctctactcgactatgatactgngacgtctcatggctacgctactagtactcnatcagatgtatcagatgatcgtactngtganaccgncgtggtatagtantccactgtggnacntntntanacggtcnatgacacgattgctgcagctaatagcagtgacngcngnagtagtacntgatgnagcagaagtantantcacgtaatangngtngcagtgatacgtcgangttcganttaagcngagtagcnagtactgtgactgagactacgtnagtacgattagctgagcgtatgagatngactgctgntatatagtcggctgatgtantactgagacgtacgtnctntggtngtngacatctgntacgtcnatctgntctcgagtccgntgagtacggctaacgacgtgnatnngtaggtagntacggtactctagtagtatgactngantacatcacntcngtngtggagtcattagtcngtgtactnatgaactgcagctagacgacnagntagtagacgataactacaggcngtcagcgacntcnncgtcntcnngccatcangcngcatgacgntagactctgaggangacgactaacgntgntcatntcatgcntcnctaaccgcncgatcgagctgagtactgctagcgacncattggctacaccggagangtnagangtnatagcgncatgcgacngntatctncntgntcgtcgacantgatnatcntcatagtcngtnagcagancagcncactaggtcgacatcagngtctagcangagctgcgacncngtcgtcgnatcnagcacacgcncnncgagtcagatgtcgaccgcacactcagcatgcnagcagnacagcatcgacgatcgacgtcgtcgttcagagagctgngcncgactagntcgtactgcgccgtcncntcctnatctntgcantct

SEQ ID NO: 6525 - DNA, 1318 bp, Homo sapiens
  misc_feature (1)...(1318): n = A,T,C or G
accggcacaaacgccagaatcggccaagcccaagggcccccgagggactaaagggaaacaacacaccccgcccgcccttccgacaccgaccgccgaaagaaaccaaacgcgaccgcgcgggggcggagacgtcggcgacggcgaaggacgagacagccacacggcaagacgagcaggacatcggaggcagaggccgccaaggagagcgccggagaccgagccagcgcgcagccgcggaggaaagacagcagaggccagcgagagagcagaggacaggcgcacaggagccgcagcgggcgaccgagagaaaacaagcacgacaacgcaaagtgcgacgacaaaagaccccggagacaccgaacgcaagcacaagaccccccccgcgaaccagagggcgcaaacgaagtcacccgcgcggccgcggcagccgccngcgaaccggaaagaagagaaaagaacacgacagagcaggccgcactaccaggagacggaggcaggaagctaagagcgcgagaacccacgagccacgaaacggacgccgcctccaccttaacgagcgtggaacgacgcgccgcacgacaacgagaagcccaacgaccacaaaacgacagaccagccgcaccgcccggcggcacagaataggagtccgatcgcgcaaaccgagacagncgacacgggacgacccgactagcagcgccggcagaccaccgccacacccggcaccacaggagcgaaacatcaagagaagagcagcagcacagagataataggccacaacaacaagcgcagcacagcgcgcctcacggacacgtatcgtactgatgcatcgcacgcgagaagcactgcagactcgcacgcgcgaacgcagcgaacgacgcgcgtgcgatacgcagagcatcaccggcggagacatacgcacacagagaggcacgctcacgacagcgancagtcgcacgaggagcanatnaggagagcgacgagaggcgaagagatggtaatagcgngagtgaagagatacgtgacgaagagacggttgagcacgtgaacgagtgcatagatctgtacgtgcagtggagatcgcgcacgcacgacatacgctganacgtncgacatcactcgacaggagcgcgcacggatggccgcancgagtccggctacagcgtagacgacagncgcatcacatctcacgatatgatgccgtcagcaggtcgagacgtcagtgcgccatcncgataagcgacaccnaagcgccagacgagcacgacgagaaggagtgtcgcgagacatccggaacaacgccgcgcgtcgcgtgacagag

SEQ ID NO: 6526 - DNA, 158 bp, Homo sapiens
  misc_feature (1)...(158): n = A,T,C or G
acagttataatantgctaacgccaggtcagggggcccttttttaaacaaaaaaggggggaaaaattaaaagtggtgggggattttttttttttataataacccaactcgccgaggggggggggccttttcctttttaaaaacaataaaaaaaaaaaaa

SEQ ID NO: 6527 - DNA, 489 bp, Homo sapiens
  misc_feature (1)...(489): n = A,T,C or G
tatgagaattgtgtgttagttgatcacttaggatgtatatgaggccggagaagtaatgaagatcataaagagcgaaaatttcgcgtagacgggtcattgttacttatacgtatgtgcatcggtaaacaaagttgtatagtgtgtttgtatttgatttttctattacatggtggaaaagttcagatttttcgtaggcgcagtcattaatactgctcacataagaaaagaattaacacctgtaggttataaattaagggaagtgaagtgtggttgtgagcacatgtatggtgcggtaatgaggcggctgtgtattctaagttggtacaaggaattcatcatatatagttaggaacttgcttaatctagaatatttaatattttgttaatttgtgtgatgttgaagaactaacagtgataaatgtaatacagaagacaagaaaagaaaaggaggatttatacagtaantgtcacttgagtagttatatatag

SEQ ID NO: 6528 - DNA, 983 bp, Homo sapiens
  misc_feature (1)...(983): n = A,T,C or G
cgcggccaagcggccaaaacgccgaaggcgggcggcggcagggacctaattgtaaacgcaccccaggcctcngaggggagaacaaggaggcgagaagaagcggggggcgggggaagagttagagcaggggctgaagcctggaggcgacagaaggaagggggaggaaggagcaggagagagagggagagaaggcggacgaaggaaagagggcaacccacccccagcgcacccccgcaaaaaaagaaaagagacagaaatggggagcagggcccccggtctttttaagagcttaagcaccccagcaaagccagaagccggagagaaagccagaagagcggaggacagggaacaaggcagaaagatgaaggcgaacaagaggagatggagagaaaaggggagacagagagaggaagccgagacgccagggcagcggcgcgccgttacaagatggtgccccgccttaccgacccggcgaagaagggaaccagcagaatcgaggagacgccgcaacgaacccaagaagagaggggcgcggagcctggaaggcgagaagcgggaaagcgagggaacgaaagagggaaacgcacggagaagaagaaagaaggccagagatatagcgggagagatcgagcaagcgccagcacaatgagagataagccgggagaagaacggccgcaactcgaaagagaaagagacagggcgaggaagacagctggaagcgaatacgagagaacgagaaagagcggagaagacggcagcgagagaaagagcaggaggaaaagaaatgtacgaaggagtgaaaggagagaccgcggaagacgcccacgcgcgcggagcgggaacagcggccgcggccacacgagaggcacgctagtagaacagagncaggggagagtgaagacgccgagcaggcagtacgcgaccagaaacacacagacgaaccgaagcaccgagcgagagacaaaggaacaggaagagcaggg

SEQ ID NO: 6529 - DNA, 305 bp, Homo sapiens
tgaataagaaaaaatgaaagatgagtaagtaggggaagtaaatgtagttcgtattatccgattgggcggataagaaggagagaagatatcagggaggacgatgaatgaggaagacttacgcatcgaccagcgcggctgacccagactgtcgcgaagcggaaagtgcacaaatcagtccgaccgacgacctctaaggcaacaggcacggaggtacgacaaacaggtaacccgtcgttaaacgaaattattaaaagtcggtcagaaacggagtgtaataccctccaagtaggggagaaggtgaagca

SEQ ID NO: 6530 - DNA, 1421 bp, Homo sapiens
  misc_feature (1)...(1421): n = A,T,C or G
cgtgttactggtaatgagtatcagtgagtatgctgtatgtatangcatgtgtccatgattagtgcatagtatgcgcatntagnctggctaagtggtatgtcgaatgtagtatctgtaggatantagancaccgacgcgcgcgtgangctagtgggaataatgcgctgccgtaaagtattatgtgtgcgctgggcgtggtgtgcgcgtgccccacctgtatacacttctatcaattgttnacacgttacggtatagtgtacggactnagcgttcctcgcacgcgctactggcgcgtactagtgatagactcagatctcggnactaccgcgtgcggtcgctctatacgtnactcgtacacttgcgcgtggcggcaactcgctaggtnatatggtactcacngcgctaatgacttggatcgatatacgcttagtcgtgtggtcgacagagatctagtggcgtggcggtatgagtgtcgccgtcaacacaacacggcgacggcacacgatctcgtatatgtgtctcgtgtatggtaatgattcgtgtagtgtgtgcgggcgggtatagcgtgcgctatggcttgctgagtgtatatacggcagcctctagtgtagtctgtatgatggagtgatggtggctattgtcttgaggggttgattttattgcggtgttggtggtcttggtcattcggcgaagaatcacattagtcgggcgcgcatgcgcggcggagcgtagtcaccgaagacagctctccgccgatacaggacttgtagggcgggctgattgaggtggtgtgcttttattgcttgttggctttatctatcggtggcgcgcacttcaacggctcggatagtacgtggccagtgccgtgccatgtccgtcnggatggagtggcagttatatgaggccgtatacctgatgatgtagtatcgatttcgtgacatatctatcgggttattctcgcgnggcagtcactctgcggtttattggtgtcgtatttgtgagttctgcgcaacgtgatgatcgatgtattgtctttgtctgaatggcgtgtagatgcatcgtacgatggggtatactatggctgcaaaggcggagatatatggcacggaaacggtggggtggtagtatcgatctcggcaatgggtgttatacgtgggtacgctacgcgctttgtgtcattagtgcaggcgctcatcagacacagcgatttgtgctataggcgtttgtaaagtgctgtcgtcaaatctcgcttttatcgttgttctgggccgtgcatggcggaattgacgcgagaccggcgggggggaaaattttggggggggcaatctaattataatactgattgggatgtcgcaattgataaatggacatgatgcggtattacgaagattgttcggtgatcgttaattctttggctggct

SEQ ID NO: 6531 - DNA, 1874 bp, Homo sapiens
  misc_feature (1)...(1874): n = A,T,C or G
cnctgcgttctctcaccgtgccgctgcgngcgctctacgtctctctctccgctgtcgcgtcgttcntcgcctcgttgctcgtcttcgcactcctcgcgcgtggtctcgatggngtcgcacgncgactgctcgcatgtccttcgctgcgtgtctgtgtgtntactgctncgtcgtctcgttcncncncgtgctgccgnttgngtcgactgncgctccgtctcgctcgtgtgtgctgcgtttgttctctcgctgcgtcgggatcgatcttgtgtgctgacgctgcatcgctctatcgtaccgtgtgctgtgactgtctcgcgtgcgcacttcagctgctgtgcgcgccgcntatgtgctgcgccacctcgctgcgcgtgcgtctcncctcgcgcgcggcgcctgatntctgcgtncntgcntacgagnctgcattttgtcatcgcgcgatcgngnggcgctctgtctctgcgtggatcgntcgtgcngagcgnccgtgggcgcgtgcntctcngtgttgtcgctactcgctcgtcgcgtctgtcgtctgcgcgtcgtctgcgtcgtctncctcctccgtcgtgctatcgcgtgctgcctctcgtacgcgctgcgtctctgcctcgatctgtgtcgctgctctctctctcgttccgtcctgcgtctggtcctcgcgtatggtgngctcgcgcgtgctcgcgcccagccgctgtgtgcgacctcgctcgtggtgtcttctcttncctactgncgtctctctgtngtnctcgcgcctcgcntgtctctgncttgtgcgcgtgtctncgctctacacgcatctcgcgcgttcgcgctgctgccgatgtgcgtntcgccgcgctctctccgtcgtcntntcgctcgtcgtcgctgtcgtgcgtcgtcnttcnttgcgctnctgtctctctctnttcgccgtccntcncctggcgctctcgtcggcgtctgcgtcgtctgcgcgtcctccctctgnntcgtgcngtcgctctgctcgctgcgcgcngcgcggtgtgtctgcgcgtcctgccgtttggctgtcgtcgctgtgtgtgtctntctgntctccgtcgtcgcgccgtccgcgcggcggtgcgtcggctctcgtctgcgctcggtcgtctntgtcgntttcgctctcggctgctcgctctgcctgctggctcttctntctcgctcggcggttcgtctcgctcgctccgctctgcgcgcgtgcgncctctcgcgncgcggcgcncgnttgctgctgcgtgcctcgtgcctccgtcgttgctctccctttgtgcgccgcgcgctgtgncttcntgtctcgtgatgcgnggctcgttcctgctcctctcgtnttggctggcttccgctgncctcgnctccggcgtgcgcntctcnctgcgctgttgtgtgtctcgtgtntggtgctcccctcgcgtctctctcgcgcgcgtttntcctgcgcgctgtcgtttcgctgnctctcgtccgctgccttcgtcgtctcctgngtctcgcgcgtctctcttccggtcccttgcntctgcgcgtctggtgctgcctgtctgcgtccgctcctctgctctgcgtctgtctccgtcgtgcgcttcggctcgtccgctgcgtcgcgtgtgtcgctcttgcgctggtgcgtgtctctgtctgtttatagagctctgcccctcgcgtnccncttgttgcgtgcggctctctgttcgcgtttcctcncgcttgtgtgtctgctcctcnctcnctctagaagcctctctctctgtgtgtttcgtactccccatcgggagggaagctcctcttttcctctgctcccctctctcctcttctgcgttctgctcctcttctctctcctgctcgtgctc

SEQ ID NO: 6532 - DNA, 1354 bp, Homo sapiens
  misc_feature (1)...(1354): n = A,T,C or G
accacaacgaaaacagaaccccgagggcgggcaaaaaagaagaaaagcctcaagggggaaaccagccaagccgccccgcttcgccaggcagaagacccagccacccaaccacaccaacgcgaacaaccaacaaacaagcccgaccgcgcgagagcacacacaaaaaaaccgcgacgacgacaaaagggccaaccgcgcagcggcgcagagaacaagggcagcgagggacggcgacacccaaggaaaccaacaccacgcgcagacaacgcgagcagcccaacaaacaaaccaaagaagggagaagaccacaccacacacaaggcgcggagacaccacacacgacaacaagcacccgaccaaagaaacacacacaccaacatttctcaggagaacacgcggaagcgccaggggcggacaaacgaggagcggcatagcgacacagccaggagaacacagacgccgaacacaacccgnagggatcactaacaaacgcgaggaaaccgaaaacgcagaacgagngagcagcgcaccccggaacacagcagcacaacaagcccaacacacatagcgcacataagaatcacgaacgacccacccacacacaccagagacctcatcaacaaacacccagacacgcacgaaagcgcctccctcccgcccaccgcccagccgccagcgcgggcgcgcagccgcgccaacacccaggcccaagcgaacacccacgcagcaagaagaaacagacacacaggcacacaccagcgacacacaaccacaagtacaccaacaggcgtgcacgaacgacacacgaaacacaccacacaatacagaagcacacccccgcgaacgcatacaccgaataaaaccaccgcacacccaccaatagcgacgacaataaccgccagcaacaacgagcacagaaagccgtgcggaccccggcacgacgcaccccgcacccaancaacacgggcgccacagaccggcacacacggcaccaccccagaagacgacgcgcgccanaggagcgcggtgagaaccacagcacgacaacacagacaccgcgcgccantgnagaccgccgccngcaggtacagacacccgcaacataccagcaagcgcgancaagaacgcaacacgtcgacgacacgacacacgcacaagcactccacacggcgacgcacactatgtcgctacaccatagacacncgagaagtctacgcaaccagctcatcacagaaagcacatcgaacggagagaccacatgaaccaaacgcaggcacacggctgcagctcacaccactacgcacgacgcaccaaacacgcnatgaccacacacacatacatgacacaccaggac

SEQ ID NO: 6533 - DNA, 1512 bp, Homo sapiens
  misc_feature (1)...(1512): n = A,T,C or G
gctctgtgactgccttctcacattgtgatcgtactgtattacattatgacgtcttcttcgtgacggtatttgtcgattgatatgttagagtctattaatgcatcgatagagttgacttatcctaccgcatgcctccttgagcaccacaatcgcactaatgacctggtcngccgcactcctcggttcttagcattcagccctgaatacttcgttcttcggtattgtatgtgagggcgcgctcctcgtcggtgttggtctggtgtgtctgtcgggtcacttgatgangtgatcaggtgtggcggtagaagtctgttctctgatttggcggcgagctctgattatgtgcgccactcggactattctctatcacacatataatcttccatgctantttctcatgtgatttgtatgacaatctcttatctacaattacattgctactatcgacatttctgactcgcctactcttgtcacatcctatactctgacgtgatctngtcggcatatctcgtcgtgcttggtctgtaatcgcgttcgcgtttctgtctcgttttcgattgnntgtctcatcatgctcgctctctccgctcacgctaacctcgtgcgtacgcgcgatctagtttcactgtttgagagttacttctctgtcgnttcgatggccgatcaatatggccttacgcacgcacgtaggtagttcgatcgtagatgncttttagtgtgtgtgtatgttgtgtgcgggtcctgacagtatctgtgccgacacacatttagagtcgatccacatatgttatacgtataaatatattatgatctcacactctaatacatagaacacatcgatctctctctcttatactatctagtatcattaaacatcttactatattanatccctcaacctaaccatgactatcaagcgtctgtgganaatgcccganggcaatgatgttcgtggngatgtcgatatgatgtgggtgttttgagagcgtagtgtgttgttgngctgtcgaacgttagaggtaagctatgagtagatagtcttgtcacgggcgtggtctagatccgtctttgtctccctgtacacatacctcgcaggactttatacacgtgagtcgcgtggagcggcagatggactttcgtcctcgtggttatgagactgtgggtgctgtantgtcctcgagcgcggttcagcgatgtgangcgttgttaganngcgtaacttacatgtagttganaantacgagacnagacgaccgtgnttctgtatgctttatctcttgntctctgtctctcgcatngagattactgntaactatganatatngnngantggctgtatttttctatataccaaataagaatntgtcgctnttacttcatgggtatttccccnncaccttcacaaggttctctcacccctccacgctactctttcatgctcccctgnatccnaccnccctctccaccctccttaatcccttttcatctctcctttattaacctctttttcag

SEQ ID NO: 6534 - DNA, 1602 bp, Homo sapiens
  misc_feature (1)...(1602): n = A,T,C or G
cagcgcgacagaaaaacgcacgangaccgatgaacgaggagagaacccggggacgcacgacccttgagacagggagtgagacccaagcacgcggagaggcagagcctttcgcgcgcgcgccgcgcgacgcagagccgccgtgacgacgacagaagagcacgggccagcccggagnacngccgcagcagcggacgcgccgtcaagatggagcggcagacgatgcgcgcgatcagcgcacgggcgacgactaggacggcagcgcgcggcgccgcgccgtcggccgagagcgcagcggtcaagatcacgacgctcanccagcagacgagaggcgcggagagtgcacgcgggacagcagccaggcgcaagcgagagagacgcgcagatggcgcagaggatgcgacactgagcacagtcaggcggctgagagtacagcgagcaacgcgacagagtacacgaagcggagaacacacgcggcgnccggcgatcagggagagacggagtagcgcacgcacgagctcagcgtcacagacgtcgatgcgtaccngcgaaggcgcgtacgcgcacncaggcgacacagcagtgcacccgagcacgacacgcgacgcaggagcagcataccgcacgagccgcactagacgccgncgcgagcaggagagtcggcacggaccgcgtcgtccgacagcgagcaccgcacgactacagcacgccgacacccgaccgcgcaacgcacgagactcgcgcggacaagcggacgcgcggccgcgccgcacagcacaggcgcgagacaccacgcggaacgncagagcaaaagaaaaaccaagcacaaggaagcgggcggtcgctccgacgacgcgccaacagaggggaggcgacgcgaaatgagacagacgagcaaacaggcaccgcacgagcacagctgcaaaccgcggccgagccacgaagngataggcgagcgcggagcggcggactagcacaaagacccgagccccgcggccacgcgacgcaccagaagacgccgttcgacgcgcaccctacgacagcagagcntcatcgccctgncacagcacggctcgacacaacacgccggcgtagacaagagacgaggcggagagcgacgatagagccggtaacacacacacaacacgccatcagagacggcacgnaaccaacanacaggactncgcgaacaacgagagacgncagcgccntncgggcgcncggcgcgactncgctgcgcgacgcagaggctaggcctcgacgagacagcgcgtgcggcagacacggaggagagacgcgcacacgatccagacgncggacgagcagccgagcacacacacaacagcgagagagncagagagaaacagagcaaaatagtacaagatacactgagcgatcaaacgagcgcccgagccacacactgcagcgacgagacaccgcttcggcgccagagaggcacatatacaacaggaatacatagagcacgagagcgcgcaacgacggggatagacgcgcnctgtagattggcgaccagacacaccctgccantaagccagtgcggcacgcgagaggaacacaatacgcgacaacagacactcgacacga

SEQ ID NO: 6535 - DNA, 1101 bp, Homo sapiens
gggccgcaggcagtgtgacagcgttgaggcactgaggcggtttgtatgtttgtgtgaagcgtctctcatgtgttctcatatctccttctcacagttcgcgcaattcgtcccgctcacacaaacactcctctatcctcagttactttctttcccgcgtactgatcaccgccaactctgcgcgcgcggttagtgttagtatactcgactagcagatggccactgtattttgagcgtcagtagtatatcctgtagtgtcatacgcatgctcacgacaactccgtagcgcatagcgtgctcgcacgtggctacgtatgttcccatctcgctttatatcgtagtgaggccggatggatggagtgtaggtgatggtggtctagtgtgtacgggcgggtacgattttgttgtcgcggcgggcggtgcggcgagtgggaatggtgtcggggcctagccgcttgctatccgttcgttgctattattcagttaccggatcgcgtgtgcgcgcgtgaggagtgtgccgaatcattataactgataagacgcacagctctctgttgcctatagtactaagcaagtgtacacctggagcttctgttagagcccatctcatggtatgcttgtgcgcgtggcgtcggactaagcgtgtatcttattatcaatcgttatctgtgtgtctgttttgcgtggagttgatgagctgctgttatgcggatgatatataatgtatcataacatgatgttatatcgtgttgttacctgtcacaatgacacttgtattgtactcctgatgtcatgtatcatatgaccgtgcgcgttgtggtactggtactattcggtgtatgagctatggttctataggataacgttgtgatcgctgaggtcactcgatcacctcgacgtcgatttgtgatgcgcagcgacgcacttgtttatattatgcgcgtacgaggaccttaacagggcgtggtcctgttacatgggtcctgctgcgtgaaacgaattcaatatgtcgttacggttaggtcgtggcgtcacagcgtggtaccatcctcagcatcggaccttgcaccgctcagcgcttcgctcagcaccatctacgcggcg

SEQ ID NO: 6536 - DNA, 265 bp, Homo sapiens
caccacaacacaaacgccagctacattcaacaagcaacgcaccaccacccactcgttcccccacgcaacatacgccttcagattctcgccgcactattataggagacacattaaccgcaagcacacacaccctgatcccccgctccaccgcacgcactggcggctcaccgaggcccaccagaataatcccgtcaccagtgaaccacacattacagcccttaaccacccgttcacacaatcgcgcgaaaacgcactacatataggc

SEQ ID NO: 6537 - DNA, 1335 bp, Homo sapiens
  misc_feature (1)...(1335): n = A,T,C or G
cgggcggtgtaaacaatcaggcagactgtacagagaccgcggtcgcgcggagttacgagaatatcgtctcgcgcagtctggggcggcggtcgcgatacancgtgttactccgtgttgcacagggcgagaatgtgggaataagtgataatcaaccacacgccgtgtttggcgcactcagaatacgtcgtgtcggtgacgccgcgcgtgcgntgacccgccgagtagtcgtcgaattaacgaggaaacgcgcgcgctgnttatgctactcacactaagtcggaacacacactaacttgagggacacagtggcagcggcggcggacgctccgggtgcggatccagagtcgagcgctgggtgaacagctcacgaagtgacgcgtgatggtagcgatgcatgcgcgtcgagatacgggattgccgcggtcggggatgcggtgtacatctcctggtaccgactgaggtgagcacgtgctgtatgtctcgccgcgcagctggtgcgggtgcactgtcaatcatgcgtagagtacgtgagcaacgtggcggcgcagataagcacgatgtaaaacgctgtgcaacgtgccatgctggctggcatggttcctctgcatgagctaccggaccgtgccaacgctgtcccactcgtggcccgtccgtgctcgtctcctgtgagcataaattctacaggagacgtgatgtccccttctccgtagttcctgcccacgactcatcacacgcgattctggattcccagagcgtgcgtgtgcggattacgaggtcgagcgtgatccccacgtcctcgtccctctggtttgtggtcctcgaccccattcaccgccccgcgacgagcgcgtctgcatccgtctcttgcgctgttagccacggcgtttattctgagcaattctttcgtcctttcacgcgtcgctgtttccaccgcaattgtcccgcctcccatccccaatgcggacggcaggggcaccccgatagcaccgcggtttgtcgcatatgtgaacagagtaggctggctgaggggtgtgtatcgcatcatcatgatcaacactctagagaagatggggaatctcaactaataggaataattcttcataattgtgcgcgttatcgtcgtctagccagatgnacttcgacaatactgttgagagcatactgatgtgtttgttgatctccgtcccccgcaaggcaccacacacatcacgatgaaaacatacatccgacctatcacagtctacgtgtgttgtatacaatacttgattatttactctgcggtcggtgcgcaccccagcgtattgatatgtagctcgtattgtatctctattatca

SEQ ID NO: 6538 - DNA, 196 bp, Homo sapiens
acaggctgcatggagattgtagcatgaatgcagatattggaaatttactggatgtatgatcagacaaaccatttgaagtggagaagagaaccaatcagccaaatcattacagaagttgcaccactgcctgaaatttcttgactgattctatattaaggtgatttttgcccgaataaattcttgaaaataaccccga

SEQ ID NO: 6539 - DNA, 283 bp, Homo sapiens
tggagtgtagttgcgtgatcacagctcactgcagcttcaatccccggctccagtgattctcccacctcagcccccgagtagctgggcctacaggtgcacattacaacacccagctagtttctgcagtttttgcggagagatcgtttcaccatgttgcccaggcatttctcaaactcctgtactcaagcaaaccttccactttggccccaagtactgggattcaggcaagagccaccgcgtctagccaattatacaatttttaaaataaatggagatgcggccg

SEQ ID NO: 6540 - DNA, 438 bp, Homo sapiens
  misc_feature (1)...(438): n = A,T,C or G
cgtggagacagaggacaatggcgcccgaattcagaagacggtatcccgggctcaggggacaagcatctcttacaagcaaaaggtgtgtaatgcgataaagattgataagatgtatatattagatataaataggtataacctgggactacaggaacaaaataatatgagtagacaactgcgcccaacctgaattatataaaggcgagctaaaagaaaaacgggatgatatgaacatagagtgtcatacggagacgagatgacaagcagatatgcaacaatcaaggataaatatgagagaataagaaaatcaggagctactggacagtgaatcaagtaactgtgatacgataagtaataagattcaaaataaacaggagtggaatatgggcccacacctggaagtaaaacagtacaaaacagatcaaaaaancaaaaanc

SEQ ID NO: 6541 - DNA, 275 bp, Homo sapiens
tggagtgtagttgcgtgatcacagctcactgcagcttcaatccccggctccagtgattctcccacctcagcccccgagtagctgggcctacaggtgcacattacaacacccagctagtttctgcagtttttgcggagagatcgtttcaccatgttgcccatgcatttctcaaactcctgtactcaagcgaaccttgcacttttgggccaagtactgggattcaggcaagagccaccgcgtctagcccattatacaatttttaaaataaatggaga

SEQ ID NO: 6542 - DNA, 745 bp, Homo sapiens
  misc_feature (1)...(745): n = A,T,C or G
attttttacttctaccatctaattttcagctgtttataatattcatcagagtctgacccccatactatcatacttagccactcgatacaaatgtagcgttctacagcctttatgcgtatttgattggccaccatcttcctggttatttgtttgtttacttccaccttattaactagtgtttaagcacctaccacgtcaccccatcaaccacagcagcttcaccaccaaccgccaaccaaaactaaacttacgctaaaatatgcctgaaaagtttaaaaacgctaggtccctcgacgtgcaaaatacatcaccagctctaggggcatttttgtttaattttgtagagtttccctatggagcgcgcaatcgtacggggatcttttatcttcaccgcggggcacaacgagatggaaaattacaaaaatacataaagaagggatttgaattatttacaacgacagaagcccaacgtcgcttgccttgatattgacaaattataaatacttgtaaatggtactaggcgggcggggcgggtggcggccgatgctgcccactccatgtctcatctcttctacccaaatttataatatacacaaaaaaaaatcaaacaacccncacnncgtgtaggtggacgcccttcttagtccgcggggggttgggttttgggtgttttcctcccacccccccccgttccccccagttttttttatttttatttattctacttcaaaaaagaactactccc

SEQ ID NO: 6543 - DNA, 293 bp, Homo sapiens
gtggcgcgcgcgaacagggtgtcggcaacttaaatccgacctctgtcgcgcgcgaagagaacgcaacacaatccggccgtgcggtccgtcagtaatcgcgccgggcgcaaacggggcgcggggctcccggggtggtgaatctcacacgtgcgccgccacccggcgggcactaaggcgaaactctcctttgacgtttgcacccttcatacaacttctgccgtgcaccgggcggcccgggttcctggtttctcggttcgcgctttgggcccccttgactccctctgtcccacgcc

SEQ ID NO: 6544 - DNA, 367 bp, Homo sapiens
aggtagttttttaggtgcccacaacaatgcaagagagaagtggaacacatcgatataaatcagggttagggagcgcaaacgtaaagcgcgatgctggggcgaccttgcggacaggctatctggaaactggttgatggagcatcaagaaatgttgatacaagtagatgcacataacctgagggtcgtgcggcggaaccaacgagaaacttccgcgacacaagtaaaatattaagtgcgattcattacagagggtcgctagaagaagaagatgatcgagttcccgctccgtacatgatgttggggaatgctcgcggccgaccaaattacgggtagtatattgataatcgagtagatagagagaagcgag

SEQ ID NO: 6545 - DNA, 292 bp, Homo sapiens
  misc_feature (1)...(292): n = A,T,C or G
cgcgggaaggaggaaatgagagactgatctctaaaaaggaagcgatttaatccaatggagaatagcataatgaaatggtggctatgcattaaggcatgttcgatgttgactggtagatgtaacgggaaagattggccgttatgggacacagaataccgaaatcacgaagcagaaatgagaggaaaaactggggcagggcagaggaaattggaatatacatttaaggatatgagtaatgggttgaaaagaaattggtcaaaccgaaacaaaggggtagataggtaggantttt

SEQ ID NO: 6546 - DNA, 1775 bp, Homo sapiens
  misc_feature (1)...(1775): n = A,T,C or G
tgttctaattgccgggccgccgcccgcccccacccctcgccccaaacttntttatgaagaccagncggggagcgggaggggggttttattggcggggaggcgtgagcggagaggccccgagagaggcgcggtggtgaatgagacttgtgtgtgtgttgttcttcgttatgcgacggtcaggttgctgtggtgtagtaccctaattccgctgtccgtggcatgagccgctttgtcatgcggtgttctcctcatactctttcggttccggtttcttcgtccccgcggtcgcgtctttgtccgcttctccctcggcgcggatccgcgctcggtgttcccctgttccggcttccccgcgttttcgcgacaccgcgccgttagtttcccccatcccctgccggtccactgtgctgcccgcgtcccccacccccgtgttgtccgccgcccgctggttttcggtttgtttggcnacgcacgaggttgccgctccattctgtctgcccctatttatgtcgcgctatgttcccctcctcgcgttggtctacgtccctttccgtgtgttccttttttcccgtgtcgtagtggcggcggagtggtgcgccgtcttcacttgcgttttccctacccccacgcccgcggtgtgcgtttgtcgccgcaccggtcccgcgtgtctgttgtcctcgcgaggcgcgtgtggtcgcccgatacgcggcggtatggcgctgagtggtatcacgtgtgatctcgtgtttagcgtntgttgtcgcacagacacgcgttgcgnaccagcgagtcgcgcgcagatgacagggattgtctcgttgatccgcttgatgggtcacgagtagtgtcgacgttggttgtgtgtattgttgatgctagccgcctctggtcacgcgcgacatgtgtcgccgctcgagccgcgcgtcgcgggcttacgcggtgtgaacaccgatgctatgcgtaggcacgctcgttgcgcgcgcgcgnatttgacgctgataactgtgttatatatgattcatacggcttcggcgccgtgcgacgcgcgacgcgctnatncacgcaccggcgtctttctctgtgtggttgccgaccgcttctgtgtcttgcgtcagcgacgacaccagtttccgtctgtttttatacagctgtcgctcgcgttggcggtcaatgctgttggtgtcgccgccggtgtatggtgtgtcggccgcgtggacgtgtcccgccgatgttcgtgngacccgcgtgcgccggcgcatgtgcgacgcccgacgtcgggctcgcgatcagcgcacgcgaggtgtgacagctggcattcgccgtctattatcacgagngttagtgtgcgtggtgctgcgcacacacccactgccgcgcagcgcgggtggctggtgnggtactcanacgcggcgacatcancacgtcggcgctgggtgtatcatccggcgctgctcttctcgccnctcacgcgtgtggtgtantgattcgtcggcgatttcgtatagccccgcaccgtgcgcttatttgatctcgcggcgcgtatgtgcagcgcggccgcttcgtcgcgccatcgtgtggcgcgcattggcgctcggtgttnacaacgcgatgttgtctcttcgcatgtcaccacatcacaccgttgttttatagcacgcgtcagccaggcgcggtttgtctcctgttgcgtaccacgacncgccacgagtagtgtgtgttcgccgctgcccaatccgatcaccgccgcgtgggagagactttcccacacccaggtt

SEQ ID NO: 6547 - DNA, 1139 bp, Homo sapiens
  misc_feature (1)...(1139): n = A,T,C or G
ttaaaagattggaagtgaatgcctgcggcgacgcggcagggtcagtgggaactgaccaccacatttgcgagccgaccggcgcgatggaggcatacaactgggtagtttcttccgcgcccaagcaccacctggggcctatcatgaaacggcaacgtcaaagccggcggccggacaatggccacatgggggctcgtatggagacgaaaggaggacgacgaggtatgatcatagtaggaagtgttcagcgagggaaataaaggagaggactttcgggatcttggggaggtgaattgataacatttctgaaacataaccgtgtggtcacgctggtgaagctcgggtgaggtttatacggtgaattctcgcccggtcgacaaggccacacgacatcgtcggagngcaataacaatcctatcaaacgctaagtaggatatttagccacccaaggaacagttcattaccacaatcgtacgactgtgacttcacagtggcacaaaaaaaatcgcaaacatcggctggccctcgataaagctagcacccgcctctgcaaatattggcgcgtcatacctacagtcgcggacacgactcatcggcgtttatcagaaatggcgagtggcgcgactccattgtttcaaccgcagactccactcaaatggggcgccatgaatactcagcagtcaccttcaaagcaacaggggaatgcgaggtgtaacacggggtacactctgtcctggatgggcgtgccacatgacctgcggcacgcgagaacggtgaccacattggaggtatggcgccacccagcgcactcgatagcgccagcggcacagcggaacacacacacaggaggggtgggtaacggagacacaacaacacgctcactcgacnccggcgnaccgtcaaggcgctcatccactaacacatctncgctgtgtggactcacctagnagcggctgaggagcgacacaacaatagagaacactgacttatgtcgagcgcaanacgtaaagagcgaagacgngcgtaatcatctgcgcaacacagtnagcaaccgtgcacctctcccatatcacatgtggcggatattcagatagcgtgaccgcagcccaactggtacacattgaggtacgtgntggagcgct

SEQ ID NO: 6548 - DNA, 1812 bp, Homo sapiens
  misc_feature (1)...(1812): n = A,T,C or G
gcgacagacgacaccagagcaccgacacaaacaaaacacaagcacaaaattctctttttggggaacacaaaacaaggtttagtgggggggaaacaaacacacacaacagaacgagccagggcccggaccgcaagcacatgcgcgacggagcgcaacccaaagccgcgcccgcaagaacagggcgggaacagagggcggggcgggcgcgccgaaaggaaaaacagcccgagagacaggaaagagaggagggaggcgcgaaccgacacacaccaggcgagagagcacgagcgacaggagacgnacagagcgacacgaccacagaaggcttgtttgtctcagggagcagcacgacgcgaagacccccgcagaaaacgaacagacaccggacggagaacagcggaccggacagaccgcacaacaagagacgggacgacacgaccgcacgagacgcgcacagggcagacgcgcacgccgcgcgaacacagaagcncacgcgcgacgcagcacgcaccccggcagcagagacgaagcccgncngacgacgagcgagagcgagcgcgncngcancacgacgacacgacgacacgcagcagcagaagaggagcgaacaancagagagacgacgagcnacgcgcagcacgcacgcgcgcngacgcgccganagcagcgagggngagagancgagacgaagacgacgcagacagacagcgcagagacgacgagcgacaccgagacgagcgcgncgccngcaaccacgcagcgcaacacacgagcnagcacacgcacgcacngacacagagagcngnagnagcagcgagananaggagacagngagcagcgcggccggacagcannancgangnggacgagcgcagggaggcgacgagncaacgcacaacnnacagnagancgcacngncncagacganangngaccgcggngnagncgagacaacaanagcacagngagcgcgcacgaccgacacgnacgcgcaagaagcacaacacgcacncnacacnagcgacacganacgaganagagcaaacacacnaccgaganagcgcgaaagagcangcagcgccggaaagaccagagaccgacgcagcgcngcagagcaagaaaccgccacnannagacgnncagcnnacgagcancnagncncnacgcagcacgacgccgacacgcagcgagacacnagagcannnagcgacnaccgnagcgnagacngcacgcagacncgacgacacgcagcgcaganaccagaccagcgnagagacacaagcaggcgacagcgcgncnacgcggccagccgacgagcacgangnagngancgagancagcagganagcgcagcaggacgcgcagccgaggacgngcagcgacgcnaangacacgacgnanncgacagggangcggnagncacgaccagcgaangagcacagcagccacnacngaanagaggcaggacngacgcgcacncaggagnagagagcngnacganganagcaccacgagaagcacagcncngacacggcaagcccgccagctgagctgcaggtacncnanacgagtactncacaagactangacgaggaagcagagcgagggcgcgacagactgcggacgcacgcgagagcagcacccgngcnatgcgtcatgaggaggcngcngagagcgcacgcagatacncgcagggagcggacgcagtgacacgagtcgcgcgacacgcagagagagaacgacgcgacgcacgccagcgacgcacgcacgaaacgncnagaggcagcngncgccactcttacatataagtag

SEQ ID NO: 6549 - DNA, 1004 bp, Homo sapiens
  misc_feature (1)...(1004): n = A,T,C or G
tgtggaaggggagaaaaagtggggggatgggaaagtagagcttaagggtaccgaggcccaccctaattgagagccgtaacaattagctcatatagggctataggcctatcacaaattaaagttactaggggcagagggggtggcttgctgaaacaacatgactcataacttgaagcttgcagaggcttctcttatttgaaccacgcactaaagagcaaacttatcgtgtggtccttgaagaatctcatgcacaacaggatgaaggctgaagaaaggtcgggggttcaaatctcttccatatcgccatcgctagcggcgggggtgggggccgtgcctctgctgcctcggcctaatgacaacaacagtatagaagcgtgccttgagtatgagctgctgggaattctacaaatttgtgagcgtgaacaagagtggaaacataaggcacctgaaacgagagtatgatgagaatgagcgagttttgtcgcccgctgtctgaatcccacgaggaggccgttaaacataccttgagtgcaggtcggcacggagatacgcaaaaaaataaggacgcaaagagggtaggtgtgagagggataggaacacgggcggtggggggagatgttgtggggaagagcggtcggataaggaggttattgtatacgaagggagtagagtaaaccgacagggaaaggttcgtaccgaaccgacaggcacgccctctctcctcaatattcatttaagatcgggccagggagtgtgagagtaaagtggagagggtggaagagcggcggagggaatgtagaagggaagagcgggggggacatccacaacgaacggggccgcgaaccctggacaaagaagaagtgggggggtgggagaaacacgcacaaaaaatggaatggggggcaagtggggagaatacagagagnaaaaggaatatggagaatgaaaatggtgaagtcaggggggaggtaggattaaaagacggcggacgggtgcgaacccgg

SEQ ID NO: 6550 - DNA, 787 bp, Homo sapiens
aaggccagctggtcagatagggggggttgacatatatttagtggaatcctgacttgtcgacactgtgttatgggttggtatatcattactaagaatgagtaatctacttaattcggaagaagtaataacgtgataaacagaatgattaagtatcggaaagaacagaatgaggatagcaaataactgatctttcatatgaggtatacaatataagcgtaaatatggatcaagatgatacaaagtgaaataagggcgacacgttgagggtggcaagttttgataagctaattgtccatagatccccgtccaagtgaagtgtgaaaaggagtagaagctgtgacgcatcagtctcgaaggtgaggtgcagtgggtctagtggtgaaaccatagtaacaggtaatggaaggccctaagatcccagaggataccataagaggaggagtcaggggaatgttgaagactgcctcctacaaatatgattgttggagtacaaaatgacagtatgagcaagttatatggtatgcctagtgccagtgagagccctcagtaaacagtaggcagcgaccaagctggtgggaagcctcctatccaggaggatgcaaattgttgacttgcaagatgatgaggatttccagatagacgcagagtcctcaccacagatggaattctttcatcttttggattaatcatgattcaggtcttgaaatgaaaactaaaataatgccagatgcggccggagatataatatgtagagtataaccaacgggcgagaggggataatataaaa

SEQ ID NO: 6551 - DNA, 1296 bp, Homo sapiens
  misc_feature (1)...(1296): n = A,T,C or G
acgcatgacagaaatgaatatatggttcatatcgcagaaacacaagaacagaagagactagtagttcgccgcttactagggtttgaccgtatatgagaatatggcgagtatagaggaagcgactagtatncgaggcctattcttccttcgtccgctgtagcattcgcaagtgcgcattcttcagtagttacataacgtcttataagttcaaaatatgcgccacgcgacggcgacccaagacttcaagtagtntaaccgctatttcacacctctagaagtctgaggcaatagagataatccagagaagagcacgcgnatacaacgtagcggctgtgtcatctgagtagaagctagtaacgagtatggtctcccagtgcgtcgtctgtgtgcatctgtgatngaattatactagtctagtaagttttgctattaagacatcacagctagaacgtgagcgacatcacgagactacaaggcgcgagcgcgggtgggccgcgactgttgcgcggcaatnttagttcgagcaagactaagtgatagaaggaatattgtagtggacggagagtagtaacgccacgcctatacgaccgtttctagataaactaaattggctagcnactcacgcacttcatggatcgtgagtcgccgatgtgatatgattgttatgattcgtcacgacgcagggaaggagacgggtcacagcgtggatacgcacggctcgagcagtgagcgtaattagaggtctactgtctgcgtgaggtacgtttctagagaccatgctgaggataagagcgggaggtgtataggagggagcaggcgatcaaccgtgtcccncacagagagagaaccggcgtccattcacagcccccagctagcttccgtgctgagacatttgcgtagggcttctgatagctagactgcactaatagaacgatacaatcataatattaactaaatcacgtacgattttcactgatcagggcggtgtctatgagcgatgggatgtagactgcgccacgaggagtatagacagtgtatgatataggcgacgcggtttgagacgttgtataatgcgccgtcaccgatcgcgaggtgatgggtggtctgggctgtcacggaggagttaggtgcgacgtatctagagcattaatgactcaagggtggaggtaggcactcttcgcagaacggcctacgagacaatcgacgacaagcagcgcgtgtgtgtagctagtagcgaacatcggctgaggggaacagagtagaagtcaatcatgaggaggtagatgttcagattac

SEQ ID NO: 6552 - DNA, 367 bp, Homo sapiens
  misc_feature (1)...(367): n = A,T,C or G
cggtggtgctatgctgggctgcggcggcaacgtgtgcatggatgcggtatacttgttcgcgagcgttcgatcgtccccgttttagtgcttgcttgcgccctgccctctttnatttgggtgtctacgatatgaacacaaagttgatggataacagaatcgttaatgcacgtacataatcgacagcggggtatgtggtagtagtggcacgttctccgcatgctcatcgctttttttctgctttatccttttgtgtcttatggtattaatgtgctgtcttgctatcatttttaatgaaactccggccaagaagaaggttgtcgcaaagatcctccctcttntntnttaatatctcggccagtgaacgcgc

SEQ ID NO: 6553 - DNA, 2258 bp, Homo sapiens
  misc_feature (1)...(2258): n = A,T,C or G
tcagtagaaacagaagctngacgagagaagacagataccanaccacacgactgatcnacagcgaatcgtcagagcanagcccgtcnacatgaggcgagaagaactnaagagcacatncacgacacngcgcgtcttctacatccancagacgncncagatactcactatgacagcgcatgtccgagtacncaggtanaatagacgacatagnagacttgtctgtgatgtgactgagatatagttattggtgtgtctgcgacacacntcagacnatatgcgacatcgctaagatgagngatangctgcacanacggtncgactcatgagcagangacgtgtacanaacacncagcgactaatagncatacagtagcgtgtacngncgtatantggtgaacacancgtgtcagcagcgcacagatcatgtcattgctatcgctgtcgcagtcgatntgacgtacgtatgtatgcactgagtatcgatgcgcgtgtgagtatagtcatgcatnatacatcntgnacancagtagcagtccctgncgtatgcgcagtcgagatatacgcacaactgatgacgtaggcaggcnacacgatcagagtgagtctagncactgtgagtacgcgaacccaggatgacgtatatgtccgcgacgncnatcatgtacggacatgntcgtagcagtgttgctcagatgcgctattaccgcagcgagcttgatctagatcgtagtatagtatgcatactacgncagagtgctcatgctcacgacgcgttacagctgtagaaaagacgtgtangtactgagtgagtagagagnacgaganatattatccgtactacgacgcgagggagtcatgatcgtgtgcgcgatgactgtgacgcagtcatatatttcgcgactagangngcgagcgtgntagtgttcgaatganttagtgagtactgntagtctntctgtgattacactgcgtcatctgctcgatgantcgactacgtgtntcgtctgagagtcagtcgacagtngactcntcatagctgcctgcagctaactactatgctgtngtatgtcatggtgatgagtgtgtgancactagtacnanntatgtgtcgtatgacantacntggacgctagatangtcgactatatacnagcanagagctactncgntacgtcgcatanacgcgctcgtcancagacgacgcagtacgacgtgagcatacgacgncagagtacgnacgnctgataggtncgtagngcatactngatgagagangtcgtagtagaatgcgacgcagatatcgagtctnacgctntgnctctcgtgtagtactattgctactcgtctacaggaacgaacagacgtacgaacgtatcgtcactcancatcgatagcntactcgcgtactatcngaggtacgagacaacgcatacgtacaagtnacntgatatcatcggacacgttgttcnagtgantgntacganancaacgagncatcntctacgacgctacgtcagcaaactcatcntgcgatctgnngntcgtaccagntgcatgctctncgctacactccancncnactcgtanctncgtcgcntgctatcancgntacagtcngcncgctggnttactcaganaccnangatccgctgatcgacgtgctacgtactgcnatgctactatngatgaacntgnacactgtacgtggcagtgngtatgctgatgtagcganactccgtctgtgantacttgcacgtgtgacgttacgcagcacggactgtgcgcatctgtntgtcgcacgangaaacgatcgacantgacgttagctgtgntaggtcgtgacacatgcgtctantcgaagtagtacnagaggacgcnagantcgcgacagcagacnagagctgtatgcangacatcgtgagngtacnncnngacagcacgtgacnagngcgtagctgntacgncgtatngacgtgatgacatgcgctacnagcacgactagtgntatgtcgangcatatatcgtatcatcatcttactntnaggtnatctctgtncgtctatagtcgtctctgtcgacnctcntcgcantcgaccatgcngtactactacgcgaacggangtcgngaacnctactagagtgtcnaatcagcacacctnactngcacacatgacaccntgacgtcgcgcgtcgncgtcgcgctgcgcgactcgccgtactagntggntcatacgtgcgctgtgtctcgtctggcngtt

SEQ ID NO: 6554 - DNA, 1718 bp, Homo sapiens
  misc_feature (1)...(1718): n = A,T,C or G
gaggagaaagcggcgccttcctctgctcaataatactctcatatactactacacatatcacaataagacggagtcatactggagccacgtattctagtagtacgtgtacgcgacgatgaatcgtnangcgttgggtncaatgtagagacgcaatgagcgatggcgctacagctgacacgatctcagcgtcgccgcgcatagcggcgagtataatgtgaagtaagaagaagaaccagcgatcagtattccttgtgagactgctnacacgcatatgtacatcgtacacgactccatncnggatttgatcagagcatntccctgcgcatacgcgtaccagagagatcncgcantcgacgcgtaatgtgactcgtaactcgtcgcacagtatgcgncatcttatgaacatatatacagccatggtattgcatcacacgcgatatgcgattgatcgtatcatatcaccgatagagaagagtctactctcgcgcgcgcgatgcaggataccgatcaccgattcgactgagcctcacagcagtagcggatcgaagaggcatgccgagcactagcagtatatagagatgttgggatgtgtgcatgcgcatatgctgctctgntgactatggcgacgtatatcggcgacgagatctacgacaccgcgctntctncgacgaatnacagtagattatatatagngtatgtatctacacgatgtatatntatctacagcgtagtgagtacgatcgagtcctagactcgctattagaatangtcgaacgtgcgtctacagtagtgtagctagctgcacatcgttacacgcgcgtagcgatgtatgacgatgcgtcgtcggctgtgcgtacgatancactacaacgctgtctctcgtgcgccacgctgcgcgctcgntgtatatgattgatctgagntaanatagccagcagcactacgacttctgacacacctgacgtgtgctgacgntcggtatgatgatcatcagttantgatgcgcgtacggtntaccntgtatgctgtagtcagacatgcgtgggcgcatgtagntatgtcatgcgccngatgcacnatgtgcattanantgacagtgtcgtagacatctatgtagcgagantacgtcgatagctgctgncanctatcanttgtgcacgcgatatcatcnatcgtgtatagacatgctagtatgtggatgatacacgtagctcatntantgctcatacgctgcggcagagntncgtcgcatacagacatancgcgcacacgcgtcgnatatcgtacangtgcgncgtgtncgacgcngnatgtagcagacgcagacttacacgagctagagagcgtgatctagctgtangtatattacgacgtcgtcagcgcaagagatatatcgncgagagactgaagcgtngtatcatnactcggcgcgtacncnntcagtngngannnatgtgacatgcgatcgctaccgagtatatctntgtgcgagctgctagcgtgatagtctacatntacacacgtgacactgcgatagacgacgccacgccacctctccatatgagtcgagtgatanacggtattcatgatcgcgagagaggacatatgacgngcagacatagcactactgatagtcgtctcgtatacactgactcatcgcgagacntctgatacngaggacaagcgactatntggatcggtcatgtatgaccatgacg

SEQ ID NO: 6555 - DNA, 1421 bp, Homo sapiens
  misc_feature (1)...(1421): n = A,T,C or G
cttatactgtccgactgcatatgaccattgccctgccgacacatctgctcattcgttgtctctctctggagtgtctgtaccagcgattcacttcctcattaaattttttctcttccctcatctctaccttactatattccttttcagtcagtttcgctcccgccgtcaactgatacgcccctgttatgattccacggccacggcgggcgcgcatttgggtgtgtcctctcgccgctcgaccgtattcatctgtgcacggcttcgctggtcacgatcatggaaatcactcgacatcacaccacacaatcccactatacgaataatcaacatttagtctgctataatctgcgcaccacgtcctcactccatctgtcccacctgatacccacttctctctctggtcttttctccttctatatcgatcgtgtatcataaaaaacacagatggatttatggaaataatcgcggtacatgctcggtttggtcacatccatctttcttcttctgngctaggctcacgaggtgaatttgtggtgaaattacaaaacactgttgggactatcacatataacatctgtgctccaccaacagggctgcgcacgtcatatgttgggtcggttcctgactcactcatgatgtgtgaatcagggcgggggagcggcggaaacacggctatcatgggctgcggtctcagtatgataatatgtgtagcaactatataggtgggttggcacatggatatatatacacagagtaagttatcaacggtggtggtctatcccgcggttgtcatatgaaagatggcggggcanctcgcgcgcttgggctgtacggagacatcgctagggtatgtgatacacttgcgtcactcgccctcgggatgtatcttggccacccttgctggcgctcttccacacacacaccacgggtgctggctgtgcgacgcnctgctactttgtctcgtcgcactngtggtganataccagtgcatctacctctggggtgaacggccgctntggtcactgttcactcttcacacncggttatgtgactggtggcgggaccnccgtacctcgcgcaccacgacacggtgatcacccntgtgtgacacgtgggcgtgggtcggcaatcgctcaaccatcacgtccccagtgcgcggatggaccgcngcgtacgagaaatatatgtagcagatgtcatgttgatgtattgtatctgagtatagtgtgngtctacattataattcatatagtcattgtggccacacgctcatgcgctctacaatgtgcgacagaacatatacacaacacgcgttgtgcgccagcggtgacnattggtagacactcgtcagtcggtagcggacaccacgctgtcnaccacactctgcgcgctcaatgtctcgtaacaacactatctccgnt

SEQ ID NO: 6556 - DNA, 1538 bp, Homo sapiens
  misc_feature (1)...(1538): n = A,T,C or G
atcacacttactgtgctcaagcaccactactatattgttataaggaagtacaaagaatatgtatctactctgttgtctcccccactcttccgaacgcgtttcttcatcaggagaatcatgcagcagaggcgngatgtagtaggcacagtgagaagagcactgctnctaccaggatgctaactccggctgagcctctagctgtgcagctgtcatgtccttcacctgcaacgcagacgcgctctagtagctagaacaggctagaggtagggtgagctactgcgtcaatatgctaagcggaaagtcgcagtctagtgtggccggacgctgaaggactgtgatgagcaagtgctgcagagctgcccgagctaccatagttttggcgatgctaccgaccacacatcattgtgttgtgaggaggcgagtaagccaccgctctacgctagataggacgtgcctcttattttaatcacacgacctacagcatcacgaccacggcccaatactgtatagcactaagaatctagtatacaacacggtgtagatgcacagataagtcacataatagtacgtgttcagaatagagtntgtagcacacaacgtagagttgcatcatgtaagatcggcatgacagactgagcaggtgtagtgctgattcattgagtcttgggtacgacgtcgatnagcgaatgacgactanctgtatanacaggaagtgtgatcgttnatatatagntgctaggccagcctccgtctcggcgatacgcgtttatcatagcagacgcacncncgtcgtgttactgatcacgatgcatttgtctatgagatgttatagtgcgtcgcacgtcactaaatgatgattgaagctatagcgcctcgtagccgtccacctatctccgtctcagctccgacgagagagactgtatagtcgagtagtctcnattttgcacggcaaagtagtataaanatgagacgagaagtattatactatacgtctacactgtatgatgtctcttctggatcgtgtctgtagcttcaagagctgtataggattctaggttacgtccgacgctagtgacgtccgaacgagaacttccacgccctaacaccgacgcgacagccgtactctagtttntgttattctcatagacgctccatcatctgcatatcgtatggtagcagaacgccacgtgaaacacatacacagtnaacctaagcncagctggacttaacttatcctacggtgngaagtagagagttgtatgtgtgtgatacaatgggtttatagcaatacatatctgacgtcgaatctctcactctctcatccagacaacatggtacgtggtgactctgtcgttcctactgtatgatgttctatgctagtatatatcatnctgcatcactgactcnntactgtatgatgcctgagtcggtactcacacgctgacgactgtatcatgctctacacaagacattatgcggcgagtgctacattgacacaccgtgtgtatacagctctgcatctacattagatatattat

SEQ ID NO: 6557 - DNA, 1428 bp, Homo sapiens
  misc_feature (1)...(1428): n = A,T,C or G
ggaagaagtagggggtagaggggaggaggcgcaacgacgaggggcttgtgggtnaaacggcaccgccgaggcttgacgggcaaaaaacaaggagacgcgaacagaggcgagagacggcggggaggttttagaagactaaggcgcaagggggacaggggggacaagacgcgagagcgacggaactcccaccaaccaccacaacatagagtgggcgtaaatcgactgacacactcagaagtgagacgcgagattgagggcttagagcgttagtacaccacgacgccgatgacacgaatggctagaataatagccagtatcgacggctgacagattccatacactaaacgagaccgcgagagactcgccgcnccgcgcacgcgactgaagagcgacggtgcgcgctaataacgatacggacggcgccgcgacaatacagagaagtgcgaattagtgccctagagtgaggaggggacggctcgcgagggcgatgtatcacacactactgcaagcaccgcgcaatgcgacgacagcagcgtagacgttcgatatgtgtcaaagggcgagagacggcggcaggtgacaggtccgctgaggagagcatgcctacaacaacagagtcgcctcatagtgctccggacaaccagtgctcgcggcgaacgcacgatatacgacagcggcgtgcactagtcaattggcagaattggtgataggcgcnagaggaacggtgcgaagcaggcgcagatgctgtatcagagagagtgtagaggcgcggcactcggcagagctagaggcgcacggcacgctgcagatgcgagcggtagagcatgtagtagtatcagcgcggcgctgcagactgcgacagtacgcgcacgagagtgtcgtagtacgncgatcatgacgacctatcatnaccgatccctaccgcgcgncgagtccgcgatgtgtctccagcgagccgctcgcactacncagcatcnactcgccacgcgatcctcgcactacanacgtacgcggcatcgcagtcgcgtgcatacggtcatatcgaccacgaccgcactgcgtcgcgtatctcgcatcgacgtcgcctgagtgcgantctnactgatagatcatagantcgcgatagagaatcnanagcccgancgccacatcggctgcatatgagacgtctggncntgaccgcgcgtcagaacacgatatgagtagggagnacatactattcgcgatgccggtggtgatagcggggacgacagcgatctaacgccagtcgcgacacanagactctgacgtcgcgcgacaaccacagacgacaacacgcgcacgagtgataactagncataagactgacgcatctgtcactcgcatctgtccacatgaagacaacaaacagcgcacgtccacagtgacatataacagacacacacacca

SEQ ID NO: 6558 - DNA, 1776 bp, Homo sapiens
  misc_feature (1)...(1776): n = A,T,C or G
cagcgatatatnagcgaactatatataggatggatgttgcaggcgcgcgcggggtgtctcgtagcgtatccnanatntgatgacagcatcatacgatctcatatcacgagtgctgcttcagtaagagctctacgagtctctgtatnacataacgcactatacntactanatcgtctgcattgcganctagcagtagtactggatgtcgagngcagtattgcantatgatattgtgtcgatgangtattatagngtgcgacgcgancgtcgtggcnctgtancgctcgcgtctattacntagctgttagtattctatacnacatatnctctagtctatctgcgctgactagcataattattagtcgcttggcgacgtagtnantaganacactgacgcgcngtagtantatgactatcattnctctccatnagcgcacgcattgtaatgtcatatatncagatcagtcgtcagcantgctttactctaacncccgccgctatcgtttgctcgtattaatacgtgattcgaatataacgggctcaatatagattacgcatatcaagataactcgagactacatgcacacgtgtctcgtncngttctacgtatgagaantataactcatgtcgcatangacacgacataatcgatagactcagatctgtgtgcntgtatgtgctgtctgcgtctctactatatacatacacactacgtgagtcagaggtctaatgacatcgctaagcacattcgngacgtgcatactatgcacgcgacgggacgnantatatgcaacatactganatganaaagtncgaccgcgagatatatggtcgtcatgagcgtgttgaggatctgagcgtcgcatcgattatcaanacagacgccgcgacgcgatattttggagacactcctatgcgaatagtaatagtgcgtcgcggtatagaatatagaggnacgagtatattggtcgcggcgtctatcgatcaatagccttagacagttctcattggatctcctatcggcgcacgatgtcgcggcattatcaatccggtgctgactgagacgcatatagcatgatgatgctgtaatatactaaacatcacactnacgtatacattacgtagtatcgatgtatcggtagcccgtacccgtacccgtacgcgtgataatatggtgacataaaatcgcgcgcgtcgtggcacataagagcgcacctntcatttatactggctcagatntcctgagtatcaggtcacagatatatcgcgtggaaatnatacgaggacgacgcgtatactcatattgagacacacaagataacatcaacactaatctcgctactcttgtaatatttttgtcacttgtatatatgtttaatatataatatgtgtccatatcgggcgcataatcatggcgtgggcaacttcactagggatgtacggcaaatcatatagaatatatgcgcgcgcgattgtgcacatataagcccgatattaatcatccgctaaatcgtcgccgcacgncgtgtgctaaaacatttactgaggcgatcttgaatattctcatgattcgcacaagtagcgngacgtaattttgtgtggttaggcgacgatatatgtgancgggaactgcgaatactgatactcagatacgcacctacgacaagcactattaatatcgcgtcgcgataaaatatggcacatgattatgatattcatatccgagtggcgataaatacgtgtgacatctgtgtcgcatcgcagtccgacatatac

SEQ ID NO: 6559 - DNA, 1836 bp, Homo sapiens
  misc_feature (1)...(1836): n = A,T,C or G
gccgacgactcnatcgtgacagctgtntatgtatgtgacagagtataactgatctgcatcagtncgtctgctatgatgagatcgctgcantagatgncaggtatagcctcagtatctaaagtagtatatataatcataagagtactcacgtcactctctnganatactacacgcttgtctatctgtcactcgatcgacaggatatcaagcantcgcatctatctagtgactgtagacgactgtncagaggngacgctgtgttanatgtactaatcagcagtccctccagncgagaactgtngcgagcngcagatgtgcagtgntnacgtcgcnccattgccgtacgtacagcgtgtctgtgtatgcatatcatctctgatagcgagttgatagtcatatatcgatatatcgtatacgcggagtacggtcgcgctgtacatggtnctggtcgctcngtgattactcagcgangactaatcttgagatgtaattntatnantcacgtngatgatatcnagcacgacgaatcggtattgtcagctatctgtcgtacgatacgtngtatctgtatttcatacacncgcacgcgcgactgtgttattcactgtctacgcgatatgatcggtgtgtggtagccacgctgcgactgncatacgnatcgcatatgtatnatgntantntgcactgtggancgtctctgctgctacggtgatgagtgcntgnctgtaatgtgtgcgcgattatcgtgtgactcgaatangtagactgagtatagagtgaagcgcgcaccatcactaccgngcacgcgcgtagtcgcgtgagtganactaattntaagattattgtagccggcagcgtatgctacgctgttttgtctataatgtgtaacggtgctaggcgcatcatcgtacagactgtcgattntatatatagctcactcttgtagcgacgcacgcgcgccgcacgttaatattcttaatgtatatgagactatnctgcaggtccgtagcttagtgtctcgcgtattnacgcggatccgtcactacgatgtctgacgcctcctgtgtattatattagtatatcnatgctctcaacgttataccgcagtgcaggattccgncgcacgccgtcgatgttcgcgcctcacgatttctggtacgtcagagtattctccgtatactcgcgactgtcttcntaccacgctctcttntntctatcacgtcgcgtgacacgccggcgtgttctctcgatgatctgtagtaaaaggangccgcgagaacgtacagttgtagtcactatatctacgtcgaangtaggatagagatagtatgctccagtnccgatctatcgacagcgacgtngncntgagtatatgcgtcgatcacgagctgngacgcgctggtccgtcgtgatatgcnttatacattgtgcgttactnaggcgagtcngcgccgctcgtagactcgactctactgacntactcatctgttntatgtangttagcatcaaagtatcgttagcgcagacgagnccggctactgagcagtgtcagacgtcgactagtcgaagttatagcaccgagtatattgtatatgtggntcgtcaagatacgatatagtccgagtctctaacagtgtactcgaatgctgtatgttatacgatgtgtatcacgcctaatttgacctagttgcgcactaccgtagtgcagtatgcaccacagtcacgncgtgcgtgatactctacgtcagcgatgctagtcactgctagacatctctcgctgtgacgtagtgactctcatantccaactgcatatgtcgatatcgctacccgcagcgc

SEQ ID NO: 6560 - DNA, 1366 bp, Homo sapiens
  misc_feature (1)...(1366): n = A,T,C or G
acgnccttacgacacgaactctaacagagatgatcaataagacgataagagatatctcattagtcttatatagcatcagatcagttcctctgaccgtcttcgcaccnccctcgttcttgctaggatcgtcaccgcgcgccgcgtgcgccatgcgagtggttcacgtatactctgtgcgtgtcgtntctgtagtttgcgtgtcgcgatgacaccgtacaaccgctgcacctcctagacgacctgcctaggtggcactgtatagagagcgancgaggtcgtgcggtagtctcgtattatgcttatgttcatatgtatagtcanagcgtctatcacacttctcgtatctatgtgcgtcactgtcgaccgctcagngcacatctcaccccaactctatacanttcaggcgctnatacctcgtntccctcctccacctccatcgncccctctacacctccatatcttcctctctactcctcccgcctcgtcagccgacacaattaactatcttttagtagtactcgtctgcgacgacgnctacggatgcaagcgtctagtgantccatgtacttctatctatcgctcctcctgtccgntcagctcttnatgtgaatcttcatcttctctcgncnttctcttctccactacattcgcctctcactgatatataattagaaaaacttagtataactactctgacattctctctgtgtnctattgtctcctcctcgaaacgcttgataggcgatttgttgttgttgcgggtacntgtttaggggaatacgtttggaattgagatggtctagttgcggtgtttgtgaaataaattaaaccatgtctctttatccttttctactcccctactctccccatcctccacacacagtctcactgcatttcctgcctttggagtttgtgtggaccagtagcactntcatacgctcggcctcccgcgccttcctcccctcccggccgtctgctcgtgacgcgctccacgctcccgtcagtgtggtcttctgtgcggantttcgcttggtggttaataagagagcctaccgtcccggcgtcggtctcgtgctctcccctcacccactcgnnnncctcgcgcagtggacgtataaatcataggagctgcattccacacaagtccacgnnaccgacaagataactgtagatcgatatacataccgccgcaccactctttcttcccgtttctttatgtggnagtatggcctaccccgccgtctnttacatttctttctttcgtggtcttntccatagaagacatcttctcctcaacccaccgctctcatacccgataacatcatacaattcacatacctaaaaataccgntcaccaaaacacccc

SEQ ID NO: 6561 - DNA, 874 bp, Homo sapiens
ctagggaaagagcgggaaacaaaagaacatgaacaaaggaaaaaggacaggagggaggatgggggcgtgcgagacgatctcatcaaaagaacggatagtcgagagatgagaagggcgaaaagaaaaagggatgaaaagcggcgggagaatgaagcaataacaaggcaaagaaacagagtgggggcggaaacggaacgaggaaaatactgaaatgacgaccgacgaaatgagcgaatagacgaaacaagtaacacgataactgcgctcacgaaggcagagaaatcagaacacggatcgaacaaacccgacagaaagataactcgggaaatagtaacgcaggcgcacaaaaattccaaccgacaaccacaacagaaactccaacaagacactagttaacagcacaggcggggtggaatcccaacagaggtaaaagcaagcagaaaaacgagagcgtctccatttgacgacgagaccaacaagaatgtctataaaaaccacgccacatagggtgccaactcgagcagcaatggcacaaaaaagccaaaaggcccgagcgcagcaaaggtccgaagactaaatgcgcatccaaccagtcgataaaatgagcccgggaagctaacaacgggacgggggcagtgagtcacgtgacacaggcttcaaactacggagccatgtaacaagcatcacttgtgcacacagctcctgagggccaggaggaaactttgtctccttgaacatctagcctgtcaacatctgcttgaccaaaatgtctgattggatgattcctacggaacaaagtctagtataacaaaccccgatgcggccgaaattgtatattggtagaactcgggacagtaaaacgaatcacacaccg

SEQ ID NO: 6562 - DNA, 786 bp, Homo sapiens
aatccgatgtgctcaataaaaggaggtgtgggccgtatattatgcgaccaaatgacactatatatccgaatgatattgtgtagtttaaagaaaaaactgtgattttatgggttatttatggtgaatatgcggttatcgattaacttattagtagtatctaattttaaattatacatgatagtataatgatgtatacgtactgagtgttataatttacgaggaaatgcaggggaatatcgagaatgagataggtcaggagaggacttctcccgcggtatcgaaacaaaatgatttttaagaagggtctaggtcttgggagtaggcttccttcatggacttgagactaaagaattataatgtaagagcttatcaaagagccttttgtagggtgatatgatattcccatcatagtctggtattagagatataagaaagacatgctcccgcatcccgctgcaatctgtataggactcacttcattaactgatgaagccagtggagtgaatgtaatcgcccaaagcacatgtgttaggtaaaatggtccaaggacagagctttgtgaacaccaacactgaagaaaggaacagtggtttaggcacccacagaagatgcaagaagcaagaggcacagagcagaaggaaaaccaggaggagctacaaaggaaaatacctcatgaagaaaggactgatccagtattaaatatgaaaggaaagtcaaatacaataaaaaacgatgcggccgaaaccttttatgatttgaatttgacggtatattcggagaagaaaa

SEQ ID NO: 6563 - DNA, 229 bp, Homo sapiens
  misc_feature (1)...(229): n = A,T,C or G
cnccngnnggggattgtgaccanccaggcctcctnccacctggtngncttaggaccnggggttnnaaaagnaaactnnctttttntntttgnngnnganacngaacctnaaaaaggccccccttccctgganngcnccccctcaggnnaatccnctgnnncccngcctgggtnttgggacantnnggcccccnaccaaccaaggncctnacncanngggttcnggntgt

SEQ ID NO: 6564 - DNA, 724 bp, Homo sapiens
accagcaccgccagtgatttagcggggcacagaagccaaccccaactaaagggcagccgccgccagggcctctgcacaccggtcccaaacaaccgcgccgagcgcgctggcaggaaaccacccgagccggctccaaagagagagccccgcgtgcgcaacagggaagagagatcgcaccttagtccgagcacgccggcaccctaacctgaactgccaacctccaaaactaagagtggggcgggagaccaaaatatgccccaccaccaccttaaagacaagatgcacctgaaggggagccataagagacaaaaacaccggagcccgctgcccggcccctagagggcgggcagcgagccacagatgtatcagcccctacggcaccgccaaacggaaatcagaccaaaaggcggaagaagaggctattcgggagaagggcacacaccaaacccggaaggcaggcaatccagagaacgggggccaggaggaacggcacctggggaaagcaaactacccggtagcaaggggagaatcctctcggggccgggcgggggggttcctaacagaaccctgccaggcggacaaaacccgagagtaaaagcgcgccggccgtgccctaacgggggagaccccgagcccaaaaaagcctcgaagccccgggcgaaggtgccgcggccgggaaacaccccaaggcggtaccccgttcccaagaccgggaccccccgga

SEQ ID NO: 6565 - DNA, 1761 bp, Homo sapiens
  misc_feature (1)...(1761): n = A,T,C or G
ccgccatgatacgtcttcctcctaagtgactatcgtcctgcgcttcgtncagagagctctcggtggcactgaggacgtctttcagtccgctccgtcgtggcgaacgtaaggagtagtttcattgccggcgtctcacgtgagtgtccacacgcccgagacgatccgcgaggcgtctntccatagcccactcatctcgcacgcaccatgtcctgcgcagctctctgcgaccgctagcgatctctatgtcgtgactatgctntntgcatatgtgctgagcgatactgcgagcgactcggaagaccgcgactcngnccacgtcccacncacaggcncagcactctagacagtggcngtacatgtcagatgagatatacacttgacgtacgatgtcatcttatctgtctctgacacatactcgtggtcgtcacttcgttcagccagcgccacagcgctctcagtacacaaggcgtcgtgcatgaccgtcgtgactcgtgcgtagatgatgcgaatagatgagacccantctgtcgtgtatccgtcgatctantcaattatctacttctacaaggcctcactatcatgtctgcncacctatcgttacatcatctgtcagcctacgcactcctaacacacatcccatcctacggcttgactagctactcaatacagcatgcatccacgtagcacgcttactcaactctaagtagcacctcgccgcaatgtgcagtcgccaccggccatagctctagtctgcttgaacatactacntgcattgcgcactaacagtcgcctagatgtcactccgtcgtcacgtctccgtcgcnncgtgttgcgtggtatnttagatgagtcgacaaggatctcacatatgaagtgtacgataatgatcagcgtgcgtcgacgtctctgntgtcacntatgctctagcgcgatcgcacactagctacatactccactatgcgtcgccgtcatacatgcatagtggtngatcagtactcggatagctagtgagcncgtgacgattgtgctattcattattaaactatcagtatgatcatgacgcnaccgtagtctcgcgagaagtatcgacagagcgtatgntcactacgctcctggcagagtcntcnantatcctctcatagtctagatgnctatacatccacagagcatcgtaccgctgctgactcgcctgcatactnatcatcacgtntcaccantctatcagctcgtctactacatacatatagatanatgtgagagtacacggaattcacacgatcagtngtatgtacnctttcaatcgtgtantatactgatacgtatatgagatagtantntcactcacaatcatatgtatntcganctntaaattctgatcatcatgtatcatacatatagtatcgcgcatatacgntagngcatacgacactagatactcaggccgtctccatcgctgctctgcactctgcgtagtntacgactctngctgtcgtacgtgacttnagatcntcagtccaagatcgctccngctggtcgatcncgcnacgcactatcgcctcgtctccgantctatacgtactcacaccactgagccacactgcactacacctctctcnctctcgtggacgcttgctctctcgtacatgcatantgtatgacaccactacgcctacactccaccaatatcactatctccagtgtcgcactctcnctggtgcatcccgagnacagagacatcgaacacatcgtacngctatatcg

SEQ ID NO: 6566 - DNA, 1165 bp, Homo sapiens
  misc_feature (1)...(1165): n = A,T,C or G
acgtagtntgcggccgttccaccacctgtacgcactttcgcgtgttcacacccacacacgcgacccgacccgcatcgcctccccctcgtcgtagtcaggcgctcgttcacgcctccacgcgacctttctccctcattcgtcagtcgcgctccgcccgcgcgcacctcgcctcccggcacccatcgtcctcgcttagcatcgccgttcgtccacgaagttttnagcacagtttgctgccacgtcnctccacgcgcacaacatactggttcaaccagcggcntatcgnttccacccgcaccacacacctctttcacgcatcccgcgcacaatcaaaatnnngaagaggattttacattttcaagagttacccagatggtcccgccttcgagtggcggntccaacccggcgttaacaaaaccgtggtccccgcanttccagcgacaacgacgntnanttacagcgacccagtaccaccacaaaaattacacgacgtcgtntccacgacccacgtacaccagaantcacgcgctccgtacccgtattccaccaatcgcccagcccgtaccacntgagcaacgcgtcantccgtnntcgcaaaacaaaagggaagggcccnccnttacgccgttntaagcaccaacgtnagtacccgtnagtaccacccgcgccaatagcgcgtcgtcaccacacacagtcgaccctagacagntattttccccccacgaacacngggaaacccngtccaccgtggannnggtgcaatatatttcgtcccagtggacataccaacaccaacgtccaacagtaccataatcgtaataggttcagaaaggtggtcccccgtgcgccgccgtgtacaccatcccacccacacgacatccatgcggtcgttccccgtgaaacgcgggcgcggggttcaccaggtaggtctcacaaaaaaaagggaataaggagtagttagcaaatagagtggttttcgcacccaaggcgatagggganggccagtccccgttagcccgcgcggtagtagcnggggccgaangacngacanggagcccccaagcntcnggtttgtcaacacccaacccccgtatactaaaaaaaccaccccaaaccgtaacatcattataaggtgagctaggaggggtagccagacatcagatgc

SEQ ID NO: 6567 - DNA, 760 bp, Homo sapiens
aggaaaaaggcatctatgatcaaactctggagttccggtggggaggggattggccgggcaatacgggtgggctcgatcggccagggggggggggccaccaggcaggggtccgtaactaataggaaatgcttatttgggaggaagcaagcctgtaactgacgtaaggtgggggaaatagtgtaaatagtgggtgtgacatagcaagcgggaggaggggaggggggggggaaggcacgaagcgataaaaacagaagaacggtatgaagggggagaaaaacgggactgggagggggtatatggactaagcaaacaaagaatggacggtgacgatgcgggttgacgtcaggaggagacaaagggggggggggggagacagataacgggaggaaaagggacatgggtgtgggggggtatgagtgacttatgcatgagcaatgcggtggcccagggagaaatagaagagcgaggtacgcaaaatcggattgccgagtggaaaggcgtgggctgggtgacaaatcaaaggtgtatacacgcagacggaataaaaaagaggagggttggagtgggaaaaaggacaactgaaaacaggtgtggaagaggggagaaatataataaggtgaggtgcgagagggggttttactaatatatcggaaagaaggcggcgcgggtgatactgagagtgggaacgtgggaattgtgagaagagcaactcaaaaaagggtgggtaaagggatcagaagaaggaagagggatcgtgaaa

SEQ ID NO: 6568 - DNA, 903 bp, Homo sapiens
  misc_feature (1)...(903): n = A,T,C or G
aactttaactctatcgcgaatttaacacaatattaaatcttatcatacaacaatgcgtagtccatgtagattgttgaacatataaataatgttataattacacacccacctacttcatctttctatatcgtacaactgtgacattggtgtaataactacaatattgatctctcttaatattttagcactcttagagccataatgcttatgcgttgtactcatattatcatgtaatcacanttcactatcatatcgctatagttgcccttgttaatgatggccataatatagcatattaagcactcactggnaggttgattatataaacgatactagtatatatcatattaatatatactaatcatcattttatatttatattttgtaaagtagtgtaaataaaaataacattacaaactcatcctcatacagtccaaaaaagtattggacaatatttcatttgtgtgtcctagatggtgtgaataaaatagaaataaaatggacttcaaaaaagataggggcttcaacatttaatttttaataaaacattaactcctaaaaacttcaaggcccaagtcggggctttaaaaaaataatacaaattctctctttcaaacagatcatttggtggggtttgttataatgatccagactcgtccattgtnaaaaaaaatggtcatattctttatttattgcaaaaagaaccttgatgttcagttgaaggtgacctttctctagcctcagggggtaaagcataattagtccaagatagccatagtagtcttgccagtgactggtttagacatgggcatgaagaccagtcttggccaataggaagtgagggaacgtccattgggtgacttctgggtaaggctttcagaagaatgtagagtactacgaccg

SEQ ID NO: 6569 - DNA, 1045 bp, Homo sapiens
  misc_feature (1)...(1045): n = A,T,C or G
ggcgattatattccctacacggcgccctatgtcgacgccgggtgcgtgatatgtgggacggtgcagaactgcgaggcctgctccacccagcaccacaatcaactctactatggggacgctgggctcctattacaacacggcgtgggagcgcacgccgacgacgacgtgacctcggcgctatgctgacgtaactctacanactcagcataacaagtaaaacgcaacgtaacgacgagaagtgttagcagcgcgcaggtgacactaaccgctgccgacgatccgcgcgccacgacttgcgactgcgaagccacagcatagcgacgcacaacactagattaccctctccaccgccgnccaaactcgcataacccacgtccatcactacccccgcagaccgcccataaccacatgcggcggggcgagtcgcgcacggcgcgccgggtatgaccgcgtcatccaaacgcgacctcaggaccgcccctgccgcctatctctgaagtaccacccgctatgcatcacacgcacctgaccagcagctatgcgacaagagtcgggcgttgtaaagtaagatgccactggaatcgcctnggaccccaacgaccgtgcccggcgccccacgcaccccccccccactacccgcagcgcttgcgccacgcttcggactaatcaaactacacaccgcccacgcccgaaccgccacacgaacgcaccacaccccccccacaacacggcacgcagtcggctcaagaggctgtgggcgtctcaggtgctggggggggcgttcggcggggaccgacgggcgcgcgccgggcttgcgcctcacgtcctcacgcttgtgggggggtgcttgtggtggtgggctgccgcgcgcggctctggccgccccgccccccccgcgtcgccccccgtcgccgngcccctcgcgtttgtgccccccccgcctgggccggttcggccgtctaactcttttccctctgtctttttttaagttttgcttctctccacaagaggtttcgcgaagttacaacccccccccctccccacc

SEQ ID NO: 6570 - DNA, 506 bp, Homo sapiens
agtccaagaacttgaccatggaccggccttggcttttgtgcagggtgacctcatgggcatttgatccctcggtcttcagccttttaactcaaaaagtggcataaaacattgcgaaggcaaaaatttaatggcaagagattttctgtgtgtggggggaaatgaaatttattttccaggaaacagcgttgttgccaaactcctgggaaaggtaggagccatttgaagattattcttttcatgtactaagctcttgattggagacctgagtagaggaggaaagaaagacttttgctcctttggtttccaagaggacggtatccacttcgttgtttcatttatttttcccccccactggggggttatgaaggataaataccggaaagaggcacgcgggccgggggggaactccctttctggggaccactgcgccccaatatgacactatgtgtgttgttgaaaaagaatagtttttgtcctgaaacacaagagaacattcaccccaagag

SEQ ID NO: 6571 - DNA, 347 bp, Homo sapiens
ataaaagtaagtcgagttgatcgtctagtaattagtgtcaaaccacactagtggtgtgggcatcgaattttcaatcaataaaaaataaataatatacaccacacctcctctgcgcgatattcggttacagtgataatgtgaaaaacagcttatgcgcgatgttcatcttatgaacggtcggcgaagatctatctagtgtcgagcataactgtacaaacaacttcattctcttcattactagctaatgaagtcatctaattccttcaactcaatctaacgcaataatgaacatttaatgaatcagacgatgttattgattagacttgtgattactcgcagcaatcact

SEQ ID NO: 6572 - DNA, 940 bp, Homo sapiens
  misc_feature (1)...(940): n = A,T,C or G
tggcccgcggtacgtgcggcgggcgggnnncagcggcgccgcgacgcggccggaacgtgttgcgcggtgcgcctgcagtgctccttgtttgcgcccccccctgccgtgtccgctgggtgcccggccttttctttcctcccctcccttgctgcttggggggtgggacccaatctcccttnttccccggnncgtcccctccccgggtgccgtttgttggggctggccggtcccttgcgccttctccctgtgggggtctgtgtcgccggttggcctgcctcctcctgctcctctcttcccggggggggggctccccttccctccttcntccaacaaacctccccttccttctccncttcctcccccccccccccctcctctctccccccccttttcttcttttnactctccttccccctctctcccccctcttttcccttcccctacccttccttcttcccccttttcccctccctccctcctctcctcccccccgtccccctccctcctcgccctcttttcctcttccctccccccccccctcccctccctccccccctcccctcccccccgcccatctnccccccttccttctctccgcccttttccccccccggctggctgcctcttccgttgccggcgcgcgcgcgcgcgctgtgcgggcgcgtgtcgcggcggtgcccccgcggggggcccgggtcgggcgcntcgtcgggtgggggggtgcggtgggtgggccggggcgggtgcggtgtggtggggtgccctggtcgcgctccggcgcgcggccgcggcccgcccgctccgcggggcggcncgccggcgtggggcgnccttgcctccgtgcggggccggctctcgcgcgcccggcggcggcgcgggtggggcggctggcgtttgtggggtgggggtttgggtacccggggtggtgggggtggtgtgg

SEQ ID NO: 6573 - DNA, 851 bp, Homo sapiens
ccttgcgatccacatttatttatcatttgtataagatgggacgtgcatggcagatagctgctatacactctgttgacacatgcccgacctccgctccagcctctattcattactttgtcctactgacgagcccattttaattatgcaggcatgtggtttttcatatttcacatgctctcagattagaataatatctcttcaccattgaaagacccccagaagtaacatgaggttcatatacaaaatctatcacttagtcacaactagttcttctaccaaattttgggctttgacaagggctggagaccagactgttaatcatagaacccttgcgataacagcttcacagcaccctgcctatgaatactgctgagggaatagtgttgactactataacaacgtccgggagtacatgcccctgattcccatgctgactgtttgggtggtactacgagctatctgcaaacgatatgcaccatgggaggtgatacacatgttgtgtactatgccagcaattgtgatccctttaatgaccctgtggactgtcccatgcggtggtcactttcttggtggccttccgggacatggtactaaccctgggcccgagacatgtcgtgttctgcctacctatgctcaggttggtcttgggggctaatgccgaactccggttcaggaacttttgcgggttggaggaccttggccaggatccggccgcagttgttttccggcagttcctgtaccggggttgtaaaatatgcctgaaataacttcagggaggggggccaaggtcccggccggttaaaataattctgggacggcgtcttggctcaaagaactttggaaccccggcg

SEQ ID NO: 6574 - DNA, 820 bp, Homo sapiens
tcatactaccttcgcacccccccaaaagtacccctgtaactacccaccccaaatttcctcttcacaccccaggttcataccacaaacatcctattaataatcttctgtccagcgaaggacgcctaacgtctatctctatatttttaaacacgcaaggaaggtggttttcttttttacacttttctcaaggatcgctcatcccatttccctccctgtctttctatatttttactttccaaaccccaaggagcgattgcgcacagttttttaaaatctaaaaaacaattgtgcgatactccctttagtatccctttgcgccatatagttaaaaaaaaactttttttacaaccaaagtaggaatatatagtaagatgtagttacaatgagtatattcccttttgatgctaggttttgcttttttccccccaagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcctgccctgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtagact

SEQ ID NO: 6575 - DNA, 869 bp, Homo sapiens
  misc_feature (1)...(869): n = A,T,C or G
aggtgggccttggttgtatcaagtatagctatttaaactgactgggcttagggagggcgatgagacggggggactctgtgttcgttgtgctggtggtcgtatcatttgtgattcgttttgcattcggatgggtcgcacggatgttctcgggtgttatcacctacatgtgtcaatggtgtgcaaagtttgtgcttagaggagttgttggcactgggaactggggtggtcctggacacgggtttttggactgaaaaacatatgaaacatgggggatccacatcccatatatgagaaggccacattggcacagggttggtggggtgatggctgtgttcgatttggtcacacaggggaacaaaaattgactacaccggctggggaaaaatagggggacgtgcggggtcgggtacgcacaagggccgaccacccagtgcggggtgggaaatacggggtcaaatgaggtgggtctttgggggggtatgggtcaacaacactcaacaagggagggacacatgatcacatgttggatggggcaacaacaaatgtggtggggaaacacaactgtggggaggcaaacacaacacaaccggggggaacactgtgctgtttccactctccctcatctcccggtgtgtgggacataatacctagggtgccaataccatggtggggggtggtgaggcatgggtgacaataaatacgagaagggggaacaatgaattaacattggtggtgggggtgtaagatgtacaagntggacgtcctctacatcgcctcttcttttactgtggtcacacacggggtgtggtggtgggggtgtgaaatggcaattgggggggggggggaagggaaagggcaatgacaggggg

SEQ ID NO: 6576 - DNA, 1007 bp, Homo sapiens
  misc_feature (1)...(1007): n = A,T,C or G
cgttgcccgctgttctaccggggtaccacagtgtttgtttatatctgtttgttcccctatgccttgttgattgtccgtaacaccactgtacccgcgcatccacgaacccaatgttacactatcatgttccagaatacaccgcaattattcgatcatattatcaccacacctcatggtgcgtactccccacacacacacctgattccgtttattttatttgttgtgtcccaccacccccgtgtgtttccccgtgtttccgtccccaccggtgttcctgtctcccccccccattcccacccccccttgttattcctccccactctgctccccacatccacccttgttccccgcccccccctattttttccccgtttttttttcttccccctcctctccttcntcacancatgtctccttgtgtgtgactcccacacncgtgtgccacccacttccgtgttatattttattccgttcgttgcccaccccctccccggcgtgttccgtacgtttctcccattccccccggtcacgtgtgttgcccctttccctttaccaatgatgtatgtgacgtgaaagcagggtccccacccctaattaaaccccataataattaagacagtgtaactcccccccaggcacacaccggggtgtgataccccgagcactctactaccgagttttattatcaccccttgttattgcccaaccgacagacccaccggctacaatttcacttcaccacaaacgaagcgggaaaaaatacgcagaggagcacagctttcccttagttcccacccggtattaggcctggtctcactataattaattattcacacaggggggccggggaatataaaacatattatgtccttccgcgatgcattagtagtgtccgtaaggcccccgtgccataatggaacacagtgaccccgcaaagctccccatcaccccggttctccttggcctccgcttcttataagagtgatnaataaatacagctcaggccg

SEQ ID NO: 6577 - DNA, 307 bp, Homo sapiens
  misc_feature (1)...(307): n = A,T,C or G
gggnngcatngangaggaggaggagtagtagagtgagatctgaagttatggaaaaagggtagggagtagcaagagaaaggtgtgaacggggcggggaaggggagtgtagtgtgcgagcgggggccgcccgagcggcgcgacgaagcagcgagacgcagcttgcgggaggtggagtggggccggggagcccgcgacaacgggcgcgcctgcacaaggccgaaacactgacgtaaattaaaaatattgtaatacaaaatacgtaatacggggagtagaaggatgagtataatacttagggagtgacagg

SEQ ID NO: 6578 - DNA, 829 bp, Homo sapiens
ctaacaattttctttcgtatatttgttttatatcccagcaatgagttcggcttcccttgtcagattttgcctcaaacaccaaaaaagatactacttcactcttcccgcctttctgttggatgtgtgttaaaggggcccttagcaaaaaaaataaagggggggggctcccacgacacagagattcttggagtattagatagtttttacaattataattctccaggttagtaaatggaaacagcaaaacgggactaaggtttttatgaataaaaagatttttccaaaagaagtgccccctggaaagaccacccattagtctaaaaaaagggaattcaacaatcccttgaaatttcttaagggtaaagatcctatgtgacaaaaccctctgccctttcttaggtaggaaaaaataggtttgtataaagtttcaaacctggtatccaccagagcactcaggactgtggctcgcaatttacgtgctggcttgcagcttcaattgccctatgtgttgccttctgtaatgtatttttcctggttacctaataactcacatttatctaaacaccatagcatctctgaggctctgactcatccccttatttggaagatgctagctatctccccacactggtattttaaaatccagcattaattacagtaattccttctactcatccatacaggctcatgcagaaagaagtgaaaagttatttgtttcttttttccttcataaagagcctaaagaaatgtgttaattaactacaaagttagccaagattggatttcatttttttgattttatagatggcctcacgtcaaaaaaactcgg

SEQ ID NO: 6579 - DNA, 780 bp, Homo sapiens
  misc_feature (1)...(780): n = A,T,C or G
tttcccttttctttttttttttcctccaccccttttttccatttgcttttttacattttctttttcaacctttggatttaaaattaaaactcggggtagaaggactcgtcactaaatattcctgtattttacaaattgcccacactttataaaacgggtggaaaagaatcggtgtgcagaaaaggaaaaactatttttttaacgcagttagtattgttaagaacaagcggtatgggggggacgaacggcacagaaatatagagggaaacaaagtttgaagttgtatgtgtaagctgctaaagaaaagacaacaaaatggtggtgtgaataagataataatccaagaaaatgggtgggtgaaaataacaaccaacaacaaacggggaaaaaaccgggtggaaaacgaacgggggacgtaaccggggggtggtggtgtgaaatatgaactgggggaaactgaaaatggggatggacagacaattatgatgacggaccagggaagtggtatgacacgggtgaaatgtgatgngagtcataatacatggcagtgggaagggaaaatggtggcggtggaacaagtacaggactgtatgggaaggggacacaaaataggggaggacggggacacaaaaacaccaaacgggcacgtgtacaacacaaccactgagggaaaagggtgtggggtaaaaaggtaaaacaagtggtattacctggaacggaacagggatggtccagaaacaccaacaactgttttagtgaaatcaaggacatgactattaa

SEQ ID NO: 6580 - DNA, 260 bp, Homo sapiens
caacaaacactgtatgtctcaatacctccatctattccacatcccccccccccgcgccccctaatcttaccccatatcaatatatacataacatccctacctcttactagtgccatagtcccctacatgataatctataattaatatccctcttcgcctacaatgagttattagtgtaaccatgcatcacgctcgattcagttctagtactcacaacaacttgcgtctcgccgtcttaccacacctcatcactacgcacc

SEQ ID NO: 6581 - DNA, 689 bp, Homo sapiens
aactataaaacgatgatgaatcaaacccggctcctccactggggtgaacataagggcccagctgtgtcccgactcctagaatagacggtgggcttgcagcggattgattgtcattgaaactgtctatcgaatgaatctaactctgaaatgggattggaattttgaacaggttgaccctgacttaaaattccaacttcaccactgacaagttgtgttaccactggaaatgaatagtacgctcgttgggctgcggttcccggagaagaccgtgagggcaaacccgtaggcttcaaaaagttgatgaacagatcatagagagattggggaatgtactccaaacgcacactattcccttaattattgtttatttgttgatctcggcgactagctatgctctccaaacctgaggggggtggttgtaagcattaaggtatcgaggtgagtttatgatgagatctcgaagaacagataagccaaatgaatttagaatctctgttcgaatgaaatagatattattgctcagataacgggcgtactttgatggacaagaagggaacttaatgtatgtaagtgagcgtggtgttacgtgatagatcattatatgaatttcatacaataataggtattcgtaatgaattgtattaacgcataattgtaggattgttcaatgtcgtctttgacggtgagag

SEQ ID NO: 6582 - DNA, 817 bp, Homo sapiens
accaaaagactcacccgcttgttatcatagatatgttatgccaccgggacccctcagtttctttccacacccaaaatatctcatttttaaatcccccacacattcgcgtttcttggccaacggcgatacgcatattaactaagactcctaatgtgcgaaccagccaaacgctcacactaatatcttcacaccaaacaatctttttcccataatgctccataggtcatgtcttctaaggttccccccatcttttcgtacagaatctctgatcacctgaggttaacattccaccacccgccgcgccttgtcattttcctacaaaagtcatggttagcaccaattaactccacttaggtggtcgtcatcacatctgagtccccaatcagaaattcaggacccatttccatgcaaagggcagcgttgtttttacgattcaaaattgtcatttccaatgagatattggttggcaacaattgtttcactgtttcaaggtataatgggttatcattaactcatttctgtaaagcagaatacaagacctcaacctgttagagatcctttgttgattaacaagctgattaataagctgattgttctcatgatttaaggcctataccaaaattcttgaagctcaatttgcaccacagagtacgccaatatgtttgagtgaactggctctggctctccgaagctgttttgtaaagacaagagactataagccatggtgagtagttatacatgaagaacctcaattattgccttacatatggcatgaggagactagaaattttcttgttaatggggcaggggtataata

SEQ ID NO: 6583 - DNA, 1084 bp, Homo sapiens
  misc_feature (1)...(1084): n = A,T,C or G
agaaaacagggacgggcgaacaaccagagagaactcctatggagactggccccaatctttgcagggggaaacgnaaagcgcgnccccgcggacgaccccgaaacgcgtttttcgcagacggggggggacggcgggatctgacgcacagcaagcaggccaacaccgcgaagcaaccgggcccgggcgcgttccacagacaggagagaaaaatggaaacgagcccacgttgcggcgaatagacaggcaaaatcgacaacacagcgaggaacgtaacgcggagaacgcggggacgcgagggggaacacacttctcttttttttggggaggaccgcgggaggacgacagagcaggccatccacgtgagggtgggcgccgggacccggccaaccgacccacggggaaatacaaactggagcagacgtgatatacacatgcaagagagaaacagggaggggcgggacaccagggcgcggcacacggaacgcacaattgaagatctcagacgaacagtggggattaacaaggctggagacgaacggcgacagacatacaccggaggcgagcgctgcgaaaccgcgagaaaaacgaaaagaagcaggcgcggctagccaaacgggacgaaagggcacgacgcgacccctgcacgacgaaacagcagcagagagacaacaaacggctcgggcgggagccgtcggcgccgccgaggcgtcaccacgatgacaccaaaacaacacggataggggaggggatggaggacccgcaacaaggagcgaggcaatcagcgaggaaacaccggcgcggccaagcactcggggcaaggcacagacgcgcgggacggacggcggacaaaaagaancacgagcgagcacacggcgcgcaaaataagaaaaagcgagagaacgcaggacaaagcagtggagacatggcgggggcgagcaataaatcggcgataaaaaacggngcgactagagctttctactcgtgacaaaagtgactgcggcgagtgtggaaattaaacgttcaaccgtgggcgggtggcgcggcggaagccgacaggcggacaggcaaaacacatgaaacancg

SEQ ID NO: 6584 - DNA, 942 bp, Homo sapiens
  misc_feature (1)...(942): n = A,T,C or G
ataatatcatgattctaggtttagaagagtctaactacatgtatccaaacacacgccgctcgtcatgctttctctctccntcatcacacaaattttcctattctctctcccctcatctcttttgataatcattctatatcatcgaaccttcgtattctattatacgatgctatatgtctaaatcacaacgagcatctcactgtaataataactgcctgatcttttatcaaaatcttatctttattattttactacgtgctctttcactaatttcatcccctccccatattcccgtctgcgcgatctcccggaatcgatacatttaccgtactcatttcgtacaacttcctgatatgttactttataaccaaactatcctattcctaacaacaattactatattcaatatctggttatttccgaccccgtcttgtacatgatttcccgtcattttcattcccgacgatcaactctcgccggattcacatcacatcagcgcctctatatcttgccaattatttcgagtacgattacatatcattttccatccctttttatgttaaattatccctctacttttttttctgccaaattcctgcttgtaatgcgccgattaataaacatttttattttcttttctctcacaagacgaagtatgcttcttaaatacattttttgtggttgtttaagagttcgcaacaatacattttaaaataatttaagtatatcttctaatccaactatagcacttcacatgtagtgccaataccttataataaagtattcccaactctcccatcccttatgatgttgctgtcattaatttcctgtattcacattgtataattaccgaatgcatcattacatcaattaaaaataagaaaaataaaatcgatgcggccgtcaacttcacctacgaccactctgccttaaaccctctcc

SEQ ID NO: 6585 - DNA, 1391 bp, Homo sapiens
  misc_feature (1)...(1391): n = A,T,C or G
ggtatattcgtattgtatccctttacatnagacctctcgacgcgatctagtagatccgctgcggaagttatacatactaaaacaatctcacggcntctcggccatctccttctcacatgcaacagagctcataaacatacgcgctccgctgcccgtattactcgtacgtacgccctatgtctgcgctcgctcttacggtacgctgctggaacgacgtcgctaaccaggaacgatattacgcnccattctatctgcacctctactactactctagtcatactattgtctaacgagagtgagtactgtcgtacggaactgcaacatagagagcatatgtactgatgtaataattgagaacacacctagctcatacttcactcacactactcgtaatatcgagatcagtcactacacacgcaaccatcacacttcttactaatctttaatctcttcatcgcctttactatcacanaaattctttcttcacacgagtgtgatgcgctccactactgcgattctgagtgccaaaatgctatttctttgtggttgcaatgtcgnnncactacatgacactccccatctctcactcgtatatactcatggacatatnaangactattatcacaacctacatacaatatatatatatcaanatcgtgtcgtgcgttggtactctgatgttgagcccctcacncgccttctgtctccttgtcaattcctcgcttgctctccgatagtcgtgtctcagatatgcgtaagagtggttggtncttcttctctccnctctacaggagagaataatataataattaacacatcgtaggaacgtaagcgtgtataactgtcttctcnttataccagtacctccgcncatcatcttgtatattggttgactatatgtatgatccgctggcgngcttccgtttctacacacgcatgactgtgcagctcctcttattgatttagtctctctgactggtcgtcgcgcactaggctacccgancgccactacacctgcgcgcgacgtcgggacgaccactcgtagtcttgcttcggcgtntgctgtatataattatgtcgatagtgcgtcgttgtctcgactggccccacaccagcgcgcctctgttttcactttataaaaacacaaagataattataagtaacacacacncacangnacttaagtatgatatacaacacccaccctcattcttcccttcactcccttctnccttattctctcctcnnngagtggttangaccttcccncccacatccctcccccccgctggtctctctccattaagttatatattcaattttcttcttcaatctctaaaatcataaaacgtnntcagaaatatatacaaaaaaaaaatattataccaccc

SEQ ID NO: 6586 - DNA, 264 bp, Homo sapiens
tcatcactacacttccctctcaccagataatcactatacgcggctaccacgttccacttggatcgccacgaccatcgtgatttagtttcccactgtggtatgaatccattcttgcttgtctccaacgcgtaaccagttacacgtgaccggcctaaaatataaaaaggcaggacaatattactataagaacagggacgacgctatgaaacagcatcccggttaacctctaaatcaggaccagtgtaggagtgtgtgccacctgtc

SEQ ID NO: 6587 - DNA, 369 bp, Homo sapiens
cgtcacgcgcgcctctgcgtaatgtacccctcgcgctgtcctcgccgacgacaaagtgtcggagcatcccgactaaatggaaaaaggtaaagggcacaaagtcgacgacaaaccggaacaacgagatcacgtcggcgcgtgcctggccccactcctagtccgtcgcctcgctgcgcatatactgctgccgcccagcggggataactatcgcgccccacaagcgggtcagaaccatcccgagtactttggcggacaaccgtataaatcaaaacacaggcgcgaagggaggactattaccgaaatcaagcaggaattgcttacgcgctacaaacggcgaacatatgactactaaaaaataaggtagtgttt

SEQ ID NO: 6588 - DNA, 427 bp, Homo sapiens
  misc_feature (1)...(427): n = A,T,C or G
cttagagtccggctctgccaccctgnatgaagttcagcggcatgatttcagctcactgtaaaactccgccatcagggataagtcatcctcccacttcagtctcctgagtatctgggactacaggcacgtgccaccatacctggctttttttttttttttttttttttcgggggagacacagtttttccatattgctcaggctggtcttgaactcctgggcacaaggtatctgcctgtcatggcctcctaaagtgctgggattgcggacgtgaacccctgtgcctggctgacttatttttaaataacttctgaaaatgcacaaagcttaattgtgtagcttggtatattttcacaaatgtatacacttctgtaactattacccaactcaaaataaaaaaaaaaaacatttccttcaaaaaaaaaaaaa

SEQ ID NO: 6589 - DNA, 693 bp, Homo sapiens
agtcgggggggcgggggggggggcgggctccccgggagcgcggcccccggcgcccccccgccgcgcggcgccttgtgcgattgggtgtccctcctctcggggttgtcggtcgggggggcggcgcggcgcgggcggcgcgggcttttggcgctcgtggcttctctggcgttgtttctttctgcgcgggtcgcctgggggcgggcgtgggtccgtgggctctctcgcctcctgggcgtggtgcggctggccgcgccggggttgtcggccgggtggctgttcgtccttgtgtgtggggtggggggcttctttccctgggtgctttggccccctcgccctcttggcgccccgcgcccgcgccccccccgtggcttccgcggcgcggggggccggggcgggggcttagggcccgcggcgggggggtctcggggcccgtttgggggggggggccggcggggcgcgggcccgggggggcggcccccggccccggggcccgggggttccgccccccccgttttttcccccccccggttttggggctccggggctcgtggccctgccggccccccccccgtttccccttgcggggggccccctccttttttttttttttcggtttttttgggtgggggctgttttctttttttgtggcccccccccccccccccccccttcccccccccccccccctgcccc

SEQ ID NO: 6590 - DNA, 672 bp, Homo sapiens
cgggggccgggggtggtcggtgccccggggcgccgctcccctgttcccgggggcccggtcgtctggggggtctgggcggcgctctccgctgctggctcggcgtccggtgcggtgggcgggggcgggggtggcttgtgtggcgcgcgcggcggccccgtgccggcggcttggggtgtgcggggggggccgggtggggggttggggcctcgcccgcttcggccgggcggggggcgggggggcgccgcggggggtggggggggcgcggcgggggcggctcccggttccccccgggcgccgctcgctctccgtcccctcctctccccttcccctttgggcggcgttttgttcttctcccctgctttgggggccgggtgtcgtccgccccgtcggcgggcggccccggggccgcgtgttgcgggggggcgggcggtcccccgcctgcgcggcgcgccccggggccccggggcccgcggggtctttgcgcccttttttctcccccccccttgtttctgcccccggcgggtttggggccggttgggcccccccccctttctcccgccggggttttcgccccctttttgtttttcttgttttttttcgttggggggtttttttttttttggttgcccccccctctttttccccccttcttcccccccccccccccctccc

SEQ ID NO: 6591 - DNA, 783 bp, Homo sapiens
  misc_feature (1)...(783): n = A,T,C or G
ccgcgttgccgagcaaccaccaaccgaacaccggacaaccaaccgccgccggccgccaatgacnagtctccacaaccacaccgccccacaaacacgcggcccgcacggctaccggagaaacggcgcgagcacgagaagcctaagaaatcaaccgcgcgcccgcgacacgccactgttcatcacgccgactcgcctgcgccccacacgccagggactatataccgctggcccgggcttggaccactccacctatgcgcccgataacgcagcccccgcagcacttccaaaagcctaaatttgcgccggataaaaatggtccctgtttgcgtagtctacccacgggaagacccactacagccttctgaatcccacgaaaccctttccatttgaccagtatcctcagcaaatccatgacatgctctgaaacttgcaatgcctgcagcccccattggcgaacagaaggggtccaattattatccatgacaatgcctgaccgcacactgcacaaccaacgattaaaactgagcttcgaagctttgcctcatccgccatactcacctgacctcttgccggctgagtagcacttctttaagcatctcaacaactttttgcatagaaaatacttccacaaacagcaggatgcagaatatgcttcccaagagttcatcgaatcctcaagcatggatttttacactgcaggaaccacgaacttatttcttgttggcaaaaatatgttaattgtaatggttcctatttttattaataaagcaatgatgctgtccg

SEQ ID NO: 6592 - DNA, 799 bp, Homo sapiens
  misc_feature (1)...(799): n = A,T,C or G
ctcatttctcctcgtcggctccggccgctcggtaggtacgcgcgtcagtctatcctgcggtgggggggggttatgtcttacgtcccgttcgtgaaatatctgctttggggcggtatgtggaagggcttcttctcttctcgcgctgttgtggcgcggtccgcgtccttcttcccagcgtctttcctccataccagcctccccccacgcctggtgacgcgcccgcgttggtgcgtgtccgcgcgccggttccttggttctcgcgggcccttcgccgtttggataccgtctttctgtctccccccgttctcgctatggcggcggggcgggcgcccgtctcgtttgcatcgccgtccgcctcgggttataatggagtggtttgccggggatggcacaacgccagccgagatgcacttttggcggnnnnnaaacccgcggggggcaacacacgtttttttttgggcgagggggccccccccttttttttttttccccccgggggggttttttccccccccctttctttttaaggggggggggttttttttttttccccccccccccgggggtttttttttttagaccccccccccccgggggggcccccccccctcttttttgggggggggggggggggggcctttttttttccccccccgggggggtcgggggggccccctcaccccccccaggggggggggggggaaaaaaaccctctccttggttttaaaaaaaaaagggtttttttccccccccttggggccccccccccccccgggaaaaaaaattttttccccccccc

SEQ ID NO: 6593 - DNA, 911 bp, Homo sapiens
  misc_feature (1)...(911): n = A,T,C or G
ggattcctctcagccagcctgggtcggacacgagctgcagatatgggtcctggcaacgtgtatgcggtctccatgcacgcctgttagattgtgtgcgcgtgcactttagacgtaatgcgcctacattttgttattttgttttttttgtgggacttatgcgggtcggcatcgggctcggatctatcctgtgtcccctcgttgacctccttatacccatcatcttatcttatcattttctggtttgctagtctgcggtgggacaaggtcgcgactcgtccatagcgccgttagttagatgcgagactgtctaaccaatcggtagtgcganatatcgcggcgtgttagttctatagaaacgttattgatactatgtacgactcgtccacgcaattacttattcgtgcgtgaaaagatagtgcaggcttatactaatgttatccattgctggtcttatgtctggtcacgcgcgcgatagatctctcttccgccattggctagatttattcgaaggatgtgtcgcagcgtgggcgtttgcgtgttctctcttgtcatacgatgtatatctattatgctcgagagcgccctactatccaatacgtgtttctcgtaacgctcgtcggtcatatcattgagttacatatttgtcaccatgatctgcaagcggactttcattcgcgatctttgtatgcaanttgtggttacactctacgcgtggagtcgtacccggctgcggcgccgccgccgcgtantcacgcnncatttaatttctcaactattattttcttcatctattatntattatttccagacgatatgacgtctancgtctcgaatccgcacctttagatgatcatggtacgaataagggtgacgcgtgtaactatccacaatatatctgcgtgcgcatcgcg

SEQ ID NO: 6594 - DNA, 1605 bp, Homo sapiens
  misc_feature (1)...(1605): n = A,T,C or G
agaaaaaaaaacnccgncgaggggggaggngtaggagacggcgaacgccagtgcgccccgccgaccagcggggagcacaccagcgaaccacacaaaaaaaaacaaaccttagagaaaaaagaaaaaaaggaaaagaaagaaaagctctcgcgcgggngggagnggaaccacgacagaagacaaacaccacccgacaaggacgacacaccgccagcaaaaggagaacgcctttcagaaagagaagngaggggaaacaacagagcagagagaaccgngcagagcccacacgcgccgcagcgcagagcgcgcgacaagcaacagcacacgagacgaccagcagcagaagcacggaccagcgcngagcanagncgcgcagnancgcgaaaccgnagacanacangngagaagagagaccaacagagcagaagacgagccngacagacacgcgcacnaganagaggacacggagacgccgccgcgcggcagcacacagacgcccgcgcgccgacgcgagagcggcggcagcgacagccgcacacagcaagacagcanagcgagcgcgcagcacccgagcggagcgccacagccacacagaacgacaccacccacacaacgacacgacgcacaatacaaagacgcgactagcacacgatgcacgacgggagaaggggagtagaggaggaggagaagggaacgcggaggaagaagaagaagagacgggcacagcgagagacgcagcanagcaaagccgccggagtacacgcaaccgggacgcgagcgccgccgcgcgacggagccagccccgggcggcgaggcgacagcggcacgggccggcagggcgcgggcgccgggcgcgccgacgcgcacaccgcgcggccgagcagcgagccacgcacagctcgcagncgcacacgacgcaagagcggacgtgacgagaggccgagagagaccaggagcgcgccgcgcgcgagcggcagggcagagagagcacgtcgacacggacggcgcnaggagaagaccgacgaggcggggcgcgagagagcgagcgccggcacggagagccgaccgcagacgaagagcacagaggtagcganaggaggcgagaagcgcgcgagcggnagagcgagaggcgcgcgagacagacacgacgcctagacgacacgccagtnaccagcagagagcacgagaagcgagagcaacaagagacgaganagagagcagcgcgagccgcgaagccagcgacagcacgcaagacaccgacaagcaccacgcgccacgcaccgtgtcgacagnagagagaancggaacaacgagagagagcaccagaggaagccgacgaccagtcacgagcacagacagagctgncgagcacgcgcgaggacggcacgcgnatcagatagagtcgcgagcacagcgacagccacagnagcacacggcaggcagcgtcacgtacngcgcgagagcgtgccagagcagagagacgagagcgtngacangtaggagagcgnacagacagagcggacgacggccgacagatgaccgatataccgagtaggcagcgaagagcgcaagagcacgtagagcacagagcacgcacagagcacg

SEQ ID NO: 6595 - DNA, 513 bp, Homo sapiens
ctcgcggtaggagcgggtagcataaaagagagacgacgggtataagtatagaggagttggtgggtgtatggagacagtatagcacgtcaattcatggtagtctcggaagaaagacggcgggagaatagaaaattggatgaaatcggggggagaaagagaagaaagaaggataagtgaatgcggggggggggaataggaagagggaaaataggaggagagagggtggtaaatagtgggagaacaacgcttgaatcggcttagccgagtgaagatatggttactaagatcaaatggggaacggtataacagggtaaagcgtgatataacgagacaaacaatgtataaggaaaaaatataggcaattcaatacgaaaagaacgtcctaagttaatcgaaatacagaagtatgccggaggtcacaagtaacggaggagatatgaagaatagaaatgggacacccgtcatgtccacaagagctgcgaataaacttgtgagacaccacagctaacaagt

SEQ ID NO: 6596 - DNA, 1513 bp, Homo sapiens
  misc_feature (1)...(1513): n = A,T,C or G
aagggggggnnnnnnnaaagggnnnaaggnnnaaaaagagaggagagaggtnnaagagtatgtnnaagagggaattgggtgtngnagattaggagtngngataggaagaagtgtgtaggngatgtaatattnatggtnatcaccanttatatttttggtgtggaggtgtagtgtatggnngagtgaaggtgatgaagtgatggtgagtgagtaaggtnnnaggtagnatagtgtattttgtntaagtgttagatagtagaggaaaggntaggatagagttgataaattgtganaaanaaataaacagcagaggaaaagatnagtggatggaggtangtgaggngcagcatatggattatgtatttagttntaaagatataaggtaaggtggatgtagagaggataggatagtgagnnnaaaganatatagaggtnnataagtgtaaganntatatagtnnatatnagangantattagaagttggatgatgnnnnaatannanagatgaggnnnntagnngagatagtggnnaaagagntntagtgatgatagtctgattagaagtgcncacanctagaagcggnnntagagagggnctcgtgtagtggaggagcaagagagtgnnncaagtgatcagatcctacatatcgnaatagacaatcagtnanacagaggtgcagcgatcgagcgcacaggtggcgacagcccctctggtctcatcgcaacaccgacagacacaagtacaagcccacacaagcggcaccggacacgagcccgccggccngagcccgctgcatcagacgtacggtatctcaggtctnnnagtctacgtagctctcactntgtgtctaagtcgctccatctaccnntaatgacgctctcccgacgctacccgagaggtgagcncaggcgccgacacactgggttgagcaggatncagtagacgtctcagagtgcaacgaggatatatgagtnnnacagatgtgngacaggagtaaacagtgtgtacacgctagatgttgtggtntctagttatgttgtcgcttctngattctagttcgcgcacgatgatgnnccagtataggtcgacacncacacgccagcggcacgcacgatcgacacactcnctccatagagcgcgcgccagtnagtcttacgtgnctatattatgtcatatgtacttctcacgcntagactgatggtggtntcagtcgtatcatcgcgccgatgatanaggncatggnatggagagctcacaagtcagcgcgcgtggccncgcctcgtaggtctncatacgatgctgcagctctcnactagtgtgnnnctaattatatgcctgtangtgcgtcacatgacaagacgtcnataacgacgagacancgacacagactgtgncccatgacagcgacgcnnacaatagcaacacgagcgatatactntcatatacaagtgcncnaccccgctataacgtgcgtttncgtggcgacgcgtaggttaatacagatagatatt

SEQ ID NO: 6597 - DNA, 796 bp, Homo sapiens
aaccgcacgtcagactactttggcccgcgatatccacttcagtacccactcttcctgtataagcgcggctgacaagcgggggtgcgtgatccatctcgggcgctattaaacccgagcccccatcgtggatacaggtacactcacgtactatgccaaaatagcccctttctgcttaatgctcccgcggccatttctcatgccagaaccttctaggacgtggacgacatagacccttgtgagtaccgacaggtactcgttgattctggcgtcgcaaggggattaattacgggagaatgagcttcagtggcctgaaagttaaattctgggagagaaacccctttttatagaaggaagccaatggaagggactatttggttttccttcccaccaagatgtttgagccctaagtattaatgatcaattatgaacaaagatccaaaatctgcagaaattgcaagtctcacttctggttcacaaattcacttctttcatagaagcaaagaacattggccatctgcttcctgtctttccaaacctggcatttcctgttgacgcctcaccaatcagccatcattcatatgattgtagacaggcttcatgatcccttaggcttagagcagagctacttgaagtgctcatctgcagcaagataagaagcttggctcggaatgtaaatcaaggcaatgttttcttcaaggagaaagtcttgctatgaaaataaataatccgagatggcgcccggaagattattattgttctacttatatgtcgaatagcgcgacaccgccacccgcca

SEQ ID NO: 6598 - DNA, 763 bp, Homo sapiens
  misc_feature (1)...(763): n = A,T,C or G
ctcccccacaagtgttttgaaacccctctctcagatttagacgccagtgtctttttaatttcccacccgccccgaggtttcacacatccaagcaaatagagccctggcaacggtacccttaaggttcctccccccagtgcagaatccgccaaaggtcccctggcttgccctcccctggttgaattcccgggggttattcttgagccaacccaaggatgagccttgaggttccaaattccccagattcctccaaggcagttggtcaacaaataagccattgttgagaggatgccagtccatgctccaaatggaccacggctcaagatagcaactggaacaagacacacagcccttgtgctcagcactcctcctgcatgcctcccattgtatcttccgttttcaaagcccctcctccaagcctaaagttcgaagtcatttctggagttgtaaactggctgcttccccactgctagctttggaaatgaaaccattttccttttgctgtacttcatccttgttattggntacaagcagcaagcagccaaacttgtgctcagttgcagttttgtcaggtaaataagatgaagggaaagtgtgcatacaagagagtgaccatcattgtgggccataaaatctaagctggataataaagtacgtaaggacatgaaataggtgacagccaaccaaaaggtgatgaaatcagtgaatggttgatgctaatgttgttgaatgatatttggaaataaaaccggatcggccgaag

SEQ ID NO: 6599 - DNA, 1712 bp, Homo sapiens
  misc_feature (1)...(1712): n = A,T,C or G
catgatagaccatgttagtataacgcgtgtagatctaggtacgcagcaacgatcactatgacttttcgtagcaagacaatcagagtagagaagagtgtggcattttttgagtggatggaacgtcgtccctctctgtgtgagcagtactcaggcggagctgatcagcaatcgccgcgcgctcagcccgcgccgttctgcgaggctgtctaacagaagcaggacgcgccacccgaccgctagacgatggatgagacggtcncgcacgatagtgtacgggatgcgctgacgcgcgcgcgcactaattatatcgtcgcagcagtacccatcaaagatgtggaatctacacgtgaatatatgatcgtacactagcgaactcagcgatgtcaacaggagaacgntctcagcctgaccagcgcacaatatatacgtcagacctacgtnnatnactgatatgagagctcgtgatgtgatctgtgtatgatctgatgagtgcgtcgtatgacattgtgtcacgcgcatcacgcgatccgcgagagagcgtactgagatngacgagatgagctagtnatgtgaccgtgcatcaagacntcagtgtggtcgacgtgagtatgtgctacatatctacaacactatacctgncntcgttcatactactccgtagagtgagctgtacgacgaggacgtacacctgcgcagtgacgcgttcgcgatgcatatgtgaggtacgatcggcgacacatgtccgacatgctcgacgagtgcgtgtcgtgagcgtatatantgtatatanntatgtagacagatatgaggagctnagcttagattgagatatgtngtcatccgtgcaggatagtgtnagagtatgnatcgtgcattcaatatacattattgactctacattatcttctatataatattcgtgctaaccttcgtcctaggtatagtcacgactatccacttgtctatcactatatagcgcgatcgctagacacgacgcacacgntgcgcgcctcanttaccactcatggagatacgagattacnttcactgtgatgctgtgcagtgtcatcactgcgtnactgtgntgcatagcgagangaatacnaccgatcgttgctcgntgcagtaatcgctagcatcactgcagatacttggatagacggtactcattcactacataacctagacgtatacagcgtgcgtgcgcgtcatacgtcatgactacangtgcgtagaggaagttctatatacgagagctagtagacatgtcgctatgagggtttgtctgactatctatccgaatgggncaactctaatcttntcgangaactcgtacctgaataggagtgagccggacgctnatgtacgnatgagtgtgactccatcacgaacggttgccgcgtgcagctgacgagtcggtgtgatcgtctgagtacgagtgtgattctgcacgcgcgctgctggctattcgctgactcgtacacaacgcactgtggcagagcacagctgcgtgtatatatccatctgactacgcaccanatacgctagagactacgccgtagtgttctatctgtactactgtaacacttctctgngaatccgtatgctggctgaggaaagtgtgaggagtaacaacataagtacgaccttattcagtcctcgcgccggtctttctaaacattcacttgatgagtacgtctccaattgcttgt

SEQ ID NO: 6600 - DNA, 1442 bp, Homo sapiens
  misc_feature (1)...(1442): n = A,T,C or G
atctcgtaaatacatctcaccngcgtgcaagggcgtgccagcaggcaagtcgcagcgtgnncgcgcgggcgtgacagcgttagacttgccgttnctcaccacgccctgaccacgatgacaccgtgcgacggcgctgnagcacacnacaacaagacacaataggatggagctcggtgggggtgcgagcggcgcgacgcgaagaacaactcgaganaccgcgcgcgccgagatggaatatacagacccgccgcgccccgctacagatccgccgatagacgcaacgggcgnggatacacagcggcgacccagagccgcggagacgggggtcttgtatgacgagacgcgcgagcgccgccgtgcagacaacaacgcagcaggcaacggtacgagacgacnagacgagcacgncatcggcctgcacacacgacgaggcncgcgcgacaacgnagttgacgaccctgctgattagacgccagaactccgtcgtcgngcacgtctcagacactantgtaatataggcgaagcgagtcncggaaggcgcgtaggagtaccggcagnagacgtcgacncagtantnccatcagcgcgagtaccggcacgacggccagatggacgagcgncngcacgcgcgcaagcggcgagcgagtggcgcggnaaccgacgcgcagcgagcgcgcagacgcacgacacgtaagagagtaggngagctagtcgcacgcgnacgcaccagcctacggtcgcgcgtgcagncngcgcgatatggagcgacgcgcgcgcgagcgaganagaacgagcgatgtcggagagcgatccgagccgagcgnacgcggagncgagcgagggagcgtaagagagcananatgtgcctacgaggagcgtagtagagaatagtatgagnatagaatatnnacagcacatntacgcgccgcagagataacggcgacagacgaganangcatggagacnagaccgcgagcngtgcgcgcgacgacggatgagtgaagntgttngnggtncgtgcgtcaggctcangccgtcacaacagagacgcattgcgccagcaaggcgacgcgcgacngtatagatgacagcgnctcgccngtacagtgtacagagcatagaacgagcggtgcgncaggcggcgacacacactacagacacgncacacgcgagcaagngatgaccgcaggatgacgagtgtgacgcgccgccagccgtcagagagagatagagcgacggcgaangagatagagaggagagacagactgcggacgcgcagagctgtcagtggcatcatcgcgtacagncagcacgcgtgtctgcgaccactgcgaagtancgacaggcagnacaggcagatgnactcacgcaccacataaatgaacgctgtagcaatgtcgcacacgtcangaagtcagccagaacgaagcactaacgtcaac

SEQ ID NO: 6601 - DNA, 830 bp, Homo sapiens
ttcaaacttccacctcaccaatgttccaccgcttgcacaccaccccatataatacaccgctcagtatcactaccacttgtctccgaatcaaaattaacataacacctaaccccaactcttgcgaccatcgcaaactgtcacccaaccgcatcacttacaaccgcaccgcctctcacccatcccgtctcccccatcgcgttcgcgcgattacaacaaaccatagcacttgtgtcccactacacagttttctccctcccaccccccgcccagacgctcacaaataaattcaatccctcacaccgtccatccaacactccccatacacaccccgcgtaaaccgaaactctggtcccccagcgcctgcccatctcacctcacaaaaccacaacattgccagcttcctcaaaactttggtacataacgcttggaataatgcctccaccagcccaccatgtagcccaccccagggttaaaacagccctttttgataaaaaataaccaccattttgcaaacctatattaggtaagggagcccaacctggagccagccacagtatggtcaatcgccttaggcccggtgctcaagcttgaatcttgcccatgcacaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgacacaattgttttttaaaatctctaaagagtaaatacttgtgctgttctttgtatccaaagaccttactaga

SEQ ID NO: 6602 - DNA, 263 bp, Homo sapiens
ccgcactacaaaggataaagaggaccgagcaagatggaggtcattctcgtcttggaaaaaatgaaataattttttttttttatatgtcacttgggccggatggggggccgtattaaactacaggttcatccagcgcaaaagcgacgcaacgacggactctcggatcatatgtcaggcgggcgaaaatctggtggcatatatgaagaaaataaccgtgccacaccgtgtttttttcctgacgaaacaataaaaaaaaaaaaaaa

SEQ ID NO: 6603 - DNA, 511 bp, Homo sapiens
aattgccaccgttaaaggattgctgtgttgcaatgtgatcataaggctgaagctaccggaggcacccagtggggcactggagccatgtgctaaccaaaacgtgcggggtgaagatataggagtgggggtgacactaagaggggcattgtggggcaaaacaaaaaaagacgcgaacaggcggatggcttgataagggtaattcataacccttgatggttaggtgctggacgcacaggagggggtggcaagggggggaactggtacaaaaaagagggagagtggaaaacaaaggggggggggggaacacggaaaaggaggggagagggggaaaaaaaagggggggggggaggaagaaaggggggggaaaggagggagggaaaaaaaagggaaaacaaaagtgaaaggaacggggaaagggggagagggcaatggggagggacacaaaagaaatggagacaggggggggaggaagaaccaatacatacaggaacgggataacgggcgggaagga

SEQ ID NO: 6604 - DNA, 636 bp, Homo sapiens
cccgttgcctgagtccctgcggcactgaaatttccattacgggaggggtaattttttggccccagggctccaggggaccggaaaagcccccctaaccggttgggaatttatttccagtaaacgaccctgcctttaaggcccgatgcacgtaagaaagacccgctctctatatcagcctgagtcagggtgttatttgaacccccaaacaacaataacacacaggacggaggcggtttaaaagccgggacttctaacctcctcgggggtagaagacgggtcgccaactggttttgaggaccgaaccggtttgggggacccttccagaacaccggcaacaacaaggtcattaattgtattctcccctctatggagtttggtatctcaaaagaggcaaaaacattgagtccctaatgataccatggaagacccccttcaatttttaatcgtcgcttattcaatcaatatacttggcggcgttacccttttaatggggagtaggcatagaggccacaacataaactcgcatcacccagtttattttctgcagtgggtgggttaagataattcaaggggcgtttgttctagtacctacatatacagtgaataccgagaagactgatactatatttcacttgg

SEQ ID NO: 6605 - DNA, 704 bp, Homo sapiens
ttcaagatcaaaaaaatagagccctggcagagttaaacttgaggttcttaaccccagtgcagagatccggaaaaggtacactgcttgacctcccctgcttgaatttccaggggttattcttgagacaaaccaaggatggagattagcttccaaactccacagattacctcaaggcagttggtcaacaactaagccattgttgagaggatgccagtccatgctccaaatggaccacggctcaagatagcaactggaacaagacacacagaccttgtgctcagcactcctcctgcatgcctcccattgtatcttccgttttcaaagcccctcctccaagcctaaagttcgaagtcatttctggagttgtaaactggctgcttccccactgctagctttggaaatgaaaccattttccttttgctgtacttcatccttgttattggctacaagcagcaagcagccaaacttgtgctcagttacagttttgtcaggtaaataagatgaagggaaagtgtgcatacaagagagcgaccatcattgtgggccataaaatctaagctggataataaagtacgtaaggacatgaaataggtgacagacaatgaaaaggtgatgaaatcagtgaatggttgatgctaatgttgttgaatgatatttggaaataaaatacatcttgcagagaaagaataaaatcagacggaacg

SEQ ID NO: 6606 - DNA, 631 bp, Homo sapiens
  misc_feature (1)...(631): n = A,T,C or G
cgaaggctgccctcattctagattggcaaaacacccacctgttttttgttcttgcggtaggcccctccgcgatattttactctcccctttccgacataaataatgtctgtcctgttgatgngctcctggttgatctgcccttatttgtcctacctcctttttttttttatttcttatttttacgttaatgtattcacgctaaaaactatttaccccctactacccatataattccgatcggattgatgatatgcgttatggattcaaaggtgcctttcttcattattaatagatataaaaatgagagattttaccgattatatcatatcttacgcatcccattacattttgacccaaagtatatgcgttgtcaggattttgggagttgcctcatagattcactactatgtaatctatttctgtgttattgttataggttgcagtagtttattctatagagttacacaaatacaatccatcatatatatacgaggatgagaccgcacaatctctgtgtcgcgcgaagtaagccagtattataattaaagcaatttggatatatgcgttcactaatgcgcgatgttaatgactcttagatattatcaattatttctctatgtatatatacagc

SEQ ID NO: 6607 - DNA, 1192 bp, Homo sapiens
  misc_feature (1)...(1192): n = A,T,C or G
cccacctcacactcttttatatctccaccctatttctagtacattcttaacaaccattccacactcactaattacacaactaaacaatttttntcctcgtcataatacaataagtcatataattaagaaatttcacaacttaacctccacttatttttctacaaactactgtgggcgatgggcgcctcgaaataacaacaactaacacctctccttttcttctcaattcctatcataatcttntctatatttacttcttgtctcattaccttatattacatcttaatcttcaatcacaattctcttattatctccacccttcacaatacacactttcacctccttgcatctatctagacaatcatattacctatcaattactcaacttacttcttcttaaacagagcggcggttccttactactactccccaccatcctactacttaacataacgctataaaacccctcaccaaccttaactcactcctacattccctctcctattatctctaatttatttacatcattcatccatctattctaatgcatagaaccacaacatctctgcatatcaccaccacactcaactcattacccttcctctcctcccctataaacccaactacactgacaaacacatcaacctcacattccccttcatcctctcctcgccacactccaccatccccccaacctccacatcccacccaacttacctatcttactccttccccccctactcgaccctaaccactctcattaaaaaccaattcaattagaaatatattctacttatctattaacattccccttctattcactcacgcacatctacacaactttcttctctcaccacactcacttaataatcctctcttctatattctcctcacacctccacactcattattaccctcaagcttccacactttttcgtggtcttcgcctcctatactcttctattcctccctgtctctcttttataaattgaacgttttacacctctcatataacactcactattacaccatctcntctttccttctccttcactcaattacctctccatacttcatatacttattatcctctctccactacttgttactctctcacccttctcctatctcctccacttactaacaccanctccatcacgccactctactcctcatgtctatcccccactcg

SEQ ID NO: 6608 - DNA, 369 bp, Homo sapiens
gacgagggggagaaataacgccacactgatgatgggttaccgccaagcatgatgaggtggccggcgttagccacacttgtcgccatcacggggtccagcggataaataactcactagtatgcatagagcagcgcacttgtagtgtatagcaaaaagcggcatctgtcgaatggtcatgtgggtagtggggaacacgattcagtacagggaatgtttggtaaggggagtacgctggaagggggaggggaaataatggggtatatatacctagatgccttgccacgttgacatgcttattcgaatcatgctttgttatttagcaatatggggattgggtgcccggcagtctctgcattcccctctggatac

SEQ ID NO: 6609 - DNA, 1242 bp, Homo sapiens
  misc_feature (1)...(1242): n = A,T,C or G
ggtaaagaatggagggaaaaggagagaagagnanagagagagagagnaagaaaggnnnagnataaggaaaggnnngggnnagnnagagggnaagnnagggaaaggnnnnagaggnaaagggtnnannnagagagaatggaaataaagnnanaggaagaganaaagaagggaaaaggaagagaggaaaatgagaaaaagggaagnagagggggnaaggnagaggnaagggncagggaaggagatcggatggttcgcaaggggtccagggttagagccgcaggagtagacatccggaggcnccgcgagagaagaaagtgtaacatgcacagccagatccaagcgctagacgctcgccgtcgtcttccccatctggngtgtctattgatgtcgccatgtgtggctagggncgtgaggggtggccagggacactgtgcggccgcctggatagtgctaaggcgcgcgctgagcacgcgtgagggccgcgctgacgctttcgagtggtgaggtnntagggtgttccgtcgngacattgcnctgctcgtggctgtaacgcgcnctctgctcgtgcgtcctgatctattgtgtcttcttacggttcctcgtcgngcgcgtcacggtgcggcgtgggcgggtccnatcagttantatgaagtgtttgcgtgtaggatagaatgttggtattgagacgntcttgtagatctagtggttctgttgttaagtgtctgggatgtgtttntcgcgtcttgtgttgtgctgaagcagctgatgccaacatcagcgcactcatccgtggacacttgtcgtggatacagttggcgggtgtgncactcactagattgtacatgcgcatcgacctcctcgcaatggaggtgtaagtcggccttcgcgcgtactccgacgcgctatcgtcgatgtnccgtgtcntgttagtatagatgtgactgatagtgtatgtagagtgtgagaagtgatgggatgtatactcncnagtgagcncaggctggtagtgacgagtgggcgaggagcagggcngatgagtgaagaagtgtaaggggnncacagaataggtgggttctcaggaatgtagtccnncntcgacgctcgcgcacnccgtctcctagagagaggacgcgcgccgtagtctccgacgtcaagtgatgtctaccgtcttctcgcgtcgcgcccgcgccccnaccgcgtggcgtgggcgtcgtgatcccgcggacgcantcgcctctgagc

SEQ ID NO: 6610 - DNA, 601 bp, Homo sapiens
ggcgggacattctctagtgtacattgccgtgaggtgtgggtctacccttgttcatgcgtgtgttggagtgacggacatggtgtcaggtggtggctttagtgggcgggctgttgcactggtgtgggtctggtttgggtgtattggggtgtgggggtgggaggaatgatgatttatatctgtcttgttgtgggcgcgtggaggaggcgccgaccggcgtggggcggagttgcgtggccgtcatcccattcacgctgcggcggcgggcggcccccgagtcggttgcgggtggggattgcgggtccgggggttgtgggggggccgattcagttgtggggagggggcggtggggtttcaggccaaccagcgggacctcacagccggggttatgctcgagtatggaggggggggcgaggtgggatggttgtggggaggtaagattgaagtccagcgctgtcgggacgtatctgctccgggttggcgatcggtattgggagtgcgtcgttttgtgacgatgtaacgaaagcggtagtatggcgtttgtttgtgtgtgatgggggcgcggtacaggcgcggttactgtctatgtgttccaactaattgg

SEQ ID NO: 6611 - DNA, 910 bp, Homo sapiens
  misc_feature (1)...(910): n = A,T,C or G
atcttcttaaggttgggaggatttagctagacgtgcgctgatccaataactgttgaacaaacacttaatgtgtaatcaagagacgacgaagcgagcgcgcaaaccctacaaaaaaaagataaatgtagcatattccggaggagagccgttcctccttgtccgttatgttcgagtagccccccctcaccagtccctcgttactatattatctccacgttattggcgtatgggaataggtacgagacaaacgcatatgaaattgttttaacgagctcccttgctcgctgccgatacttgttacatgtacgtagcgtacccctcgccatcgtctcgtctttgttttttttcaatcacacccgatcgttcgaattaccgcgcgatatgcctgattctccccgactaccgcccgtacttttttcacttctaccgcacatcatagccccaattgatcggngaagcgcacaagaaggcagcgagaagatcgctctctggtaaagatagacagccccatgtcttacctattatataatcgatgatcacccccgcatccagctttattatgttccgcgtgaggatgcgatccgcgaatcagtctattgacgcgaagccgtcgtcggtacgatctgcgctggtagtactacacgagtatactataagtgatagaggacggaagtgatttttaaggtgcgtgaaatcgaggtgattctgcgtgcctaagactgtaagtctagtatagacaaaatcgtgtcgcagagaatggttttcagatcaaggacatgacgtatggtttgaagacagcgacacgtcagagtaagtcgcgctcttcgttgtctgatgtgcggcgtttttgtacatcataaatagcgtagttcatgcagangtgacgatctagccaagctgtattgccgcg

SEQ ID NO: 6612 - DNA, 162 bp, Homo sapiens
atgtcccctgcgctaaccccaccgaactggatactatgactggcatcacacctaagtcactacccatcacctcccccccccgctacaagtcgttctcgtggcccagtggatcaccccccccttgaaacaaccggcccagtgacagcgggcaacacccccccc

SEQ ID NO: 6613 - DNA, 1733 bp, Homo sapiens
  misc_feature (1)...(1733): n = A,T,C or G
gttgtcactgatctgtctgccgcgatatcncgactacacacgnattcagcgcgacgcgcgcagnagacgagcagacncctttagatagagaggatagcgaagagagagcagtgcgacgtcgcctacgctcntgtgagacaccgcacactgtgagntatgcgacgaagttcacgactgcgccgtcactcactgcagcgcttgtaacggtgatcttcgcagacatatgtgcgngcggtcggccacgcatactcacagttggacggacttgaatgacgatcgatctgcgttgacaccagtatagacacatactcaccactatctacaccnactgtgacatgatattctacacgagcgcacgctgccgcgactgtctagtcgaatgcatccacgtgtttcacgaccatctcctgttcgtcttgtctgggntcgatggaagatctagcactcttcgctatatcaccgggacatagacgcaatagcggagangtgagatggacgatggactttcatctatcggacagtcganatttgtgtctgcattggggcgcagcgggcgaacgctacgcagtggcgcggtggcgagaccagagtggcgtctgagcgcgcgacgtgagcacacgagcgctagcgcgtgatgacaatgagcgtgtagtctgtncactctcgtgcgagncagtggctcgtactgntgtcgtgtgcgtgtgtcgacttatactaccaagcgtatccggccgcgtgctgattgccactgtgagtggntncggcaactgncgcngacnttctcaagacctcgtaatgagagctagccacgcagtaaggcggacgcgtgtgcgaagaagtacgcagctcactacacgcctgcagtgccgnccagacagagagatggaganagncacacccgganatcaggagagttggaccacatgtgtcgctcatcttntgagtgagcatgcgatagcgtgaagacanagtactngcagtantnagtgctagtagtcactcgtgtgtgagagccagtgtacgagttgctgctagcatcgtgcagtgatgacaacgtcagtgtagcgcagggagcgcgacaggagtggtcttatactgtgtgtaacgctgtgtgccactgctcactctgaggcggctgagcactgtgtatgtggtgcagtcacctatgccacgcacggaacntatacgagagtgaggtagttggtgnctntggctagangtgtgacagcgtagacgcacgagtntgctcactctagatcgtatcatgcgttactgctangcgnagtgggtggtngacgagacgngccgncagctccagtacagatgtgacgtgagagnnactgctaggatagaatactacgctcatatgagcngcgtggtcagggagcgagtgngtgtgctgagtcgcgcacnactacacagtctagcagagagtaccagacagtgacgcacgcgccgncctgctcacgtgactgcgcctacagctgcaacgtatcgtccactcangtcnagactgtagcgtgtgctctcagcaggagcagtgatgcgctganccgctagcatgtcngtgagcgctgcatagagcttcgcgcgccacctgtgcgccncctgtacacttgcacagagctcgtccttggatacctggttggcgtgggcgtgtatgtggtgctgagaacgaacacggagcaggcgagganacngcgcgagaatacatcgctccactgtctcagagg

SEQ ID NO: 6614 - DNA, 714 bp, Homo sapiens
tgagggcggttataatctctataagggaaattgggtcaggccccccccctcaagtctacagaatgattagtttcatgtgcaatagggactattataggtaaaatccacccagcaaggggttacaacacaagtttgaaaataaagcacgatggcttttttaataccccgcccttacgggcccacagggccaattgaggattatgtggattcctaaggatggagaatgacacaaaatgggcaccaaaagcccattgccagtgagtttgggaattttgaacgcatcattttttggtgtggcccaaagaacttccaaatcaacatcttcatgttccacatgccagccagaattacaaatgccagtgcagaaggtggtggagccaaaagaagatcggagcctggatccctaagtcactgcatggaaggcagctgctcaacaaccgtgtgagctggaaaacaacttctattatgttagccatggagacttagcagcgtacctgtcagttccagtttgcctgtaattgtcctggttttagcactgaaagtcctgcttcctggggaacccctcagtcttaggcaaacctaaatctaatcaccctagatttggaggtcatttggtatagcaattgagctgccctgactggtgtgtgacttataagatcacacaccaatcttataagatgggtattactattatcctcattgtgtacgactaaa

SEQ ID NO: 6615 - DNA, 1907 bp, Homo sapiens
  misc_feature (1)...(1907): n = A,T,C or G
agaaaaaaagnngnnaaaanngaaagagnagagggagnagnnnnaagaaanngnnnannnnnnnnanatntanaagatgatgnnnnnagatannganangatatgnnnnnganaggagngnnnnaagagagtgnnnnanngngnagatgnnnnnnngnnnnnnttaangnnnaagnnnnanagagatgnnnnnnnnnnannnaagagangngagaaggagtttatagngnnnannagaatntgnnnnnnnnaagattaannnnnanattaagtaaaaagagtnnggngnnnnananaagtaatgtgnnnnnnnnnagaganatannnaanataaaatggnnnaanaaaatntnnnnnnnnnnnnagaatangaagatagngaannanaagagtgaaannnnnannnnanagagagnatgtatangtgatgatgnnnattnatnatatgtgattaantgagtatganntaatgagtatatatgatntatatgtatgtgtgaantatntntngtanttaggtattgttatgtaagattnnagagatntntntatatgatgtcatatatnnttattgagtatattnnnattacagagtagtatgtntaagagtggnnattatagttatagtnntatatagatttnnntatnactaatatataagatataccgatttntctattaattatntaaactaatnattnnnnatatatagtgtatacaatgtncnntcatagtcttatagacactnctctataactacnnnncanctnactatnaaacgatagancccatacacagtatnctcncgtctacaagccagtaacactcagtagtgagtnataactaatangaaanatagatgatacatcntaanggcgtagtacnnacnaagtaactagatgcncncatacacactacatcatactatacagtatagatctacagaacgagctgtgtcncatatgcagtaaatacacatacactatgcatcacncagaatacgattgacaataaagatgactncncncnagaatatatatcattatnncataatatnatcgataatgcaacanttcnatatactatactcncaccagcaagtatgccgnncncncaatatctccacagtcgactgctctatacgcccatcacctacctacgcaccaacgatccatcnnnctacatcaccactgtatatagtcgcgagtatnacaatagatcatccaatatatgctcacactatactatccctactcatcacgtacgtagtantntccacacactatcgccncacatcagtgatgactganctacacactntcnnacnactccacatgtagatcattcgtcagctaagcattacatgtgcnntccacanaaactcgtacacagcaattcncntgctacactacgtcagtctataacagtatgctaccacacagagaacctacaacaagagcnncaattatataatgcncaacatcgcacncatatacaatcaattaatctctctcacatatcatcacactgaatattcnnnnatatctcattacagtacagatcagagatctcacaccacacatccatcacgtcaacatctcagtcaccacaattcnnncctaacatcgcacagaaagtaactntacacatagatatgaatatcgaatagaaggntacacacacacaattacatataaacaccaacatgatcatcattatatagtaagactcnatcaattctatatctcactatatatgttatgtgatatattaacaagctnnccncaccctagctacatcatgaagagaagtnnnccaatgaatcaanacgatattatatacacacacaacactcacagaatgtantcaacatagatgctacaatgancnacactacaacagacagt

SEQ ID NO: 6616 - DNA, 1180 bp, Homo sapiens
  misc_feature (1)...(1180): n = A,T,C or G
ttgggcagcgccgttccccctttctcaattcgcccgtttctgcctgcctttcataaccacgtgactgtccagtctgtaagcgcctagcctctgctatcgactacagtatctacgtcttggtgtggagggaaggttgtcgttttggcggcgccccgccctttacgattcgaccacttttttaaccagctacccatgttatatgtatagtaaatggaagcgacactacagcccccgaataatatccccgctgagcgacgagttacaaaattaaacgggtgcgtagactaccacatgccggcaaggcgcaagcggattaactatcgataacatagccgagggttaagacgccgagctcgcgactcgcgcgataaacgccaccatcttattcctctgtctcacgctcagtagtaggccgttatcccgacgatgcgagtgtgagctaccggccttgcactgcaaccagccgtcacaccccgctcgcagatcgacgtgaacgcgtacagaagtatttaccagcangctcaatcctacggatccggagcacactacacatatcgacgaatcgccgatatgcctagccacggagcacattagacggcgctcacgcgacatgtccggagcgacgcacgctcctgtgtcggacactcacagcgcgaggagattcatcgtgcagtactacccctcatggtgntctctcatagctcnattacgtaaccacacagcacgttcttgattgaagatnatgtgcacatcgacgcagtgattcgaatgccgtttcacataatctgctagcgctatgtcgtctttcggctgacccgccggtactgaccctctgacatgttgatatgaacatcactccgaggtaggtacgacgacgcgtgtatngataatttacncacaatttaacgagccgcgcggagatnagtaactacgtaactacacacagctatacccgctaccactatgattctactctgctctgcgacctacggtagtaccagataatcactgatccacactacttatacaantattcagccgtgcagaatagagactcagacaccacactcattcgagtattactngatatctgacgccgcnccgcaacgtatgacacgagtcntgcacatcncctggccgcgctctatgctgatatctgatcaacgtcactgcgacggag

SEQ ID NO: 6617 - DNA, 675 bp, Homo sapiens
agggtgggatacgtgactaccggtggactcataagaaggatccaggaagaagtggagtgaaacacggggaaaaacgaagatgggatttaatgacagcaaggggaacacatggggaaaagggatgaaggacgcaggggcggccgtcaaggaaacgaacagggaaagggggggagaaaaacgataaaatggaggggggggggggaaaaagagaaacgagatgagaaaaaaaaaggaaaaggaaagaggggaaagacgaggacaaaaaaaggggaaagagggaggacagggaaaaaaaagggggaacaggggggggggggaggacgacagagggggaggaaaaagggggggaaaaacaagcaaaaaagggaacagggggtgggggggacaaaaaccgggggcaacaaaaaaaggaaaggcaaagggggggaggacaggggggggcgctgatgaacgggaaaaaggagtgggcaaagaggaaagggggaacaaaaaaaaggggggggaagaaatacatggaccggggaaggggaggaggaagaaaaagggttggggaaaggacagaaaacaggggaggaccgaacgggagggggggacaaacaacgaacaggggggggggtgacagaataaacaaaaaaaaaaaatggggggggatggggacacaaggggggaaggggg

SEQ ID NO: 6618 - DNA, 1571 bp, Homo sapiens
  misc_feature (1)...(1571): n = A,T,C or G
ctgctcgcgataaatagtgtgcgcacgcactctatagatcaactaacagtgactcacacagagcgatcagcgacactacacgtcatcagctctcatcgagtatacaatactcatcagtataacgacgctgcgtagtanaaacatctatatcactacgantctaccggactccgtatgantacactacatcancaaactcgcgtgtcatacgacgccgcaatatgtgagagagcatcgcggcgtgtcacgacaacacacatactacttctgtcatcanagttataccaccataaatacgtcgtacaatacatagacacacactnagtacacatactatattggcatcgagcactaatgagtcattacaagtagaatacatctattagagagagtgcgtancagacatatatgtgcgtgatcatanangnacacacagtacgatctaatatanagtatactatggatacgcgacacagagtacattgacaatgntgatactcacctacagccatatnacgacgatacacatagtacggcattacgtaagcgaagattcataacagacactagtataacacatacacgtggacgtgcacgtcgacactcgtatatcgaantanactacttgactcatagtcacacagccancatacatgcagtanaacacgaccaccaactnattggccgtatagacgcatcaatacaactcacgcgacacgcgcatgctgactcatatagatctgatacgtgtacagtaaaaatgtatacgccgacgcgcgagcatacgtctaacggcgtatgttcgnacatacgcacgtatgatccgatacgaatacgttgctctcgtcgacactcacacctactgtgacatcgatcattagcatgccgtgcgatgtcgagtcagangtctctattcgacagatacgtattgaacagaatctcgcgtcaccatgcatgccgttnagatatatgatacaacgtagaagcacacacagcacgacaggtccagtgtcactcaactaccagagtcgtacagataaactgcaccataccaagttacaacggcgtctctatacacagttaacctacgacctacagaaaattatgtcctatttatgcacaataaaaacatatcccgtccaactgttataccactagaagatagcatgtccatttacgttgttgtagccgctcttagagtcggaaacatatgagtagatcactaactaatacgtatcaataatgtgtggcgctacaatagtcagatgcgactcggcgagatcatgacaactagtataacaagaggcattcctcagagcgtgttgcatgtgtcaaacctaagangataatcgtacctgcattgttgtatgctcccagattacatactgcatacactactacagcgcacgcctatctgtctattcactcatatactgtagtcgcacatacttctcataaactcgacatctgacatcaactgcatcactacactgccgagccttgtccgacactcttcttccatcgataataatatcataggtcaagtacacgttatatactacatacagact

SEQ ID NO: 6619 - DNA, 1196 bp, Homo sapiens
  misc_feature (1)...(1196): n = A,T,C or G
gagagagtcagtatgcacgacaagcagtaaccccccgtctacgatcgggatatctagtagagaatagaaaggataaataaaaaaggtatcctaacatagggtagtaggagtcaataaaagaacgaaaaggtacaagaccgctacgaccacagccggatgagccccgtctcgcgtacttttacccgttcaagaggagagttagctcttctggacattaagggagagtcgtattactcgcgcccccccaccacactaagattcgcgactgtctccaaatacatcgaaaccccgcatcctcaacgtaccccgcacctacgcgccgaacgtataaatagcccctcacccgcgtcatggtccccttcaccatcctcgacacggcagcttcgacgacgctctgacgtcgccctgaacgctatgacgcaggcagtcgaccgcgcacggcgaacaccaacaaccacactctgacacaccgagcacgtccgtanagagccaaagttcactcccatctctagggcctagtgctccattatgtgctttgacgactatgctgagaagtgatggtagatagcatccaatatggatatatgataataaccgaccgcctcactcactaactctatgatcgcgtgtacccacaaaacccgcggtctacaataatacactggaactaatacgacaagatcccccatttatctattcctccacagcgttcccaatctcctgttcccacaccgccggctccacatcccatcctcacgatcccacactacgcacgcgcacagaggcgccctctgctcgcaatgccgcgatccacaatggagcgcgcgccactccatcgcacagattgccctcagggcagacgtaccagcagcacgcgcataacactacgacgcgttcctcgactcttactcatacacacataactgtgtgctcagaccacgccctcagtagtactccctctctgcctctgcacttgcagagccgcgagatatgtgccgcatagtcgcaggaccttatgatctccatatacaatgctaatcaccgacgacctgacacgagagcgncagcagtgacacagagttagcgcgncgcacgcggacgccgtaagcgcacgcttcgatgtctgcgcaccacgccactcagtaaaagtagnnctgatagctataaaaagtatcagcaatcccctacttacgtcg

SEQ ID NO: 6620 - DNA, 2159 bp, Homo sapiens
  misc_feature (1)...(2159): n = A,T,C or G
gctagacgtgtgntacatgatatatacaggtacacttatctactntcgtatcgtnatcactcgtgtcagtgctanctatgatcagtactnacngttngacgctgtatgagtanagtanctaagtagtcatcatgagactantatcaaatcgtatgactatgtggagatcgaggtatagagatatcagcagaggcgatcagtgatanagtgtacnagcagagtgtgagacggtanacggtagnnangtgantatgagtgctgatgagagagantttntatatatgcgagatagctgctgtgnntctagtagtggatcaatggtattgcatcgcngtngcgagtgtcgagcagccagcagcagacgacagantgcntcagagctntngcacgagacgtactgcagaatcnagntagtncgntatacgacgcntacatatgagtagcgtcccgttagtctgatctagtagcgctcagaacgtgtcgcagtagtggctgtgaaggctcaacagagtcgtgtgtgcanagcagatcactagtgtcnctctcagtcgcgnccntccactcgtgcactgcctnatcagccgtcatgncgcngtactcncgtgctacctgttctatgtcgtatgctntncaggctacgtgcancgacgtgcactgagtgcagtctcgtatgtagtgtatcacatcgatacgacacagtcgacggcgtcncatgaggncgnncncagtgtngtcgccnaccnacagctctatgcantgagtctgtagatactatcatgcgctgtagttgtncgtctcctantcttctcaacactctnncntcattgatagtgggcgagacgtcgatgtangcgnctantgactgactcacacgtccnanancgacgtcatctacatcatgtgctataatcttgagtcacatcgngancacggcgtagttgtcagcagatcgatgacgtncgtngttctctngtcatgtgcgtaggtcggtgtgtacattgagctagtngctgcgctacgntacgactgtgagtcgtcagtagtactacttgtatgatgggtatgagtccgtgatagcatgcacttcanagctacgnctagtttgcgatggatacatggtcaacgacgctgacacgtcgcnatgcctgatgcactgcnctacataagtatatatanacgacgtgctccanactacgtgctctgcacgagcttanctcatctcncgtgagctngcancatataagagctgcgtntnagtgtgctacncacagtcgacgccgacgactcacatatnattgtgcttntgctcctcnctctagctgatatttacgnactcantgactctagtgtgcgcatntcgtcgagtcgacgactgntcgctgcactactcgtcagcctgagagatggtnactcaccagttactcgactcatcactctgtcgacatccatactctctttatatcagtatgacgctgtcagtactcntccatanacatgtgacagtgtagtacntcacagtaggagtgtcgattgcagtcgatcncgactatgtagtgtgctacgagtgagtgacgntantcgngtgatntatagtgatanagataacatcgatgntcatnatcttagtatnatncagcctnantagcgacactncgcntccctagcagctcnntatntaagncagtncgnnanttggctctgncangctgctcagtaancnacccnatagtcgcgactcacatcgtngccnntngctcanatcagctcgacacnctcgntatcatgcgacgantganacgcgcgtagtccnnncncnctactctcnctacttgctgctcgnncntcgctacnctncanttgcntcntcntgantcgatcagcttnacgntcatgcatngcagtcgtntgctcntactgtcgtagcntcnannnatntanngtagnatcgatgatttagctngtagntantnnntnancagcntgcgantagtntccgcangctantaacnatgcgtagcgatnggntgcncnatnaagnatgtncgactaccgnatancnncaatnacgctgnagtcatacgancgcganctacagatngacngatgcagtcaaagntacgtnncancagtcttcagtctgntcntnnantnctnaaccg

SEQ ID NO: 6621 - DNA, 951 bp, Homo sapiens
  misc_feature (1)...(951): n = A,T,C or G
ggccgaagaacgggggaaagagagaaaaaaaaaaagagggaccctcgggggccaaccaccccccaagcttacgagggagaacagaagcncagaaggccanagaggccaaacgcaggaaaggagcgaacgcagacagggcgaagagaacaaaagacgagggacggagagcacgagcagaacgcgaaaacggacaacagcacaaaaaaaacagggaggagagaaaaaaagagaagagcagaaagcggagggcgaacgaacagaacgcgcgcaaaaaagccgaaaaaagaccctttttgaggaggagaaaaggagagacggagacacccggaccggagggacaaggacacgaagcacgaagcgaggcacaaaagaacggaaggcgggagaaaaagagagaagaacacaacggacaaagcgccagcaaccgaaacaccgaagcggcgccaaggacacaagcgcccgggggggggaggagaagagcgcaaagggaagagaacaagggaagagcagaacgacaacccacagaacaggaagggaagagcacgaacgacgccgggagaaacagaagagagggcacggagagccgaagagagacgcgcaaacgcacaaggggagaacgaaaaaaagggacagcaaccagacgcacgcgaagccgcgagcgagagaaccacggggacaggagcacacacgaaaggagaccagaaggcacgaagaggcgcacgcacagacaaaacccagagaacgaccacagcggggaaagaagaaagcccaagagggagaggggcaggaaggaagcccggcaaaggcgacgcagagcgagacgaagcacgaacggcgcgcggcaaggaacagggggggaagcgaaacacgaagcgacacagagaaacgaacacaaaacaaaaagaacnacaaagagagaaagcacacagagggaacgagaagaagcacaag

SEQ ID NO: 6622 - DNA, 1171 bp, Homo sapiens
  misc_feature (1)...(1171): n = A,T,C or G
atgtcgcgatacagcctatataacaagnagaggaaagcgcgactaaaatcngtcnacacgcgggtaacaaccacgcactagcactccccaccgcacacaaagancacaccaaacgacattttttgaaagcgcgccggagctaaaacacgcgcgcacacggcctcatatcctcatcgcttcaccacccgatcataccacgtcttcttactcgaggcaacatcacctacactaacccacgactccactgagctgcgcacggaagccagaccacacatntaacgatcgacatacgctacactcacctactacacgcagagcagacatctctctttaatttcggcgttgtgtggtacatcacccacagacacgcgagtcaccatcagccaatctctactttaaggtgtaatcaaccgtaaacctcactactcgggctgctctcagcatcgtgagaagactagttgcggatcagtgtgcgtngagttgatgtatagtagcacagcagcatctctgctctncgacgttgtccacntactaccaatgattctgagttctctaatgctgctgtcacgtgtgcgctgagttcggtgacatccgactngtgcacgcgttacatgtagatcaaacacataccactcagactacacaacncggctcgactcggccgtctcaattccaccgcgagctactcgccgagtgcgcactcgacaccttacaggcacctgaccgtncntacgcacgtcgacgatcacagcatttattgtaancgagcacagacaccgcacgcaccacgatcagactcaataataagattacatgnaatataaggcacacgctctgctgcaatagcatgcgctagctgccgcggtgctcncctctcgcgatacagctaactatccacactcctcacgctctactcgcacatattngtatctctcgcanctcacattcttcattcacnctccgacgcctcgataccagttgctgtcttctcatctcggatgctcntnttctatgagcgctcacgaactcgtacgtctcaatccaatgcctccaccgcaattgctcgaccgtgtcgtcagacctctcgctgtactacatcatggctccaccatcagaccgactcagcacagctncacgtcgtacgtgcgcatatgtatcgcgtatacactct

SEQ ID NO: 6623 - DNA, 749 bp, Homo sapiens
tttacacatcttatgatagatagaacaacaatggcgcaacgcccgacatgggccaatatacttttatcgaaccggcatacgccgggttcatcacccagcggccggcctggctctctatcattttgctgcgtgagctttctcgaacctttacaccttcacagacagcgtattgctttatattaaacactactagattcttacctataccttcgacccccggattgcgcacatctccccccttttcttcacaacatggttgtacacaagttaaagagtacgaacatgtatcagaatataatgatatcattcactccggctttcccacacgtgagttcattctcatacactcacctaacacttctccaaacttacaattgtgcatcgagacatcacattatacttcatggcccacacataatttcgaaaacacctcgtgtctcaagagaccaccctacctaatagccgttcacatctactgctcaccgtcacagcgtagataatcaaaactatcgatgctgcttccgcgtccaactactgtccaaaccctcctaacacataacgccccaaagccttttgtaacacaacacttgagtaccgtgccctagctcaccgcccgacagctcacctaacctgtgcgtcttacgacccatatccgtcatgtttgctattctcacacgcatcgttcttgttattagccatatatagaatcctagtacttgactcatgcgcatagtaatttgatacaattg

SEQ ID NO: 6624 - DNA, 1283 bp, Homo sapiens
  misc_feature (1)...(1283): n = A,T,C or G
attcagactgtgtatctacgtgaggtaaagcaatccgtactccggctatctccggcgtccatcgctctcaatttgcgtccacgcgtctccccgcaagtagtgacagagatgtctccacattgagggttctatattctgcgttacagtcgtttctccataactgtcatcgcgctgacatctnaagacntttatgagctccacccgtaacgcgacgtccccagtctaatgcnattgctagacgtcgtcgtcaagtgacgtcatgtcacagcactcatcagaatggtttacggatgactgcgcaacacataggcgtatgcaagagagcacaaagatcaccacagcgctaaccacgacgcgtctcgtgtcgccgtacgcacaccatcacatctctcgtactaggtcgacagtggcggtagacgctgaaacgggccggcgacgtgttacctcctctcntccgcacgntanatcagccgtgtacgacacaaacgcacgaagagcatcagaggagctccctgtcagattncaatatggtacactcatcatgagccttcgagtcgccctcgtgtcggcatactccgtgtaagcacccgtcatcctctacgtgacgcctcgtcctctatcactctctctctctatatgcgncactggtatgatggttagtctacggtctctcgtactacacatagagcaacttctactntatcgacagtctactgcatactctacactgtacgctcnnangntgagaagaacatgacgtaagtcacaatactcagatacacacctagactacgagattgtgcagagtgcnatcagnctaaccacacgatcnctcaccagcagatcggatattgtcgagacgacgatcactgctgtttctgtatggctgactccatgctgctatatcatctaatgtgtgatctggcatgacatccacagcacccactcatcgactatatctcagtacgcatttccgcncacaccataacctctcctctgtactgcgttgtactcactagataaggagncgacacagcctggacgagtgcanacctgcttcggtgtctgatgtagtgttctagcgcgattaattgtatgttctcataagagtgagtgagtgtactactgcttcatccttgtcgttatgtcggtctatcgtatatgtgccgtccttgtgaagagcgnccaccgtcatggcgccacataacacaccatactatggtctcgactcctctgtcgaagtgcttgaagtacacgattagtattgctagctcacgttgacg

SEQ ID NO: 6625 - DNA, 1707 bp, Homo sapiens
  misc_feature (1)...(1707): n = A,T,C or G
ctgactggaagacagtgtatccgctggtatgactgagattataatcactacacaacgacagcagcggatagtattcngcatgtgtgaaccagagactgtactacgatcgcatngtaggagacatgtaagagtataggcancgatactagtatatctgtccaggtcagccgagcacgcgcgctccagcgtagcgtcattgcacgtcagacaacacgatcgagaangcatgggangntgatattaatatacntatatgtaggacgacaacntgaganagtgatcggccgccnagcgtggtagtagtatgaatcngtagatagtggacaatcatcacacgccatcgatgtaagcatggctgcgacgactacgatcgtcgacagcgagtttcgagcgcaagtatgctagtnagcggcgtgatacgatgttctgagcgatgattcccntgcgacggctgacgctattagtcagacatacaagatctgttgtctaatgagccatantgntcacatgactctcgatcatgagagcgcgtgcgtgtagcagtcgagtgcganagtcgactctgtacatatgcgaacagctcgtctgtgcgtaggagtcgtatgggtcgcggtncacgcgcgtgtaggagtctatctaatctgagctcatctcagtgaggatcttcgcgttatngcgacctatgatagtnatagttttcgtatcgatctacgtatgtggtcgcgtgtagaagagacaagaagagtgtcagtgagtgagcgcagagcggcagagctncaagtagatatacacagcaagcagcgcacgccagattcgccacaccggcacatgtgcatcgcatagcgcgtcgtcgcgtcctntgcgacgagatagatatattagtcagacgncagagcgctagatgcgcacacgatccggcacaagatacagggcgcagcacgacgccgtccatagtatcacgagcgacagacgtagcgaatcctcaccacttatgcatctgctagtgcgcgctatgacttttcgtccagtatgatacacatagtgctnatagtatgattatgcacgagcgagggccgcagatccagttacactgcgcaatgtagttcacgaggatgcacgcgctatgacagagtcatacatgtgtgtatcgccgcactcacattgcgtgatcgcaccgcatccgagatctccgaccgtgcgcgcgtgtcgccatcgccgcgatagagtatgagagangatacagccagtggcatacgcacgcgtattctagtgtatgtagtatatcatcgcacaccnacagcgcagttgttcgtatgcccatgcggtgcaattatcgcctacgtgtatatacaccacctccgatatgtatacctcgctcccattatgtctaccgctcgaaancatatgtacgcctatatcgcgcgctgaccattattcacatccgtacgcgtccanttacgacncgcgatccattgcgagattcgaggngtgtcgtatacggttgcngttcacatatgtgccgcacgagcataatacgagacattagtatgaattaattcatgcgcgcgcgcgtatatctcgatgcaagctcagtaagctttagcgagtatcgtcgagtaacgtcgtggagcgagtgcgcacacatactgttccgaccatgttacagcgcgcagtgtaaggtcgagagtgtcgccgcgtgttgagtcg

SEQ ID NO: 6626 - DNA, 1163 bp, Homo sapiens
gatgtggtcgggatcggtttataagttgtaaacgcgctagctcagtgtttcttgtgaaatggctaatgatgtagtgtataccgtgaatagaaccaacatcaggccaggcacgaccgacggtaaaattccagcgtagcaatggttttatagcatcccgcggagacatgctaccaccatttgtagatcgacctaaataggtgcattagtcgatgtacatcgaaagatattatgagatctgaggtgcgcgatgtcgggtatgcgacgaatgacaatcagtatcgcccacaccgctctctatgtatgcaccgatggtcgtagcgcctgagttgtatatgcttaggtgcgtgtccgacgagccaggtcgtcatacgccgagagagtcgcaactgacgtcgacagatcggactggtacataggagcggaagtacgtttgaggagcgaaacggtagttgagagcacaatctgaacaatggtaaccatagtagtatatgatattgtagagagcggataataatatgtccgagagaggaacagagagccaaccacacgcgcgggatcacccgctctctatatgctgccatgacgggcgtattctggattttgcatcccgacgattcggcgcttgtctatataccgcccgcagctgcaagtagagtgagagtgatccaacggttgctggtgtccgctagcttcccactcgtcccgtgtatatatattgtcagtacacaagccatcacgatcagcgcaaggtatgggaggtatgaattgccagtgatcttttttcccccccgtcagtccgcttgatttttcctacccttcgctatgcctcatcattcacctcctacaccgcccactataatgttatttatgctccgctgccatttccaacacatcctggttagcctgtagttaccgcggccatatatgctccccgtttttgccacactcgtctccgctatccccccgatattatctctaccatccgccctacatcacggcctctcattagcacttacgcttcatcgtaccatttccacccaagagtacatatgattattatttttgtgcacgctcgttcatcatgccggattatacacttggcatttgttgacagcttgccggccatgtcacctgaagacccgtatatgctgttccctatggtc

SEQ ID NO: 6627 - DNA, 655 bp, Homo sapiens
gcatgctgcagacactctcttaattctccaccgctacaactgtgctggagtttgctggaggtccactacagaccctgttttcctcggtatcaccagcggaggctgcagaaagcaaaggttgctgcctgcttcttcctctggaagcttcgtcccagaggggcacccaccagatgccagccggagttgtcctgtatgaggtgtctgttgacccctgctgggaggtgtctcccagtcattttgcacaggggtcagggacccacttgagcaggcagtctgtccctcagcagagctcaagtgctatgttgggagatccactgctcttttcagagccagctggcaagaacgtttaagtctgctgaagctgcgcccacggccgcccctttccccagttgcctgccatctagtggatgtaatgcagtcaagtcagcaagtgctttctttcaaagcaatcaacggtgcttattgagtcatgcaataatgtcatttgaataaaaacaaggccaggagcttatcctacagcacacccccagaataaaacccatctctgggtgaaggcttaaaggaactatgaaaagacaaaaaccagatcattttttgtgcttggctaatcaaaaaccaattcctttttaagccaggcacattaaataaaaaggga

SEQ ID NO: 6628 - DNA, 790 bp, Homo sapiens
attacggcgttgtaggggggaagagggtcgggagtaaggaaaagatctattaaatacatgttgggagagaggttaggttattgagtaatttagaagttggaaagacggaggatagtgggaggagtggagcagaagtgataagctgggatatagtgaaataggggcagaagcgtaaatacaagtaaacaaattgcattagagaataggtccgtgcgtgacataaagttgaatgtatattaaaaatgtaaagatattagataaaaatcaaactaattaactcatgaatgagcgtatagaacgggggagatttttatattaagagaggagtcagagataaaaagagaagacatttgtaatatattagtgaaggtaagttagatagtaaatagaatagagtaataaaatattaataaaaaaaaggttatgtaataggcgaaaatggcggaattagtcatttctatgagggagggggaacaaaatcttaattccgtaacaatttaatgaaaaattatcaaatatcaaaaaaaagtaacagttaagtcattccattcaagcacattatataagggaatagaaaaaatatacaccaaatataaaatatttggtacaggaattacctctgtatttcttacctgttaggtaactgaataaagcacattattttagcaaaaaaaaatatttcaaaaaaacaaatattatagcagaaaaaagtcctgagatgcttgaaaaaatggcaagcaaacaaattacagctctataaaaatactaaataaacaacagatcggccaag

SEQ ID NO: 6629 - DNA, 1840 bp, Homo sapiens
  misc_feature (1)...(1840): n = A,T,C or G
agaagtgtgagtacggaggttcagagtatangcgatagttagcttcgatgccgcgcgtacgcncgacgcggatcaagcgactatcagaggcagatcggttgtctcagtagtgcatgtagacaanctcgaagtatttatnctcgctgacgccttattagcgctgtgtgagaacggcgacgctgagtatgcacagcgagagataccactcgacacacncgatcagtcanactcgtcanctacatgatgatagtcgagntgcgcacgagtcaactctatgnctntataccgcggnacgncgtctctgtctcgtgtacggagtgtccggcgcgtnagctgtgctgtatgtanttcacagtcaccatacaggcatgatgaagcgcgntgtgtgcngcgtgtgtctgtccgcaatctgtatctcgatacgatgtgatcgtcatgtcgtgcgacggancttcacgcacgttgtgcacgacatctgcgcagctcactatcatagcaatctagaggagcaggcactcagcgcgagtggtcgtcgacgctancagcagncgcngcatcgccgcgcgtagcancgagancagatatctgagcagacgtatcgtctctcgttcgatgatggatantgtagatagacacagtgatagtgtgtactataacatgagttaggataagaggtgagttgaggatgacgccagccgatgtacgtatgatgtnagagagcaanagaactgagtcataacatnccgtacacagcgcncgcgccgcgctcgcagagtgtacgnatacaggtgtcagacatcactacatgacagtgagtgtcggcggatacagcagtgtgatnagaactagagaacacacacacagagcgccctcgnctacccaatggcgccgcgagctcacacatcatcgatgcgcatgtccgcgatanacgtatatcatagtacgacatcatgaatagatnatctagagcataccagcgcncatgtgatcgagtcgacgttccagtgagagatgatgacgncagctgtcgcacacatatgcgagtatatcgccgattcacactatccagctgcaagcctctgtcctgcgantcatgcggacactgcagatgagcgtatagattctccacgtnaccacgactatgatttcacnaccacgtgcacgcatgacacagtagagtcacatatagatagtcgcattnagttcacgtccgatgcatacgtgcatacattgtgtatcatccgcgcctcattctctagantcgcgcgcgcatcgcgatcgatcacgacgcaagcgagagttcncacagagccacagacgtatagagctatcagtgactcgnatcgtctgccatctactgaggctatgttaatatagtatatatatatatcggcgactctcactcncngtatgtatcgtactccaccatatccgnctcgtactaatccacgtcatgacatcatcatgcgcacggtccagtatagtatgtgacncctacgcgcgtatcagtatatcgcgcgacagctcgcacagacctgcactatgtatacgcgctgtgtacatacgttcgacataccatcccgtccgtatttcattcatcgattcatccgcgttattacgtgattgtcccatacgctgtcgtttgccgatacacacgccgctaggtcgacncatccatnattatatattaataatcacgcgccccatcatatccatgcatcatcgcagagctagaacgagtctatgacgatatgcaccgtgcggcagtttgcgacgcaccatatgtaccgctattcactgtcatcgttgtntatctgcctcattccccactagctctgcc

SEQ ID NO: 6630 - DNA, 168 bp, Homo sapiens
ggtttctctccaggatcttgctacttattgatgacaccgtatcaaggcgccagagtccaaatggtcatcataagaaaaactgcacctaacttccacagcctcctaagaggcccagagacatcactgtacttgcctgccatcctatgtggtgctggaaaaaaaaaaaaa

SEQ ID NO: 6631 - DNA, 966 bp, Homo sapiens
  misc_feature (1)...(966): n = A,T,C or G
aactgcggcccnccccnnnnaaggggnnnnnnnccaccngttttaggcgccaacagaagcctcaaaattcacctgattatgtctttgggtattttacaagggtgcatatccagtgattgtgcggggctttgggtccaccctaactaaagggcgtccgccgcccggggttttaacaaaacgagttatttatttttagggagtatggctcctttaaaacacaaccccttcaccggcctttctttcggccttcgtaaaaacctgcctccaggggggggcttttctctgtgggggggttttttttcttaaaaccacctaactccctaacggggttaaaattaggggggctttttccccgcccgcggtaggccccgttttaaaaacgccctttgttctttatactcctggcgcccagccttctaagggcgtgcgcgcaacaccccacggcggccgcgctgtcagccacctcatgtcttttcgtcccaaatttgaaaaaaataccccccctccccttccctgtctgcttaacgtgtgacgcctcctataaatcagacaacaaaacccctcctccccctgttgtataattgaattacccaatcaaaaaaataaagactcaccctcggcgtgacccttccctattatgcccggggaaccaccctaccttcgctggggaccacccccacctccattcctaggatcctaaattcggaactctttcattctaatgcaccactcctgtacattgcgcaccgccccccccatcttgtgtctcggatggacctcacgccccccccctcataccccccaagcggaggatcggtgtttcaacaataatagtaacccgcctttttcctaattcgaggcgggaacaactctttgtctccattattcttcaaatncgataaacaacgaacactttctgtcgtgtgtgcataccatcccccccggnagatatgcatattgctctgc

SEQ ID NO: 6632 - DNA, 370 bp, Homo sapiens
cttttgtgtgaggggagtaaatgttttgattgttttgaggaaaatataaataatagggggtttggggggatgatttttcgttagaaaagtgtgaggttaaaatggttaagggtgtaaaaattttggtagaatttggaggtttaaattttggttaaaagggggtggaatttttaaatcaaaaggggggaaaagtgggaaaaattattttataattaaaaagaaaaggtggaaattaagggttaaagggtggttctagtttggaataagaagtcgatttttaaagaaaagtggtatttgaacggggaaggggttaaaaaaacgtttattagggaagatgggcttggtaagtgaaaaattaaagtaagtaaat

SEQ ID NO: 6633 - DNA, 335 bp, Homo sapiens
cattcacatatccggtcgtctacggacaatcgtatagccgaggtgggcgtgggggcgagtaatgggtggtgggtgaatagggggggagtaggggtggagacgggagggaggtggtgaggagagggtgatatattgtttcgtcgatcgtagtagtataggcgtgagtcggtgtgggttggtgattgccctcgttatggaagggcggcgaagataaggggtggggctggaggggcggggaggggtaaggcgctcaaagaggggcagtgacgcgtaaagtcaacaatcacctaaaacaggttttacgggggttaggtcctggaaagcgcagaatggtg

SEQ ID NO: 6634 - DNA, 830 bp, Homo sapiens
tcggtagatcttttgtgtgtttgctcgcgtgagattggggcttcggcgcgcatcagtttttttttttttttttttttggggggccttaatttttttttgggaaaaccacctccctaaagggtgctgggaaggtgaaaaaaaaaaagaaaaaaaatcctttccttttcctctcgaaagggcttccccaaaaaaccccccgggggttttgggggttttttgggacccccggggtgaaacctgttttttaaggggccggggttcccatagacgggggcccttctttttttcttttgaaattgaaagggggcgcacccccccccttcggggtctgcctttgtgttggtgacatttcgcccaccccccgtcccccccccctctctgtcggtgcccccctaagggggcgttcccgtccgttagatcccctctccccccttctccccctacccctcccccgtccttgcccgtgctttttcgcgaaacgccccgccgctctcgggtctgtggggtctgtttcccctttcgtcccgcctttgcatcgggcgcatcagtatttacctccggcgccccgtcgtgtttctcccggggtcttccgtcctcttgtttcgttctttccccgctttttccccccctttccccctcggttcgctctcccgctttttcgcgcttcctccttactcacttctccgtatcacctccctcctccatcctttccccctctgtacccgtatttttttgttccccacatcctcatcctcccctcctgccgttcgcgttcgcgcccgttcgccccctatacccgcccctcacatgttctcggttcgccggcatcg

SEQ ID NO: 6635 - DNA, 487 bp, Homo sapiens
  misc_feature (1)...(487): n = A,T,C or G
gtcttattttatgccatgtttattgttgaaaacacatttgctttaacaccttctgacagcctgagttgctggacttctggcaaagtgacctctgcagctggaatgggaattgagtggcaagctggcctgtgcatctaacctagcaccagtgacccctctgggctggcccagtacaactggctttggtcctgcatgctgaaaaaatgtttaccagacaagtaacaagcctcagatgtgggactgtcactctattcattttgacatgtaaaagaatggtcactgcttatttgtaaccatgagccttaaaagaacagtttacagccttggtatccagaaaagcctcanatacccatgagcgttattctgagcatgcattctgagactgaattgtaatgatttcttcttcttttttttttctactcttaaacatacttttagcaagttgttctttccaaataaaatattaagaaccctaaaaaaaaaaaaa

SEQ ID NO: 6636 - DNA, 1618 bp, Homo sapiens
  misc_feature (1)...(1618): n = A,T,C or G
cgtacagcggcgaaggaggcaatgcggggactagtgcgtcacttgcgcggcaacgcggaatagtactgattaacggatatatcaggagacgatcgtaagaggcagcagtacaattaaatgtacagttggacctagtgcgggcgatacgcatcgtaggacgggaaatatgaatcatgaatgaacgcgtgatagggttgacgtatgtcatattacggggtaaaccgaacaggggggcaatatcgggtggtaaaaggactggagacgaatatgtagtcacgtagcgaagcattatggatggcggagaggtaataaataagaatacgggcgccattcacccgctgtcttatcaacgtgatcggtgctgcgcgcacgtgaataatgagtgtgcgcatacgtagtatgcgggggatantaatgaatactcgactatttcgtactctatcattgcattgtacctatgtgtcctcggcgatctcggcgtgatacttcagggtcgattggccatactctgggcatatgaccgtctgacgttctgtcacacggtgtcggcatgctactgctatctaactctcacgtatcgacgtctacgcgcanatnattcgaatgactgggggcaatatcggctggactcgctaccataccattaatcgaccataccgagtgcatctaggcgcgagcgacgcatgatgcgaggcacgtggcgcatctgcgcgctcgcgcctgtcttctacttctntctcactcacaantctctctcatacgctacacacgtgagtgcacanccctcgctctacagctgcanaactatatctgcagactgagacgatgactgncgcagctgatantgangcgacatgcgngatganacaatgtcgcgatgtcatggagcgctcgcacncagtacatcgtatgtgtcgcgacttgcgctatcacnatgcacactgctcactagtcntgagtatccatccatatgaacgtcgtatatagnttctcttctcatgactaactcatacggtgcgaggcgctgtagtcactgctgcatngtcgagcgtcacgacgtcagcgcggacagtcacgctctgcaattangntgatantnatnactgtcatctgcagtacgntctaagtagtgtatagctatgctcactantcgcggcntgactcgcgcgacgacgtctccaatctgtcactatagcagtngtgcnatcgaaagtcgatgctcagtatagagactgatcggtcacgtgancgtacagatctgtcgcagagngtgngtagtgntatnangacgtagctcagtctctgtccggtctgtattctgactactactgtccggatcgcgtgcacattcttattcgtgtgctaggcatgatatgttactgtatgctagctcattgtccgtatcgcagctatgtctggatcgagatcgtacngacagatagtgggatgctcactaggactganctgacnctcgntctactgtctcacatagtcgcaccantattgcgcgctcgttgtacacgtaacgtgtcactcgtctccgtactcgctnttcttgtcggccagctacggtacagcatactatctcatctcatctgctatcgatgactacttcttg

SEQ ID NO: 6637 - DNA, 746 bp, Homo sapiens
aggccgtttcaagttaactctcctgctccactgatcagatttggccttcactgtgaaataatgaacatcatggatgagaaagctgatttactgagtacaccagaatggcatctgatgtatttattgagtcaaatgaagcaagtttttatgaaacatttggttatagactagcctcaatctgtcgccaggctggagtgcagtggtgcaatctcggctcactgcaagcttcgcctcccgggttcccgccattctcctgcctcagccttccaagtagctggtactacaggcgcccgtcaccacacaccggctaatttttttgtatttttagggcaagaccggggttctacccgtgtaagccaggaatggtcttgatcttcttgaccttgtgatcccgccgcttcgggctcccaaagtgctgggatttacagcttaaattgtcccttaagttgacaatgtagtaccttccaccgggtgcaaatttatggttggtattttaatgcaccagagcacgctatcaatatttataaaatctatgccgcggtctttgttgttttgaaggttacatagaattttccatattgaagcctgaagtccccaactgcgcccagatagcgtgttctgcttctttagtgagataagtgaaatagaggtgcaagactgagtcgtaaggtgatgatgacagatttttgtgtttattctccaactataattttgaactagtttactctcactctgcatccgagcgc

SEQ ID NO: 6638 - DNA, 1764 bp, Homo sapiens
  misc_feature (1)...(1764): n = A,T,C or G
tntgtcacagcgcactacgtcaccncgcngtatgttagtcatagttcgatattcgtgtgcgtcgtctcgtcgactgctgtgcgaacgctcgctactcgtggtgncggctacgcacctagcggtcagatgcgtangtatatgaatacatagtgcggcgagtgtatatgcgtngagngctagagatcattantnacgtatacggacgttatctgtgngcacgngggatngcacggacgaggtagactgtgatgnacgtngnttcgccatnactagcactgcggccgctcactgacgtctgttgntgcgcgagtgtcgctanctcgtctatgatcacacctagttgagagttctatgactanctnctnctagtgtcncaaganatatntcgctgagtcagtccagttattgntactcttgtncgcacacgattgtctgctagngtctgatccgcatntcgagcgtcncactctgagagagtgcgaagtcgtacatnactactcgtcgcatgtcattaccgcnctacgcgctgtcacgnttgtatcgatancactatntacagatgtagttgcatcggcgacttcgtgcggagacgcagcgagtgntccagacgaatagtacanaagacgcacataactacgnaacatagtangagagtgacggangcgttactacgcgtctctctgctcgacnagaatagtagcatcggacangctcngcgtcancgtacatgtatgagttcagagtcagtcgtagcgangtaagtgtgtgattaatagagcgtagtagagacgtcataagagnancgagaatgcgatcgcctcgcattctgcgaggcgcggcatgctgagcgtgatacgatggcgatggctggggacgctgcgtgtngctgtgctctcgcggcacagtgcgtgtgtggtgtggtgtcgtggactantgcgngcgcgacggcccatctctcttcgcncatatctcgtgacgctgctntnttgagtatcgaaatgtgngcgtgtattntntngtacaatatantaaacaactacatccgactgtgttgtggtatgtcacaatatcactatgagctgaaaaggagctgcattcatntgtacctgcancaatcgcgtatactcataggcacagaatgaggangtcgaacggagtgtggcagcgntccgcgctggcgcgcgccgcgcgtgtggtgggttgcgagtagtcagcgcgaactgcgcngccgatgatgacgagagtgcgcgatcgcacgatggcatggncggacgatatactatctgcgaggttgcacgtcgcagacgctgcgcgtctcgtgnctagctatcatgttncgacctaatgctacacatacacactgaccatatcacncatctatntatattgcgcagagagtgcgagngaccgactgcggtggtcgctgntgtatggtggcgtagtatgagatggagtgtggaagtagtntatccgcgcgcgtcntagtcgctagcacgcgcgtcttcgctgcggtcgcaccgaaacatcganggttgtactcgacgtgcgctgcgtgttgacacgtggagatggngggnngtgtgcgtcgtatgctcctcgcgtctccggcaaccccgtgctnnctctgatgctgggctnctctcntccggtgaagactgctgtctntcttctntgctctcgactcgtttgcattcttactcgtcnnacagctganctctcnnaccctatcttntttnnttttagttcgttttnctttttcccttt

SEQ ID NO: 6639 - DNA, 552 bp, Homo sapiens
  misc_feature (1)...(552): n = A,T,C or G
atttgaagactgggaaatccgagatnaaggagctagaagaatcagcgactgntnagtgctgccctagggagagatgaccgtcatggccggtactgtagggctcgcaggtagcaaagaaaaccactttgtgttgggtgatcagcggagcgccgcagccgtgtcgtgggaccgcgaagatgacaaagaggcgcggtctggtagctcgtatgcgcgcaaacgataggtcgtacatgtgattttatgtggttggcagtgtgtagacgaacactgtcccggcattgtcccgcgttggtgtcccgtagtgttccgacgtttccctcgctgatgccagccggccgatcctctggttcgatgtctgcaggctaggtttacagacacatccctctcggcgagagatagctctaagccgattccccggctctgtagtagatctgcttcgatgttttgcgcccccgccatttagatcttgtatgcgtatctgcaggacggatgaagaagtgtcagagtgcacgatgttgagatcccttatgcggtcatagtgcgcccgcctat

SEQ ID NO: 6640 - DNA, 782 bp, Homo sapiens
ccactccctctgccgcctctgcttcctcctttcccatcccttccggctcccgaagcgccccctcatccttacccacccttcatttactttagtcctccaacacccacttttcacgtcagccatttctccccccaaccccttcccagccgggagtgcagacccccatccgattccgctttccaaagccccaaaaacacatctagtgcctgccgaaccggcctaccccactagtagatcggtctccatacgaagcaatactcactcctgctggataagctgtcttacccgtaggcccttttacagatacatgtcatcagtgtggatgaataaatgtcctcccatttgagagcactcctgaatcccaagtactatgcaagagacatatgtgtcctcccaaaattcgtatgttgtaggcctaccccctagagtaatggtattggagatggggcctttggaaagtaattagggttagatgatgccccgagggcagggccttggtctgatgagattagcgcccttctaacagcagacactgtgtgttcactccttcgcccaaagctctctctcttctctctctctctctgtacctctgtatgcacacaaagaggagaagtcatcatgtgaagacacaatgagatcattgccacctacaacccaggaagaaggcctccccctccacccaaccatgctgacaccctgatctcagacttccagcccacaaaatttgagaataaatccgatgcgccgaaaacaacaaaatatcctcttccccccggacacgc

SEQ ID NO: 6641 - DNA, 1162 bp, Homo sapiens
  misc_feature (1)...(1162): n = A,T,C or G
gactatgtgcactactctcccagcgcgaatatacgaccactatcacgccgctactgctgcatcgacgctccacccgacganagcagagtaagtgtctggtagtagtctacgcgtcagagnaagctgtcagagcggttctcggatagttcatatataatgacttatgtatggaagtcaaggcgtgctggtgtcggagcgctctacgcccactctctcacactcatcatatcgcgctanaattgacacnctcgtgcgcataattgaagtgcgtcgtcgccacggtcaccttgtgagtccagcggcgaatcgcagacaaggactgtacttgataagtgtctctgccccctaaacttctccgtaggcgacgccaggagcccagccatggatgagaatntgtgagtcgacctactgcgacggacatgcgggcggcgcgccacaggataatatacaaaagcggcagaggggacgtagcggcgcgacggggagctgcggggcgggcatccgccgctccgtggngatagagctacaggattggatacgtgatggaaggtgtgctcgagccccggcgcgaccgcggggggtctgcgggcggtgtgaggggggtctgtgacggaccgccgatgacggtgcgctcgtaggtggaggggcggggctgttgtggggcgcggcccacatacccgcagccgcgcttcggcgcctgaccaataatgcaccccctagggcgctctcgcgcgcgttactcatgtatttctgttgtagattgtcggtgaatcaacacagcaatacgacgaggcgcggggggggaggagccgacgaggagcaggggtttcggtttagggggatgggcagtagcttagggcggtattccacagcccaacacccttcgcgctacaaaacggctaattttcttggatacccgaaaccaacaccacaacgcaccggttcgcgagcggggctgtgtgtcctccgcgccgcgcccccacgggcccttgtgggtgcgttctcgcagcgggggggcgctgcggggcgccgcgctgcgcgttgtccgtcctgtttacctttttttttttttgtctttttttgcaagatgtttgctcctncagtgcaccaaggccgtatttaccgcagccgtttatttcnnncnacgccttccccacttccc

SEQ ID NO: 6642 - DNA, 690 bp, Homo sapiens
  misc_feature (1)...(690): n = A,T,C or G
aacgatatttaccgggggtgggatgagtggattagtgtctgccattatataagaacaggacgatatggtgcacttgcagaggtagctgtgcgaaagggtgctggcgccgtgaggtgtatagtttgtgtggttggggctaaaagtgaggacataattactatcccaaattcttggaggtccgctatgatagtgggtatgtgatgtaggccatgttcattttgtaatgttgtttttataggcgctggtgcaggttaaattaagacgaggtatgtattattatagagtggtcatgcgaccatttacgtggaccctttattccgcttttgagagatcatttttaagtgtgggtggatagcatatgttaatgctgtattgatgccgccccatatggttgtttgaatagaaggagagagagggtgtagtcttttgcagtgacgacctttaatgggattttggtaatcacggngaagtagattatagagtccgcagtataatttgtgtcggacggttataagagggaagagtgaaaatagcataagacacgtagggaggtagggaattcggggtggagtgagacaaagagtaagtgatatgggtcgcggatgtatacgtggtggagggaggagtgcgagatgtcgatttgtgaggttagtgttggtaatctactcacgaagtctataattattgtat

SEQ ID NO: 6643 - DNA, 1525 bp, Homo sapiens
  misc_feature (1)...(1525): n = A,T,C or G
accaggaaccgagaggggaaaaaagggggacaaagaaacaaaacctaaagagaacaaaaaaagagggaaaagcttcagggggggggggaacaaaaacaaacgcacgaaaccgggaaagacaacaacgggactataaacagagcgggggaacaaacacaaaacaccaaaaacggggngcggcgagcacaaaacaagagggggaaacaccacacaaaacaaanaacaaaaaggaaggaggagaggggaaggagcacacacggaccacacngcaacacccgcaacaacaggggcacgcangcaggaaaacataccgaggcggcacacaacacaaaacacacgcggagaggagggaacaacaaaaatatttgttttagaaganagaacacggcacaacaaacgcgcagacaacgcngaccccatcaatcatagtgtgagccactgaccacactcgaaggagtgatcggacgacacaaacaacaatgtcgagagagagacaacaaataccgagcggacgaccaccgcgctccacaccaacccagcacacaaggacgggcggggcgcatgcacaagcagtagacactacacacagcgagacatcacggccaatgatccccggaacaacacgccgctggtgtgtgcgcaccagagttaccaacatgcgcaaccgcagcgatcaccacacgcgacgcgtgacacacgcgcagaaggggcggagagagacataacaaanaacacagcagagtggcagccgcagatgcacgaataggagagcgnctgactctagaacgccacaactgacacgcaaacatcgaangcggccgcgcacagagacgcgactcaacacagacacaaatcacactcaacgcgacgtggacnattatcgggtaccaacactacacacacactcagagactcaccgcgaaccaacacatgcagcacatacacaagagcacacgtcgcgcgagtacggcgagactcacaaacaaaacatagtgtgagcaatacgcagacaacagacaatacacaaccagcantgtgngaagcgtccgtggcacactcgcacaacctaaancgcgctnagcntacgcacacactcgacggagtcgagatacgcgatcgatcatagcncgaccgcaccacacanaacacacactacacgcgcgngcacgacaacacactactgtagcacagtcatcgcagcacaacacacgctcgtcaactacagaccgatcgagaacaantangaangctgagtcaggacancaggcgcgcacgactaaacggccacgcncncgcctactatacacactcagacgcaaggagatgcgcagacagagagagaggtatagactagtctgacacgacatgantcatacaggacgcgtgccgtatntataangcaacacaantccatgagcagatgagcagaaaccaaacgacgacgatcagcgtggcgagacgcatacgtcacatagtacnacnanacgtcanacgcncatgcnaatcnaccantcagacacgcgca

SEQ ID NO: 6644 - DNA, 1536 bp, Homo sapiens
  misc_feature (1)...(1536): n = A,T,C or G
gtntgactttagctttctatcgtattcttcattctcggtctgtgacgcccttattgctctatcctcgtatatacttcggtcgatcgtagtcggaatacgctcgatcgtcggtgtcatggaggatataggagaatatacgatagtgaagcaccgcgccgttgtgtacgccaaaatatatagcgagatggtgtgtaccggcgtcgcgccgcgcgtctgctgcgacgccaccgtatacgngattcgcgagtgcgtgtgtgcgtaggattatggacagatggcatatagatactatagtgatcgtgaactgcnggctggtgtgcgtgatcgctgcgagacgggattaaacacacgatcgtctcggtcgataatgaatcgataacgatgtgagaggtatcggaagatgggcgatgatgtagcggtatgattggatgaggattggaagaaatcgtatatagatagataatggtgttcctgtacgtagagacgggctgcgattggagaggcgtatagtataatgacgtgctatcatctgcgatcatcgacgtgggctcgaagatcaagtctgcttgacacgtagcgcaacggaaggcgacgcgacggcgatatgtatctgcacacgttgttgtacattctgcctttgcgtcatactcagggagtagtgcatgtgtgtgaatatatgcggatcgctctctgatcacgactcacgaacnttattaacacagactcagatgccgatatcactacaatccatcatcaccagctcttctcacgcgatgtcgccgctcatctgttggaagtgtccggtgtctacatagccggtggtcgtcctagatgcgtcccagctacgatatcgagtcgaaggaatggtcaacatgacacatgacgtggcgtaagtagtctagctgcctctctaactctaacacactgtngctgatgtttatcttactctcagccgccgaggctacacaatatatgcgcctgtctattccatatcgacgtcgacgtatacgccacagcaagactcgctatcggtatacccatacacgaactatagcgatcacgatgtacgccttgcactcgacgcatcttctgatgcttgatgtggtgtgngttgacacgggtcagcanctctctcacagacatagcacgtacggatgacgtgctgttantngatctanatctcacatctgatatcgactgtacgagcgacgtnagtgcgtggacggatctactgcatactctgacgcgacaacatatctgagactctgtcgctgtctacaacatagagacggaacatcatgttcagtgtcatnagccgattgnagacttatttgacgttcgtgtgatattatgttcggtaacgaatcacgagaccaacaacantactcngtcatatatgatacactcgttcnantntatactgtctctcgtcgatngtgttcaggcacctgctactctatanttctgctgngngngagcgctgctgcgagagganatagagctncgcaaacttaactagaactagtatctaataca

SEQ ID NO: 6645 - DNA, 1197 bp, Homo sapiens
  misc_feature (1)...(1197): n = A,T,C or G
ggtacaataaggaaataaattataggtcgcgggtcggctgccacatggaacatgcttcgatctaatgccgcncgcggctcacggagactgtgggaaaggggagaaagaggaaacaacgcacgagccgcgcttcgcccaaaaatgtggctggtgcctggcggcaggccggacttactgtcgcccatacnactcctagctcggcgagctggactgcctgagcgatctctaccataagtcgtgatatgagctgtagacgcggatgaatgaggcggcaacatacattctgctagtggctaatactagatcatccgcgggtgtggcacggtcactggggaatctaagctgaacgtgtgaggcggatcgggaactgagctcgcagattagagcactcgcgtcgaccgtggtccagctctcggcacttatccacgctgaactatacccccgcggctcaataaacacgatgcactgacgtcagaaagatagggatgtagtggcgggctgtaaatgactcggttgacccggttgcctgagcgtcaactctgtgtatctcgcttgagcgggtgtacacgaccgacgggagtgacccaagacgcgtgttgatgtagcttgggcggttcgccggtcctccggtcgatggtcggctccacccccctggcgctgggagcggccgatcgggtacgctgctacacacctgcctcacggtactcgcgcacacatacctctttcacggaggcgcggcacgacgcggatacaggcgcagccgatatagggcgctcaaccaaccaccttctcatcgacatcgcgagctcgcacttatcgactatccataaggtcagagaccagggcgagcgccagcggacgccatcttctctgtcgttttctgtccctgcccactcgcacatcccgtactgacaccgtggtacatgtcagtatcgatttactcacaataccacatttcgcctgcacagcacgcgcggctcacttcactatatgtggcaatgtcatgtgcatttattctcgtcgaaacaggttatataaaagacaacgtcactatccccacaactcacgcgtcgagaaaacacatgtcaaaactatctctccctcaagtgtttccgtgcgtgaaaagggatgtgtttagtcttgcgtggcggcccctcgagcgnacgtaattcctcttctattatcacgtcgtgaatt

SEQ ID NO: 6646 - DNA, 1363 bp, Homo sapiens
  misc_feature (1)...(1363): n = A,T,C or G
gggcgcgtaatacgaggtatatgtacataataaacgctgcgcagtacggcctcgatagtgcnatatatcgcggagcgcagttactacgcgcgcgtgcgtgacgcatggcgtataagtgcgttcgtaagngggtgtatcaggtggaaaaagagtagagaacgacgcccgcgtcgtgcgcccgcaataaataccgctgtgtgatcgcgtgcggtgatcgactctatcagtataggagcgctgatatctcgtatagttgtatcgtagtacggcgtagtcacantgcacatgcgaaatcgatcacgtcatgaacgcacgatgctgcggcgcggcggtgcgacgaaacgtgctcgtgaaatatccggattgagagcgcggtctacatcactatgtatacccgctgagcgtgaacgacacaagtgcgctacatacaacgacacacgagtacgcggaatagggcgtacgcgtaccaggatcagtagagcgcgactcacacgtcgattgtcatagatgagcgaagggtatgcgtgtatgtgtttaacatgacctgatatggcacacgcgagccgcgtactactgcgtagtacctcttctcatggcgacgacgtgccacattgtggtgatcccataccggaaggcgctcgaaatagcggaagttgtaactcctgcgatgcgcggactgatacaaatatatcgacattctacgcgtcaccgtcgtgtataaaacggagaatgtatgatacccacaaaccaagtgatatcacgactccgtcgtaatgatgtacctcgtatgttcagagagtacttctcatctgcggtcttccgggatctgtgccgcatccccgctcgtagcataagcgactgtcatcatgtttcatccgggcctagtaaacaagacgagagaggggcggggtgtctcgggcactgctgcggcgcgcatataacggccgcctactgaccctctccttccctgtcctacgacccgcgcattggtaagtcttcctcattcgaatatcgacgttaccacgtggctctacctcgctcgcccccacatcgtgattgtggctccactgccacaatcccaagaaagacacagggtcgtgtagatctctcaaccctcgcaccatcatcacaatgctggcaactagacagacggagacatttacgccaatgtcgccctcactgataactctgaattcatcgtcatgaccgcggaacacaactgttgtatcgcctcgcatcctacggacaccactcaattacaaactagacacgcactccttgtctgtcgccgggtgaagcggtatcgctagcgtgtcgcgtgcccgactcacttaattatctgttataatattagccatgatca

SEQ ID NO: 6647 - DNA, 1519 bp, Homo sapiens
  misc_feature (1)...(1519): n = A,T,C or G
gggcgcacactcgacnaacaaaatccagggttgggcgtgtttgagagcgcttgcctcccgcgcagcagttcaaatggctagcgggtgatcgggatatggggaaaagaaagaccaccgccgcgttcgcccaatacactgtgggtcggacacaggcgcgagatatcgacattatgtttgagttagatggtacgcgcgcgcgtgatcgcgacacataacacatggatactatatatactaccgtacacgcgggtgccgtgcggacgcacgcgcgcgcgacataatnactggcgaggggaatagtaagtatatagcgagaggtacggacgtgccgagatatcacgtatatggctgcgcgcgcgggacgctcaggatcgtaggcgtacactagggctatcagtagtgagagcgctatgagctcttatccactgttgtcatagggaactagcagcgtgcnaccgttgactatcatctcgacgtctgctgctaatcagtcgtgctcaaactaatctcaagtctgaagttatatggcgaacgcgtcgcctcacgcgggaccgcagaaggcggatctacgctacgtcatataccttagccgagatcatactgcgctcggcactgacatcatgtcagatgcgcgcggatcagacaccaacagacatcactggcggctagtcgaccgccagccgtggcggatgggtcgagtcacacgnacgcacttcantngatgcatgccgttacgtgtaatcggtaacgtcctgcgtaccttgtgccgcggcgtggctgtgcatacgacaacagtacaccgcgtaccgtacgntgacactacgcgcnagcgtgatgatactaatgcgcgcgtgatntcngtcggatcgctgagtagcctctgcgtagcaatgagatctccagcgtacctagataactcatactcagtgctatttatgcnctcgattggagagctcgtgatgcgaccgatggctgcgggcngtggacgtcnacccgtccgtatcgtagtagctcatcantcacacttgatntgctccactctgacgncactacacacagcacagcaccacttatcgtgatcgtcggatagttgtgcgcttacnacgtgctcagagacatanacacagtccatcgacangacagacggtcgtaggtataggcatacgaatgctacatnttagcacccgattcttccacacctgctgtgcgattactagcgactcgtcntgactgtnacttattacgtcacgtgcgtntgtgtgcgatacgtggtagacatgctgcactgtgatagtagcagcgctacgttggcngatgcgcatatactgctgtcgcgttcatgtactagacacgactacggtgtaacacacattcactatgatatatantgtacacntnctcacctcttagttctgactctctngtctaacaacactagtcagcactcacncgccngcgtngcgcgcactcgcagcnntaccttagccgtctagtntgaaaacttgacgtgcgtgagaaa

SEQ ID NO: 6648 - DNA, 607 bp, Homo sapiens
  misc_feature (1)...(607): n = A,T,C or G
atagtaagagcgcgggacctccatattttttaagcccagggctaaccacggtataacccggtttttgcgccttacgccctcccatntatttttacgcgacgctgtttcaccccattttgagatacaccgaatgtttttttttttaccaccccaacagggctttttttgaaaccccccagatcttttttgttttaaacccccgcccgggaacacacttttataaaaacctggttctataaggcaccatatcctttgtaccccaaggggcccaccccgatttttttaaaaaaataaaaaacattttgggcccaggggggggggttaccccggatataccagactcttggggcgccaaggcgagggggcccagaggtcaaataagggagcccctcccgccccacatggggggatccccgttttcttaaaaacccaacaaaataacttgggagtggggggggcgcccgttatccacccgttctgggggggtaggcaaaaaaaatgttgtaaccccggaagtggggttttaaggtatccatattttgacctcttgatccccccccggaggcaaagggaagttcccctcctttttgaaaaaaaaaaaaaaaaa

SEQ ID NO: 6649 - DNA, 515 bp, Homo sapiens
caggacggattctaccacccgtttcgaactagaccgatgtatattttatataccccggaagagggttttttgccaaatccaaccagcttttttattgatataaagaccccaagggggagatcccattttttaaaagcggtttaatttggcaacaaaaattcctttttgccaaagggccagatataaattttaaaagtaaataaaaacttttgggccacgggtagggggttccacccctgttatccaacacttttgaggccgagggaggggattattaagttaaaaaatggggaccatcccggcccacaagggtaaattccctcttttaaaaaaacaaccaaaaataaaaggcgatggtggggggcacccctaattccaactgcttgggaggtttaggcaaaaaaaattttttaaacccggggggggggttttaaattaaccgagattgagcccctgcactccagcctggagaaaaagggagaatcccctccggtttaaaaaaaaaaaaaaaaaaa

SEQ ID NO: 6650 - DNA, 380 bp, Homo sapiens
caggttgacaatatgtataaaaagtgtggcatttctgccaagaaatacctcgtttccacaaggccaaaaagagttttttaaaacgaaaaaaaagagcatagggacgggtgtagccttccacccctaatttcagcctttttgagagcgggccccggggaccaccccgtttaacaagggggcccttatggccacaaaggggaaaatccggttttttaaaaaaaaaaaaaaaaaatgggggaggggggggggaccctgagatccactttgtttggggggggtggcgaaaaaaatttttttcaccccgagggggggttttaagtaaacccagatttaaccccggcagttcaagctggaaaaaaaggggaaatcccccccgtttt

SEQ ID NO: 6651 - DNA, 132 bp, Homo sapiens
cagcgggtctgcaaaccggagaaaacgaaaacacaagcaggcgctccagtggcaaagaaccgcgctgaaatttacgttggggcagggttctagggacattgagcagtggacatgatccgggaataaggcggc

SEQ ID NO: 6652 - DNA, 1377 bp, Homo sapiens
  misc_feature (1)...(1377): n = A,T,C or G
cccacgacgctaccccctgctccaccattcaacctgagtaccacgtctgccaatgactaactcgatcgacnacagacactcttcnacgcctccacgaccgtttcttatacccgcatccatcacgtacgcatatccgtcagcttccgtgcttcgttcgctgagcaccgaacgctcatcgactgtctctccttcccacatcgctncctgacatccccatcctccctcctcccctctgcagatcatgtagcactgacncatccacactcgagtagtattgtctntgctttgnatcagggtccatgactacgaacaattcacttgacactatcgtcaagtattgtgacacacttgtaaccnactttgataatctatattacgactagtctaatatgataaatatatcgttgtcgcgccgcccgaatacagagtgatgtgcatatcncacggcgcgctcgtaccacacagcgcgtcgcagcgtgcagcccaacgaccccgtagcgcagttacggtggctagtacgacccatcttcctctagtgccgatcatatatganactaaatgtagtagatcgaactcctagcgtcatcaatgcataccatagtctgtgctacgctgcgcttcacggccacacacaacgtctgtataacgaaacccgtcctcccgtcgcgcgcggtgtcagagggagagacctccggacatccgaccttgtacattgtgccacctacggaccgtcgacgtgcgcgcgcggcgcaggcggagctacgacggcgcacatcgtagtcacatgccagtaatcgacgtgcacgcacacgacaagaatgcgacacgagaagacgtggccgtgaccttgaatgcacatgaacgcagcagtcatagaccctatgagcagagaggtcgtagagtatgatagaactgtggtatcgcatcgaacttcccgctagagtatgcactgtcgttgntatgcagagcnagagatcgataaccggataatgacgagcaccagcggcgattacattgatttgtgttgtcggttacggcgcgagtacgtatacagtatcagatcgtcntcccaccgctcaccctctctctacaccgccttctcaatgatcatattatacgtactcagagtatagatgtaaagactacacgcattcccgactgatgtgtcatagtatctgagnngtcaagcgacgcgntactacagctccttaccttccacggtcactattatgactctcgccatgcncgcgatcgctcgatcacctcacgcaacgctacatactctctcactacagtgcgatcatccgtctatgcggactacactggtgctctcacgtcncttcatgacntcacgaccgatcggcggactgactaacc

SEQ ID NO: 6653 - DNA, 202 bp, Homo sapiens
acccgtgccccctcccggtttctgcttcattttcctcccccattccccacttatattagcctgctgctgcaaaatcaaagttgtcagtaatgcctcgtgaaacttacggaggattcaagggagaatgatttttttgtgtatttttcagcttctacaaattgccttttgaggcttgtggtcctgtccaccttcaaagccagac

SEQ ID NO: 6654 - DNA, 1448 bp, Homo sapiens
  misc_feature (1)...(1448): n = A,T,C or G
cacatacacttgcgacacggtatatacgttcagtgctaatgacactactcaaccacacactcgtgataaggggatgcgaaggagaaagcctgatccggatcagcataggtcgagacttagcggaactcacctctactacgcctactctctactagcactcgccatgttaatctcggccgtgctgaacatgagttgcacactagcggcacatatggcgtgatgtctaagatgatatagagctacgctctgcgtaagctatattttnccctcacacacttcacttcacacgacacatgtaccgttcaaccgaactcatacatatctcccatccctcgccacgcccctgcactataacaaacgagtatgtgccgcatgtgcaccacaccggccggaacacatgcacaacacgataaagaacactcaacatcgaccatagatagagacactcctactaccatcacaatagatgttagtataggtcgatgacgagtgacgcataggccgagccacgccacgcgctactagatgtcaacagagatataattaaagcggattcttagtaaaggtccctggctatatgagtgttactatattgtgcggatgtcgatgcgtcgtagcgtctgcgtattgcaaatagtgatcgttggatgagtatgagggtgcgatggcgtgatgatgcatgatacagaccaaactcactncacaacatagtctctaaacgtagacctcagcacactacactcacacgatggggcacagcatgtcacgccgactccacatgactgcatgcaggcagacgctcatagaccgtgtggtatatcgcgcaagagtacacccaaccgcaagcacgcgaccatatatactcgaactcactcagcgtgccgactcacgctccgtcccgtctngtcgtcacatcgcgtncacgcgactgcctcgttcatactgtcgacgtaatgtcgcgtggctcccaatcaccancttcatatcacgatgagttatattatgtatgctagcatgncgactagcaggcacatgaccatagcgncacacgcgtatatatagtgtagagagtcactagctatacacaccgagagtgcacagagtgtagatcagacttatgatgtcagtatctnactatataatagtatcactgtgctcttgatacatgtgtgatctatcgtcattgagtagctatatcacgtgtaccactactgtcacgtgcnagcgcgctatgccgccgtcagcagacgatcatacatatagactatcagatccgttacgctacatacggtctttgtcgtgcgagcagtatgtagtcgcgcacaaacatcagccacacgcacgcaaaccaacacncacacttcacgctgctacgacaangctcacatagagacagtgtgacgacggcactagactgcgcangtgtgatacctacgaagcctcgtcgt

SEQ ID NO: 6655 - DNA, 202 bp, Homo sapiens
ccccccccaccccaccgctactcctccaaagccccaacaacccgacaagaaactttaggctgacagtggaccctctctaattaaccacacgctacagcagtgctttccattgctcatgccaattcttagaagtattaaatatgcggggtgggttccaagacgaagttgcaaattttcttaagaaaatcgtgcaaaaaggaca

SEQ ID NO: 6656 - DNA, 2092 bp, Homo sapiens
  misc_feature (1)...(2092): n = A,T,C or G
agctatcgatcagatgctgcttcgccatcaggacagtcactcngtactctgacggtaggatctggcgtgcgagtgcgccatcgaatacatgagcgnagactgatngtctctccgaaggcgtctgangttctgatgtgcagaacgctgcagcgctctctatcgtacanagttccacnacagtcagttcgagtctcgtcgtcgngttataatacctatgtagcactacanacgnacgactctcntcgcgcntgcgagcgacagctcacgaccagtatgtgagtatgataggcaggtgactagtctacgaagcgatnacgacgaagtaatagtgtgcacacattagtaatctacacactcacgtatactacagtgcatgatcananancancatcaggtactctctcagtganacatacacatgtcttcatgcgccttctacgcgtcgtcatataatgtgacgtngagtntgagactcgacatgatacgtaccntgaattgagtcgnanatagatcgctatagacggaacgtcgtgtcnatgtgcacgctgtcatcctgctagtgtgcatgatcgcgttcntcgtctgactacncgtgtgtactttcgtatanactgacngcgattgtagtatgatgntgcgcgagtgatcacngttnntatacggacacacgcacgtcgcagangcgtagttgttgcactcntctctcgctagttgatcagatagctagtcgatgcanctatactcncggctctcangtgcccgtcgcataatctcactcacgtcgtgctcgngcacacactcgntcggaangctacctcagcatactgcgcacgccagtgactacgncgtgagactaccattagtaggtaggactctacagtgtnagacatactatagcgtatcatacngtaacgagctatgtagtccgttccccgcgancacgactgncatgtgatgaganactacaggtgctgtgatgtactattnanactctatacatccngngcgtgcnattcgacgcaganacgtatcgttgtcganaggcgcgacgcagcgcacgcgcagacgccacgtcgtgtatggacctgctgagncgacgcgtagccacagatgacgcctgacaggctgaccaactactcggcgcgtgcgctncacgcatacgncgcacgcacatgntgtatgtcagacgcgncacatacnantcgtcatatgcgaccactatcaggncatacgcacgtcgcccgctctgacgcgagcgcacgtcgagccnagcgtaacagacgcagcagatagcgagnacgtcagcataatctgcacatcgtgtgcgatacgtacgatgatttattgcataccagctaacactcgacgcancncgtcctgtgcatcagctcgtgcttagctcgtgcgcatcgttntcagtacctctccgctcgctcactcactgcanatcatgatatcattgagcgntactctgatgctcgatgacgatgactctcgacgtagtacanacagtgcatgagtntgacgatctgcgagctgtgacnantacatagtatatatacacatctatctacatacgtgagatgacaaagagtgacgatgntanagagagcatcgatganacgntccanatcgacactantatgcgatattacattatagatcgtgctgcgagtagcgtanggtatgatcaagcgtgtgcagagntacgattgtacagtgcacaagtcagagtacgncngnacatgcacagtacatgagcatatagtcgtcantntgtctctcgtgcgcacgcgccacccgctcnacgttctatgctcatagtctgtagtantgcntagtacatnanaactgagtgacgagccgacacgagtcgctgattatcgtatnactgtcgacncagcacgctccgtgctcagtctcgatgctgtgacagtgtacnnaggagcgtctcggcacgtatgtacgcncgatcagatgcgagccgctacgatcantatatncgactgacgcgncgtgtcagnatcagtagtatagagtgctgctatntacgantcgtngtcgcagcngcatagcngatacacgtancttg

SEQ ID NO: 6657 - DNA, 2260 bp, Homo sapiens
  misc_feature (1)...(2260): n = A,T,C or G
tatcagagtngtagtatgtcagatatganttgagtgggtagtattnatactgcttgtggcaagaagtagcgtatagatcgtgngtttgtcgtcagacgntcgtgtatcgtgtctggngtgatgagtgtcgatggtggatcttgtataactatgttgagtgctgtctatagttactgagcgtgcagtgtgtctatactnatggtgttcctggcatgtcatcatctgcgattaatgcatgtactgcncngactgncagcgtataactgtcgcgtgagatagtgcagactgtnctgagcattggtgtggtagcacgtcagcagtactctgatatcgtactgtcatcntcgngatcgacagctgagtcctactcgatcgctgtgtcgactcngtggcatgntgcncacactgcatgatgcgacgactagcgctgcgtcgcgtntcagtcntcntgatgcngatggatgtctggtagtcagctgtatctgcgatgcgcgtcgcggtgtgtctcgctgatgcatctgtacgcgtcgacacgtgcgcnatgagtatcgctgtgcgctgacagcgatgctntnatgagcttngctgagtgcgagntgntcattagactatactgctcactcgacatncncgagcatagtngtcgtctcttacgtgtggcgtncgagatgtctagtagtgtactagcganagtcgcatcgncagatgtctagtggcaccgctgatgagtcgcagcgcnacgtctacccgtacgacnattgcatgtacngtcgtgatagtgcgtgcgactgtgcgcggagtactgcaagtatgtcgtacacgcgcgganatcgagtgcatacagtgcgagatcgtatttcncnntcactcactcgatttctacatctagctacacgttatgaaacgantagtttcgtatgccagatactncncngctcgcgcagctctgcgcgactgtatgcaacacttttgtcgcgatatatcgtgcgtcatactgtacgtcggcgtatactagatnagatgatcgtgacntgtgtgtacgactcngcgcancncaagatcgtatgntgagcagncgctgcangcagtcactagacacgcatatagacatgtctncgtgcgtgactgctngtcgatgcgngtcatacttcgtnntctcgagcattgctagtcagntcgtccngtgcagcacgtcgatgaatgcngatcgtcgcacgatntacattgangcatactacgcagcgcgncgagtanctgtgtctgcacgtagctcgaaggacgatatgagcagacgggntcatgntgtcgcntgtcgacgctantcatcagctcgcatcgatgatantacgcagcaccgantgcgcnactgtcgtancgtcatcactcctccgagctgtgntctgcngnagnttacgtcaactanatacgtgnctttagcttctcatntcgagtgttgatgcgcngtctntangtnagntatcgactaccgctacgtngcnantacatagatctgatcagtgcccnantaatttagtagtcgtagtcgnttncagtangngttagtcngcngtgtantacgnctcgngntcatcatctnactgatcgaccgtacactgacgacgatacgcctactacagtcgtnagnatgctgcacgtctcatcagctgacatcacgtcntgntgtcangctcgnctgcagctgtctgctgagtcgnggncgcgtcgctgctgatatatcgccatactgctgcagnncgctcnaccngctgctaggatcgcngangcgntnctnagtgctgcangnntntgactgctagccgtcgacgantgacgctangcgtacgtngtgcgcctgcgatcgtcgtatcntnnttgtcgctangcantcgtgtcatcgtccgtgattgcatcacgactgctatatagcaacgcgcaaatcgtagatcgtagtgtcgcagcgcgccgcagcgctacgcgtcnngtacgcgtcgttagcgagcaggacgnncgtgatgacagtcgccgantagtgtgctacggtatancnnagngnttngctgtagtcgatctcntntcgtcattatcgagcgtagcagctcgctgatagttgngggtcangntcnactcgcgtcgtaccgagtcgagcaggcgagcagctatactcgtcgactcgtntgtactgcacgctcgtnacgccgtcagtcatactcgtanttatctcgntccttntgtgtatnttctagatgtcgtgatcacattc

SEQ ID NO: 6658 - DNA, 1581 bp, Homo sapiens
  misc_feature (1)...(1581): n = A,T,C or G
ggctgctagtctgagcngacactcggcgaagagtgttcccgtaagtctcggatagctgcnctcacacgcgcttgagatgccgcgtttcgttacaggaagtctcaacacgcgatatacttatttactagacggaggcaaggncagtattagtagtgcttgnagtctcggtagcctcaaaggtgtaggagcgcgtagtgcttantagcctccacatccgcagattattggtgacggtacgtgcgccgcccacacatcgtcgccacagtaggagatggccgtactgccccgtcattgcgacgacgccgtcgaacatcctctgtcgcatgtcgtaggggacgaggaggtaagagtacagcntcactgtacgtgtgttaagtggtgtggtggtcatatgcatgaagaggtatctgtgtgcggcggccgggaaggagtggacgcgcgacgcgcggcgtacagccgtctgcgccagcaggatcagcgtacatacgtgttgagtcctgctctgtgtcacacgcactaccctantcatcgctcgtacaaccgctcgtcacaagcacctcgcgtcaccgcatgcgcggtgtccgtcacgtacagacgctctagctgccgctcacgaaccaccggactggagcgtaaggagcaatcgagcgtacgtagagttacatgtacggagctgctcgngtgatgtggataagcgtcggcgatgcgtctatctccattcgcactcgtctncgcttgcctacttggcgacaatgagactatcgtagctcgcgtcacangtcgctcacgcggtgtgccgcgcgtgcagcgcaagacgagcggttggatgagtnngtgtgctgcatctcgcgattngcacatctgcgtgtgcttcatcaccccggagcgcgcttctgcgacggggttgggcacgtgcacgcgatcggacntgacagtacgaggaccgtatctcgccgtatagaatctacatacgctcagtacgtggtgcgcgatgtcgggtggctgataacaacgcgacactgcactgactactctctctgcgtcgagtccctcgctcaccgctcgtctaagacacggagatgtgcgatcgcagagtgccgtgtgtgaggctccttctactcgctcgtggactacgtcacatgctccgtcgcgcaatagcttctcagncaggtatattgtaaagtctgcagcggcgtactctcgtgtagtagcgtactgctagcgcacgagcgcgcgntattccgtcgacgagagcagcagccgacggcggcnacgcgctgtcgagcgacgcgagactagcagccgctgctcctgcaccgcacaacactcagcccccctgcacggacgagatgtttcggagacagtgatagcaccattatcgccgctcaacgnctcgagcagcgtgtgagctatcgagcgatcatactagntgctgagctaatagcgcagtcgcgatgagtctgtgtgttggctacacgagagagcagtagagactagagcatgagngantattatccgtctcgatcgcgcnancatagtgtaggtnacacactatcatagtcgatcgtacatggagagtat

SEQ ID NO: 6659 - DNA, 1535 bp, Homo sapiens
  misc_feature (1)...(1535): n = A,T,C or G
caaccgtcacgtgactagacgacacgatcccgcccgcactgagctacatattatgcgaagcacgcccagataagcttagacatcaatccgcggagtggaagatatgacggcaccgctatcgccgtgctggcgtgcgcgccctagactcgcgtatgggtcgctacaccgtgacattaggcgcgcgcgcaacgtacctattcgatgcacacaattcatgacaggcagtctgcaaagtgcggtgccgatccattgcacatacaccgctcgcatagtacgctgaattcattacgcgagataatccgtacgactatatagaggcggcgagacgaacaatgatgatgagcagagaccaacagagagcgataattgaccaacgttagcctttctacgacgctctgataacgacgagacacaatcgtgtcaaatcatcacgcgcatgtcacaacgagtcacgatcatcacaccgatcgtcctcctcacacgctctcaccatctcacgagctcgatcactcgccgtgctgctacgtatgctcgtagcagactagttatcgtacganttgcatagccatcacaatgcgcgctgccgtacgtctgctctgataggtctcatgtgtatatcgactcgtctccacattatcctcagctctgctctacgctatcaggtcgcaggttgacgatgcacntcagatgatgtgttatagtggtgtgtgtatcgtgatctatctctcgctactcatcagagtataatcgttatgctcttgatgatgcgctgctatatgtgtcagtaccagtacgactcaatatacgattctatcacgccttcttgtatacgcacatgtactagcagcacgtcgacgcgcgcgtactataagcgccgtatctatcggctctgacgcgctcgtcagagctagcntcactacgagatcacgtagatagtcgtcatccgacgcaggacgtatgtaacagatcgagtgacgtcgtagtacgtggagcgtcgcgttgcgcgcntcatcaagantcgatcgtgtgattagcntgtctcatacgaactagtatattcgtgatatatngtaccgtgagatgagcacgacagnacgtgtctagcagacgatcgtccgacgtgagtgcaggtatacgatccctgtctatacgtcgcgatctcgtcaacgtactgagctgtatagtgctcaccttctntgactacgnacgtcactgtagaccgcgatcagactgcactgatgaacagagtatgtgtatngcacactctcaacgcactgactgcaccactcgtgatgaagtgttcggtncgcgcacgcctatctcagcactcctgatacacatgtctncancggactcgtgtgatcatgcgcaatgagacacgtntgatatntagacgtgagatgctaattatcatcagagangatnatgtctaaggctcatgcgagacgcggacgcgatctcaatcgttgnaaggctcgancagacactcgatacttcgcgaaccgagtcgcgtatcggaccgacagacctcaccg

SEQ ID NO: 6660 - DNA, 1463 bp, Homo sapiens
  misc_feature (1)...(1463): n = A,T,C or G
tcatcactgttctctacttgttattatttctatcttgaatgttgttcttgacgtgcgtaatgtctgcgtttatatattctctcccatccagctgatgcacattctattctnctcagttctgtatccttactgttctgtgtattntatcacagtctaattgatcctgattgantgtctctagatgtaacagtttgntgcttgcgcacgcgagtattgtagatgcgccggccgcgccnctcatcacgctctcatagatgccacatagncagtctgctgatactgtatcgcgagaggtttgtgagcgagccgcgatattagtctcgataaatggagtacgctcatctagagtgcgcgtctgacgccactttctagaatgtgttcgtgcgcgtttagtagcgtatggcagagccgcgatttctatcatgtcatacactcgactccattcgtgatgtcttggcgttagtatggtcatataagattacttatcccgcacagctcgtatgtgtcgtgcacgtcgtcttcgacctatttacagtcagacacaatctttacatacgctcgtgcctctttaatacgattcttcgtgtcattagatcacgtcggagtgctgctttgaatgttggcgctctggtacgctgtcgacactcatcgatactctagattctgatctgttccgtngtgctgaaggcacttcgcgagtcacggacacatctcatatcatgcttgatccgaattaccgaatcgaccggagttatgntgtcgaagacgagnattagtgcatgaatgcgtctgtacgcctgccgtctacganccaccatcggtctacaccgtgactagtctaatatcgacacgacgccgatatgcgtgaatcttagcgcgattgtttatctaagtatagagttcgttgtacgactcgcgactccgtcgctgtggcacgagatgcgtctgcacctgtgaagaccacgacgcacgactttactggttgtctgccgtgtactttacatttctagtgtcacattatacttcatggaatctataatgttcgacagagtcccatggcgctctacgtcccctattctgttacgcgacgacaagagactagtttgcatctttcagcaactcgcgttcaagtctgaggctgcacagatagagtagtaccgattgtttacctgagcttcgcttctacgtctagcatgtcgcgccggctcgagagcacgctgacgccgcagtcgaactgatgggccgccagtgcgactatatattccacactagtatctctctttgnttcgacgaccggatagcgagacacgtatctcacgacgacgtgagagctgctgtctcactcgagcgagttcgttcactgttcacgtattagacgtatactaatatcggtattagatattcanactatgcgaactgtatacactatcaacgtcatagcctacgtcctcacctgatactac

SEQ ID NO: 6661 - DNA, 256 bp, Homo sapiens
gctaggatgaaacaagacggcacccttagtcgtcactacgcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacactttttataaaagaataaaaaaaaaaaaa

SEQ ID NO: 6662 - DNA, 241 bp, Homo sapiens
  misc_feature (1)...(241): n = A,T,C or G
ctttagaagcacacgaaaatatantctgtaatgcaattcaaggctaatgtaacaacaaggttacaaatctgagcatatatgtcagaacagaaaagttacagttctcatggtaacattatatcatcagcattatactgcctgcacaataaaatacgtatttagaaacctaactggtaatttaaaataccacatgttatatatattaaatgaggataagttaacattcctaaaaaaaaaaaaa

SEQ ID NO: 6663 - DNA, 678 bp, Homo sapiens
  misc_feature (1)...(678): n = A,T,C or G
cctaggtgtgactatcttgctcagtaaaacaagaaacacaaattgaaacaaaacctatggctggtgaggaaaattgacttcctggcaaagtgatatcaggaaacccatttgtctgcaaaaggaaacaactctatctgcatggcaaagatgtctgctgtaaccacaggaaaagagtcaagggaatgtccatgtatgggttctgcaatgctacagaagaatatttcctttttttcttttatttttacctatatctagcttatacattataaaattggttccatgactaaaatgagtcacatctaaattctactacaaaatgagtccattcttgcacatcttctgataccaattataacatttggtggaagtccaaattggcaaacgtgttttttcttcccagtaaccttttgtgccacgttgaatttaaagagcatttatcttctgaaatctcctaaagttcctcaaggcaggaanaaaaaaagattgtactcttattccagaaaggaaaccccaaaagtgaaaagaaccaacagaagaatcaggatgaattccttaattcctgccagtgtgccatttagcaaattggttgaaatctgggaataattatttgcattatgtttgatgtggctaaaatttttacttcttaatagatattcttgaaaagcaaaaaaaaaaaaa

SEQ ID NO: 6664 - DNA, 235 bp, Homo sapiens
ctagagaagcacctgaaggaattaaatcagcttgttcagcagcaagcttcacagccacatataagcacacctgataattcagagacctcgcgatgggttctgagaagacacacccagcagctgccaaatgaacagcacatgacggaaggggcccttggcctgatctctcatggcagacagtgaccctttcctgactcccacatggccacccgccttaccgatctttttaggtctg

SEQ ID NO: 6665 - DNA, 675 bp, Homo sapiens
agagcaaatgcatggccccagaacctcagagcttagccggccacagcggttcacacctgtaatctcaccactttgggaaaccagggaaggggatctttggaggacaggagttcaaaaccagcctggccaacatgatgaaactccttctttactaaaaaaaaaaattacaaaaattaccctggcatgggggcccatgcctgtagtcccagctattcgggaggctgaggcaggaaaatcacttgaacctgggaaatggaggctgcagtcaccctaaatcacgccactgcactccagcctgggcgaaaaagtgcaattccatctcaaaaaaaataaaatacctggttattggttttcttactactgagttgttgggattccttaggcatttgggatattcacttttcacaaaatacattgttggcaaatattttctcccattctggaggctgcctctttaccctggggattgattccttgcctgggcaaaaaatttttagcttatggcaatcccattcatttattttggttttccctgcctgaactttgggatttatattccaaaataccattcgccatgacttggaggcttttccttcgttccttctagtaattctacggtcgccaccttgcctttaagtctttattgcgcattattctttatgtggggggcaaatt

SEQ ID NO: 6666 - DNA, 1413 bp, Homo sapiens
  misc_feature (1)...(1413): n = A,T,C or G
atgtggatacattcgacgatatgcttggcgtcggtatagctgaagtgtgttcgcgacatcgtgctgtcggtagtggagggagtggtgagtttggatgtgtgactggacggngagttgtctgattactcgtgctaagtatacacatcaaactaagggagcagtcgtgacggatcgtggagtcatgttgnggcgagtgtacattcactacgtggccgccagatatcgtctggacgtgcacatgtcattctcttcgcactacgacgagatcatgagtncttatctcgattcgtgggttataggatgtggatagcgatcccgagacccatatgcagtgtacttgttagttacgtcccttggcgtatgcactgccaccctacgcacgcgtcgntcgcacatcgtgatcactagtgcgatgagggctgtcgcggngttcaggtcgtgaacgagcgtagaatagagacagtncgtcgtctntcacacgtgacatgttctcataactcgataatatatgtgtcttgatgagtgactctataatattgtataagatgtctcttctacaataaatcctaaatatgctttataactttcactctttgcatcctgctaaatgcacgtcgcatatncagcactctctcgcgttcttcccctcgtccactacgttatgttgtactctatgnttatattatagatccataatacttacgataaaccattntattaccgagatatacaactcatcacgactagcacaccgccgcgcacaacgcacacacaaactcaataaactacatatctcaacatatatatcatctatcatcgacactcgcntcgcctatacgaagtaccatattatattggatcntcattacagacgttcatccacaattatatgacagactttattatggaatatgagactcatcacatgcgttactcctcatgtacgggagctcntcctctcgagagtacattatatcatcctgcaacantcgctacatacgaaaacaatcatcaaactatagtaacacaatcacatcacacaacatcaaccaccactatattataataacaacatctattactaacttaactaaatctttattcgcactcagtatatctcgatcatcaaccacgcgaaaataatttattattatcaacacagccaaccgtcctcactgatagagtcatgtaagtaggttgtttaatgcgcaggttataatggtgttgtcgtgcgtgggaggggggcgcttggggcgcggggcggtagcacccgcgtgtctataacgtgccgagcggggtgtgcctcgcccgtgatcagcattgcggggcggggggaagggcgagcgggaggtgtccgggcgtagtgacgggggtttatgtgcgcatgctgatttccatatgtgtttcttgttc

SEQ ID NO: 6667 - DNA, 1334 bp, Homo sapiens
  misc_feature (1)...(1334): n = A,T,C or G
aggagggagagcgactgtgcgtaaatcggagattataagtattgctcgcgcactgcgcagtgatatatatcgcgttaagcataatacatgcagatagacgagctgatgtgctcttacgacacgaaatcaagataggctgattaattcttagacctgcgtggtctctgtatctacgagacacgtcgacccacacacgggagccacagttacggcacccgcgcacggtgcgacgcantgcactgacgggcggcgtaagtgacgtggataacatcatgtagggtcggggtagctatatagcgaacgatccagtaagactatggtggtgacgagtatacggcgctacgnttgtgctnactcacacgagaatacaacatagaatcgaagacttgngtttgacatattgttatatatgtgtgacagatgtatagtggttatagttatgacgtagtgtaaaggttgtagataagtaatgagatatgaacatatcagtagtaattgaggantacacgacacgcggacatcgaaagtaacgtctgacgagcgatcgtgtgccgcgcactagtagagtggaatgatggtgtgaaggtagctatgatgaagatactcatcgtggtacactagcatccaactgtcatcagcacgcgcgcacaaccggaacagcgcactcactacgtacagcacgcgaaccgacaccgcgcggaccgcgacaaggactgtgtacgctatcagttcgactacatacaacacagtcgtaccataatagcggcactacgtcactccgcattaaatcaactatagatcagtctattcagtgagaggcgatcgctgcaccaccccgtccatcgcccataagtactcgctcatcacgatcatctcttccctatcgtcagtacatagaacgattggtaatgancactacgcncgaggtactgcgcgacgagtcgtgagcgagcacgacgcgaggacgcgctcgaggcggaacaggtgtcgacgagactagttttgacacgcagtgaantatactagcatcactatcagccatcgcgtgccgtctacgattgagtaacgcactacatgtccatggctgcgaggagggcgngtattactgctaaaagagnggagtcgattctgtacaatcgtatcgccgaatcaatctatactcatcagttattagtactaggttgcgattgacgagagtcatgttatcgagttcgacgctgcgtagctggctgtcgtgtcgtataggcacgtctgatactggatgtgcccgctcacacaccccacaccaaccgaggcctcctatgcggcttacacacagctcagggtcgcctgta

SEQ ID NO: 6668 - DNA, 1453 bp, Homo sapiens
  misc_feature (1)...(1453): n = A,T,C or G
gccgagaatcaccggcccncgctccgtgctgtatctctatgtcagagtccgcgcgctttgaccncgataggtgcgcccgcgccngcgtattgtaccgggattcnttagtgtctagtgcaccgccagctagtgtcttgtaaagtagntgcataccagcgcagccgatacacgcccacgcgcgcatggaggcggacgagacggcgtctgtgcttttgacacaacacgtactacacacgtcctacggtgtcgcatagtatgcgaatatctctcagcggtaactcntnctcgcacaccgatactgccgatcgcacattcgtatacgatcttatgagtgatactggtgacgcacacacttaagtcgcatgaatcgttattagtcatcgtgtgcacgtgtatagttaatatggntatctacttgatctatagtgccgcacgtgggcaatagaaacgatgtgacatgcatcagacgtctgaaaggaagctacgctcgtcgacgtgaacgcgcgaaggggacagtgttgttaacgacagggagatagacactgtataattatgtgtcttcgacggatcgcgcagcattgagacggcttcacgatcacgcaatcgatagttagatggagaatttcgcgtttcggatgtgtgaataataatgctacgtctgttgtagtcgcgtatctgaagaagagcgattcgagcgagtgaacaccgcgatttcatcaggcggcgcgcttatgcgactagatatacgttatgagcgaccgtcgcactgtgctctgtactgcacgttgtcggcgatgccatggtatncaatcgggcgcgtcgcatctgtggcgtatgtagcgtaattacgagttcatantgggccgtggccgtattccgcggatacggtaggttcgaatcgctgcgaggagtggtgtgcgaagtgcgttctccacaactatactgatataccacgagtcgccgtttagattctcttcgcgtcagtatccacaatncgtcgcgatacgctggctaatcgcgtcagctatcgctacgtcaccgcacggcgcgttgagatggttagacagcgtcaccacactccagcgtgctgcgttgtgcgcgctgtataatgttctgtcgagtgagagttaatttcagacgattctgctctctctacacccctgcccgcggataagggtgtcgttcatctcacccgaaaatatttgctttagtcctcagtgcgtctgtcctcgtgccgcacgagctaataagtgatgatactcgcctacggtccatcacgtagtgattagggtataggtagcgatggcgactgtgcgtatatgagcgtgtctgtatttagataccattaacctcttcgcgtctatcggagattgtgtctgtcggcgtnggcgctatgtatgcgtggtgtcagaaaaggatgatacgcgcagagctgagatattctagctcgtgt

SEQ ID NO: 6669 - DNA, 1592 bp, Homo sapiens
  misc_feature (1)...(1592): n = A,T,C or G
gcgcagagcacgcctcgctgtgcggctgcgtgtcactctcgtgtgcgcgattacctaggttggctcccacagtccgtttcgcgcgcgttcttggtgataagacagtgcgtgtagtgaagcgacgaacgcgcgcaccgccnactaagacgcgcgcccgaaggtgcggagagggaggtgcagaacttctcgcagctatgtgagacgtgcgttgctcgctattgacttcatatcacaccgcatgcgtacagtactggttcgcgcggatgacatcgaccgagatgctgagcgtcactaccantctcaccggcaaaatagcgtgatatgtgatgaatatatgtgtcgacgatcggtatggcgtgtgtctaccgtcacacggatacgcgtactgacgcggcagactaacgtcgtatcagctagcgatatagtaagtagagttcncgntcngnctcatactactacgtcngctgcagcatagnngcagtgccacattatgcactcgtgatgtgcgagacgagagcagatanagtgtattgagcgcgtgcgctggtgcgacagcgcgctngctacgagcgcggcgagngcgantcggttaagagactacgcattgtgatagcactgaagtgctngcgcgatatcttgtagagtgagcatacagcgccggacgctagccacgtgtcagaggtccgagcacaacgcgcgaagtgcgcnantagctgcgttgcgtgcgctagnacgtgacncacagtgtcattcgagtacnctgaacaacgcgtgtngcatcatagcagtatccacgcgcgtgcactcgcanccacgcgacgaacatgcttncgtcgtagacagatactgcagcgtgctatcacgtctagcgatctctaagtganagagtcagcgactctctactgattgcagctgacgcgcatagcgagcgcagcagcgtctctagcgctctgacgccgtattgtgcgtgtgatggtgataaggagctagtgtcgcacctgcgaacgcaagacagtcgttgcgtcgcggtcgtggcgcgtatggcgagggttacgagggngttgatggagtgtgngtgcgtgcgtccgagccttcgagcccaagtcagttgcgctccgtcgtattagtcgatggcagatgtcgccgcagtgtggactgcgtgtccctcgcactcatacgtgcgtacctatagtcgaggcgagctggaattcccggcgcggtcgcggcggaggccatgtagtctcgatatctcggcggcgcatcatatcgagcggagacgccgtgagagagcgccagcaaagnagagagaatggcgggagagtactacacctggagaggtatagtggagaatctgagaaatacgcggaccgcgacatgcggcgctgtgtcgcggtgctagacactacgcgactgaggcgtcgtctagatcgagacaatgcaagagacgctgatcgcgcagaacactagcgcgcgcgagtcgcgagaagtcagtgaagactaggcgtgtggatcgtgtgangntggcagcagntagcgattggatcgtttaatgtgacgcgcgggtggatgatgtcactgtgtctcggnatgac

SEQ ID NO: 6670 - DNA, 832 bp, Homo sapiens
tcataggaggactttgaggtcatatgagagagggggggggggggcttgtagctgactctgcggaggactgctggggtcataccagacaacaaaccggctcactagagctgggcccccaacccaggaactgactcagcgcaagaagaccgcgccaaccccctatgatttcatctctgaccaatgggggctcctggctcactggtttccccctaccttcctaattattcttgaaacctgtgccccccttccaaatgctcagagagactggttttttttatagtggggcgctggcccgagaggccttaaggaaggactctgatggcccatctctttcgggagggttgatttatgtttctaataccctggcttatgtggactgagtgagtgttgcagttcgcacgaagttattgttcttaacgagtgggttggcgggcggatcagaaatgagggggaggttgatggtaaactgcgtggttgaattgaatgggagaaaaggggcaggagtaaaggaaggggctaatgtaaaggttaacctccattatttttttaggggacggggcgctgggaattggtaggtgtactcgtgacagttgagtgttttattctcgggggtgttattacactacgagtagcggaagggggagaggtgggcgaggctgacttgtctgagtctaggtggatatggtgaagctgtggggtgcggggagtgtaatgaccaggaattgtgcgagtaaagtcgtggagctgataatgggtgtcaatcatcaaccaacaaaatgtgatacgaataatctacagagttgtcttccagcagcaagcaggagtggagaga

SEQ ID NO: 6671 - DNA, 1431 bp, Homo sapiens
  misc_feature (1)...(1431): n = A,T,C or G
tgggatgtgttagagtagggattaagaggagaggaggggnaggggnnaaagcgagacggggagcggcggggnagagagaggcgagagggcgttccgaggaaganaaagacccatagngnntggtgccagcctcttcngcgaccggacgacgtcgcgaaccaacngccncgccgtgctattctcagcgcctagcgacacctaganagcggcgtactacaaagattgcgtgcgcagacacatcgctcaaccacgtgcgacacagcgaagcgttatagaacactacgcanctcgatattgtgttaaagcgcacnncagggagaacacccccagtagcgctcgcgaagaagtcacgccacccacaccacancacacatatctgctgntcacgcactacgctactcgattgcagtctctcactcgcgcacacacactagtccagcaaccacatcacacgccctcgccccaccacacccgcgcgaccgcgccgcgcacgacacacgaccgacaacgaacgcacacgacacgagcaggtcgcagtgatggggggagggagggaggatagacatgatgatacatagaaagaggggcgaggtacgggcaggcggagtggtattgttagtagtgtaatatattatntacntgatatgtcagcgagagcgaaggatgagagttaacatcgtgatgtgtcccgcacggatacgtcacgccgaacacacagtccggaggccacgtgtagtcgctagcacccaaccgatcacaccacgcctcgatcatctccacccaccccacccatccgaactacgactgctacagaagagcacacgcagaacagaaacaacaaacacgacaacactcataaataacgcgcctgtcattcttcatcgcntcgcgatcagacggtcgataagaancgcacgtccgcgccaagcgttggaaggagcgcgtctaccggtatacccacgtacaagntgacgacatgcnagagtgtnttggtggtattgtggaggtgtgtgtgggancgcgataggagtagcgatacactagaatgacatacgcnacgtgaggtctctatgacagcaccagagagaactacagcatcacttcatcacagcaagaatgacaacagngtatgcgtagagatacatatacgctgtggagaggagaggtcgcgcacttgcgagcacagatgaaggtgtgtccgcggagatagaacaatncgcagagacagagcctgagacatacacacgcaacacgcgcgcgtacatagattacaatctagcccacactattagcccgcacgcanagctgcgatacggcgtgttgagcgccgcggcgccgactcgcgctcgaaggcngcacacgccaccgccaagtatgacactcctatcatgcgacactggctacctgtcacgctacacacaccgagatgcc

SEQ ID NO: 6672 - DNA, 1314 bp, Homo sapiens
  misc_feature (1)...(1314): n = A,T,C or G
ctgcgtggtatgagagtcggtttcggcgctgcgtcctcgtacaagttctactttgcgtctataacttgttatcgcgttgatgtaccgcttcgtgtctctatctttcgcagccacatgagtagcagaagttgcgtaggcgaatcgtgcggtggagagtatgaatatagtcgtactagacatgtcatatagtcggccccagtgaagcgtaccgttgtagtcgggctgatcgacgtagcacgtggtcgcacagcagctcgtgacgagtgattacagcagtgagctcaccgttccacgacctctcacagagtcgcggatacgtatatacgaagagtagatgtatttatacacgactagataagttcatcagacggcgtgcatatgtgtgatgtacttatcgcgtgatctctcgcgtgtcgacttacgcatgtttgctaagttgtgactcactacatctatatcacttcgagtcatgatcgtgcctgcaatcgcgtcatgtttcttatcgatangactggatcctctcagtagcggtgagtnatctggtacgatacgatccttagagacttcgatgttgatgtcagttagagctggttaccctttggcagaactgtaatccgcgcgcgtgcactcacataaagaagcggtggttccgtaacagtatagtaatgatcgactcagtcggcggtcatcacgagtgcatcgtgcgataacacccgtataagacaccttcagttgacagcggacgcacgagtgtcaccgtgatgtgtgtcggtgagaatcatatatcacccggcagggcgatgcggacgacttcactgcgtntatcatctctgtatagtacaatctatgatgttatatccgagtatcgtagacagaccctcacgcagcgaccatcgtaagaccgcctatgctgcgacagcgagtccagctagacctattagtccgtgacggttcgccgcgatatagcatatatcgtgtcacacgacaatactatcaatggtgcgcgtaatcgaagcacgacgaggagggccagcggggctgtcattcgtttcactcgccgcggcgtgctcgagctacgagcgactcggcgtgtgaagaagaatcacgcgtgtgagtctggggtgagcatcgcaccagggacacgcgctcttccacggacggattgcggtactatcgtgtcgtagcattcacggtaagtcgctactcatcaactcttcgggtccagccgcagtaccacgccattgtnaatttataggcacgactatggtatatatatgtatcacgtacactgggctgtgcntgcgacgtcattag

SEQ ID NO: 6673 - DNA, 701 bp, Homo sapiens
ttgtattaaggatatgtggacggccgggttggggagggcaaagggcgcgcgaaggggggcgggttggcagtttggcgggttggaggttgtggtggcgagagtggaggcgggtgggggggtcgttagcggggggaaacgtgggtataagggcgggggaaagcgcggggcgtgttttttggacgggtgtttgaaaaggggcgtgggatcgggggtcggggggggggttaaggggggcagggaaagggggtgtgaaagcttggaaaggtttttcggagggcgtggggaaagatttagggggggagatcacggggctttttgggccaaagagggtttttgagaaggggttttagggggaaaaaattgatttcgccccattattaaggctgatggttattgtgtcgggggttaagggaggagtgtctggggggagaaaagacaaggggtgggggaatagggctccattaaggggggggaggggttttttttctaaaagagaggttttaaaaggtaatgtttttggaggccaggaaatttgcccaccccccggaggaattttttttaatggggagggaggggagaaaaaaggaaaaagaggggttttgtttttaaccccaggccttgggaatgaaaccttttaaaggaaaaatggccttgagaggagaaataaaaattagggttatttttttggcccccccgaacac

SEQ ID NO: 6674 - DNA, 1139 bp, Homo sapiens
  misc_feature (1)...(1139): n = A,T,C or G
cgtgtcctcgcctcgtttcttgtcgtgtgctcgcgttctcgtcgtgtgttcttcctctgtttctctttgtcctgttcctctcctcggcgtccgcggcctttccctcctcgtctcttcgctgcgcggtcccgtctgcgtcttgcgctgccggcgtgcnccgccgtgggtcctctgtggcgtgctcgnttcgctgccgcgtccgccgggccgtgcggtgcgggtccggggtgctgcgcgccggcncggtcgctcgtggcggcgccttgcgctcgttccggcccggcgctgtcctctctcgtccctcggggctgtgtgtcgccctgcgtcgtgtgggtggttcggcgcgtctgtntctcctgttggtggtggttcggcggtggtgccgtggcggttgtgccgctccgcctgcctgccgtctgcgnggcctcctcctcctgttcttctctctcctctctctctgtgtcgttgtgttgttgttcgttgcctcggcgccgcgcctcctgcgcgcgcggtgccgcgtcgtccgctcgccgcgggtcgcggggtgcgctgtgccgtcgttggctctttgtccctctcttcctccgcggctctcgctgtgttcgtgctcgtcgcgtcggcgctgggcgccttgtggtgccgcgcggtgcgtgttctcgcgctctcgcgcgcggcggtgtggtgggcgggcggggttgttggccggtgggcgtgcctcgctcctctgttgccgttctgcgtcgctccgtctcttcctcccgttgctctcgttcgcctcgtggccacacagccgcgcgttttgtgttcgtttgtttccgcttctttgctttctcctctgtcttctttcctctcgggtctgcggtgtgcttcgcgcgtgcctgccgttcccggtgcgtttcctcgtgctggtggttctcgttgtcgtgttttctgctggtcgtggttgtcgggtgtcccgcggctggctttgcgggcgtgggtcgctgggttgcgcggctcgcccctctctcggctcgtgtctttcgtcgcgggcgcggttccgttggttttncccccctccaccntggtggtttggtctcctccccaggttgtttcttgctgtggctgcgcgggcgccccccgccgcgtgctctcgtccc

SEQ ID NO: 6675 - DNA, 2123 bp, Homo sapiens
  misc_feature (1)...(2123): n = A,T,C or G
tcgtctcagcgagtgagtcntgtcgtnctcacntgctgatatagctctcgaactgctgtatctgtagcnnacgcacgcagtgtgctcgngtnctgccgccgtacagacagcacagactatngtnctttatnagacagnctgtgagagaatcangccgnaccgncngccnctgacgtacgctttgntgntgncgagcgngncgngcngtagnaccccanatgagngatgtcgttacagatgtgtatgtagtgtctgatgcgactctcgtgctgtagtcncgcagcacatatanctcatgctgntgcagcatgtccattantagtccntcgtgcacacatgngagtcgtgtcctcgctcatgatcactagcgntcngagagncgctcnangcgtgagtgagtacgcggacgaagcnctgncntgactcgtacgagtccagatatnancgcatntgtnnctcgacatagtgcatgtgcgtagtgnagtgactcatgncactccttgatgctccactgatttgtatggtgcgctgagantnaccgcgatcnantgcncgtagtggttctctgtcngtcgcattagggttgcgcgccaccgccgcgcgncgcagaatcgtgcactgtgatngatgatagtgctcgaggatgcccactgcnatcatgtcacagtcatgaggctatctgtatgtatgcnggtgcacttanatcttatgtatagctgtatctcgnctcncatccgtcatntcttcgatagtgncttagccgcgncatgcatactattgtcagcacacggtgtagtcatgtatacactncgtcnctctccgctgtacatgtatatacattctatctgnagttacatcacatattcgcagntatcagtgattacgtgctgtactcctgcacatctagatctatatatngcgcagtgagacagcagcgggtgcacagcngattggctccggtnactagttcgctcgngtctcgatcgncgtnatgagatacaataatccnctgcggtctggtgcacgtcngtntatcgattgcgctcatngtagtgtccgtatgtatgtgtgtatgtcgctagtactctacgtgtctgctatcgtgntcatcgctcacttgcgtgcactcacntnaatcggancgtgtgtgcttgtctctncntcgtctcgatctactacgtgaggcgtatgtaagatagatatgatggatatgtttanatctctcgtcgtattngtctactcgcgcanatcttatctctctgatagattnagancagcatagncggcngntagntatgactagcntagatacattgatatagactagagtnangantcgtngtcgccatgtgcatgtactntgatgacacgtagagagcgactcgtcgacgcacacccgcgcagcggcacatcgtgattgatgtctcgcgcgncttcagctctatgctgatgtacgncatagacatcttatgtatgcgagtctcgcacgtatcctacgtcatgcgaaganagtctgaaatacacgcgacttatngcgccagtcgncngcttgtgaagtatctgcnattacgcatgtatatnacnttacgcgcggacatcacacgtacagtcgagcgagcgncgcatgacgggacatgatagtcgtgcgcagcgntnagtattaggatcgngangngagtgatanagctgcntgagtagtatgtcnagtcagcntgactagttcgngctgcctgntgttagatattntatcgtcttatnatcggagtntangatgacgtagtacgtagcacgncgacgcgcagttgcgcgtncncgtagtccggcngcgtnnatctcntcgtnagatgatgtatcgattattcagtattnnattcgntcngtcgtcnggnacgactncggantcngntncgcnntcgatgtcncagcgntntggcaggntcngcatnctacatnatgtagtgaagatngnngtgtacggattatactagantagatcnactcgatcgcatgcntcngtcgcgatcacntcttngcnacgtcactagnagttttcgttncaatgattgnctatgacatcatnctagctgggantgntgatgcttgatgatgattgagtagcatgt

SEQ ID NO: 6676 - DNA, 1767 bp, Homo sapiens
  misc_feature (1)...(1767): n = A,T,C or G
tgcccggcgctgtcgaccctcggctgcgtgcggaggcgctgagggacgcggggatcgtgtgagtcgagatcggagtgcgtttggcggatatgacatgctccttcccatgcgactcctctatgaggcggttgctggtcgcgcagacgtaggcaaatgcgtaggagtgatggaatatagactcgcatgagtcttcaagtgtctagtgttcgcacaagtgaatnaggtcgncatcttgcgnctgttattaagacattgtccagtgtgcgatgtctatgatagagcgattcggagctcacactctgtcgatagcgttgtgcgtgtcaagagtctcgtgaacgcgcatcgngcccgcggagcggcgtgcatgctgtnagtgatgagtggagaggtgtgtgtagcgcaggattaatctaggantaacgtagtggtggagcacacgtccgctggaccgcataacttagaagcgtaagtgtacgcgagcgaattgatatcacgagcgaggngcgtactcattgcgccgtagcagaggaggttatgcgagcgcgagcgcgcgccgatgtccgatcngctacgaccgcgccgccgacgaggtcgactgcgcgtctatatatcnatanccgccaacgctcgagtgaagctatggcgtatgtggatcgtcgctgtgcgtagctggaacgcacgtcgatcatcatcgntncgacgcagagtcgggcagatcgtntgatccactagatgactgcgcgctcgtatgtcgctcccngtntcgcgtcgatcgtacatgtgcgtcgtcgtatgactgancacgagtcntagatgtactgtgcacgtcgcatcgaccgcgtggngacgaccgtattgtgaggatgacgcncgtccgtgacgtactgtatgcgtnacgcatcagagatagtcggcnatgntgagcgcgcatgncgtagtcngccggctgacgcagcacgatgctcgnnataatgtgcgtaagctgctgcgcgtatggacagtactgcgatagantcgcatatatacgagctatatgctgtagctgactatgatttctgctgtgactcgcgngcgcagcgcacgtcgtcagagctagtgtatcgtctagcgccgtcgcncttgaactgtccgcagcgagtgtgttgccgtgatattcgtagagcacgtgcngcgtacgggtagagcagggacgcgagtgcgtgcgcgtagatagaccatacagcacacgagcgggcgcatattcagagccgcgcgccgtcgccgtntgttcgtnatagcgatgagagagatgtagtgctngcatcgatgctgtncgcaggcacgtgcgaacgtgtccgactaaattagcgctagcggtantacgtcgntagcatcgcgagtggatgtataccgctacgcgctggccgtctgagtgctgcagtgatgtatattatctatcgacgcgcgngagatgcgccgaggcagcatcgtgtcgtctcagctanagagtgcacgatcgacgcantatctactagtattatatacataattgagagcgcgcggctacttctcgtcattgncgcatngcgncagagaatgcgcagctgatatatatagatatgtgcgtgtccgcgcgctncatatgcccatcggatgaatgtaatctactcagttgtgtcggctctngtagtggaatgngncggcgcagtgaccagcgngnagcgcgtcggcgacggaggagtgtaggagcggcgcgcctgcgcagtgtgagttgctgtcgattagtgt

SEQ ID NO: 6677 - DNA, 272 bp, Homo sapiens
cgattgcgcagatcatcaggaatctcagcagatacacatttactcaggcgtcgagtgagcttcgtcctagaaccaatatcgttctttcgaatctagtcgattcctatgtattctaatcctcatgcgcttctcgtgatcgatacttgtatgagtaccgtacgacacctcaagatcatcactctcaaacgtgtcactgtctcaactactctctccgtcattatctccgatacactctcttcatcctgcgcgcagtggaagcgggtattaggctc

SEQ ID NO: 6678 - DNA, 125 bp, Homo sapiens
agtatggtgtcggagcgaccatgtgatgcccagtcgtgtatactcgttcagggatatgtgacggaacacggagataaacgtaaacggctgaaaaattaaataacaatattttcccccccgtagta

SEQ ID NO: 6679 - DNA, 946 bp, Homo sapiens
  misc_feature (1)...(946): n = A,T,C or G
ctgtcttttctgatcgccggacggggggtaaggggcctccgttgctctcggaattcgtgcgtcgccggccttcctctctgttggtcgtgtgctccttacctgtgcattcgggccatggaggggtggtggcaggccgcctctctgctctccctaactcaattcttggacggagcgtcgtaggcgcggctgtgataggacgtcggccggcatcttggcgacccgacttgaacttgggcggactgtatcattgccagctgcctgatcctatctcttcgatctggctcggggactggtgncgtgtgtggtgacaccagcgggcgctccgtcgtctgtcggccgttcgtttggttggcggtgtaccgtgctgttgctggctgggggttcgcccgctgtcgctgggtgcttcggtctgttttcattctggcgggtgggctgtgctcttttaatttggggccccgtgcttttttcttgtttgggcgggcttcccatttccgcctttctcctttgttacggtttcgcctcgatcggtgtcgttcccttaccgcattgcggatcttctgatcctgtcggttgtttcgggttcctgtgtgctcgctcctaactctgggtctttgccccgccctgcgtcgctcccctctccccttttgcctgcttgttgttgttgtctttgtgttggccctgttggcctgtggttgtcccttgcttgtatgttttgtcggggggacctgctcgtcggttaaaccttctgctttccaacttcttgtcggcgtcgggttgtacggccccccctgtgctcttcacggccttcctatcttgttcttcgttcgggcttgttgtgccgttcctacccccccgaaatctgcgcggggtccccgctgaattaacctcacttagaagggaagaatgttcttgtttttccccttccgtcatccgacctctccccttt

SEQ ID NO: 6680 - DNA, 1878 bp, Homo sapiens
  misc_feature (1)...(1878): n = A,T,C or G
cgtgacgaggaatgcgcagcgtaanctngggacgccacagcaggctgacgtcatcagacagcgatactctgtgagtcgctcatcncatagtactggatgtctatgagtcacgactcagtagtacgagaatgacaattacgtacggacgctactgncctctcatgacgcactgcctgcatacgcncancnacngatcgcacgtctgatncntgatcgcgtcatcagaggtagtatgcgtaggtgacgtcagacgcacgtgctacnacccgttctcgatganactcncgtcgctactcgagcatcaaacntaaactcgtcagntnggtatcanggcatcgagtattctgctagcgtcacaactgcaggctctgncatgctgtgntgtagatagtggactctagcgagtgcacgactacagnggtgatgtgcgaggagcgagtatcgtcantatgatanctaggagagatagcatactacgagtcgcgtcgctgtcgacacacatcgctcgctgctgtaggagctctcggccgtctgtgtcangttggttacgtgtcaagcntcacatagtacatacggatcgatgtcacgtcagcganctatgtactcatgacagtgtagtactagaacgtacgacgagcnacacagtagacgtccgcgtctcagcatcacactgctcgcgcaactcatctcactgtcacaatagagagatagacacgcagnctgtgcatgtagatcgtgcagctaatatatntatagtctcnctgtagtcgttacgctgcacatactgcacagttagcagtgcatcatgncatgcgacatactctatancatctgtcagtgcgtgtatacatgagagtgcagaatgaagtgcagctgaatagatacagcatgcacggaatgtgntttagactcatagttgtacagacatatagcataacgagcattcgacgtatcactaactgcgattatatgatcgtaatcgatatcatnacgtcgcgngataatgcgtaagtcattatcgctatatctatcantntatgctatctgtgatgactcngtgacngatgtaatatgtgactgtatggattctgacangtagcagtagnagagtgnagcgatgcnangtatgagcagacagtacgatgcgaactctacgagacagcatcagactcgatactccatcnatcacanagcatgcgacagagctacacancgncgcacacctacgcgctgatacgatgtcgcacagtatcagcgtcnctgactcgatatcgatncagaaacttcactgctacgtggacgcgttcagcanagcgngattatagtcttgtgctatagtaccatcacatcgatcgaactctgtctgacagtatgtagctatgctcagctgtatcatctccntatctatatacgtattatcgtcactggtattcatacttgcacacactcattacatacaagtgtctatactcttcgtancaacatctcatacactcggtacgtctcctggtattacgacgctgtagtaatagantacactactatctgtacgtcancngcgtagtgagtgagtgaagnggatgtatncatggtgcgtatgangatngtgtgttgtgtgattgtgngtatctantatagttgcctagaaataagggacgaaggcgtcgtgtcgagtagcttctgtctccacgtaacagatcantatatctatatacatatagacancaagagaaatcagacgacagatacaatctcacaagcagtcataatatcgtaagatcatctccttatcaacatcaacgacantnggtctatagtacattgcactataattcatcagatcctaattattctattacttcataatattattatatc

SEQ ID NO: 6681 - DNA, 854 bp, Homo sapiens
  misc_feature (1)...(854): n = A,T,C or G
actataggagtgcgtttgtaaacgtacctattggatgattcacaccaactccgtataagtaatgtataggagatgggccatctgtcaccgcctagtaccccgcccacatgttccctaaatgnttgccattattataacgttaaatttctaacaatacctcaccatatataattaacaaactcgtattggagatgtatctctatagaaagtgatatataaagcatcgcaagatcgataatagataaatgtgtgtgatcacccttttctccatgcgtccctgcgtgtgtattcctcacgcccgctccatagatagaaaatatcacttactccccccccaatgtagtggaacaacgtatcgttggaagattacagagaaaagaagtgtacgtaatccatcgaaggagacaccccggtatacttggtgtcaggtttccacaactcatagaacaatggtccttttagaggaacgtccttattcaatttgttagcccatcacacgcttagtccccaatgtggcctataagaaacgagctatctttgtaaaatcttatagaaaacattttcccacaatttattcaaatttgaaacacgtatacaactaaatgttcaaggcgaaaactaagcatagttatgagaattattacacatctccctcggggttatgtctgtacacacatttttttgagtatgtaaataggaaatggaattgctgcacctttggattagcttatgttttattatatatattaccagttttataaagtgattttgaaaaattttatttgtgtataggtgcatttactcccccccccatcattaaatactaatttaaccttgaaaaaaaaaaaaaaaaa

SEQ ID NO: 6682 - DNA, 795 bp, Homo sapiens
tttctgctttctggcgggattctactggtgtgtagtcgctcgggtctcgcactctcggtgcgggtgccttgttaagctccgttgctcttctccttctgttttgtgtctttctgccggtgtttattttttctgaccttcgctctctcgttgattgcttttgcttgctcctcgtccggctcgtcctccccggtggtcgagtgcgcggtgagtcagtgtggtgagtctcgcgtttagtgccgggcgtgtgttttgtatttcgtgtttggccttctcttttcttctgtcgtgtggctgtcttttacccgcgcgtctcgcgcagtcggtgcgggctttcagtctcgatgtcgcgttccgcgtcctgtggtcgctccgtcttcgcgcctatccgtcgcctgtgggttgttggggttgcgcggtgctgttgtctgagcggttgttttgtccgcccgtcgtgggttgcgccgctcctctgtctctcgcgtcgggtgctggaggggtttttcgctctgctggactcgcgtgggcgggttttcgtcttctgggaggtttcctctccttcgccgctccgttgccgctcggtgctcttttttttgtggcttgtttagttggtatttgtcccgggtttttagctggtccttcgccgcgttcgctggtgttctgtcgcgttttgttcgctgatttcggctgttggttcatttctcgaagcatacctctctgttcctctcccattcgtgcccacacgcgagctgcctcttttcccatccgttgttttctgcgagattctgatctgatcgg

SEQ ID NO: 6683 - DNA, 1814 bp, Homo sapiens
  misc_feature (1)...(1814): n = A,T,C or G
tngtgacacgatactaaataatatatatnctctaacaatctcatntcgcgcgcgcgagcgtcgtacgcatacagtcatgcacacacagagcatcacagncgatagcgacgtgctctcggacggcgatcgctgngtcatagtgccagcatgaagtgaggagataaagtgaggtgtgtactgtagtgtgatanatatcatatacgacacgagacnccctgncgcgctgtttgcgcgcaantatactncaatcatccggctgacgtactatacagtcgacgtgactggnttgtcgatnanttactacgtgtgctgaatgcgcatcgtcgcgactatgtcggacgatgcgngagcagtcggtacgtcatatgatgcgagctcatcgtgatactatantctctagttgtgancgatcgcgcctcatccgatgtngtgatctagatggcnacgcagcgatcatgctncatgcgtacnctacataacatganacaggatgcatgcgctgccgaaatactactagattggaataatcatcgatgaacgatagcgnaaagccgactagacactctgctgtcggtatatatcgatagcataatgtgagcgaagatgngncgcgnngaanagangtctcatataattactatcgcgaacacgactatngtnagtgctcanctcgtctgctcgactangatantancagntgagctactnatctgcagtgtgtcgncatagagcggtctctgcacgcgatgtatgaganatcgagcgtacgcaacgaacgtccgcgtgaacactatagcgtgatgagcgcgaaacgcatagtcacagagtgtgatagcacatcantatntatgttgcgttcnctctatctgtggcagtacgcgtagcgtcactacgtctgtncntcgtgctacatgctatacacgtcgtgcagatgtcgcancgcgatgcagatgacagaagtcactgataatctacgattacagagagtanagcgagtgtcgaactacatacncaatcacggtgggacaggcctacgtaccacacactacaacaccacgtgagtantacaacagctgtcgcatacttacgtctcacgactactccacgtgacgcatgacgcgtcctacacaatatctcaacgtcgtctatacgtgctgacgtagtgtgtcttgtgtgagtcgcacagcgagtctagaggtataggtgcacgcgatctcttcgtgtggtcatatgatgtaatagtcgtgcgtganagtggagtatggtgactctattatcagtagctcgtacgtcttgaccactaanaagtactgtagtaattgctccacgagtcactcgtatacttacgtactggatatacttcgcatcatgtacaggtataagaacatactctctcgcgccatgtgaaggaatcatctaagctctccctacacttggttgccgtcgactgggcacacttgagaaacactccgcagtacagactcatcgaggggctcatctcgtcttcgatatagtacgaaatcacagctagccacatcttgctgtctttatagngtacacctgatcataatacnattatctcgtccgagtcacccgggatacaaaccgcgatggcgacacaacaacaggcgaagacgacacccaatcgcaccgaattatatacgcagcttggctcgggcacacacacgcacaccttaatagtatcacaactatattgtatgtgtcggcgctgtgntagatagcgtgcatgtatcatcgggttggtgcgcgcgcactgaatccaatgtcgagctgagtaattaatattctttata

SEQ ID NO: 6684 - DNA, 734 bp, Homo sapiens
aggtctatacataataaatgaacacccccgtcgaccgccattcatactcctcgccacaccccttcacactatacgaaacctgccaaggggtactgagaaaaaacacaacatctccttttcgccaacaaaatcggactaccgacgaaaacaaatacatgatgagtttgggcatgcccgtcccaatgtgcactatatgatacaaagaataccaaaacaagcaagcccagtcatgtgccgacataacattgacctgtaaactatttatagccacgtctaccttgcataatcgatacagagggcaagcggacaatccgactaacaagaactactacactgctcatgctaagcgtacaaaacctacaaactaaccaccgatcatgaaatgacaaaacacgtaataacctcaacttatgaatttcatatctaaaacactcacatctcctctcttacatcctatttacttatcgcacttccttcaccaccagtacaactgacaaacaacattataaccataacactactcttacaaccgtacaaaatatctttcaatcaactcccaatcgtcctcggtctcataacctcgaaactcacgcaaaatacccataacgctcctcgtctccacacccaatatctctactatcgacaccacctcaccaacatcacgtacaactaatatcatcatccaacaaacacaaacacttttttttctgtaaaacacgcgccagtgaacgcgc

SEQ ID NO: 6685 - DNA, 440 bp, Homo sapiens
  misc_feature (1)...(440): n = A,T,C or G
ctcgttagtgtagagtaaggcgggatgcggaaganagagcgcgtctgacgcgcgccgtgcacgcatngacgcgcgaacgcggccgcgtcacctccaccgatgactaataactagtacctgtcataacatgcgntaaatagatgccgaaattatgacggccgcgtcgtgagcgtcagccgtagttcgatgcaccgatcactcgatacgtgacgtaatcgtgatggtatcggaatgatcctgatcttcctatatgtgagacgacgtcccgatgatatcgatccggtagcatctctcgtaatcctacatgtcgtgtctgcgctatcgcgcaacaacacggatcaacacgcgcatacgcgcgtgcgatacacttgnttctagctccagcggcgcgtgcgtaccactatctattcgagtgctngntcttatatatgatatataac

SEQ ID NO: 6686 - DNA, 1670 bp, Homo sapiens
  misc_feature (1)...(1670): n = A,T,C or G
ctgaatgagttctggatgtgtagaatgtatttcacaccaatatntataatttttgtcgcantaatactccgggggtctttcgactctagatgagacagactcgcaggaataatagactccacgcgtagcagcactagtctactatctgcggagagcaccgcggaggacagcgagaggtacactgcgtgaacagagagtcaactgaacgacacgacgcacgtgtgattgtgtcgtccgcgcgatacagcatagagaggcggctagatgcaccacacaggcgcaggagagatcgaaaagtgatcagaagtagatcgtatatgantgagagacacaacagtgacatgctagcgacgaatcacacactcgtagatagtacacatgggcgtcgtatgactcactgcgacgcctatanacacactaactaaagtactngtatgagactacatacagtgtcatgcacgaccggaanancgantcgttagtagngagcatatgtgtatgtcgtttacgtgtgcgcggcgtgagatagagacacggtaatcgcattcaagcacgcggagtatgcgtgttttntactagtgcgcaagccacatcctataactactcatcgctccgtaatcatagagaatatcactcacatccaatacgccacgttgggttaagtgacatcaagcgctacgaacgcgtatagtgatgatagtcaacatagtagcataccgtactacttagatgcagagaactanacgacgagtntcacagagcacgcgactcctctcgtacttgacatcnacataatgtgaatgcatatngtatctaacattgcctagccagacaaatcgaaagtgactccaganaataagaaccacagccgagctcactgagcgcaacgtttcgtattatttgcatggactagagatgcggcgcaggacgtgtggaagatagtaagagactacgcttgcgtnntnctgcgccaccgaatactccnacatgcatcagagcnctatataagcaccgcgtcacaccgtgcgtaacgcagcatgcacaagtatgatgtaagcatcagtactatagaatatgtagctagtgctgtatgtgcgctggaatgtgcatgctacagacaccaaancagcatgcgtgttacagtccgatgtgtcgcgttagataactcacgctagtgtgtgtactcgagacatgacgacacgagcatctcgngcgagtgattagtatggtagttgcatcgactcgctgtagcagctagcgancgcncgaacagacatgcgcagactcatcagctctgtactcaatctgacgtactatgttacaactctcgcgcgacactacggaggacatacgatggctgatatatgagactgaggtgttggagtgagtggtntntgtactagacgagcgtaatgtgactgactactacgacaggcaccaggagacgagcgcgccgcngtcatccagnatgcggatggtgantatatgacantgcgtagcctcgcaccgacagtatagcgcgtgnatgacgcacgctgcgacagaacgtcgatccacgacngtgtgtanatgtgtatagcgagtacatagagactagtcactacgtgtaacgatcgagatatcgtatctagtatcgatatcaatgatgacgtgctcatctatagtctatg

SEQ ID NO: 6687 - DNA, 1919 bp, Homo sapiens
  misc_feature (1)...(1919): n = A,T,C or G
gttgagtcgttaccgctcatcgacagnatactcacggcacgtcgagaccgcggtcgatctcgtacatgcagtgcagcagttcgcgtcgtgagncacgcacgcctntctgcgcgtnacgagacaccagctanctctgacgnctccgcacactatctgtcgcaagngncagacacacggctctgncggcagacnagatgacgctcacatcgcntacaggagatgcgcgaacgacncatgctgcagacgctccagaggcagcgagtcgtccgactacagcacagcacagtgcgacgnagtgctacgcacgtcgcgctgactgcagccgagacgcagacgatctgcactcgacnatgnacgatcggaggctggcgncacagtcgtgtagactcgngnatgcgtctcgatctctgcncnagtcgcgatagatgncagtactatgcgctgcatntgctgtcagtagtcntacgagccacattcaccntccgcatgcanacggncgncagcctcgatgacgcgtagntgtgantcgcgnactactcgcacgcgctngtcgttcgcgctgtgtgagtgtgangaccnaccnacactttggtgcgggatctacatgtgagatactacgangatagtagatcgngcngactctgcgnaccgtctacccagacgtgnagaggtcaactgctcgagcgcactcctgctccgtcctgtagangagncaagagcgtnccngctgtacgnatcatacatacgggtcgtatgatcacgcgntactatgtagngtnagtatctcgtcgtctgcgctagcacggctgcacngtagtgatantgtgagtcgtctgcgagtntagtcgcatgctagctacangncagtcatnagtatcatgtgtacgcggnagctcgntgngcgctcgacgtgtgtgcgcgcatgcgactacgtcnacacagcagtctggtactgtggcagggcacgagagcgacgctgtagctgcgcacgagcgctgatagngtgctgtacnactnagntgctgncgacatggacgtgtgtgtcnattcgtacntacgtagagagtggcgtantgtatatagtcatactgntgtagatcgtgcgtgtgcactgcgancggnactcatgcgctcnctcgtgtgatgtcgacacgagtgtcgantgtgtgtctgaatacgtcaccgctcacgtacattagcggtgangtgactagcagacactctagtancatgcgttgatggcagccatgacagctatgcggngcagcaatcncgtcancagattactgntcgcgcgctcgacgcagctacgcatactgacngntcatcatgtgtgtgagagcatnctacgtgtgttgaactgccgtcgcngcgncgtcgtcgcgctatagctgcacgtacacatgcacgctagactagagtgtagtgtgtagcgagagcgacggcagctaccagctcatcgttagantcgcgctatgcgagcgcggaccgatgcgtctggtgacgctgangatgatacgtacgtgtagttgntgaggtncnnctcncagcagctctcgctatagctcacgaganacacacggagncagctatgtgtcgtctaatatcagtgcagtcatgtcnatgcgtgcgtcncctactgatacacactgactcngtgcatgttacgctntgcagagcagtcgtcagcatncatcatggtcgccagacaccgcacgcgtgccgcgacccacgcgtgcatgcacgtgtggcactgtcnccganacgacantcagcgtccgacgcaacgtngtctcgacgctgtgccagtgatcacgcgctcgtctcgacgctgtcggagctgcggtgctcgcagcgctcgctgtgcgctgnatatcacacagcctctncggcntggagtgagcgcgatgancnacacc

SEQ ID NO: 6688 - DNA, 1086 bp, Homo sapiens
  misc_feature (1)...(1086): n = A,T,C or G
catgactcaatatcgaggaatgacgtacatttcatcgtgtattatgatatttgcaatgtctaatttcacatctagagaagtggctaaaggcgttatgctcgtcttagtggcgcgaggcggctccctatcgaagtcaatcccaacgatgtattgcggtaccaacttacatattgctgggatacgcacgaatatggcggtgctctcataggatttatcttcgatgggtactacgccaactggaatactgtattcttcgaccctgccgtcggcggatgatctacgggtgagaataaataaaccgccgcaccgcatcgctgtgcggcgattatgttaacgacggcggggcgtcaacgcctagccaggatataaagctgatacgccttatcgaagcacgatgcgatctgcaaacgttgcagaattccatggctcgcgagtcacatggcgtacataacgtgggtgcgcatggctgttcagatcgaacaccgggcggtaacacgcactatgcgcgctccaagattcttacttatgacgtggcgaaccactgttcgcctactttcctctgctcgtttaccttcactacttgccatatatactttgcgcctccgcgcacatcctctgatcctcgcatggttcatcatggtcaccaatgcctcctcttcgcgaaggtgcctcatacaaaaatctctatccaatctctttcttgaatcctggtctatttcatcgcatgtttggtactatcgcttaacggtcttatatgaggcgaattgatggggggtcaactcatcggcaatgtgtataaccgaaacgatcgtgaatcagacttgtcagattatgcggctaccgccttttgttcagtccggcgcgacgtgacccctcacactccgtcttcatctgtccatatgcgcgcactcactgtgcgactctgaccttgacgtcgtcnccgcgaggagaaatatacatgcggcgcgagaaagtaactatagaatatatactgtaatggggatttgttgggcatagcaaacgcgtgcaatattgtggatctttcgctagtatggcgtgattcattatctaatacgttcccttctc

SEQ ID NO: 6689 - DNA, 1048 bp, Homo sapiens
  misc_feature (1)...(1048): n = A,T,C or G
cgcgcgaccgcaacatgtcggccaaacggctcgccgcggcgaggagacgctcgactagtgggtctcgtcgtgaaaggagatcttgtgtaacgggcataagggaaaagttataaacaagcgccgcgttgcaacaaattacggcgggtgcctacggtacatcataatccggtcgagctactgcacggcacgtccacactcgaactcaagcatttgcaaatacggcggaatgaggagggaggtgatgtcggagggaagtaacaaggcggcgactgaagtatgcgtaggatgacatggatatatttgctacggagtgtggtgacaatacgaaacagtgcatcgaggaaagaaagtgacatgggacggtaatatacatttgtgatcttgtgactcgctcgacctcatctagtaggatgcgtgtggtaatgtcgtagtaacaaccgcctgcagaaatgagcacggacaaccctcggtgtctgtaagcaatcttaggcatcctgagtgtaggggggtgccagaggaggtgcaggtgcgagagtaaccacgtagtgtgccaaccgagatatgcgctattgcagtttaacaagagccaaacgtcacgtctcttgagacagcgctttcttccatcaacaaactcctcgcgtcgtcgcgaaatcgccgcgaagngagcgaatctggcactcatgcgacctaacccattaaataaatcgttccggatagcacgcggcggggagagacacaactaaatgaattaacgctgcacccttcacgcaatttgtagaccgcgtaatcgatagcaatccgatatgtggtgtttctcagctacttatccagtgggcacgttgaactacgcaatgatggactctttatactgtcgcagtattgattaagtgttgacagtatacagacatcataatctggtgtgtcattttaaaactactgagcatagcgacacgtcgaaaaaatgctactccattgtatcgcggtgataacgatggctctttcgtgctgcggccgcgcaccaacaaatgggtcatttataactgtaatt

SEQ ID NO: 6690 - DNA, 1280 bp, Homo sapiens
  misc_feature (1)...(1280): n = A,T,C or G
ttgagcgcctggactcggaccgcataacgtctgttagcgcgcgcgcaggcatacagtgccggaacactcatttatgatgatcggccctcgattgagggatgccaagggtctacggcgcatagctaaagtttaaatacgaataatatttncaccgcgccgcgggcgaagaagaaaataagtatcgtcaggcgcgggctgtgagtaataagcacccggcgtcgtgcgagagcaggatcaaatctcaactgcattgatctgcatatctttcgatattcatacagcacgcgcaccgctacaaattaatgtacgactctctcagtacagtcatcgggaatcacgcaagagaggacgactgctggcacgcgtttaaccaatctaatattcatacccgcgaagggcacaccgtgtagaataacagacattaccttgaataccgcatcgtctcggcatacggatacgtcacatatagtgttcagtggaatataatggtcgctgcgtcanaccctatcgtataacctcgcgtgcacatcgcgtgtgaggaaaacgtgcgtctgaacacntcggancatatnggccactgatctgtgacaaatcgtcttgcttgcgcggtgattgtgacgcgtctgctgatcatgttcatatgtaccgcggtcgtggtgctgtgtgcttcgacacggctcagagacgctactctatatncaatgcttctcgactgccgtacttctcggatcacctagccacgacaatcttatctctacgcgttgagctgactcagttaggatcctgtccgcactgggcggtgcggaacacaaattgtctcgacgacgacgctagggagtcctaatatcggtcactgcgttcagctgataccataggagctgaatattcttacccttttttcttgcatatgcgtgcaccatcgccatgcaagtgctttatatggtgaactcacttacaaagtcgtactccgtcttagttnatattcttctagcgaccgactacttccggcgatactagtgcgtgcgacgtcataagatacaggcgcgtgagtacgagggttgacgatatgtggaattatacgtngaccatgaccctccaccgagcttctccgatatacagtcgagacttacacactgtctagtctcgaatacattggcgttgtggtcccgnnacatgcagattcacacgcctncagancnagagaggcgcaaggcaagtcccatcctctctctcacacatcccccattgtgntagactcgatgcagacgtattggataaat

SEQ ID NO: 6691 - DNA, 852 bp, Homo sapiens
agaagggcaaatgcgctgataaagggatgggcgagcacgatgaatgggaggaaggcaatgagaatggaagaaggacgacgaaagtcaagcgatagaaaaaaataaaaaaatatggagccgcggggagagagaaaaaaaaagggggcggcagataaaataaaagggcagcggggaaacgccgaccactcacagaagtaaacaacacgacagtccagtacggggggaaactagtagaatttaggaaaatgcggttagattcagcgcgacgaactgaaaaagaaagaagttgaaagaacgcacaatatgagacgaaaaagtacgatgagacacacgaaaaaaggggcgcgacacggcggaaccgtacaaaccggatttggggaaaaaaatatgaaatacggaaagggaaactggaaagggccaagtagtaaaccaggggaaaaaataaggacgacggcgacaggatatgattaaaatcaatcaagtgccagaaccagcgagtagggagagaagagcaaaagtggtaacagagacattgatccgcatccggtccgagagaagtaatagatgccagggaagttagaaaacagaggatagatccaaaaagatacactgtaaaatttaaacgcagagaatgagggccatgagccaaggaatgctggtattcttaagaagatggaaaaggcaggtaaacaagttctcccctaagcatccagaagaacaagtggtgctaacacttcgactttagcccagtgaaacttatttcagacttctgacttcagaaatataataaagcactgaggcgtgccgaaatgctgcaagttagtggaaatacggtaagatgaacaaataaat

SEQ ID NO: 6692 - DNA, 1570 bp, Homo sapiens
  misc_feature (1)...(1570): n = A,T,C or G
ctcgcctctcctctcgtcgcgccgcgttctnctctgtgagcgtngcgtatatccctcgacttatcgcgattcactctgtcancngtgcgcgtccttcatctgtgtcgctccgcgtgggcgctctctctatccgcgccgctttcgtgcgttgaagtatgtggcggtgcggngcgcgcgcggcgggctcgcgcgctcgctcgaacatcgtctntgtcgtcgtttcgcgtctgcttcgcttgccctatccgtccgctcttacgggatgttcgtctccgcttatgcgccggnggccgcacgtctcggctactctgcgctccctactgggctgcatcgccgtctctccgtcgctcctcgttctgttattccgtcgctcgcgcgtgtgctgcgcctgctgtgagagagcatctttgcctcttctcactccccgccgcgccctcgctagcgtctggtcgcgtgccggcgtgattgcatgctcccggcgcttcgggtgtctctggccgctcgccagcggcgcttactctgcgtcgtccctccctctgcgttcgcccggcgcggccccggcgtgacgctgcgctcccttcgcgctgtgctcggcgccgctctctccggcgttacactaatcggccggcgtgcgcgtttgtngctncggtttctccgtgctaggacntgtgtcggggctgttgtgcgctctctctagccggcgcggtcgcgcgtcggtcgtccttctatcntctctccggcatgtggcgacgtgtctcggctgtcgtggggaggctgcgtcatctgctcctatacacctctccggncgctcgcgggtcctgcgccctctctgacagtaacgctccgtctccttccctgtctcgcgcgggcggctgctnttgtgtgctgctgtggccgtctgctgtctcgtcgacctttggcgtctgttcgctngtgtgcgccctgcttctgtccgcctgntctcgtctctntgtcgtggtccgttcgcgttgttcctttncctcttgcgtcacncgcttgtgctcgtgacatgctctgcggcgtggagtttcgggctgtcttgtctcgagcggttccatgtcgcggtggtacggtgcgttcgtttcgtncgttgtctgctcctgtgtgtgggtgggctgacttctgtctactggtctcccgtgggtcgcatccttctggtatacctcctcttgcgtctcccgtcgcgctgctcgcgtgcgctgcttcgtgcgcgttctcctctgcgtctctcgcgcctgccngtcggtcngtctacgncgctgcggctcttcttctcgcntctctgacttctagcttctcgcatgcgctactgcnccggcgtcttgcgtcngtggcgcgtccgtctcgctcgtccgctgcgccccgtggcgcgcgaatactacgcgcggccgggcggttgtttgcgcccgctcttatcaacccgctcttcctggcncgntcgtgttttgcgcctcatatgcgagccncgtncctcttctgtggtctccctctcgctccatgatngcgtgggatgcgggtgcgcttggcattgctctcgcgcctcttgttt

SEQ ID NO: 6693 - DNA, 302 bp, Homo sapiens
  misc_feature (1)...(302): n = A,T,C or G
cttattgttatttctgagtggggactgaattgattagctgtacacatcacctcacatcacgtcgccttcggtctaggcgtgtgccgactgcttacctatactcgtcacattgttctttcttagaatggttcccggacagtccgcgcctacctcccgtcgcctattcgggggggaccgtggagtcttatactagcgtatctgtgtatggcttgttctgtatggacggttctgaatcttgccgtattggacccctctcgaaaatatttcacctaatcatccatctttcctatttgtcnaattct

SEQ ID NO: 6694 - DNA, 1608 bp, Homo sapiens
  misc_feature (1)...(1608): n = A,T,C or G
gtagtgatgtgtgtctcttgtcgtctgcgcgccacacgnatcacgatagtgatagaganacgcatcgtnagttganagttagagcataagcacactntacgctatgctctgttaatnatgaacacgtgattagactatatagatgtcgactacattagtggagtctggaacggtgtgatcgtatacatagcggtgattctatacgcgactacgtgcgacgagccatctcggtgagaactgtcatacatctgtgtcatcatttctcatcatatcctgttatcagtgctctcggtgagtcgctgttantatactcacantctctcgcttanctcctctgtcgtgaatgctattagatcatctatgcgatatgttntagaagtctgtacagtagttcgtagcgcaacgagtgcagcgagtgtagtagatatgagatcagggancgacgcgatctacagacgagcgtgcganancatatgtacgtctatgtaggctgcatacgctctgcgcgcctggaactgtcatatacgtgacatgcatacagtctgtcnttcgtcgttatctcttnagtgcgtctgcgcantcgacgcgcaagagagcgcgtntgtgcgagcaanagtactatcgacgactagcanatatacgggacgtagtagcgtcactgcagcgcactgagagcagagtacatcggcctcctgtcgtaatgactacatagacgtgtgatcgcaggagagagagcngcaatgcgtcgtgacaaaacaatacggtggtgctggcgaaggtgcgatatagaatacgagacgtcgatacgcgtcagaagtcatgcgcgatgtcgtaagaggaggcgctgcatgcacggcacgatcttgatcgcgcgacgtaagcgtacgtaaatatacgaactacgagagcgataggcgttangtgaggtgcgtcgcgagagggaatgtggataactggtgatcacagtatagtggattgactgtctcggctggatatgatagcaggtatactgcgagtagtgttgtagtgatatatagcccgcattcgtcgttcagtctgctgatagtatcgcatatctgacctgtgaggtgagttgatctgaaacgattagctcgtgcgcttataagctagttgaatgcgcctaagtcgtgcgggtgttatacagcagtcgtgatcgcgctacaattagaatactacatctcaagatggtataaacagatatactccacgcatacgtctaacctttatgtatgttaatggacctatgtacatctatcatagctccactgcgtcgcacgccacttctcgncgcatcgtggtcgatcgcacacgncttgaatgaaatagatgtattacgacagtgtgtagcgcgagcggtgtgtntcgtccgaacccactacctcaagtcacgtgattcaaatacatctagtcgcgcaaagcgtagcggtcgcgcgcttcacgtggtgtctgtgactcgatgagatcacgtgcgcggtgtgggcgtggtagtgcctgctcgaatagatattgtcgtgtaacgcgacggtgactcacattcgtaatctacgagatnagatgatgtgttgtgaatgcattggtgcagaacgg

SEQ ID NO: 6695 - DNA, 787 bp, Homo sapiens
cggcgcccgccaccacaccgtgcaaccccaccaccacccatcccccatgcatcctccccgggccgccccccgtgcgcctcccccccctcacgggcctctcccgacaaatcacacctagcctatacacgcccccgggacggaatcggtaccaacttgctccgaacgcacccccccacctctactagcccccccccccccgccgcagactccccccgccaatggcaaacacggaggacaggcgccccccccaccgtgcgcggacgaacaagcccttggcgccgccgaagcgccacacgcctccattccacccccagtccggcattctgaccccccatccctcgcgtttgggcaaccgtttgaaccccgccgtaatcaacatgcgccgaaaaacaacaaaacacaaaggagctgctccaactcccgccagagagcccttaatagacctctccaaagtatttattttatatcactgagtagtgagcattttaatctctctttcgcagtcaataaactcaggcttggggagtttaagcaagggcccaaagttatggatgtgtttccaaggtagaggagctgataaaagggggtcaggtagcctgacttccggcatgtatgctctgatttcttgttaagatgaagggcacttaactgtgtctcatccgtctctttccccactgcttgcaaaattgcccataaagtttgtaaacctgcgatgctctgcaaaataaaaaacgatgcggccggaaactgcctcttttgccccccccacactccgttacctctacac

SEQ ID NO: 6696 - DNA, 941 bp, Homo sapiens
  misc_feature (1)...(941): n = A,T,C or G
ctgctatagaacaaccatcatatgacgcagcacggggcgtgggctgtgtgtacaataccagacgcgcacacctacgatgtaaaattatatacctctggaacgcatgtagggcaaaaacatgaaatcatatatgcatggcgtcgattctataataatatatacgaacacggcccgcgcgaaacaanctaccccaaacatgtgcctgtaaccatatcaaagcgcgtcacgatatcgcggacttgcggtatattatgctggatgtcatgcgattcaggtgttctcagtcgcttacaaaacacgaggacgcagcccacaaaagacccgttcaaggatccaggggggataaaagatcaatcagagcggagggcgtggtggagaatatgtatggtagggcgttcacacgtactgccggccgcatcgggtcgggtgaagatgacagtccatatgtctacgaatagtgtaagttgactagatacaacgagcggtctgtcaggggagctgtagggaaaaaagctccgccatgattcttgtagcccacatgcgatgccccacacattaaagtgttcggcagaaagaattactttatatatcgcggaagtggctgtcggaaggattaaccctggcaacatatgcattactctcgctcctcgatggtgaggagaagaggccaacgggaacgttggtttcgtattttatggcttcggcttttgtattttcatccggcgtagggattggccgaaactcatatccaaggtgacaaaatataaattatttctctcccagtagttttgacataatgaaacagaaagaaaagatacaaagaggaatcaggagatttgttcaaccaaactggttactcttgtaacgctaataaaccccgatgcggccgaaagcctcctctctcaatcacactttaccatatcatcgagatatatgagtaa

SEQ ID NO: 6697 - DNA, 1938 bp, Homo sapiens
  misc_feature (1)...(1938): n = A,T,C or G
cncacatcgcgatgcngatcttcgacgaccacacatgtacacgctnccatcgcgtctcnaacgatatacactacgacactactcgtccngctctacattcgtcgacacccatctatcatactagtagncatcgactacacacacacacaagtnacacagatacncatagcacacatnaacnactngcgagtcgtaacagcgagcgcgtaatccttgacgtacatcatnacncgtantntntacactacaacatcctacacactacactatacactcgctactaacgacacgtgctaccactacacagttanactgctgagcgacacagcnctgcagtcatatcantcacgtgtataganataccatatgnactcgaatatatcnctcntcactcacacgcgtagcagcacgacaactctcgcgtctcatcaatttacttatctatgctagccatctacattcngcnacgttagatagancanacgtagaactcacgacatccacgcaacatcagatcaccgttcgcatagtcgagcgtactactgcgtgcacatcgtggccanacacatacatatcacatcgcactcttgcagttncatcgcttgtgagtacatacgtattgcagtgttnaggtacaagnatcttatcantagacgaagngnagcgcgcgatgtactgatgacgctcgccctgggtcgactgtgtacttaagttcgagtctagtgtgtgtgtatgtctgtgcgtagtgtctnttgagagacatgatcanctcaatttatgtgataagatctctgcatagtatgttagacgcatattagttatattgtatagagacagatacagaaccatatagttctatgctcctcgtgcacgcgtgcgccgacacgagcgtcacctcatcatcccgcatgagtgtcancgcgccctgaacagcagcactaatcgcgggagagtgacgcgagcattaaacacacacgatacctctacccacctactatcacanccacaantcaaattacgtactatactcgtgttcacacacnacaaaaaacatacaacaacgacnctcatgcaaagcgagcaanatcagacgacacaacacnacaccaatancgcacacaagaananaacaataatcacagacatcactatacacaacaacatcacactagattcttacatactnatgcgatcgcatcactgctggtntgtgtcgtggtgtcgcggacgtgtgcctctacgcgtgatgtgagtgtgccgtcgctcgtgtgntccgtgcaagcgatgtataataatagancgagatcttacgaaacgatgcgcgacagcgatagacagtgtagangangaatagatctagntacaactacatgaaagcanatacgctanacaacactcataatctatatagtcatgattananngcatcacatcacatncactactatntcagtagagnggtggggagngctagtagaacacgcantgcacgcgattgatcgacacatgacagcgnngtagnancgngtcaatgctcactacanacatacatactgcgagcgnnacatgcaacttantgcgnaacaacagcnaggganatagatagatgatnagtgagagtgaaagnactatnatgnagagacaccctcaatgtagcacgaccctcgtctgccactgntngnnatgtagtgggggncacgcacncgcgtcncacagcactcacagnaaccnacagtcacncnncacgtcngacggggtatcctcacacccncagaaacagactacacacacnnacancaaacaacgananaccacatanncaantcctnncaactnntgagaganatcatannanccatgacactaacactctgacacacaanaantnaannananncnaaannnatanattaatataataacaatattaaaaaaaat

SEQ ID NO: 6698 - DNA, 402 bp, Homo sapiens
acatcccacatacacatacaccccaccttaccgctcgccgtactctcataaggacacagcccacctaccacggacattacatagccagcgcccaccgcagccacacccccacacccaccgaccgcctaaaccatcatcaatagcagacacccccatcctcaggcctccgctaccctcccgtcaaactaccgaaacgtggacacccccgatcaaccgctataacaccatgccacctaccccattttaccctcagccctaaacccccgtccaacccaccaaccccccgctcgcccatcccccatcctttccggccctgccccggttgacgaaaaaggaccgcaaacctccccccccctcaaaaacatcctttttcgcccaaaataatgtggtatcgatcctgta

SEQ ID NO: 6699 - DNA, 862 bp, Homo sapiens
gaataacgattatggatatgatacgtaaaaacggcgggggtgtttgtcaaaaaaagaaagtggaaagtgacgctcgaccatcataacacgaggtatgagggcggagcgtaaaaagggcaaacgcaagacctggattgacatacataattaataccgaaaaatacggggtattcgtagaggtaagtcaatatgggtgcggaaatctattaaaccggcggggaatatgggaacaacggaaaatacaaatgaaggcaagtggacccccctatatgaggtgtgacaagaatcgggtaaaagtaaatagagcccgtacactggcataggccacaggtggaatgttgggggcgagtgatggggttattaagacatggagtatctccacggccggggaagagtaacgtgttattgacaaaccaacaggtacaaagggcgggggctcgaagtgcatcggtgcgagcagttcaaggagcgttaaacagagggatcacttcaggctaggaatttgaaccaagcctggacaacatggcaaaaaccccatctctacaagaattagccaggcatggtggtgtgcgcctgtggtcccagccactcaggaggcagaggtgggggaatcaattcagcccatgatggttgaggatgcaaggagccatgattgtgccaccgcactccaacctggatgacagagtgagaccttgcctcaaaaacaaacaaacaaacaaacaacaacaacaaacaaatgaacgaacatacaaaaaacattaataaagattataaaaccgtcaaaaataaataaataaatgatgatgcggccggattactagaccaaaaataacactttacttaggtaaggataaaaaacaac

SEQ ID NO: 6700 - DNA, 1075 bp, Homo sapiens
  misc_feature (1)...(1075): n = A,T,C or G
atagttgctgtgctctggattcaggagacgaggctcgaagctagcggcacgcggacagtggcgcgggtttgagtttatctattatacttgatcttaggtagctaacccagacttgctcaaatattgattgtctgaagaaattagggagaataggggtaatgcattatatcgntagtataatttcggtagccgtcaggggcgcaggccgatctcagatcagagggatgctatgatggcaggaacggacggcgcgcgagggcgatgatgatacgaccacacgtacacatgtacactgcgatgcgagcgtatgatgtggacctgtgtataagtacgcgatcatttacttcttgtatcccaatgcgcacaatacattcgactaactgtacgcgctctagttattgagaataagggatcttgaggcgtacggaaggtgagatcattatttcaaaaagacaccgataagtggtacgggcggtggatcataatgggacgagatgtcgacgcgccaataaagcgggtggggcggaaatgaggcgaggacattgatcacggatgagggatcgcgggtaaatggagaatggagtcaatagtttgttaaagttggaggttaggcgcgatggacgccagacgcggctggtatactgtttaatgatacttgcgcttacggctaaacacgagagattactatgcgcgcgtcataccgtatgatcctggtacgcgaaatgagtactactagtgagctgatgtaaatccgggacaaatcgaaaaaagcgcatgtgggcgcacagtacccgggacggaacgcgacaatgatcgggagtacggggagtcatcagtgcatgacgtggcccctacgacggcgccaactccgcggacctcccgcttacggggggagtagtgagggcggtttctacagcgcgctcggtcgctgagtgtagagggaagggcgggtgggaacagaagtggagttatatgggcgggatgtggtgtaataaagggggttgcgtatctcgtcgggcctgaaaagccgctaatagcgggaaaatggaacgcgaaacgaagctacgatgattac

SEQ ID NO: 6701 - DNA, 441 bp, Homo sapiens
  misc_feature (1)...(441): n = A,T,C or G
ctagtacctacacacaagcactcaccgcaaaacaacgcgcacggcggcgacgcaccaaccaacaaagcggctaaggctacggcccgccactactaagaggggcgatccgtctcccgcgcacaaagaggaaactcaacacgtccggctcccccacacaaaacaccccaaataaccccccgacacaccccccccgctacccgacgcgcccacctaacccacgctggtcctcacgccaacacgcggaccaccctcgaccgacgcccagcggcatattggcgggtattaacactcccccccaataaacaccagactcccgccgcgcgacgccacgccgcgcgcaccgcggtcgaatcagaaaacaacgccccccccccgaagcgtggctgcgccggaagcaagaagccgcgaagggacgcgtcacatctcccggcncnncnngcc

SEQ ID NO: 6702 - DNA, 266 bp, Homo sapiens
attccctatctaacctggcgcactgcgtccctctcccccacgcccccgccgcacacgccccagctgtgggctatgggagcactacgcaccccctgcccccggcctgccctcaccccacgaagcccacaccgcccacccaaaccgacgaagacgtcgtcgtacaacctgaaaggaccccacgaaagcgccacaaccgggtgaggaccggcaaactccccgacgcactgccgccccaccgccccagcgccggtgcgtaacaagaccgc

SEQ ID NO: 6703 - DNA, 829 bp, Homo sapiens
  misc_feature (1)...(829): n = A,T,C or G
ccccccccctccactcgacacctcacagagcgccctacaaccccgccacgaacacaaaccctcgttcacgccccctcccccgccggacggagcgctccccgccaacacaacagacacctcccacgcaggcgcacataacccgaaccgcccaccggagcaaaggagcaccagaaaccatgtcgaagctcgtgcgaacaagacgcaccacatactctctacccacctcaataccaacggaccacccctccgtgaatcgatctgaacacgcacacaccacctctcccacatatgcccgccacgcacctactacatagaccccctcgaaaggtcgcgaacacccacgtgtgcacgatcaggccgccaagcgcgcactcgtcaagagaccgcgccggcatcgaaaaaatgagggagccttctataattatacccccgacgacacccccagggaaagtgcggagtcgaccaccagagcgcggccccacagtttttttatgacagtttcagcttctccgatcccccaatgccccctccatcgttcacaagagaggaccgctctccccccaaaacagaggaatgcgagagcaagagagggttcaactggcccttttatgagggcgcaaatcccacccaggagagtagagcccacatggcttaatcacttctttaaggatcccccctgtngatactgtcacaatgacaacccccccccacatgactattaaaggagacagtcaaaccatagcacacacacgcaataatctcaataaagcacgagtcggccgaaactcnnccttttcctccctttctgcgccccccccgtacacctccc

SEQ ID NO: 6704 - DNA, 1435 bp, Homo sapiens
  misc_feature (1)...(1435): n = A,T,C or G
cacacgacactccaccggtctgtgacaaatccacccaggcgcacacctgtcatctcgcgacaccagcccccaacgaccttttgacatgggcagaaccctaacatctggggtgtgggcggtggtcagtcccccccatattttattattatatatatagctcgggaggcaacgggcaccggatatagtaactatattggaggggtgatgtattgtgtgtgggcgaatatcgggcgattaatcacgaaatacaggatatgccgcgggtcgcggacacaaaaggcgccgcggtggatcacgcgttgcggcacgcggaggttgcccgattctttataccactacgaaacagcggcgcaccactgtacgtgcacactctgcggggcaatattcaattaataacgcgccgcaccttaactacgtgcatgtatttcttcgtgcaacattgacctagcataattcagcgacccgcacaagcgccatggacataaatagcggaatacggtgtgccacattgtgtgccccgcggcactaacccaccaaatatgcgcataggagatgcaaatgtcacgtcatacgactggccgatataaacacaacctattcacccaggggtgcccacaatgtcgtcgtggctcccattgggccctccagtcactgggtcctccgccactcaaccgtgtggtggggcgcacaatcataatgggtgacgggggtggctcacctattcatattcagtcacgctatatacacnttgccacactcttgccacggcgcgacagtcggacaggcgcgggcgcgcgggtacgcataatagtagtgcatactaggcgcggacatatctggagacggagaaagagacatacncgatacactgcatacanctactgagtaacatcaaaacgtgaggagggatctcgggacacgaanacaataaggatcacacacgcagtgatatctgaagtgaggaggggtgtggtgcgtgtcagngaacagngcgcgcgtgcgatacactatcaccacacccactgggtgtcctctgggtagcggcgcaggcacaaccagcacgtcgganatanatatatgtggngatatatcataacactcgccacgacaaacgcgacgggggtggcgctacatactataaagaaagtaanagaanggagacaganacacagcgcacgagatttggctgcgtgtgctgcactctatgaccatgcgtggggcgtactcgactctctcgctctactctcagtgacagcagaccactatcacactcaccngtcagtagtnggggcggtggtgggacacacacgcgcgaacaantgggccaagttgtggcatgagtgcgagtctagtatatctggtgacctctgcggctcgtagtaacatcagtgtcgagcacacactagtgtgcgcagcgagtggggctggacacaca

SEQ ID NO: 6705 - DNA, 1449 bp, Homo sapiens
  misc_feature (1)...(1449): n = A,T,C or G
ctccttctgcctcgctctgtctctcggccctcgctggcgcgtcctcctcttggggcggtgcgtttgcctgtcggtcggtgcctgtcgtggctcgctctctctgtgtcgagtggcgtgtgtncgcccgctcgccgcgggttgtccgggctatgctgtgtgctcgtctgtgtctatgctcgtgtggtctcgtcggtgtgtatgtgttgtgggtggccggtgtggcgcggggtcgcgcggtcagatacgcgtcgtgtcctcgcttctcgtgtctagtcggctcgagtcgtggtctcgctgcgctcttancgtcgcgcttgctcgtcttgtcttcgctttcgtctgtacaggcggcctgcgtgtctcgtgtcatacggcgactgtatctgctctgtcggcgcgagattcgctgtgtctgtctctgtctgcgcgtcggatgctgcgtgtgcgtncgcgctgtntctctcggcgctgttctcgctggtggtgcgactcggcggtgtgtgtgtgtgaggtgcgngtgtaggcgngtggcgctcgtcgtgacgcggctgcgcggacgtgtggcggcggtgttgtcgcaggcgggacgcgatatattggcgtcgcggtggtcgatctcccgtcagcgcgttgccacgtcgtcccgtctgcggctgcgcggcatcntnttcncgncgggtcgcgctgcgttgtcgtgtgctgcgtgcgctctcttgtgtccgctgttgtctgntgccgcgcgtctggtggcggtncgccctgtctgtgtntgtgcgtcacgctccggcgggtcggtctctgcctgtctccgctgtgtgggctgcgttctctcggcgggcgccggtcctctcctcccctgctccgcgcgggcgcccgctgctggtgctcccgcttccggcctcgcggtctgtcgctctctgtcctcgggtggcgggcctggtcgtcgtgccctcttctgctctctggttgtggcggccggtcggcttgtgccgtcggtgccgcccttggctgggcgccggcgggctgcgcgctcctgtgcttgtttgtgggccccgcgtggtcttgggggtttgttgttttggggcgcgtcgngtttggtttgccgcggcccccccccaaagaaggagttctttcgtcttgcttttccgcgccggggcccctgcgcgccgcggccgtgccttgcgagagcgtcgtgtctgcgccggtgggcgttcgccggggtgcgctgtgtcgtgtgggggcgggtgtttcttctcggctgcgcgctgtgggtggcggctccgttctcttctntcntcggtcgcgggttctcgctcgcctcctccctgcacggggcgtgcgtcgggnncgctcctcnccttcncncncnccctntggttnntntcctncaaaccaaaggcgcggtggccngatggnacctacaacagaannnnctccccccggccgccg

SEQ ID NO: 6706 - DNA, 1759 bp, Homo sapiens
  misc_feature (1)...(1759): n = A,T,C or G
agtcggtggatgacgcacctccggcggacaagtcacaatataggatggagccgcgctagtcgcggagcacttcgcctatagacgtctttacttgtctctgtgtcggtgatgcaggctcagctatatatactcttgtctctcgaagaccgcgatcatctgtgtgctctcctcgcatnctgttctgactcctcctctctcctgctatatcgcactatgcatgcgagcgacnctcatgcatggagcacctgactgcaccaggagatacactatgtgagttctgagggtcgatgctggcggcgttgtggaacgcatggcatatatgncttcccatctacttgattgtatcatctgcgcggcgagttccatgcnatcatgtgtagctgtgactcatgctgtgtcagcacttatgcgcgacacgcgcgctatgctacgccgcgccactcatatatgcgcgaggtatgtggctatacctgtatctnattacgcgtgtatgcgcncttgctcgtcggtagtcgtcgctcgcgaagtgagatgtggcactatcagtgatatgatcgaaactatattcgacatgcgattgggatggcgttatacgacacgatgcattgaggaactgattgtaactgcgactctcacantcgtcggcagtgctgattaggcatatacgtcattgcgatctggcttcgtgcangcgnacatagcgngaccgggcgtgccggtgtntggagatgaaaagacgcactaacnccgtgtctggctgcgctgacggcgtacagcatacacantacanacacaccngcacgttactgtctcntgacncnctgacgcgtangtctgctgacgcgcgcacacgtgcgtatcncatcctcgcggtcgcatcgatnatcncacgcgcgcgaatngcgccggtgctcggtgactacggtcgtgagtgacagcntacgcatctacagtatgtgctgctgtcgcgcgcacgctgcgcgtatacgtatctancatnangtccgtcagtgcagcgtganattantacaacatcgtacactcactatctgacgantgtancgtactgcgacgtgtgagagattacgctacngctggcttgancctgacagactctcnanttaatagtcgtantcncgcacactatctctctgcacacgagactagagtatctatcaatgcttcgtcgtnttggtatagtgtataccgtgganggtcattgatatcactgatggcgactgactangtagacantngcaccgtcagtggagagtactnggngagtgacacacacgntncngctgatgatctgtgngtgatctcgctctanacgtgggtcgacgatcgcgtgaaatgacgtgtgacgtcgtcatgancactgctgntnggcatgtctatgntgcgtagtgtgtcacgtagcgtgtatgcggcttactcaagcgtactgagagatatgagtggctgcgagcagacgcgcgtgagagacgtcgatcataggtgncagtactcatcttatagcacgaccgctcgcgctgctctgtacaattcatccagcgtgcggtccacgaagcattcttgacgcagacggtactctctgtctaatacatagtgacatacagggacagcgccgccgctgcggttgtgctactgtgtgctgccgcacgaatcaaatcctcgactctctaatgtgtgtcgcagtaaggagatattatactgtgacaatgacagactgagacngtctggcgncgctgcactgcag

SEQ ID NO: 6707 - DNA, 1648 bp, Homo sapiens
  misc_feature (1)...(1648): n = A,T,C or G
catgtgtggcgcgtggtgcgcgcgagcagacngacatctgtcgcgcgctatcacgtgtgcggtngtatgagtgaggcgagagtatcaatgcaatagcgcgatatcagtaatantcagatagcggctgnggacgnatacagtacgcgcagngagaataatanctgagcgatntgcgccnancgngacgcgtgacgtcgtagnatnagactacgcatacgtgtcactcgctgtaactctgtgaacctacgatactagacagcagtantacacgagtctctgaggatagtaggcaatcacagacagtcgtagactcacagcgacgtgcgtatagcaattactgtngatgcattatctgatgcgtcgagcgtgcgatgtgaggcatctctgtggtcggcgtggtctatctctcgtcgnggtgtgtggtcattgtcgcgccaggttatcttgcatgtgcgcgtggtatctactgtcgagntacgcacttgcgcgcgatgatatgtcatcacttntactatgcgtgtcgtgacggcttataactgtgctggtatagtctctcaagtactgngtaatcgagtatcatctctgtgtagcagatanagcatcatatcaacgaggatgatcctgtcgactgcnatattcctccgtcgactatgcagagtgctgtctgtgcgggcgtacgcggcacatcggtctgcgtacngagacagacacagaagacaatgctgcagtgtgctctggcacngcngcgtgngtagagggtaatgacatcataacacatatgtagggagagcaatagtgggcatgaagacgaaacgcgatgaggagttgatggatttgcgtactattgantattcatgcgacatgggagggtntgcgcgcacggagatacgtcngcngcgcgtacacagtctctgatcatgtntcatgacttgctgtctcaaactcatgagctacgcagcgcactgagtgagtcagagtacggctaggattcatatgctactggcatatcacgtaggctgactcanataacctgtatgtgtaacgcaaagattactcagtaaggccggtgttggcnttagttattatgtattgtgttatatgttatgcatggataggtggcgccgcggcgattagtcggaggtgcggggagagtcgtgtcgcgcgtagaagctgcacctattatnttaggattcgagagnatagacgtgtcgttgcggagatagttcatctcaacgccagttgcagtgaatcacgataatctcgaagatgcgtgtcgcgagntgtattaacttataatcnttgttactcacatgtcgtagtgctgcagcctaccataggtatcgcgcttaggcacttgcgctgtggtgtctgagttgacggatgcggtcgagacatcttatctaaaccacactcatttataatcatcgccgggcgcagaggcaaccacgttgcatagttgatggcggcttgacaataaggtcaaatccccgcgatngaggtcgccgcaagtacgtgccgtgtcctataatgtcgtgatggaatcgaggtgtaggtttgatcgaaaaacgtcaggcaggcgaggtctcttgcctgaaagatcgtcttcggcgatgtatgcaaaaatgaattttgtgctaagattagggat

SEQ ID NO: 6708 - DNA, 424 bp, Homo sapiens
atttttatgccaggaagccatcccgtctgaggggttcaagggacgaaagtcggacactgcagctacatgaaggcatgtttccccaagcaatgaagaatctgagactggcttttgatatgatgagagtgacacatggcatagaacacatcctgattgaatatttaattctacttttagaagaatgcaacgccaatttcaaagcatcctaagggaacgcactcaaaagaaaatacggccccgtgtctttgtggaatgccttattgaggacacacactctatgcattgttagctgtgtgacacctatactattgggaaattatgctccgtgatcgtgtatgtaaataaaggcagacatgggcagcaaaccacagaaatcattactcgtagacaactacatatataataaatcccgatgcggtctgtg

SEQ ID NO: 6709 - DNA, 1744 bp, Homo sapiens
  misc_feature (1)...(1744): n = A,T,C or G
cgctcgccgacactcgcgagcacgtcgatcacgcttactcagtatantgtacgtcatatgttgtcggtgcgtgntacgtattaagatgancgtacgtactatatcttacgcgtgatctacactgtgtatgtctataactcggacgantgcacgtcgtagcgagtctgtgctgtgtctcgcgtgagtgagtagtagcagtgncacattacatgcggcgcgcgctgatgagatcaaagtagtcgatcgcgggcatacgccactacaatcgcggtgagcanactgctgcgacgatgcgtggcaatatagttactctggcgcaaaaattacaaacgcacaatgagttcatctgacgcgtaccacgcgctggcgncgacggcacgcagatgcactggcgctgtgattgatattgggtgggttatatgcggatgctaattagaggtcggtatngcgctttatacgtgcgcgcgctcgtctcgttctattgtcacacaagatagacacctgcgttcgtcgtagcgagaagantancgtantcgtgcgctacgcggccagcgggcttgcgccggctactccgctgatgagccgtcatgagatcacataataacggcgctacacgtaatgaatgacacgcgcatactatgtatatatatcggtatgtacacgacgccgtgacgcgatccagtattacgtgttgttggtcgtctcatctcatnacgatcggagatacggctctcgatntgtggcggagagctgtcatcatcaagccggtggagagatanatacaggtcggtgcgtggtgggcgcacgcggtcgtgataccggagtcgtaattcacgtgtgaggnntatatatagatagatgtgagagcggacagatggtgcngtgtggtagattatcgaggacatcgattcgcgccatactccgagtcggcgggatcgaccgcacgttgcanantgcgcgatatntgtgtgagtgatattcaatgaactgtgcaatgagcggcagntgtgcgcgcgtgtatcgatcgnctgcaggcacatctcacgctcctgccgctggcacgaatagtatagcatatgtcttaagaggcgtagtgatgccagcgtgatcgctaggtgtatactatcnttgttatactctatgtgacggatgtgcgcacgcgatgtgatgttggtggtgatgagcgactggtgcacganaatatcactcactcagcgnangtctcatcgnatcgagtngatctcatttcagcgtgtcaccgcagtcgagccccgtcggcagcaggtcgtatcnttttgctaggtancgcgatgcagtgtgcatcctgccatgtcatgtggactgctacgtcncctcacncgtgtattgcagtcatgtcatgtaagattcgcacgaatactcctgtgatcgtctcagcatgtacatgtcactatcggactacatcactaacgactatgcgagtngccgcacgatctatccactgatcactgcgacgtatgtccgtncacgcttgtatccgcttgcctcatctatcgatcgatctcgtgtgtganacagactgcgcctgcttgatcgacggtnatgccatgagagtatctatcntagcgtcggcggatatcgcgcgctgcagtagcgctgcatcatgactcactgctcntctacacgtcttcgacgagcgcgagcgagatctggagagcnanttcngtgtcgctgantccncgtgacgatgtggtcatacgcgtgt

SEQ ID NO: 6710 - DNA, 367 bp, Homo sapiens
cagttgcaaactatagaaaccatttgggctggtttgagcataaaaggaaattactgggagttattaggtgctcggtgattcattgggaggtctggcaaaaaagaagctcaaggctaagctcataggaacacagcccggcatctcacacagaagtggcttgatgaggattctactgcctccacagctcctgccatcatcttcatctgcaccatagatgctcagaacccagtctgtgtctgcatgttgctgacttccaaatgagagcttcatgagagtgtatttggttggtagaacataggtcccagaccttctccctgggagctggaagagatgctgggaaattctgccctggaaaaataaaactcga

SEQ ID NO: 6711 - DNA, 1233 bp, Homo sapiens
  misc_feature (1)...(1233): n = A,T,C or G
gctttggtatttaccgtttctggtgccttggttcatttattgttgtttccttactgtnagtgttctataagtttgcnccgcgtnagtagttagcgctcccagttcaatggtcctgtcgcgtgggaccgcgttctaccaggcccgcgcctaggtgacactgttgcnncacgtgctcgaacccccaaggtcaggtcgggcaagtggtcaatgaggctatgtggnccgccatgcnatctcaacttgacgcgtgcctggtcaggtctgccggtgagtcgcatatgtttcgttctaaggttcacgtccggtcacatgtagtgtcgattgatgtgtnnncagtancacacgctcntcccatatcaaatcatatgtcctgnnaaacagggatagagtgcgagtatgtatctcncacccacttcaccttggnacattcgacatctattgtccttcttactcctatgnttcatttagatgagcgcgnttactatccactgatatgacatgtacgtttcctcacgcccagagcgctgcgacacactcctactgctcntcgttacccacatcgcgccctgtcctgtaacattatgccgcccctctcagctcgatggcacaatgttccatgcatagtttgttcctgccgctttctctcggttctctctagtatacgtgttcagtgtncnacgtccgagttgagtctcacccacgtctatgtcgacagtcccggtgtctccgcctctcctctattccagtccctctcactcgcggntcctcgcatagttggtgtatgtcatgtgatctctccgacggcgctgcttctaaccacgtaggaggcgttgagtaagtcgttacatatactatctcgtgcgtcactcctctctggccctcactcatcacgacagtctcatttatagattacgacaataccacggtgcactttgagtatatgcgaccgtcccgnttgtcatgtgttacgncacaatcggcctagactagtcgtgcgcgttnttcagatgcgcaatcctctcgtctttacgtctcgcctnttcactccccacccgcctcccttcgcttcctctcgttaagctgcattctctcgcgacatcgctatcgcgagtcgccgcgttgctgagcgtcgncgcgcagtgctccgtccttctctctcgccctctcggcacctctcactcagcacctcagtccgtcgtgccgatctacagntcacgtactcacacactctcg

SEQ ID NO: 6712 - DNA, 1290 bp, Homo sapiens
  misc_feature (1)...(1290): n = A,T,C or G
ccgttattctgttcacttcaccgtaatcacaccttcaaacgtgagcacactataccgctactcccatctccgttttcttctttactcttttaacgctagctctcatccgtcnctcaactcacaggctacatattagaggtggttcccccagctctaattttcgctctatcctgatgacaacgcaacatcccatcagtgttaacatctcgcccgccgctctccccgtcctgctgccgctcatttattcccccgattgtgggcgtccttcctctcccaccnacgcccntcagagcggagctagccttctgcgtagtctggcatnnccttgcaccacctcggcgcgcaacacggcatgcgttctgtcacacccncccgcaccgagcgctcacactagtcctacctctcacaccttctcagtttctcgttcctggtgcncgccacacacgcgcacatattnctatggtcgctctgatgtcccntccgacccataagcacccatcctgctattcaccaccccctccatccacacccaagtcgtctcacctcctccgcatacgcacccgcacctcgtcttcctcctcccctgtcgcacacctagaaccgatcccaccctactcgtcgacctctccgacgctctgtccacataacgttcctcccnatagcgtctcctcctctcaacgagtcacgcgtcnnnagatctgtcgatcgagccnncctgcaatgncgcgcagctagctcactgttcgcacacaaagacgaagcctccaactgactccacgtgtcatcttccctatctcccnccactgtccgcgncgctctacgttgaccacccaccncacccgcaccgcgtgtntatcctcgctgtcacgtctcgnccttcttccacacgtcccatccgactgtacatatcgtatncctctatgtctctcgactctcgtatctcaccctactccatacgtatactgtcgctcactccaccacctctctacacacttccccagcgcctctccgaactgcatgacttgcctgcctccatcgccctacacgctcgaagcgntacacgtgctcatccaccacgatcacccnttctcgccgcccactctcccccntctctaacttcctctatattcatcttctctcgtccacttgtctcatcgcgttcccgcccgccctctctcacgccgccacacttcgtccccccgtactcgcagttcatcnccatcgatgcctacgcattacacgtncatctcgtatcctgcgacatgnnccctatacactctgcgcgtttcg

SEQ ID NO: 6713 - DNA, 343 bp, Homo sapiens
ctgcttcctctggtcattgatgtgtcagctcccgctgtgcatcagccctgctgctccccggaagccccgccttgcaaatcacaaaatgtacccagcactccctcacccagcctggattggcaatggccccacaggacacatgggaatgatgatctttaagtctcagatgcctcatgaataaagtggatgtgatggtgccaaatctgactgaaaagtggggaatcagctgacctttcccagggattaaagcatcacctgctgtgcaggggttttgtgatacatgaaggcggtagtgcatgtacggtaccaggagtaacattatgttattttaaataaacaatga

SEQ ID NO: 6714 - DNA, 723 bp, Homo sapiens
ccttttcagatgccaagttatacttcatgatgtgatgtaaactgcctaaaaggtgttcattttccatgtaaaatattagctgtttctagcagcagtaatcatggggaaacaagaactcaggtagtaaagcattagtgaaattgaaagataagaatggggaggtcatcatggaggagtgcaaaaaaaaagacttagtcctttgcattcccttcatgataaaaatgaagttatttcgttaacatgtacttagataattttacattcttatagtgcatatttaaatttggattaaaaaaacaacctacatcataagattttgcatcatctgaaagaatattttaattggtccatctggcatttgaaataatacggtacttattataaagcaggtgttagacacttccgaatattctgtccttaattaaagcttaaagtaagattacattttctattttaaactttaaaaatctaaagttagtagacatgaataacaaaatgtatggaatcatatgatgttaaacattcagtaactaatgattagatattatttattgaactttaattcctgaaatacttttgttttgaatttgaaaaatgtaacaatgggtatcattaggttgcaaattatttgtgttcagactttgtttattcactgtaattaagaaaatttggtgtactcttgagtgtcatagttcaacacacactttaggaaaaaaagcttga

SEQ ID NO: 6715 - DNA, 162 bp, Homo sapiens
catttttctaggcatggagcaaacatatgcagaaatatatagatcagtgttttggatcctgctctgcatcttcccacagaaatcatttgaatactgtccacttttgatgtttctgtttccttggttgacgtcacagcacatctcatcttgaataaaggaaga

SEQ ID NO: 6716 - DNA, 325 bp, Homo sapiens
ctgtcgcccaggctggagtgctcactgaaacctctgcctcctgggttcaagtaattcttgtgcctcagcctcccgagtacctagggattacagtacagtgtttgctctttagtgggaactacgctcccagtcctgcaggctggcatggtgcagtgaatttccacatgccttcacccctgtgagctccacagcaaccacagccgggagggcgggccttcctccggcaatgaagggtggcctcccttgcggctgaagaaacagaagccgtccacacattttcactgctttgcagattcgtacagatcttttccagaataaagggtga

SEQ ID NO: 6717 - DNA, 358 bp, Homo sapiens
ggggaagaaatatgaaaagctcaaaatgaaattacttcatcagaattcacatttgattttcatcttttcagctacccagctgcattaatgctcaactgactatactcccagctgcattattcaaggaagttattcaagaaggaatacttgcaatatgtggtatactgagtagtgagctaattaaaagaaactcacagctggatttttagaaggctttgatcttgattgtaaggcgccaaaaatgcttgttggttggattatgttcctcatactctagatctgtagtcttatcctgtaagaaaatgagtaaggactcttcataaatgaataaatgagtgattccttaaaaaaaaaaaaa

SEQ ID NO: 6718 - DNA, 290 bp, Homo sapiens
aactgagttatgtaacaaggatgcaaaacagtgacataatctctacggtcatgatgatcccggcataggacagaggagtggaccagatgtcaggctgcccaagagaccagctccacctgggaagacagaaaccaggtgcagtgtttcacacctgtaatcccagcactttgggaggctgaagcaagaggatcacttgagcccaggagttcaaggctgcagtgagctatgatcgcaccactgcactccatcctgggaaaaagagcaagaccctgtctccaaataaaaaaaga

SEQ ID NO: 6719 - DNA, 1254 bp, Homo sapiens
  misc_feature (1)...(1254): n = A,T,C or G
aacaataatagatatgcgngtgggtcgcgagaacatatgagtagtagatatagatcggtgtgacgtgtgggtgaggtcgancgtgattgagatatcgggagatgacatggaaggatanggacgctatagagacgataatnacagtgaagcgtcgctgangtgtgagatatgatatagntgcgagagatacaagacgagagcagatangagtggagatgctgatatgagtgatgtaggcgcgagatgagagtagagagagtgctgagcgggtgcgcgaggatgagaagtganactaatagtgcatgaactatgagtggtatcgacgacggantagtcatntgagataggacactagtanacgcatgtntangagcacgttatgatatgantagataggcagaaagagcgatgcaatggatgagaagtgaggcagcgggacacgtggtgtaggagagtcgcaagcgtgcgtgggtggaacgtttactatacgcatgtgcgggcgattaatgctgtataagtgtactgagcgcgcgtagtggtgtctaggagatacggaatataatagagaggaagaggtgagtataggagtgcgtaggacggtgacgagagagaggagacgtgacgtgagagagaatagaaatgggagggtaggttgtgggagtacggatataaatgtaggagaggtgggagggagatggtaatagagggggtaggagcgaaatcgtatagtgtggggagaaagagggattggggagaatgagggtggtgtattgtgggaagtgtggcacgacaatattatgaagaataggggtggcgggggtggatgaggggttaaaaaanattaagggagcgttggggcttagcagaaattaatgatgaggttgagggaaaacgagaggggggggagaggggtttgttgtgtaatagcggccgaaagaggggagaggggcgcgccccccccgggtggaaaaaaggagaggggagggtgggagggacaggttagataagagaagggtgagaggagaaaataaatataagagggaaatttgggtgatatgtagtgagagagaagagaaggagagagggaggggaggggaagagatgggtttgtttttgccccccctccccccgggaaggaagggggaaaatttgtcatttaaaagtgaggcgggtggggggcagctttccacgtatggggtttgttcggtggaagtttttttggcttcctgtttggtgtggagaagagaatatgga

SEQ ID NO: 6720 - DNA, 881 bp, Homo sapiens
cgcaagcgcgctgacgagaaaatcgtgcagtccgagatactcgtgtagtattaattagtggctggctaatcggggcgttgtgtgtatgttagaagtttagaacgtatgtcgcaacaagcagtatctaattcttcaagccgaataggtaactatttgttaatgaagtggtcagaaccgagaagataggaattgcggagtagtaggcgaaaaaactgaaacgccgaaattggataatgcctggagacacacagtggaggagtgaatgctaaggggtatcacagtgagtgggtaagagacgtgtttagagcggaagagcgagggcatcgcggaaagggacagagcagcagagtgtgagcgacgaaaaagcgatgcatgctacacgtcacgggagctaggaaaagaaaaacgggaaaggtaaggtacatcgaatgctcgtaaagatgatcttgtagagggaggaagagggaacataactgggagggggctaggttaattgtggaagcatcgccaactaatctgcagatgagtagaaggagataatttaagaagaggagattgcattattggttactcgaaaatagcccgatttaaaggagagatgttatttctcttctctagtaagaaacaggcaggatatgctccctttaataaaatgcttggttaataacatttatttacagagtaaaattttctgtttatttccctccgacactaaaatatttacataaactcaaaccacttatgttacctattccaaccagtttcttgtcagagtgagtaggaaaattcttcattaaatgtcattgcctgtggggtaagcagaacaaaataaatagttgcggcgagttccttctcctttgtgttcgataggaaacgggagc

SEQ ID NO: 6721 - DNA, 318 bp, Homo sapiens
ccagtttccatgttttgagccatcttgtgcagagcagagtgacaaggaccccatgtgacaaggaccggagctctccagccaacagtcagtgaagacccgaggccatcaatggtcacatgaggaagctagaagttgagcatcccctagtccagccttaagatgatgagagacctggttgacaatgttgattgcaggctcatgagattcagaggcacctggctaacctacacctgggcacctgacccactaaactgtaacatgaagactactgttgtgggataatttgttagggaacagtacatatctaataaacccaga

SEQ ID NO: 6722 - DNA, 759 bp, Homo sapiens
cgaaagaagcggggggagaagagaggggaaaagagggggggaggtggaataagaaagtggagagagaagaagagggagaaaagcgggggatacgacggaatggagggaggtaaaggaggagtagaggacggtgggtagaagagggaagtgaaggaaagggggagggtggaggagaagagagacacaagagggggagaaaggaagggggaaagaagaagagggagggaaggaggggggtgggagaggggggagggaagagagagagaaattgggggagggagaagcggggagagagggggggtggaatagagaggacgcgggagataaggggggctcaaggtggacggttggggacaggaggatgaagggaaggggataaggaggagggggagagaggggagaagaggaaaaaaggaaaagggggtggggagggggggagaaaataagaggagggaggggggggaggagggaaggagggagagagagggagagggggaggagaaacgggagaaaaaaaagaataaataggaaaagggaaaggagaagagtggagaagaggggagagagagaggattaaggaagcaagaagggagaagaaggaggaaggtattaaccaaggaaaagacgaaaaggggaaaaggcaaggggaactcttggggtttgtttttagaggggcagaaggagggagaggggggcgccccccccacggagaggaggagagaaaaggaagggtgagaagggatcggaaaaaaaaaaaaa

SEQ ID NO: 6723 - DNA, 864 bp, Homo sapiens
ccgcctggttcggcgctatctccgcggcgccttctcgtgcgccgtggtccgcctcctggtggctgccggtctttttctcgtttgcccgctcgctgtttcttttactcgtcttcctcctcttcgctttcttccgcccttttgtcttcgcgggtccgtcgtcctcgcgctgtttggctacttcgcagtgcgtctccttcccgtgggtgttccctgttgtggcggcctggtcgctttgttgtcttttccgttggctccggttttcttccttcgttctttcgcgctgttcgttgcttcgtatttctcgtgccgcgtgcgcccgttctgctcgctctttcatcgttgactggtcttttcccctcccgacgcttctgttcctgtcgtcttagcttctcgtcggcttgtttttggggctgtttttccgccctttctggtgggctgtcttgtggttctcgcttctcttgtgctcgtattccgttctggtcggttgtcgcgctggctgtccggccgtccccctcgttttctgccggttgttccctggcggtgctgtgctcctttctgtctctccggtttatggatcggcgtcgttctccttgccgccttcgctccctttcttggtgcatcttgctgtccgttcttttgcctccgtgtctgctgcttttcgctcttttttttttgtctgcgtgcgctctgcctcttgctcttgttgtgttcggctagggctgctggcccgcctttgtttcgcctcgtctatttttggcctgcctccttcttgcttgctggtttttccgggcagtttctctcctgttccggccaagtttcttctttctctttcgtgttggttctcgctcgtgggctgtgttgccg

SEQ ID NO: 6724 - DNA, 891 bp, Homo sapiens
attaagaggagggttgataaaagatgttaacgaggtgtgagggtggtagaagattgagggtggtggtggggtaggatatttggatggtatggtggtgtgaggaggggtagaggatgtgggtggagggatatttgtatgttagtaattgggtggggggttataataggtagaggagggttataatgggggtggggtgtatgaggaaagtggagggttgatatgtggaggggatggtagtggaagagaggggggaagggggtagataagaatggtttataagggttggtggatttttagtgactgtgttgtgtggggagtgaattagagttaagggggtttaggagggttgaggggaagaagaaagagggattttcgagttggggggtgggaggaatagaggggtttgttttatggaatttggttggggagtggctttagaaggaagaaggtaggtggtgtgggggattttaagcgaatgttggttttgtgttagttgtgagagagggttttttattagggtttaaatgtgggaggaaattttttttggggaattaaggaggttgttagaggtgggaaattgggatttttttttatgagaaggtaaagtaaaagcgcccccccctaagattgatattaaagggtagaggggataggtatagaagtaaactttgtagaatataggaaattggtaaggggcagtgtaaggaattttggaaaaggaagtttttttagattaaatttggttttgggaagagaataatttattgcacctttacccagaaatgtagagaagtttagtgggttattaggaaagggagttagttgatagcaaaaataaatctgatgggggaggttttttttttgtgtgtttttatttaattattgtttggg

SEQ ID NO: 6725 - DNA, 782 bp, Homo sapiens
actagctggcaaaccatcagtcgaccaggagcaagtctggggaccacactttgagtccaccgccttgaaccagccctctgcccgtggctgacctggaaagactgcagttcgagactgccctgactggcgtgagccggcagcctcgttctggccaaggtcactgacagttctatctgaagacctttgggtcacctgcctgcggtaagctgcctgctgcagagggagctggcgtggaggagctgggaaatgaggtggctgggcaaactcgggctttaaaagtgccaagagatcactccgtatggaatgtactaagctagtatgacgggcagatcctcgaaaaacaatttgacaacaaagccgagcgcctacctttgataattgggttagtggatttcgagatgaatgctccacctaattacaaacagaagttcgcgctgtctataggcaaataggattttttagtactgattatagctgtgactttggggccatcctatggtaagtggtacttctttttcaaacaccaagttcaggaccagagcccaaacacgttctcctgtgggatggacataaacaactgaccttttgcaccacaaaaaatattagatgatggcgctagtagcttccatatttacccctaacagccggccttatagggtaataaatattaatgaaatgaaaacagagacggccacttatctgtatgaaaggtatatcatattctggaagataatttataaggaccagactacgttctgtgttatcagggtacaataccttac

SEQ ID NO: 6726 - DNA, 1313 bp, Homo sapiens
  misc_feature (1)...(1313): n = A,T,C or G
cactcgtcgatgtgcgcacttcgccttgatgcgcgcctatactgcngacgtgccgcgagcgggagcgtattcgatcgacgtacagcgnactacggtcgntacgtcgcactctcgtgcgccatacntcaggagacagcgcacgcgtcatactccgccaaggacgatcgctcggacgtctatgctacacgtgtcatcncctcgatacgcgctncagcgcggcgagcctacttctcagtacttccgtccttctaactctcatgtagcctactcgacgcacagacctgcgcgatncgtccgcaccctccttgtttatctcgccgccgtctcactatttcacgcgttacggtgcatagccggcaccaccgaggcgctctctgtcgctatcagtagcatactctcgcactccgtggcgccgttactccctggtcttctccgccatccgcccaccgtgtcctctcgtcataatcatatatccgcatatacttgctgtcgttgcctcaactcgcgccatcaccccgccgaccacacacgttcgctctacatcatccacatncccgccatgctgcgtgttgtgcgcccagtacatcagccccgcatcgcgccttcattctgtaatcagtaaggcgcggagctggccaaaatatatcgaccacgccctgcaatagcactcggcccgactatattcacacatagatagttttgtcaaaccaaaacgggagggtagtgccaacctgactccagctccaccagcatcgcgtccacacatatgtctcacatttaacgataaagcgcgcgatacacactcccctcctccctccacaaaagcggcaggacacgccgcgcaacatcgcgctagtaccaccatacgtcctccttttgttgtatagataaagcacccctagggaggtatgcaaggtcccgcccccccctgtttntatacaataaagagatttatgttcatggaaggggcccatgccaaacagaaatccgcaccccctcttgggcacacacccacgacatgtttcttacccctctccaactgtatgtgcattatcatgagtttttctccgtcgccaactctgattgctatgtcccgagagacatagtcatacatgtaagtatttgaaataagattctcgtcgccccactcaaccccccctcttgtggagtaattggngtctttgaacgctattcagcntgccnncgttcctcccttggtgtgggtgcgccccccacgcaatagaagagccgtacccgcagccagntttttttttctttctccaccctccttccgttgtctctgccgtcgtgcg

SEQ ID NO: 6727 - DNA, 1091 bp, Homo sapiens
  misc_feature (1)...(1091): n = A,T,C or G
cgcgccgcgcgggtggtgcgctgcgagtgcggctngggccgcggctagcgccgtgtggtgcgcggtgcgacnggggcttcgtgtgcgctgcgcgcgcgtggacctgtgcgcgccggcccgtttcgcgccgcgatgcgcgggtgcgcgcggctatcgcgcggccggtgcgtgctcgagcgcgcgcggcgtgtcgtcttggtcgtgcggtggttcctcccgtctgcgcgcggtgcgtcgtggtcggcggggtagtgcggcgcacgtcttgtctcctccctccggtgggcggcccgcgtctctgctgcgcgtcgtgcgtcgccttggtgcgcgcgtagtgcgtctctcgcgtttgttgtctggtcctttgacggctgtgtgtattgcttggtgtctgttcgggtgtggcttgttgtgcgccgttgcgctggttcgtggtttccgtctgttgcgttgggcgcggcctgcgctcctctcggggcgtcgcctcgctcgtcgttttcggtgtcgctgcgttctgcttngtctggggtctcttgcgtgttcgctgccgcgcgcgtggcgctgtagtgctcgtgcggtgtgttctgtgtggtttcgttggcgggggttattttgggtggcgngggtgtggttgttgcggcggttttgtctcgtggctgttttgtgcgcggtgctggcggcgggccgtgtcggtcgtgngtgctcgtgtgtgcgtttcttcgttctctncctccggttgcgcggctctgggtcttggcgctcgtgcgcgttcttggtcttgctgcttttgtcgtttgtagctggttcgtgtctcggtgggtgctggtttggtctctcggccgggggggccttccgccgggttttcccctgccctgctgttgcttcgtggtgtttcgggcgccctctgtctcgccggggggtttccttgccgtggggcccccgtgcttgtggccttctgggggttggggtcttgtgcttttgctgcccgtcctcctcgcgtggttggcgcccgagcnctcgtctgcggtttccgctccaaggttttcttgtgtctcttttttgcgtttgtcgtctccggcgcggtggcgtgc

SEQ ID NO: 6728 - DNA, 989 bp, Homo sapiens
gtgcgtgggtgtgtcgggctctgtcttgttgtggttgtttcttgttgccttcgtttcctcttgctctgctcttgttcgctcgtcctgtttttcccgtgcttccccctcctctgtttgttccgcgtctcgcttcgccggctctcgcccgctgtcggttcctccgttcagtgcgcggtcggtcgttgtgcgcgcggtggttggctcggtgggttcgctcgcgggttctgctcgctgtggtggctgtgcgcgcgcttgtgtgtcgtgttctctgtctttcggtgcgcgctctggtgtcttggcgtttgctctgcgcgggcggttgtgtgcgttggtgtgttgtgttgtggtcggctgttgtgttgctattctttcctttggtgcgtttgggcgtctttcgctcgctggcctgttttcgtgttgcctgctgcgtcttccttttgcgttcccctgcttgtgcgcgtctgtgtggtggtgcttgtgttgctgctcttggctgggggtttgtggtgctggtttgtcggggtgtggggggttggtggttgcgtcgtattgcggggggggtgctcttgtggtggagggtgggggggcttcggtgtcggtccctggcgtggtcgtgttttcgttttttcgtgcgggtgggcgccttctgtgttggggtgtgttttacgcgtgtctctatgatgatttgtgctgttggctggtgtgttggtcgcctccccttgttccggtctggtgtccgtctggtctctcccccttctctctgttgttgttctgccgtccgcgcctgggggtcttgctctgctctcgcgtgggtggcgtcgtctgtgtgccggtcctccgtgtgtgcggcttcttgttcggcttattccgcgggtctcttttctccgctcgcctttgtcttccctttttgtcccgggaaacggtggtccctgttgccgcccgaggttttcttctctttttttgcttggtgtgcccgtggtccggtgccc

SEQ ID NO: 6729 - DNA, 235 bp, Homo sapiens
  misc_feature (1)...(235): n = A,T,C or G
cgggaagggaagcatagctggagaacactctcttaattgtcncccgctacaaactagaggcacagaccagagaaaagagctttggcaaccagaaaagccccttgactcactgcggccatgtgaccctggacaagtgaattcatttctgagtctcatttcttcatctgtaaatagcacagagatgaaatcatgaatgttaacacctggcacatactttttgattaataaatggcga

SEQ ID NO: 6730 - DNA, 1413 bp, Homo sapiens
  misc_feature (1)...(1413): n = A,T,C or G
cacacacttgtctacgcacacgactagctcagtctgcanttgcgntgncnantgacgcgatatgtgatagtttcagcaagactctgtgntatgtattatntacgcgcgagcntgtgcntcatcgacgtgtaacgcttcactacgtcagcgtntncatagcatcccaggctctgcganggcatgtcgagactcacncacgaacgactgtgctgcagtggatatgcaggacgcgtctgaagcactagtagcatcggtagcgagtagtcgtgatcgcgccgngttatcagtgcgggaccatcgngtgccnattgacgtttcnactcgcctangtgcagcttacttatatcatggtatgctagntaccacagnatcagagtccgtcacagctctgcttctactntatgcngcgataatgatctacnttctccatcnttatcgcgacgcgtatcgtcacgtcgtgctagcactcgnatatgatcanctcaacacataatatagttgtcggacgtacattgcttgatcttctcttatatataattggcgcatgcctctcgtctctcttcgatctacanagtcttttcattcccatganctacgaccgccacatctcgccagctgcatgctctatactatcntgtctatgtctcagtatgttatctgctcgtctctnatcattnttctcagcatatatctctgcctcgtactatctacacttctanatcttgaattactcgtagcataatctgtattctctacntccatctgtgcacgtntcntgcttgctctgacttgccgtggtgttatcatcttgttagctcctctatatcgtctgttctcccgggcgtgcagcgtggctgtccctaatcgagctctggcttggtcgtacttattagcgcagttagcgtacatgcatcgtacgtgctctcctgtggtattcgcgtgcggtggggcagcatcgtcagtgtcgtggcgtggtctatgtgcggactatcacttctctgtgctgacttctactcctaactgattgatactttggctaggcgggcgctccggacacgtattcagcgtgttgttcctttgtcctgatttaagttcacgagcccctgtctatatgagaaaacagcctcttttaactcgacgagttattgcggtgtccttgtgtctattttttgatccatggtgctgtcgcagtttgtttttctgcccgcatcggcgccgaggccagtttgtaggctcaggcgtgtactatgctattgggtgtcatgtagtttcgtgtcgatttttcggcgacctccccccagtaaaagtattcgcctttgcggcaacaacacgtcggagccgtttaacacagtaagatttagccccgagtcgcgccgaaagtttttcttttctgtcgtgcgtggcgcatcacac

SEQ ID NO: 6731 - DNA, 1194 bp, Homo sapiens
  misc_feature (1)...(1194): n = A,T,C or G
ggggtgtgcgggtgcgcgcgctcctgcctgtggtgtgccagtccgtgcgctcgtttgctcgcggtgcggttggccctcgcggcgtgcgtgtctctctgcctcgtgctcttctgttggtttcgtctcncgcgctgcttgtctgtctcgcgctcctgccgctgttctctgtccgctttctcggttgatgcgggggtccggcggcttcgctcgtttgccatcggcggtgctggtggcctcgtgcgctgcccggccccgctcgtgcgtcgtcgctctcgctgcggcgtgggggcgtcagcttcatggcgtcctgctccgcggggtcggcgtctatgtgtgttttgtgtctggttgctgtctcctggctgttgtcggtcggctttgctcgtgttcgtcgccgttgcgggctcctgtcctgggctcgccgccccctccgtgtcttgtcgctgcgcgtcgtctcttctggcccttgttggtttggttcctcggggcctgtgggtggttttggcgagcttgtttgcttctgggtgtgttctcttcccgttcgtgttgtgtggcggtcgggtgcgtggggtgtgtacggggcttgcgtcgtcgggggttgtcttcttgggcgcgttgttggggtgtggggttcggcgtctcggtttggtgtggcgcgcccgggcgttgtcctctgcgcgcctntgtggctgttgtgctcctggcggtcgtggctgctgcttcctgctcgcgcgcgtcctgtgttctaccgcgctcgnctctgttgtgaagttgggggtcgcttgtctctcgcttctttgtcgtctctntttggtncgcccccgcgcggtgttttcccggcgctgcgctctgctgctgcttcttctcttcttcttctttcggtcctggtgtttgctnttgcttgcggtcctgcttctgttcccgggtgctgcgctcgtttccgtctccttctgttttcncttcgctcctttgtgtggttttggtgctctctctctcgctgggtcctctcttttccttctgtcctcgcgcctcgccgcgttcttnccgtgttcgcgttcccggctcggcgtccggtcgggctgtcgtctgcgcgtgttgtagcatctgtctgtttcttgttttctcctgagtcaggcgttttgctgttgtgtcttcgctggcctcttcgtcttgcgggcttgcggtgtttgcgcc

SEQ ID NO: 6732 - DNA, 211 bp, Homo sapiens
ggtccatggtcaggaggcagtatgcgaagctgaggggctgcagatgctggcttggtgtgaccacgcagaagggccaaaccaatgtatatctaaatgtactgactgatgtctacctgtaatttcataaaatcaagctgcaacccaaccacctggggcacatgttctcaggacctcctgaggctgtgtcatgggtcatggtcctcacattcga

SEQ ID NO: 6733 - DNA, 205 bp, Homo sapiens
gaaagtgcttacctcaactgccaatttacggaggatctctggaagagtgtgaaaggattatgagcaggagaatgacatatttggactatgtcccagagagacaacactgatgataatgaataaacaccagaacactgtttagaaggcaactataacatctcatattagtgacgactgacatctgaaccatggagaagattttcta

SEQ ID NO: 6734 - DNA, 243 bp, Homo sapiens
cacactctcacatactcacgtgcgcacacacacacacagagttcatgtctcaattgtgactgtaaccctacttgagaagattgtataaataatttaatccagccaactgagagaaatactgagggagtaattttattctggattggctttcaattcttttttgtattaagatgtacgtgtctgcaggattattttaatctagcctatttcctttttgttcttctttttcagaataaaaacaga

SEQ ID NO: 6735 - DNA, 186 bp, Homo sapiens
tctaagttatcaccgctaccagatctccgctctatgcaaattgagtgtgagaaatatttggaaacgaaataggtgttcagcttaagaggaatggtactcaaggtgctacatttaaagaactacacctgaggaacttcatccagatctcaacactcaggatttcaactaaataaagtgagatgctgt

SEQ ID NO: 6736 - DNA, 205 bp, Homo sapiens
ctgataaattgaccccagtgctcatctattaattcaaacatcagcgctgcctgacacaggggaaaatgagaaatgcggccattgatatacagagaacggcaatgtggctaaactgaagaggctacttccaacatggctcatttcaaattctcacttgttcttctaaaacaaaatattaatgaatctgctgaataaagcccgatgc

SEQ ID NO: 6737 - DNA, 312 bp, Homo sapiens
caagggtctgctgcttcactcctgaagtcagctagaccatgaaactctggacacaccatctttaagaactgtaacactcactgggaggagccacagcttcattcttgaagtcagcaagaccaagcaattccagatacaatgtcatactacttttcaacaaacattgtgctacaatacaatgcatttaaaatatttggactttttcaaaactaacattttctttaaaatatatgttgcttttctctgttatttatgggttatttagccaacaatttgtgattgaagctgtgtgtccaatttaataaagacgga

SEQ ID NO: 6738 - DNA, 141 bp, Homo sapiens
aaacctgaagttatcctgagaacaaacgtcactgccatggatcccgatggtgcactggttttctttcctgtctgaccaacaagcctctggagagtggccaccatcttacaggctcactgttgtttggaaaataaacagcga

SEQ ID NO: 6739 - DNA, 202 bp, Homo sapiens
aagaaaaagtatatgcagagcttatgatgattcataatcattttttaaatggcacattaaaatgtatttggcagttggggaaacttgatcaacaactggttatttgatgaaatttacttaggtgtaaaatagaatgtagttatgttttgaaaaactatcttttagaaattcatactgaaataaatacaaatgaaattataaa

SEQ ID NO: 6740 - DNA, 147 bp, Homo sapiens
atgtgttcagagtggatgcgcagggaatccttcttatgctgagaactgaaaacgtgtgcccacacaaacactcctatggagcgctcacagcagcattattcatgagagctgaaaggtgctaacaaaaggtgaatgaataaaacagga

SEQ ID NO: 6741 - DNA, 184 bp, Homo sapiens
gcatgctgcaacgactctcttaatctccaccgctacacgatgtgttcagaatggatgcgcaatgaatccttcttaagtgagaactgaaaacgtgtgtccacacaaacactcctatgagcgttcacagcagcattattcatgagagctgaaaggtgcaaacaaaaggtgaatgaataaaacagga

SEQ ID NO: 6742 - DNA, 171 bp, Homo sapiens
taagcaagttaactgaaatggagaatcactacccaggatggaaacctacagtctctgaaaacgatatgtgtctacatgagcaacaaagcttggaagtttggcttgatccagcagtctataatatctgtctttgagtgttttttgacatttattattaacaatatatgcaga

SEQ ID NO: 6743 - DNA, 204 bp, Homo sapiens
  misc_feature (1)...(204): n = A,T,C or G
ctagctgcaagactctcttaanatccaccgctacagactatccctgtccctctggcgaccccgcttgtgcctgctcctcccggcaccacattctaatcacttgcgattagatcggcactcaggcctctggacacccgagcatgacttctgggacaacaacctttaaaaatgtgaaccatgattcaggtggtgaataattgcaga

SEQ ID NO: 6744 - DNA, 1059 bp, Homo sapiens
  misc_feature (1)...(1059): n = A,T,C or G
ctccatcatctatgtatgtagccatgagggacaacacactgcggggcactgagcttccctgtgatgtcagctgtgagatggtgtggggagcctgctcagtttgcaatatacagcattctacgactataaccgtaagttgggtccatcgtggctctctgactgtgaaggagaagggatcatagtacagtgacagacaggttagatgtatgtggtatcttgcatccacctgggcatttctttacacaccatactacagcctattgtcactcgacttgtcgaaatacgacatcgcgaatcgcggtaaacctaggtacacaaagttgtgtgtacattcagtacagagaagactaacttagaggtatacacataaacatatgtatgccgtatggatattgctactcttataataaggttggtgattaatacgtatgagatatctctcgtttgaactacgcatagcggtcaacgtaccggtattgatagaaaaatcgagagtggtgaaagtatattgacgcgcgatggagatgattgacggtcatggagaataaaatataaatataatgcgctgagatccgcagttcatatatcaaccgctattctcgcatagtgccaacacacgttcacgattctgcagaaagtaaatatagctatgtataatcatagtgattattggacacctgtacctctcaagatgcgcatcttcggtgtattcatatttcatcaatctctcacagccacccaacttccccgctcgtagaataagcacagatgttgaatctcacaacagcacgccctcatcgtcgtggcacgtgttattaaatttctcccgtggctacttagactcctgatgttcatatataatcctactctgggtcgcttaccggtgcgcgcattcaattcgcactctactaactatcgttgactccgttgttgtaagatgttttactgagggcccgcccctcaattgataaaagtaaataggtactatcatgtgcacgtacagactgttctccacccntaccttctagcttcagtccccgtcgacccctatctcactcc

SEQ ID NO: 6745 - DNA, 810 bp, Homo sapiens
  misc_feature (1)...(810): n = A,T,C or G
ccacgagaaggggcttttaaaataatatttccacccccccacaaaaaaacaataactcccccttttaaccaattttcctaacatacaactacctttccatttaaaaaaaataattttttaaaacacccccccccccccccctaataaaaaaattttttttacggggggggagcaccttcctcccccaaacaaaacataaaacccccctcttctnnntttttcctcaaccccccatcantttcccttnatataacaaacatccatctctcccaacttcctccccacccctctcttccaaaccacttcacaatacccccccacaataaaactaaaaaccacccccttaccaaaaaaaaacatcaattttatcntccactcattttatcttaccttttatattatatataattattcttttttttttttttccctcttatacttaactactcccacccccctcctctcctcatcaaccacctaaccccaacccctccccaccacaccccatccccctcacccttcatctcattctccccctcccatcctccataccccacctcctatcaaattctcaccatcacacccatacatatactccccccccccccactctaactttattcacccatacacactccttctccctaataaacatacctaacaactctataaactatcctccctcatcaccctcatttattttctcacttccactttttccactctccccatcaccacaacatctattatccccacatactactaaactccactaccaataaaattccaccctctctcttattcattccc

SEQ ID NO: 6746 - DNA, 801 bp, Homo sapiens
atatccctcccctctcatgtagccgcagccccatgttggatctagcgcgctgataaacatctaattttttttattttttttactcaactccgcgactctccgggtcttttactcatcgttaatatacgtctaataaagacctttataagcgctccacagaaggcgacataggttcttgatcccccccgcgaagatacgtgatataataacgcgcccatgcgtgtgtttccttttatcaattaaaatgaaaaacaagtcaagggggggaaaacactcaggtttttgaacttaagctgcgagtgccttttttaattttcccccgcttcgagttccttttagggtatgggtatctcagcagtttggtttcagtgcccgcagcttgggaagcagacttctcccaatatcaaagggaaccaagtccccctttttttctccaggcctcggtctgcagcatctgtgatgcatcagactgcaattgagccatccaaggatacaatcatagcaatcaaaaagagtgactggaggaagaaggcaatgaacatagaagaggaaaaaaaagaaatcttgattttccctcatgctatagaagggaatggtgctgttatatttttggcctatccagaaaaccaattatgaaaataaacataaatggttttctgcctcatggtttagaagcacctctgcgtgtttgctcactgaattgttgtgatgttttgctctccaatgatttggaagccaaacaaataaagcaagagtcggccgaactcttctcctctttggtttccctgcacgttagagaca

SEQ ID NO: 6747 - DNA, 1099 bp, Homo sapiens
  misc_feature (1)...(1099): n = A,T,C or G
aagaagggnannnnaaaagagnaaaagannnnaaaaggaaaagggnaaaaggaaaaaacgcaaaagganttnnaaagaagggagaagggnngaggagtttgaggagggaaacacggcacgcccacatctttagacgcggcgagaacccagaaaacgcagaccagggcacganaaggcgcagacctttagaaagaccagagacgcacagcaagagcatagacacacacaacccgccgaacggacgccacgcgcacccacacacaacaagcgggnagaagcagaagcgcgaaggacggggaaaaggcnangtgcaggcagggacgggcgagagagcagtncgaggaacgggggagaggaagnaaagaggaaagaaggagaaggcgagggtncncgaggtcaggccgagccgaagaagggnagaggaggagtgagagggctaaaaagcnagagcacagcnccacgacacaggaaagcccagagaaagtagggaccacggagcacgcggggaagagggcacggcaacggagagaccaccgaggtcagacacaccggcccccccgcgaggaaccggnagggagaggcgcgggcgaagggcgacaagggccgcgccgacgnccccgccccccaagctcaaccactaacagacccnaccagcgaccaacgaacacaacgccggccccaacgcccccagannccccgcggccgcaggaccgcgggcacagcnncacggccggcgacgggccgaaagcgcaacccgcgggcagcgacaaggcggagagggcacggaaccacccgcgaaggntcaggacagcgggccgcgcccggcccgcgacgacccgctnccagagcaccccaaaagggagggcgaaaagcaagcggcccacacaaccaccaggcaggcgcgccccaagggcggagaggagaacagancgcaaagacgggagncagagagggccaagagggaggataagaagccccgcgaccaaacgccacgcagaggccccgcagcaggccagccagggtgcggacagagnacgaaaaaggagcgggcaaagaagnnacccaacacaggcccagcgcccgccaccaacaccaaaag

SEQ ID NO: 6748 - DNA, 743 bp, Homo sapiens
  misc_feature (1)...(743): n = A,T,C or G
ccaatagtccacgccaagggcccgccccggctacacgccaccccgtcggggtcccaccaaaaatttgacttttagcgcaggcctcccttcataccccccgccccccattcccatcccttcagacgcaccggtgactccccgccaccccagtttacccgccggggccccctcaccccgggaattttgagcctaagccccccccgacccaggtaagcccctcatcccccttcgcctaatccacctgaagatggcgaggatcaggccccttaatccatgacccaccttctactcaataaataagctctgatggtattgatccagacaggagatggaacttctggggagaagagggcagttcccgccaaaggctccaccctcaagcctgaagacctgtggccgtaaatgaggactggcattcttgttttcatgccagaaagttgccctttggtccaccatgccccctttcctgcatccatataacccccaacgcctaagctccagaagcagaccaccacgccacccgaccagcagatggacagcagaacaatgaggcagagaaagggagaagagggggaccatctgcacactgagaggatttcagctaggggtggtcagagaggaatccggccgttgggcagcccaactccaggagagggtcccccccccctctcatccacccattttggctccccgtccatcatgntgaaagccacctccaccattcaataaaagccgatctggcg

SEQ ID NO: 6749 - DNA, 799 bp, Homo sapiens
ggtgactgagaggttttaaagggaggagaagaagtcgtgggtaattccctttttcttggagaaaagagacaaaatgcttaatttttggggggggggcaaataaacagggatgtcgcacgcggggtggggtgtaattatactagtcttcgagcctgcgaggccgtgaaggaggttggtaaaatattcccttctcgcgtcaatcaatcgggagatagtggaatatttgtgtggtgttgtgtcttgacatatacaatccgtagttaaggtttggattaggccatgtgtagtttgtcgaggtcaaaggtgaggcggagacagtggagtgggcaagtgggtgaggtctaagacttaggaaataagagactaaatcgggcagtactaatgagggcgctgtgagggaggatgtccggggatctgttaaggtttgttcgcagataacaacgagaaaggggaggggatgaaacaatgggaggcgaagatgagtctagagaaaaagatgagaagacggcggtagagcgaaagagcaaatcaagtaggggtggtgtgggacggcgtgactatggggggaggggagcgcgggaagtgatagtgattgaggtggtgaagtaggttgtaaggtgaaatagtagagagcgggaggaggggttaatagcgggatagtgcgctggtggcacagatatgttacgtgctggtcggacgtaacgatatgtgggccaggtgagaagacgcgagttgttatgcgagtaacgttgcgtagggtgggcgcggggtgtttggagggcgtgacgcgggtttgggg

SEQ ID NO: 6750 - DNA, 1151 bp, Homo sapiens
cgactttgcgacgcttctgtgtgctgaaacgggaccgaggggtatttgggtgcgcacgtgccccccctacaattgtctgaggtgatcacctggcctcattttggccgttgtaggccttccagaatttttatattctttgggcaaagcgcagggtcgcctccattatgtttctacgggacggtgtgatgtatgcggtttatgtcgttaagtgtactatgccagtatataaattagatgagcgggtgtattacggacggatcgataggtgtgtgagcgagtgattcccgtgctttaaattctgcttgggtctgctcgtgtgtccgagattatagccataaagtgatggatcttgatgttagtgctctgatatcgatgtttgaagtgggtggtttcctcgctctctttcatcttgggcgttactgcgtcgtcgtatattgactaaactgtattaggcgtgtgttcagtgctgcaattccaatacgagagtgtaacgtacttcctagtctgatgtatgtgagttgtcgagttgctattccttcatcatccgtgattccgaggtattcactagtgatctatatttcatatctaaggtcctatttagtacttgcttcgcattgtctggtgcggccacgagtagggagggtcgtgtgcgctcgtttatatacaggctgatatacttatcgtccgcgtacaacggcgaatgggtgcttgcagcttcttgaatttctattattgttacttcctcaataactggagcccgggttggcacagtatatttagatatatagtagcatgtttataaatcgtgcgtggttagatatcaaccgtggttattcttattgtagcgtctgggttgtatgatcgtgatccattcgttagtgactgggtatatgttgtgtcgtccgccacgcaccattcctggaatgaaacgtatgttgatgtatagttggttctcctctgtcgggcgttttatatgagattcagatttgctgaaggagattaatgtcgggctagagatattatggttgagaagagagctacgcgtcagtgttgtatacgaggtcggatgtatcgagccgtcttctcggtacgggacttaatgatgcgtcacgcgcaatgattcgttgttggtggtctgcactcgtgtgcgg

SEQ ID NO: 6751 - DNA, 1835 bp, Homo sapiens
  misc_feature (1)...(1835): n = A,T,C or G
gtgaaaagagaggagnacaagtggcaagagaaagaagggngggngangggccctagtcgtgcngacggactgctgcttnaatgcttcncgacgcgcgtacaagcgncatngnacntagnaagacaatttacaggtagagagtctagacgaaagtattgtttttagtcgcagaggtggagactgtgtcacatatggcagtagcacaactgcagcaantcgcgacgcaatgtatgctgtagagatatgaaatctacgtatatagatgtntatatagtacttatacagctgccacntagtgagtacagantgatcatcataatgtcgcagtacgtcgcgccagctagtggagtacatataanancntataagagactgtagagnagtacaccacctgtgctcgaatagcgcagacagcaagcctctgcaccaatatctttctgtgtcttgtggagngtgatgtgtgacgatcgaantaccgctggatggcgtagaagcctaggagcgtcacgtacattagccgcgtctctagatcacacgtgacactacgcgtgtgatcagttgagcacacattgcgtggagcgagctacnacggcataaaaaacgtgacgaaatataaggtacttggtnatgatnagttcggagtgagtgagtnangctatgnagagtatacttgcataactgtgatgatatntagagacagaacatactcgtggagcggcgcgacgacacagcagctgctantgctgantcgtgngttgacctcggtatgnctgatgaggttacgtgatcgangtcgtgtcagtgttacactncgtacggtctgatgatggtagttgagacgttaacgncgacgagcgcatcctatacntnctacngncgatcgcagtcgatagctcggacgcgagantantggactngcagagacngncgngatctatcantgcagctagnacgccgtgcccgatacgagtcgtagcgatatcatcgcaggganagatcagtgttgagggatgtatcgagcagctagcgttgtagcgntnctactgtgtgctatactgtantagcnggtgatantagcnaantgnatcagattgatcaggntntgagatagttagtggtatagatngacactntgacgacanngctgatacgcagcgcgcgatataagcgcgtgactagtacgtgtcatgtgtgctnctatgagcgtcngtccgtcngtntcggatgntagtnatgatatcattatantctcctattgtgatcaanaggatcgatgagagngaatgtgatgtagcagatatgacagaactcantgtantgcaagagaggttagtggganancntctagtgcgagaggcacacagtgacacagcgtgacgtctcatagatgacttngcacatnacagtangtgtctgtcagattgtactcttagagtatctgntgggcanctacgcagcagcaggagagcgagtgtacagagnatgtggatgcnagcgagcgtgctggcanntcgacgangctgatgtgacagagagtcgtgttantgatgatatntgactagtattgaaactgtaggtcntgagtananacgatattggaagtnctatantacacgnancgntgatatgtanctactgagcgtgtatgtagaagcatcntgacatgtngatactgtgagagctctgtaacangtagcatagtgnagtgangagtgtggtgtgatgatgggaaggangcacgtcatanagatcattacagaggngcatagacatgagcgacaggaatcgcngacgagacgcatcantgctgagtcatgagtcgcngtgatgtgagg

SEQ ID NO: 6752 - DNA, 2057 bp, Homo sapiens
  misc_feature (1)...(2057): n = A,T,C or G
cgcttgtcgtacgtgtatgtcgaccagttgactcgatactgatgcgagagctgcgcgacacagacagaaacagagaggctttcgttttgtnttgtacgtgaacctaagagcgagcgagagcgnagcancggcctttaganagccgngcgcgcagagagcgtgctnaccgcacnacnacnactcgantcgnncacacacnctccagtcacangcagtacgtacannagcggtagtcgtgttctagcgacgtatgtagactcatctcagtcacatcattangagtgctgcacatgcnagcnatgagantgtcagctcaataagtcatgtagatgnaccatacgcaacaagattactacngttactgtccatctcngcgcagctgcgcgatccacgatgacgcatacgtnctctgcatactagacggntgcagtgnantcgtgnntctgtnctntcntgntgcatcagnngagtatgtagtgcatnctagatcntgtagatcctctngcgcntcagtcgtccgacctagcatangtctgcngtggtcanatcaatcanctcangacaccacacgtatatagtacgatcagaccacacaagaacactgtgagctgtgtgttnagctgncaccaccgnagtntgcanctgcaacaaccatcaactacactgacacnccgaacctagctacataattagactataacactntactatacctntantgcgatgagtgtncaacttgncntcatcacacacacgacgtntagtattgtnnacatntacactatcagtgantgtcangngcagtgtatagtagtgtgactantcgnagtcagcactcntcgcgngcacaanctactctccgctcgcatatctggntcgcatcactacgccatcngntttngtctcgcactntnttatgtagtgcagcatgctcgtgcgcgagcgctgcatcgtgcatcgtgctgatcgtgantctgcatngtactgtcgtgtcatntgctcgtctcntctctgtncgcgatgctacnctgtctcgtcactactctcgcncctactctcactatctctctactctccctatgctgtgtcgccgcgcgtacgntagtccgactagctatangtctgatcctgccagcagtaagtaatcatcgtacgatgcccgctatccgacgcgcgtnactcgaagctcactggcagccactacnacncntggtcctatngctcacacgaagtnctcacacctcgggtacggcacagtgcgntgttgcatgtgcatntgctcgtantgatantatattcatcaagtactagannaganagatgcgttatgatttatactcggtactggctagtattatatcatagacgtcgtacgncnatcagatcacacacgtctangtgtatgtgntctgatattagtcgtcctatgtttagtctatgcacagcatcgctgctacgctcgccgccanctacangtcgaccactaatgcgttggctgaggagctatacnagctcacacatcaaccgcgcctcagctgtactgcgtgcgctaacgntatgtgtacagtcatcatagatagtactcagtantcnagctagttnngncncgatntancgcantnctctcgcttttntntcgggctgntctggcntcngtctcttgcttccgtntnnttcccccntcntgtccgtgttgnntcgtgtgatcnattcnagctanangtgcgcggtgtttaactagttngttcagngacatagncattgcanacgacatcatnagagtangtantaccgcgtcgtcntncacgcgncngcacccnntactcatactgcagtantacgcgttatacaagcangtnatcattcgtncntcatanacacnatctcgcgngtctcgnacgatgtgtcgactacgctgactgtttgngtactagtcatagcgngngnagtgagcgangttgcgngcangttgacatctatcanatagtgacgactcacgatcacntatcatcgtgcataatncttactgaactctnctcagatcgcgctctctgcng

SEQ ID NO: 6753 - DNA, 2108 bp, Homo sapiens
  misc_feature (1)...(2108): n = A,T,C or G
agcgctacgatgctccagcagtgagngcagtcagcagacgaagcagactctcatcgcatacgactganaatctgatcatatcatcatcacgtgctcgtagangcgattcagccngtctgtnactctgcagctatagcgnagtactatncngactgtgncgtcatgagagtctatcanacactactgctagcatngcnacactggtgccaacagcgcacngntctcatcgtacgtgatgangncactgatgatgtctnagccatcatatntnangtaatctatccagtattactagcatacctnctaatcngntgatcatgctctcgtagcatctcgtcnacgatcncgtnacctgtagatttgctgtcgcgtatnctgagacgctgctnatcagtggcaggcatgacgtgagtacgtntgncangtcgtgtgnctgtgagtagtgagagatncancgnccncttgcagcgcacnctgaacgcgattgacacagttttngcggntaaacagaacncanctnagacacnaaagcnacgctaantgctatatcngatcagtatagtgncgaccacatacagacncaacactagtgaancgacagatgaantcnattatacatagtcntnctgcgacgacaagtantcgtatccactatcagtanatagatctgctgagcgcagttgctgtcatgntgcagtgattcncgagcacatcntcncatgtgtctgcagatacatgttcatntgngtnctctgcatcnctgtgagctgccacngagctgtacgctacgcngcactcagcacgcatctgctgtaccagtctagcntcgcacaanatctacgctatcatcnctgagtcgtgctatgatncactcgcacaccgagncgtcancattantcatacngtcagcaaccagcacngcatgacggcgtacatccgcgacgcgctacntcgtgcatacctgactatatagcanaactntcagtgtgtagctcagancaacgcagcgaccagcgacagcagtgcacaatngtgaatntaatctgntgtgcgncgaagtgacgacatacgatgngngancgntgtcgtgtacacaccgcgcaaactcntcgcatgacntatgtgagtgacatacatgcgtcgtcatcacgacacgtagcgtatgcgagncatgatcactctacaaatatgaccatacataaagacggaatatcagcgagatggcgaacgtngttgactgatccaacatcgactanctgcactatacatgctacatagatcgcgcgnacacagagctcatgctagtcacacantcacacctgtgcatcagcgttcgngangtggcgnacgacagaatanataaaccgaagcgcgttgatgcagtgtcaacatgagacgaatcgacacacagccgcacgtgacactgtcactagcgagtggtataaacacatatgtacactacatacaccatctccaanacangcagcgaacgcagactgccgtngacgatgtgcgcgtgagtatcacacgacagagnagtatagacggcagcgtgtagaggtatgtgtacaganccagacanatgggaacacgatagtaatcgcatactggtgtgtctacatctggnacaccgntcggtgatattganacacatactgtgagttgtacgtgcacacacattactatcatgtatatcatcacggagcatntagtacantctcaangctatacctgcgtagcgcatcacacangntgtgggcacaccatcctagagtagtaacgtactctgtggtcggacacattgatcacacagaatacgtgtctcatcgcagtgctagactngatagcagctgcgcgcgtgcatcgacaataacacatcatctgacgccgagactgagtgccagcacgtgttccataagagatatcatcatcataactcgacccgctactaacacatcatcaacgcgncagacncgncacagcgatacgcgcacacactatgacatcacttggtgttngtcgattagagagcnccatcactcgtgcggctagtatatanagcactacatacaatcatgcagtgntgttgcaactcactacatcaacac

SEQ ID NO: 6754 - DNA, 1002 bp, Homo sapiens
attgctgcactgacttctcttaatcatccacctcttacagcgcatctacctctaatgagtgtaagaaatcaagtaagaaaacatctgtaggcacgaaagaggcacgcgcatcttgtaattacaaacttcaatctctgacaattacttcatatcacgcgtcttaccctacctctacagagaggctttgctgagtaatagtaatgtcttttcatctccctaactcttactactctctttttgtccctctttttattttttccaatctacccgactttcgcatatgtgcatagttactcttattttactcttgtcttgctgttcgtatcaccctcctttcatactttattctttatgatgcttagcgccactcttccctctctattgccatgattcttttcccccatcatcttctttttttatctctttcttttttctttttcccgtcatctcctagttacatttcctcatcttatgtactttattaatacctcttccttttcgtcattttacatatcctctctgatcaattcctccccttgatttcgcctatttcgctgttccgcttattactaactattccacagtgtacttctctcgctcgttatcccttctcttattttttcttttttacatccatactcatcattcctcacactgcctgttctcttctttttctctcatttccctatttacatttccctcctcctctatccaccactccctctttatttttcccgccagtttattcttccccatctcattatttatcttttcccctccccgctctttctcccctttgcttccttcgttttcttccgtcctcctctctttcctgtttttacccgttcctgattgtttgtcttctcgtttctatttttctccgtcttatccctctttcccacgcttctgccgctttcttttccctcttttttttgattcctctccctccgtctctctctctcgtttctactctactcctcccccgcgctatctacattccgg

SEQ ID NO: 6755 - DNA, 126 bp, Homo sapiens
  misc_feature (1)...(126): n = A,T,C or G
tgtgaacaaagaaagaaaggcaagaactactgcaactgctgtgtaactttgagataaaccagtttgggaacaaacctgactctaagaaaaccaatcatagaaccaataaatcntgataggccgttt

SEQ ID NO: 6756 - DNA, 968 bp, Homo sapiens
  misc_feature (1)...(968): n = A,T,C or G
gattgtctcaaataataacagtaaacactctagcaaagatcagtctgaatcaagaatacggaggtgaaacctagactccggacaaagcaggacgacgcatccgtacgtactataaacagaagtgggagagacaggacaacacgagcaacaacggcaaaagcaaacaaacgtcgacgctctagcacgccgcggggcgatcgaggaaacggacgtcctactccggtagtancgcgagtagcacgcagatacgatagcatcagtgcacccaaaacgacaacacaaactatcacaataggtaacatcataaagagtacaaactcaatcacacaaattacataagcgaatacgaagaaaacacaatccaccgcctgaataagggcgcacgaagcacaagacgacgagaaagaaaactgtctaaatataagaaaagcacacagcgaagtgaaaataaaagagacgatgcgtcgcctgacctgatccgccgccgggcggaaaagaggtaaacaaggagaacagagttaacggcggcggaccagaggagaccggacccgaacaaccggcagaagaggagaacaaaaaaataaaaccatctacacgtctngaataaatatatttgagatatttggtccgagagcaactcggggcgggacagagaggaaactacgacagaaagcgtctaaaaggaagaaacagaaataaaacctactacgacggaaagcagcacaacatacggtggtactagcgttgttgtgggaagggaggcgaccaccgggcagccgcggacgataacgtggagtnncccccgccccggcccccccgccccttgttccccccccgcctcccgccctccttcctcccggcggcgcctttttttaattcttttttttgtttttttttaagttttttttttacacttctcatacttacacccaatcacacacacccccacacccccnatataattttag

SEQ ID NO: 6757 - DNA, 616 bp, Homo sapiens
  misc_feature (1)...(616): n = A,T,C or G
catgagggaaaaggcagagagaggatgaaggcggaataatgtaaaggtcgaacatgaaagagcgcgaccaaccgcagaaaaagccacaaaaagaagagggnggcggagcgggaggaccgggcgacaaaggcacgcggtgcgatgccaccccatccccacccgccggtgccacccccccacccccgaaagcgaanaccgacccgcgcgggggaggcgtcgtatgcaccacgaacacgatcaaggcccctatggccccgaccacagccgtacacgcgcaagaccactccnagggtaagaaccacgcggcgtanacgaaaaagagcacagtacactcaatgagaagatcagagagccagtgcaccgcagtccacgcgggttgttcggcagacccactgtatcaggcccccgcgacccacncacacgtaggccccaccctacgacgatacccacaccgcggccagccaacgggccgcagcaagacncaccgggcaaaaaagcagccacacgtcagagtgcgaccgcgggcgagcacaggaaggagaaggtagtcggagggcccgggagacgggaggggaggaggcccaccgtgagcaagtgccaacgataccagcaaaag

SEQ ID NO: 6758 - DNA, 255 bp, Homo sapiens
  misc_feature (1)...(255): n = A,T,C or G
cgacaaacaagcacgtacatactaatcacacaactactgcaactaaaagccatccaccatgcacaccaagatagggtaactgctctacgccagcccgtgcaagctaagcaccgccgcacatctagaccaccgcaccgctcactctctgcagacacgcaccttactgcgtaattcgtcgccgtctccgcacagtaatcaccgcgtccctcccgcgttaaatncattcgttgttaaacgacgggccagtgagcgcgc

SEQ ID NO: 6759 - DNA, 449 bp, Homo sapiens
  misc_feature (1)...(449): n = A,T,C or G
cgctctccacacttgccacacgctatcgcacgcacaacatcatcgtcgatcatacaccacagatgatgacagtctatccaccacaccgaagggaaaagacgatgccagtaaagcaacagcacggaagtggctaccgcctagatataccagaccgcgatatcaccacgaaattctgccggaacacccccccgccgccaccaatagtaaagaactatctgtgacacttatgcgagagtaagtaagagtatagcacgaaccgttgtacactccgaaaaaagcagtcagaacaaacatcgaccgaaaagaacgcgggcaataacgaccaacaacgggacacctagcaaatgacaccccttagttgcgtaaaaaaacaactcaagaccacatacctcataagaaagaagatacaaagcaaatgacaacactaaaaaacccanaanccncncctc

SEQ ID NO: 6760 - DNA, 720 bp, Homo sapiens
  misc_feature (1)...(720): n = A,T,C or G
aaggngnagggnggnaggagggggagtgtaggggggggacagaggagcgcggttaggtccggccccccctagtcgcggttcnccgctcatatggcctagagccgatctttgagctaagtgcggaggtatgcaggtaacgctccgcagcggcgtgtccgaccaaacctgcaataagcagcgggatctcgatctaccccagtagagtgaagactattgtgaaggaaggaggttactccagacattggagacaggcccgcaagggggaaagacaggaggggcccacgcgcaggggnaagctgagtgtccgccggtaacgaccacggaaaggtaacaacaaagccctagagtcggccgcgcccggaccacgccacaacgcacccaaagcggcaccgcgacccggggcagccacggccacgcccccgcccccccgcccccgccccgcggagccgaagtgcggacgcagtctcgcgtgagacggagcaccacaagcgcccgatccgggcgcccgaggcagcccacgccctaccggcgcccccaccaccccgcccggcgggcctcgctggcctcctgccggccgccattccagacaaacaggggagtcgagcgaccaccagcccaaaccgcccccaccccgccccagccccgaagcccaggaacaggggtcgcccgaccaggtgaggaccagatggatccagcaaggcgccccgaccaccccccaag

SEQ ID NO: 6761 - DNA, 642 bp, Homo sapiens
aattgcaaattcactgaagaaagaacagttgactctcaagaaatacaagtttgaacggcaggggtccatttacacactgactttctatgcatatgcctcccctgagacagcaagaccctcatcaccctctgcctactcaacctgaagatgacgaggatgaggacctttatatcatgatccacttctactcaataaataagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaagagggggaacatctgaacactgagaggatttcagctaggggtggtcagagaggaatccggccgctgggcagcccaactccaggagagggtcaccttcccactccatccacccattctggctccccgtccatcctgctgaaagccacctccaccaatcaataaaagccgttcggcca

SEQ ID NO: 6762 - DNA, 816 bp, Homo sapiens
  misc_feature (1)...(816): n = A,T,C or G
cccgtagggggtaacgcccctatgggattgggccggcccccctgagtcgcggatgatagctaaatgccagaagccttccggttaatttaaagcagtagggtttgcccacagtctgaattaactccagtactttcttataaccccggtacaggtttcaagatcaaaaataaagccctgcaaagtgatacttagggtcttgcccccaggcaaagatcgcaaaggtcnctgcttactcccccggctgaatttcagggttattcttagacaaaccaaggaaggagatgagcttcaaattccacagatacctcaaggcagtggtcaccaactaagccatgttgagaggatgccagtccatgctccaaatggaccccggctcaagatagcaactggaacaagacacacagaccttgtgctcagcactcctcctgcatgcctcccattgtatcttccgttttcaaagcccctcctccaagcctaaagttcgaagtcatttctggagttgtaaactggctgcttccccactgctagctttggaaatgaaaccattttccttttgctgtacttcatccttgttattggctacaagcagcaagcagccaaacttgtgctcagttacagttttgtcaggtaaataagatgaagggaaagtgtgcatacaagagagtgaccatcattgtgggccataaaatctaagctggataataaagtacgtaaggacatgaaataggtgacagacaatgaaaaggtgatgaaatcagtgaatggttgatgctaatgttgttgaatgatatttggaaataaaaaccgatctgccag

SEQ ID NO: 6763 - DNA, 1222 bp, Homo sapiens
  misc_feature (1)...(1222): n = A,T,C or G
aggaaatgagtgaaaaaatagagagagnaggggtgtgtgttatggttgggngggaggctgttgttttggggagtgtgtgtatggagggtaaattgtgagagtgtgagacccattgntttatgtntngattatggcggttatagtgatgccagttgtntggnntaatgatatagagtgaagtnggntgtcgaggttgtgagttgcggggtggtgcgggcctatagataattaatataatagtataaggggaaagagttcccaacaaagaagacagacaaacacatagatacagtgaagaaggagctgaataggaaggatatgggcggggttgtatacaccttttagggatatgtgttagtgcgcgtatatctcgaagtaattattgtttattactcagcgaaagggagggaatgggttttttcctatagtgtgttatttgactttaagtttttatgtttttttcttgtggtggggatgtgtgtgttggtnatggggnngtaaaaggtatatgaggaaaaagaaaggaaaaatatgtattttaatgataagtgggagtgcgtgaattcgaatatatagtagtagagggtgttagtgatgagaaattatgataaatgaattaatttatattaacataatctccaaactgacactatantatcatatagtggatcgggatgaatagtagtgtgatgggtgttagaggagngttgatggatgttttgttgttgtcgtgtagtcattaatcgtctctattgttcatttatgttaagcgtgcacgcccgactggagcaccgacgtacgatatatgtttatttgttatatgttatgatgaaagtattatgacgaaggtaaagaaggtgtaggaagaaatgtagtgggggagttaagtgagggttgagtataggttatggtccgtaattaattgtgtgtatgtcgttgttgtantagtgtttagtgcaatgaagcttgagtacgatgagcgtggtctatggatgctaagggtgtgtgtaggtatgcggtagtgttacgttcttatattatgctattgaagtactattgtgttatcagacctttataacatatgtagtagaatgattgtttcttatagttcatagatttgtaagagtgataatgtactttatacgcatagttggttgtcggtcgagcgtagtgggtcgatcatagggagctgtaaggtatgggtgtggtcgcgcgagaggtc

SEQ ID NO: 6764 - DNA, 1834 bp, Homo sapiens
  misc_feature (1)...(1834): n = A,T,C or G
agagctgnagaccgacgacacggacgtagtctgacgacgacgagaagtagagaggaagagagttgacgagaccccttagttgccatgcganaacactgagcgtatctgactagcagcatgtctctctgcgctggtngtctctgccacactcacggctctactgacacatctcacacacacactcgcgtcgcgtncttgtgatgcgctctgatgttcatgcatgtgtcagaggcgaggtacgtagcgccgntcgctattgtcgtcntagagaagacacgtagtcaaggatactgtactactctcgttctcgcgagtcagtccgacgactntctataggctcgtctgtaggtgtcgtgtagtatgctatctgacgtatcctacatgattnagttggataaggaacgcatgcgaatgacgtgtgctnttgatgtaggcggagtacggtgtacgaatacttccacctctcactcaccccatccgcccaataaacacagacacacatgagataagtagcaaccactcatgtcctaaccgactacggtcctaacgtactgctcatcaagtactctcgtagtctgatctgtcccgccacgatctgcatactagcgcgcgagataatggactctccgcctcatgcgcacaacacgagcatattctagctacgctattacgcctgtagacgccgagcggacatgacactctacgaccattgatcatgagctggtcgcgtatactntnatctaagctatacgagactcgacagctatctatacagtacgctactgtcgtcgctacgctggtacactagcttacgctactcagagtacgtcgatccatacgtcagaagnctgagcgttaagtctccagattgtanttcctatttcgacaagtgtgatatgtgtatcgcattatcctccgatcgtcatcataccgctctcgcgtggctgcntatcgaataacctgactgcacacangtcagacgctanactcgcnactcaccgtacagtccacactatacantccccatctcatctactgcagcgctagncagaccagtgctgntatcgacgactcgcgatgacttgcatcgatcgctncacgtcgtgncgacagcacntgccgtcgttaacgcgcgantgccctagagcatcatantccgttctcatgatcgacacagtagtaccacacatacaccacgctctcatntatcgacacatactcctantagctattgttacgacgtcncagcgatcgcactncatcgtcgcactntatagngataatcngtngaatgtacgacgacgtgatgntcgtctagcgtgagngagcgtgatgcgctgtcagcacgcgctgacagtcaacgnactgtatancgngtatggtantcnagacgnggcgctatcacatgcgcatctagttgtgtgtagacctgctcgcgctcnacgcgnacgtactcgctcgcactcgccgcgtacgtagcantgatgcgcacngcgatctgcagagatgcatcagcncgngctctgctcaacggcgtacactaccagcatcgctcncacatcgctgtctctctcgactncatacagcacactctgctatctcacngacgtacagagacgagtatcatgtacaactgacgatacgagagtcnacgcgctatcgaccacagacntcacagacatangcagntgctgatatctcatcacgctnagctatatatcatctcatccacgcgcgcgccatagatacgcgcntncagctgtgtcgcgcgcgcgtcgcactctctgctccacactctntactgtgtgtncatcacncatcgctagtcngactg

SEQ ID NO: 6765 - DNA, 1429 bp, Homo sapiens
  misc_feature (1)...(1429): n = A,T,C or G
tccccactcacaatatctcccacatttacccactaattagccgaagggatagcgagagnccactgatacagataggacacgtacgtctttcgacagcttctcgcagtgtataacaactggcatatcttgatgtgataccacatagcgcgcgatcagattctacacataatacttggtcgacaatacacacctagcatatnctggtaaggagtacccatgaaggccgcggatgtgtatatcaccaacggcgcctcgggctctacactaacccgtgctctacggtgnatacggacgcacagctagatcgcaatgagtcgattaaatatgaggaaagccgacgacacgacacgacaccacatgtcgacacgagaaaaaacagaaaagagtagctntgtgcagcatatttatatgcagtgcgtcgtcgncactcgcccgctcgccctctctatgcacagatcgcagtataatgcgcgcccacncgcgaaatccctgatatgtccgtttaatattcatatcgccacntatgttttctcttactgaatagacgaacgctactgatacataaancgagagaaagagaggagcagtagacttgacgcacgtcnccgccacgtcgagccgggacttacggtgcatcatcgtagcactagagcccgcatagatgttcaaacacanaagcgtcttttgtttttatatatgtcttatncactagccgtcactgtcgacatacgtaattgacacgaccgcagtatatcatcattatgtcggcaccctcccgaatcgcccgcgcatatagtagtntagagtagtcgcgccgacagcgtcctatagcagactgatttatgcatcgtatanctgtcgtcggcatgccgcgatagctacggaagcgagcatagtgacctcgcgtatctaactcgatcacgctgctcgcacttatattattatcgccatatggtcgagtgaccacagagtcgtcgcgtccngcgtcccatgctctatgatagnaccatccgcatatattatggcatactctatcatccagcagtaatgtaccgattatcgcttgcccagtagatcagcagtaacagcagtatataacacgaagttacggtagtaaagagtattaaggagggctgtcgcgattgtgaagaccgcactagacgtagatacaatgcagcagtatcctaggtcgagagcacaagatgtcgataaaggcataacagagacttccatgcaatcgactattctaatatgatcttatcaagcgaacgtaagctnatntagataatgcagttttaggcgcgctcgatatataactagtatatcgcatttagtacacgatcccgcgcgcgattataaagcgaaagctagtaccgcaaccatgncgacgtgaagtcagagttctacgctacccgtgtcttatcgcgcg

SEQ ID NO: 6766 - DNA, 1118 bp, Homo sapiens
  misc_feature (1)...(1118): n = A,T,C or G
cgatgttgcccccaacgcgcgaccactcagctcctagaaacagcgccccaacgatttacatcagttacccacctaccactcgcggcgtgacatggccgccgatagtccatgctagtctctacttactcttgtttaaattaacgtatatatgtgaggcggggcgggcgggaagatccacacgacggaaaggcgtgggtgtgtgttgttgttaattagtgcctattaataaagattacaatcacatcagcgtgtcccgacacgcactagtcctcacactcccgcacacactacaacaatacagcgagataacgctgaagaatacacatatgtgtacatattaccaccataacaaattgcgcatcccatcgcggatagtgcaccgatctttatccgtctatatccgctgtgatccttttctatatcatattattatgacgacttgatctggatgtacacacgggaagcgatcgccccccctcccatctaaactaacattacttacacaaagagaataccggcgtgatcttagtgcgcgccaacgctgaaatgaagtagtttggtagtctacagccgcttgtctctcttattcggtcactcatcaaatgtcttaacacatgatttcctttacaaccgtgaatgtattagcagattcactaataattgtaataaccgtaattcagcactctaatctccgataatagactatgccggctgtgtcacttgattgaatctatggttgttactgacactactcaatatacgtacgcgcctataataatacgncgaggcgtactgttacatccgcgatcatcatacgtacatgtatcttactctatttttccgtgctcgcgtctctgaaaatcgcagtatatgatatcgctccgtaggtacactcctctcgatacacctggatacgatatgaatcataccgcatccgacccgcccgcgccggctcccnagccanaacatatcgatatagtaatataattatcggagatataataaagangagcacgatatttttgtgtaggtgtnaggtgtgatcctgccgtgcactatctcgactcgcgaagtttctatattcccgcactatcttctccagagttatgatacacggg

SEQ ID NO: 6767 - DNA, 833 bp, Homo sapiens
gtttcatctcgccagcgccgtcatgcatccaacacgtagacaatacacggagcgaccgggagcatgggaggccgtaaaaacaaaaaaaccggaaaggcggggcaatatataggtcacgcatacctgccgcttttaaaacacgcgccagttgggcggggtaaaagactccataaaaggggaattgggtccagggcccacccctagagggtgacgggattgaattagttcaaattgcccatagggccctttccccgtttaatttttaaccccgcaagtggggcaatgtctttggtcggttggataaaaaagccaaaaaaggtggccaaaaattttaaatccgtttgttataagccaaaccgctaaaccttacaatggtattacattttagcaaaagaaagtttttatagttgataaaaaaaaaaaagccaactgaagtgagtcagaagacagtggcaaactagcactggaagggaatctctatgtgagtggagttaatcccttcatctctttggatctctctgaattttccatttgtaaaaagacagttagtctagataatctaaactgaagcctctttcaagtgagtgtcatataaccatcctgattactgctaaataacctgtttaaacgttttggacctttaaaatgctttttaaaaattctagtagttatttgtaggctattatggatatcattattttatttaacaggcctgttaattacttgtgacttttgtagacttaagttgatttttaataagcatacggattaaagaactatgaaaatatttaattgttaaattcagcttgcatgaaataaaactagatcgcgca

SEQ ID NO: 6768 - DNA, 1046 bp, Homo sapiens
  misc_feature (1)...(1046): n = A,T,C or G
ttgggacannnggtttnncgactatggctngtggnacgaaatgtgtatcgacacnaggtacaaccattgtgtctcaataatgctccaatgggttgaccatggtaattaaatgccacantacagttctctattgaaatgggatgctgcnnatttactcnnggttacagaatggatagtggcattaaatggacgaggccgcgtggacacttaactcttgtgactnggnagagagagtgcagctaccnatccgatgtaagaactgggtcatcttaggtgtttccaccactcttcctctagtgcaactgagacaccgttctccgaaacaacctacagcccctccgcagttatcttattttctctccttctaagagagtgacttcgcccttcgctgaaggacaaagactactccgtggaggcggcctgtctatattttgtttatcacccctccttctgccgccgaaaatacaaagccttacctcctgcctttcaagcgcagcagatcgtttgtcttcctccactccagccccgcaacttgtgtctctctactggtctcctctgttacataattacttctgctacattcttttctgtcagagacaaaaacaatataatacttgtgccttgcggttgttcacacaaggaacagtcgatcgtccgcctcccccagcggatccctccatcgtcatagataaataccatatactctccctccctcccgtccctctgcttctcctacttctcctatgtcgaacatttcttcctatcgctgtgtcactctatccttccacgcgcacaaatcgtctctgttaacattctctccctttctacttctgctattttcccaacactcaaatatacattcagtcgagatgcgtcacaacaacactgtctctgttgtctttgcttatatcttgtctgctactctcgtcgtcgacgtgcgcctattacttcactaccaatccattcacacattattccatcctcacaactgccatgcaagtcatttatcataactaatattgtactctttcctgacaatagttctg

SEQ ID NO: 6769 - DNA, 1693 bp, Homo sapiens
  misc_feature (1)...(1693): n = A,T,C or G
atggacggtatgtgctgtagggtanctncgtgcggtanctnacacccacacccaccganacnananaccacgcgggngcgttcncatgtgacggacacaaactgnatcaccgncgctctgtcatcgatatggtggncngcctcgtggtatgtgtcatacgtccgctatctgtgngngcgtattnctctatgtaagcacgacccgtatgtgctccgtctatccgacgacgttagcattgtttgtagagccgtgcgcgtcatctctntgagagggtcgctacactcctgcgacgctctctaagaatgcgggcctccgcccgggcaccgtatatcaccggatctttnacttatatactacctacagcgangtgagatgtgttagatatcttcttattagtctgtcgctcgtagagggccgctctctcttgcgcgtgtggttntntgaccacgccgcncgtctctcccgcggtgtagatactctctgcctcagtcttctgttggatgttcgtcgcgtatgtccgcgatggagngcttgtggtgcgtccacacacttggaggagagtctctgtctttttttctgatatancgnggtgcgcgtacattggagagatngtcgcccaaccgcgcacatcgcctctnatactttcttttgatctacgcctgtgtggatactggcgtgctgaganacaactactgtagctctttgtgtcttatgttacatgctcgtctgtactactcggctcttttgagagtttgtgtgccgctatcaacatagggtaataggccgcggcggagagacgcaccatnatctctcgccgtgctgtgngcgtggaggtagtatagngtgggtgcagccctgatcgctactccccgggagnganatatatcactatcgcgctctctgtatcgcgtgtgttggcgcgcggcacgtattgtatcgctgctgntgtgtactggcggtcgctgatttncngtctaagaccatcgtctcacctcctcctgcgggtggatatcgacggcttctagcctctctcacagagagacatcgagagcgctctcgtctccttgaatagatgataagacncgctccatcctccgtagggcgttttctccgtctctcgtacntctcacttgttgtgtgttgggtggtgtagtatatgactgtgtagcgngcgcatgcacgtacgtggctgtcccagtataagagacagcatcgacgtgnacactatgtgttcggtggtgttttcgtctatcgcgcgagncgagtggagngngcagcgagcagcccncgtgcttctcttcgcgtgtcgctgaggcgacagacgcgattatatactcagtcgtgtgtntttctgtgtgtggncnctcgcgtcggtcgctgctttcttttactcgcgtctctatctcatctgagccccatcccgcgcacgcctccaggtgggcgattggtttgttctctccgcagtccaccttgttatatcatatctctcatgcagcgcccgatatcatctcaccctcattgtctgctgttcgccacaacgttatatattgttngtgtctgtccggacagtttctgttcgcttttgtgtgtattgctcctatctctacatgcaagcgcgctgttgtgctcgctttatgcncgcgcgttctgtgccgccagctcgctgttgaatccttgatggtgtatttatttt

SEQ ID NO: 6770 - DNA, 1174 bp, Homo sapiens
  misc_feature (1)...(1174): n = A,T,C or G
gtgaggagagagaggggggttagaagaggaagagggggggggggggggggcctaagtctggtntgatcgcgcncgctncnnnnacngcctacncacngcgcnanacacccatngnannaatcgtngngcatactcgacacagcgccgagggcgtanggaagactagcttttngcgcgatncagtggcgcaggagtgcacgtggcgagaccctactagcgcgtccgtgggagttacacaagcgaactctctaatttagcacctcgagcacctctccgagagcnaagcntcgtggtatctagtangcngtactcaccacgcgatgcngcgtgctctagcgcactggatacatctgagacgtgctctcgactctgcaangccagagtccagccgcggcgctggcggcactcacacaatattttctttggagctgggagagacaggaatngtggagaaccacactcgcgaggtgcgcacagagaacgggcaatatgtgaagaatcgatccatctgcaacagagctcgaaaaactcgcccgaaaaaaacataaagcttctcgacgtttgaaaaccagtcagtctggacttgaacatgggaggagactgcacaaagccgagaagattatcgcacccctaatcacagcctaatggtttatcgtcacgaatagcagcttcgactccggtgtggatctcccagtatatagngataagagagaaccggccaatgatgcgccacctttatttcctgtaagactatacagactcgactatgcccgcactaaagaagaagcgacgcactgtaccgtgttaaaacacgaaggccctgagaagatctgcggtggaatttcaacaagtatactgtttcaggggggataatagcttctgggagaaatagccaagagatggagtgatacgttatacagcgttatgggagtacctgtaccgagccgtaagtgtcaaaggcgccaggtcgggaatgggaagacacacgcccctccgcacccggcgcacgatggaatggagtcctcctacatagattcgagagagacaggcgtaatagaacgtttagccccgcgattcggcccaagaggtggagatgtaccgcgccacatggccacaccctcctgtgcctgatctttgcacgtggacgaaacgccatacgtacaacaacgcaaaa

SEQ ID NO: 6771 - DNA, 1343 bp, Homo sapiens
  misc_feature (1)...(1343): n = A,T,C or G
cacgaaagagcatacnatatcacatatagagcggangaagaatcggagagnatacgtggagngatgcgctacatgactactgcagagacacgactacactcacgacgncgcgaataactcgccgcgaacgtacctgaataaagaagtaacgacatatatgcgacatagatcacaatacgcacataagccatctaacgcactgcatagtagcaagtaacaagacgacatcatatacaaatccgtcatacactatgtagacagagcagtcaatgcgatcagtacgctcgcactatatatgtactagagaagtctatagatgactccgcaccagacaccacacgtanaatagaatataaagacaagatagaatatnaagatgcgaggcgcaggctgcagntagagcaanggcacacgcataatataactaataggacacaatatacctcgntccaataaatatagctcgacaccaatatagccacatcgtcgatcacagactaatacacacagatgaaatgcatgtcaagataantcacatagacagngcatgacaggtcatgactacgagaagancgcgaaataggagaaggaatacacaagtagtaaagaaactgagcattatctactccgcactgacaccgtcccaggcncccgggcgcaaaaaccggacgaagaaaaaaagcacgggagaggagngcagagaggcaggggacagcgaggataggaaagaaaatagataagagagaaagagacggccagaccaagctcttcgtatacaagcaaccaaacatcatcccaatccaaacatgcgagtacacaaaaaatactgatccccgaaaaaagatataaaagaacaaaaataaaaaaaaaaaacnaacaaagaaaaaccaagactatatttgacaaaaaagcaaagtgagtagagagcagaaagtcgagcggtagaccggcgagtgagagagtatttgagacacacaaatctaagatgacaagagcgcaccaaaaccagcaaggatgtgaccttacataacacatatagctatgacgaccaaactaatgacaatacgttncnattgttatttgatagatcacttaaccaaagaaaacaacagcacaaaacaaaacgcccaccctcccgagggctgncaatttcacacccgtatcngcgnngaccgcggcgcgcgtctgcgtnggtgggttcgtcgcccgccccacaaactttttttccctcttgtctcttttttcttaggttaattcttttttccttctttacctctctgtatatatcctgcccacgtcnagcacnccacncccgcncacctcttaaatgttcccccccccgc

SEQ ID NO: 6772 - DNA, 317 bp, Homo sapiens
  misc_feature (1)...(317): n = A,T,C or G
ccctgccgccggcgcaaatacctcaggatattgttactataaatcgtctataccccgggcacgcgcacggggaaaaaacacagcaccggcgcccggcgcatatgtacaagcccacgagtagagatgcgggagcgaagcccacactgggttatgatcaacgcggccgttttacccggccgcacacgcataatcattaacaccagcgcccacgaattcaacattccagtgaggactccgcaaacggcccgccacgcactctatccttctcaataaataannnccnnnngccgttgttaaacgcgggccagtgagcgcgc

SEQ ID NO: 6773 - DNA, 465 bp, Homo sapiens
tacccaaaaatagtcatgactgtctacacggcaagtatagtagtttgatttgagcaaggaaagctaaattaatatcttatatacacgctccatgtcagactgtctggaatagcctatgtataaaacagacacctaactggcgaaacgatttgtacgtttttatatagggatatgtaaaaaaaagtttagggagattttaatgatttggaagggatccgtgcgccacctcaatctaccccattcaggttagaagtgccatgcggccgtgctgaagacaagttatgagttgtgtcgcacacctaaggtataacgtctgcgctgagtgcgttacgtgtttagtcgtcgactgtcactattaacgtagaggttgtagtgaaaaatactattgttgaatctttggttcttctctttcgtacgttcgtaagtactacgatctttatacagacttacggatcacagtacggt

SEQ ID NO: 6774 - DNA, 463 bp, Homo sapiens
gaagtacatatttcataattgccccatggttttcatagcatattcataatgcccttatatccgatgattggtttctccaccaagttcccgttctcactaaaccagagaaaaatgacaggcataatcttagcttatcaacaccgggatttttgcgtatgtgttttatttcaccggaatgtgataaatgtacccgatgcagtctccctgcagcctttgtaggtgaccacacgcaggattaagggatataattgtaagaacgatagtaatgaggtcgatggaactttagatggcgtgtcgtggtaaagttgtaagtcgagtacgcgtagaggagaaaaagtgaatgagatcaaacatcgaaatatataaatattattagattgttacatgctatatatacttatatggctttggtacatagaatatataattcagtaacgttctatatcgtcgttctattacgatc

SEQ ID NO: 6775 - DNA, 1764 bp, Homo sapiens
  misc_feature (1)...(1764): n = A,T,C or G
attacaatctttagtctcagctaccgcgattacgtagcatagtaccgggtcagatgctgttcctagagtctgagataatgtaagctacatgcactccactgtagtctgcatagncaaggacggtagtgatgtcgcgctacgatcgttagtatgttctccatcgaggtgctgaaagcggatcgattagaccaggacaacaatgatactatggaaacagtggcgttnatattatctagcgcaggacactactcttatgcaccttacatattaagaatcatgctctgcgtgcgatcgcttcgtcgcggttaggcatcacacaaaacacacaccaagagagtgcgacctcggggcaggcgtggtcgtatttttgtattaatttatacagacgtgattgttagatattttagagtatgtgcgcaggaagaccgtgccgtaatactaccctagtacaaatgatcgacacanttcgctgctaggagagtctcttgtgatgattacaatcacggtagatatgtatatctctgtagcgtgagagctactgatctataatcatcatatcgatctctgtagtaatagtgcttgatctctgtgtcggtctcgcgtantcgtgtcgtncaatncgtcgacgcgtattagcatatcacacccgtattctatgcccaccatttcgcactgtaccagatattnacgtagcgaatcgtaatcgctgtcacttctattgtagctgagatgtgtgccgattgagcnatagtatgtcgacttaactccctcagcatagtaaatagtcatctatagacactgaatcatcattataatcgatgcagtatgactgctgttcgacgcgtatgatctatagaaatactctctctcggcgctaattcgtactccagtccgtgaaatgatcgaacacgagatatcatagtaactagcagagacgtgcgtccgctactttacggttgctgaggtacagtgtacgtctcggagttaatgcattagtaagtgatataactcgtatctatcgtgcgatcctcgcgagtacntatctcacccagagtaccataatctatcagtctgaacatatatcgacactntaatctancngttatcgncgcatagtattataccatcagacacactatcacatcttactctagctgtgacgttattgtaaacgngagatacagtctagcnagcncntcacactcatatntctgttaatgagaatngtacgagctgtatattgcgtgagcgcgtgtcagaacgtatacttgcataagtcagtataaccgcancgcgtgatanacgatntctagatgcttngacgntctacgtactncgcgctccgcgccangattcgtgatagtgcgatcagggtgtatgatactcgctgtctcgatgtattgttgcgtcgcgcttatntcagtaagtgcntgatgagagcgcattatantntatatccanctagcgcagtatctatacncgagacgangagcggncgttgactntattcactaattataatggttggatnnnactctataatatcgctatagtgtatngctatagatanantantgtnatactcgtgtcgtgcagcgattnatctncatannnatgtcattacagtntatnacagtagctcantcccnntcnantctctatnacgtcnatctacgtncnacatacgctctactatagtattcgcgtctncgtctgcatgctcacgtcgcgcatacacttctacacgaatctcgcnatcgcaca

SEQ ID NO: 6776 - DNA, 397 bp, Homo sapiens
cgctcaccgaacgtcgtcgggatcaagcagcactcaggatcgccagtcacggcggacagactcggtcactcgcaccttctaaaactataattgccgcgagcaaggcgacgattataaccagaaacgttcgtaaacatgcggcggtgtcgcgttttcaatttctcacacgcaacaaggcggttagatacgcctgggaggggggggagtaaaatacgtaaaaaaaagacgcgtggcgaccaagtgtaaccaatgttaccgagaaacccacagatcgccgggtcgctgattattcacgataaaggcagcaaaacgggcggagggcgagaggaaaaagtggtcctcgaagctttatacggcctccacctgagactagaatgtgttgccgagaagggaaaaa

SEQ ID NO: 6777 - DNA, 1202 bp, Homo sapiens
  misc_feature (1)...(1202): n = A,T,C or G
agtgaaaaataatcagaaggaataagtataatgaaaaattgtcaatcaaccagcagtgcaaatnaaagagtagtaacattcctagttaaatataacaaaaaagacgagatttttgtacacagccgaaccccccgcgttgatggagggtgacacacatcacagcaaataacctggtcaatgctcataagagcaaatagacgttagtacttagttacttttctgttgttttatgttaatatggggggggggggcgcgagcggagagcgaggatttaggcagaagaaaagggcgacgacaggagctacgcacgccattccccttcctccaccccccccacgcgcgacctagccacctgcaccctctcctgagcagagagccagagagataagcaggcgtcgagacagagcagaggagagcagtaaataaggttgagactgagcaagaggagcgagcagttttaggatttataagcagtaaggacgaggagtaagaagagagtgcaggagctacgggagaagggcaaagcgagtaggatggaccggagatcgcgcgcggagagcaggtagagcaggctgcgcgccgcagtgagcgcgcagacggagagaaaacagtaaagagcgactatgtccattcaacgctcatgctgagcacttattgtatcagcgggcgagcttagatggctcgagacatttacgggttcgaggcacacnctgcgtaatactacatgcggaatgaagcaatgtagtggtgatgggctcagaatatagttaagtgtagagcgtcgatcatgaagatgtgacgtgtaataggtaagctctagagagtggattaggtttgtagagatacaattagatgaaccacatatgacgtagaggagtatacatatacacataccgcgcgcagagtgtatcgatggcggttccaatgttaagacacgaagagatgagtaaggcgtgtgcacggaaatggagcacanaagcacaaagcgaggagaggagtgttagcacgagaggtagtgtctctcgcagagtgtaagagatgacgttttagagaagagagcgtaaccgacacataaacntgaccagatatgagaacaggcacgggcagtagaagtctccgacacaggattagcgangacactacgcttatagtagggcggatatagcgtgaggtaggggtataagggcagtggagctagagcg

SEQ ID NO: 6778 - DNA, 883 bp, Homo sapiens
  misc_feature (1)...(883): n = A,T,C or G
gatgttgtcttcaaccaaagaggaggggggggggggnnttactacggagactaccgacgccgattgnagctgaaccgctcacgcgaacacgagctactgaccacacagagtcttttatcgctgatgtgactcaattctttatccacgggaagcaggaccattgtcatttgaactattattgataaaccatgtcatgaaagaaaggattgaggggcaacgtaaacatacaatacccgcgtgcaccgggttatactttgggggatatgaaagcacacgagacacttgacggaggacgagatgatggtccgcggattgtagggtaccaggatttcgacgctatgaaagggggatgtccgtagagctgaaattaatgcgttagggggtggaaacctcatattgttattatgatggaaagtgtggaaataaaatagaatatgtggtggggggactgaggaatggagtatgagtgatggtgggtagatgcccatgggttcttgacaattgggattgattggaatggaaacatggtagtgggaacaaaaatagaataggggcacagggtgctaatactgcactaaccgggtcaattaagaggatgtcggggcatttcaatatttataacccacaacaatctattgggatattgatattactaataaaataaagtggtggggggcataaatatggtcaaatatttatttcatatttggatttaccggaagaccgtggtggaatggtgtggaggaaaaaattataaagtggaatgggggtcaatacaataacaatttatgtgtatattaattaaattacagaaggggcggggtacgctggtggtaggagcaaaagagggtataatatttgggagggttagattggtaataag

SEQ ID NO: 6779 - DNA, 895 bp, Homo sapiens
tgctaccttaaaaagacatatgtgctcatggtttggggaaaaatatcattcttcccaagaaataaccgcgaggggcccttatattttgtgagccgccattaagacaaccctcgtctcctcccctttatactaaaaaaaaaaagaatattagtgagtgttcgccgggcctccctggggggttgttgtttattggtgggggggtaatagatataagccgtcttctcatcggatcggctggtgtcgccggtagatggggatgggtagacattaattataatccaatcgcgatcgagtaaagaaggggaatccacggcgcgccggtaggttcatcgacgcggcttttaatatgaccaggagtggcggttttgtagatcacattccggctcctaaaagtcgtacagagcgtgagatttgtgtaagacgcgtgctaattgtggataggacgcgtgcgcgtgtaattttgtacatatcgaggagttcgcaatgtttgtctaggtcatgagaaccgactgtacatcgagatcgctattaaatgattccagattagggtcgttatttattcagagcaatccgctcgaaatatgttgattcgtctacggacatacggataatagaaatatgatccgtgacatccgttagcgatagaatgacggagcgatgtcgattgagcgtttcgcgccgactgacgtgagaatttctgtatcgagctgcccccccggaattacgaccatattgtgcacgtaatgataagcgcgcttaacgggtgtcttatgtcgagggatatgcgacccatcgcccgccatccgtagtatagtacgtagaggagagtagaataattaaagtctcgggcgatgggagttacaaagtccggagtcgtgatgtagtacatagaacg

SEQ ID NO: 6780 - DNA, 1311 bp, Homo sapiens
  misc_feature (1)...(1311): n = A,T,C or G
cgcatatccgtgctcctgtactttgatgagtaanaanccnnnnngnggttctccctcggtaatgaggcggcctgtgttctagtcgaaggtcactaagcggcagttagctgcgttgtgacacagcagggatcgaacttaaagctggcactgactctacttagattcaaccacgcgagtgacagtgctggcggtccaggcatttctnggagtaatttgctcatctaagtgaatgatgctctggctacttgcaggacacactttaggtgacattccgaggagaacacgtgacagacagataatgatacctctgtgtggagaaatagcaccccacgtatttcacgtttcttatctcgtttagacgtggagaggtgtcagtccgcgtgcggaaatacgtgtatcgccgcaccaccgtgtacgcgaacgtagtttgtcaagttctgtggcatagctgccgctatggcgcgtggatacatcgtacacaatctgtactcattcagcgatgcgattcgttctttacattaacggtagatctgtatgcatggttcatgttgcactctatatcgctcactttatctccgtggtagcagatattctgtccgatgatcctacacgagtcttgttccggcgtgcgagcgttgcgcactcgctgtgtaagcctgcacagtagacccactctcggtgggatggagagattctatcatagtacacaccacatagacacacagtacattttgctaattacacatccactgctgccctgcatcactcactcaccactctacactatcctggngacgtgctagccgttcgagtacgagtagtgacgaccacgaccagtatgatgcatcggtctctcgtaattagtaacaacgtcgtctgtgcagatactgtatgctgctggctccctgcgtcgtgaaataacatcactctcgtctatgtagaaactacagcgcgtcgaactcgactggcatcgtcgcatacaagtccaagtgagagtgcgctatgacacgtcttcgtgagtgatggcgtctncactatcgagcgccggcgagacgtgtccgtntgatcgtctcaccagaaatatctcacccgncttatgactacacgtcatctgtctatcgaatatctactatcaccgttcattatgttatntatacnctctctcacannccgngatagataagactttcgcgcactgtgtgtacacaataggcgcctattagatgatnatgcgcgagcgtatacacgtacggtgagtcgagccatagtatctacacacgatgcgcataaatagagtacacagcgcaacac

SEQ ID NO: 6781 - DNA, 644 bp, Homo sapiens
gggttgctgattctggagaattgacactaatcaagatgaatgtcctgtttacccctctggccctttgtagcaaggtaagaagtaggatccttgtgggtaaagagaccaggggaatttcgccacactcttttaatggaagtgttgttgctaggaaatggttgcccacccagggcccacatgtcctagtccgtgcttttttggtgtggggctgtttcacacattgtcaaaatggaacatgaacgatgcaaaatgagttgcttttgggatgtgccttcacccactctttcctgttttgctctcaggaagctcaggaatttatggcacaagaggatggtagaacctcaaatgcctacttggaaaagaagtgtctgttgatcaagaatatcattggctcacaatagtgactttattaagtcagtaaaaatttgggtctaacctcacaaatatccagactttgaaaatggatggctaattaaactatggaggttaagatggaactatacaaattcctgctcgagaaagcacgctctttggatgttaaaaattataaagtgtataattttcatatgtcctaaagttccagactgcccaaatgttttaatcagaaaaacactgtatcaagagaggaaatgatagcactaaaa

SEQ ID NO: 6782 - DNA, 849 bp, Homo sapiens
atcaaataaaaaaaagaaagggtggaagaagggccaaagagactccttaagagaagaaaaaccacccaaaaagacaacaccccgcatttatagaaaagaagaaaaattccgtccacaccctccaaggaaaataagcccttttttacaacactctttaaaacccttccaaacttgacccactattcacccggcaggcaaatcccctccagagtgaagaaaagtttcaaacatcagaaaaaaaaacaagcgcattgcaaaacatattagactgaaccatccgatgacaaaatacaactgtgaaatgttgagactgttcatcaaagctggacataagcaggatccattccattttcaaagagatggagtctcgctctgtcatccaggctggagtaaagtggcacgatcttggcttactgcaacctctgcctcccaggttcaagcaattgtcctgcctcagcctcccaagtagtgggactacaggcatgtgtcatcatgcccagctaatttttgtatttttagtagagacggggtttcagtatgttggtcaagctagtctcaaactcctgacctcaggtgatctgcccgcctcggcctcccaaagtgctgggattacaggcatgagccaccatgcccggccaagaaaatttttttaaacctaatagtcaaacgaaggaaaatagtttctaaattgtttaaataattattaaactctttttattaatatgtagttgtcagtagacagagcatctccaatgtcaaacagagcacctggcatataattggtgctcaataaatatttgttgaatgcctttgaataagtaaataaacaaatcaacacggatcagtaag

SEQ ID NO: 6783 - DNA, 1718 bp, Homo sapiens
  misc_feature (1)...(1718): n = A,T,C or G
ctctgtaactggcggattatggtttgacgtacggaacgtaacactccagcgagaaggtttcttttgtgtggaaagaagacggtgaaaaggtttttttttaggtggagataatctagtgttcttagtatgcagacgagagcagtcagcacaggagaggtngtggttgtggtttgagtcacgtcggtgagcgctggcgacctgcacatattaccacgacagcactacatgtgttcacacgagacacgcacgcgatagccgagagcagtattgtggtataggttaatcacgtgttcggtgatagtgcacactacacagtcgcgcgacgatatattgaatgacgatgtcgatgagtgtcacgagcgagcgtagcggaggntgtggcgtacnggcgtgacactttcggagcgatacgatgatgtagtgccgtcgacgcttcgcctggtacatagattagggatacgacgctgatatgcagatggtacgagacacnctaacgagacatagagacgtctgctactctcgcctcctcgtcacagtactcatagtgcatntgacgacagaggtgcagcagtgtcanagattgatgtatgagctgcagacgtgacagcgacatatataccagcagcacgaaacaaccgnacgaggagatgntgcagaatgctacaactacaccnggcgtactagtcgacgtatgatacgntngacgatagtatgactacctagactcaatatatctggtatgtgtgcatactacgtcagtactagcgcggctagcgatgttgtagcggcgagagagtgtgcatgactgatgtacgctgctgacagtgcgctgacctcgntngtgtcatgcacgtgcgaagtacacgtgcntacgtcgtcagtgtctgtaattagtcacgcatccancctatagacactncacacggagngnacagcgcgatatatgctagtcgaccgcgcgccgtgtgncgtccgacanagatagcacaggcactatacagtatgtcgtcgttactgagtgacacatatcagctagtatnacagcatgcgtatctagcgtgtgcagcatagtatacagatagngtcacgtagtcgcagagcatgtgagatgtgtagtgctcaggagctgcgncgcagctacacgcnacgctgtggcngcctgcgagaggtgagatgatatcaagacacacntcgcgtgtcgtttagctgcgcgctcacacnacanaccntcgtactgtacgacgcgtcactctagncgcgctgtactatgtatagntgagtgtncgacgcactgcacgctgacagagtncngtctctgtcgtacgagcacantcgcgtantgtagtgnaggantccgangagtgnatctcgatcncgtgncgcgttngcnancacgcgctacntcatncagacacatagncggnatatcgatatgtcgtgtcgcgacgtgatacatantgtccacgatcacgcgcgtgagtattgtcgtctgtctgtactttcatttgacacgtgcncgatagnagtactcnctgctatatgctcatgtccgcacacncagtnggtactcgtcngagtgacgcgtgacaagtcactatctcacantgtcacantgtagtgctcgtgagtcagacactaacgcgtacgnagtcagtatantgcagagattgtagctcgataagacgcgtctgcagtaatcgaangtgatagtcgcatat

SEQ ID NO: 6784 - DNA, 389 bp, Homo sapiens
actatggaaatgatgctagacaaaaagcaaattcgagtgactttcttgttcgagttcaaactgggtcttaaagcaatggagacaactcaaagcatcaacaatgcatttggcccaggaattgctaacgaacatacagtgcagtggtggttcaagaagttctgcaaaggagatgaaagccttgaagatgaggagtgtagtgattggccatcagaagttgacaatgaccaattgagagcaatcactgaaattgatcctcttacggttacaagagatagtgctgaagaaattaacattgaccattttacggtcgtttggcatttgaagcaaattggaaaggtggaaaagctccataagtcagtgcctcacgacctgagtgaaaaaaaaaaaaa

SEQ ID NO: 6785 - DNA, 187 bp, Homo sapiens
tgtttgatgttcatatcactgggagggaccaaaagagaatttgtgttgaaactaacgggggggctacgcacgtgaactaccaatctacataatgaaagggggaaaaggaagcgagaggatcaacataaatcgatgagggaggaaatcgggaaagcacaaaattggacagggaggaaaaaaaaaaaaa

SEQ ID NO: 6786 - DNA, 1353 bp, Homo sapiens
  misc_feature (1)...(1353): n = A,T,C or G
ctcagttagtttgtgatgatgcgttnngtcgatcaannacaccacngngnggtattatctggggggcatgggagggcactgtcttaaggagcatttagctagacgcatggcatgagacttgctgaacacaacagtgtgttgattcttatagctggcagattgactccttctctaacttaaaccagccgggtaacgagaagacggattctttatgtggaaaataaatagacaaggattaacatctgagtcctccgagataatatgtctaatttacaaccacaccggtattatagaagagataatcctcgtgtagagcccgaattccatgggaggaccgaatcatactctatatggcttagaggatacgccctatatactattgtatctcccgaggcggttcttagcgaattgtgctngactaccagagaggatagaatgccccgtgacatatcagagtgggtctgctgtaacaacacaaggactaaatttagcgtgtcactactgtgtccgattagatcagagtcgtacgttgtcgaggaatttctcaacggatcgtaaccaggttttcattaccatcgcatgacctgagcganatcgtgtgatgtgcatagagaaactcatgttgctccggttatgagtgatcgtgggatgttgtgtggataaggtagcgccaagttaaatcagattggatatgtggagtatctctctctaacgtataatcatagttgcaccatgtagacgatgtcgtaggaggagcggtaatggatagctgatgtctatctccacttgaagatgtcaacaaatatgcgtgcatatcctacgtctatgatgcgctaggccgtagtagcancagctcgaatgctgacataaatgatatgtagtgctctatgtggattgagtgcgagcacgatgttcgttggagtagtgtaagtatgcagtgtgatgatcgcgtgtgactacacatcgctcagttgttggaggatgttgtcgcagatgtgtgtaaagcgtagacgcgactgttgtgacatgtgtacgtctatggggactattagcacgcacgtgtacgtagtcagatatatataatgatgatatgcgtaactaacttgagaactattgacgtcgcgtgtgtcgatcnccntcacataagtagagtgaaatcgccagaccatctattatctagcacagaggatactctatgattatctccacacagcgactgagtagtactagtgagatagatgtgagtcatcacactcgtaggtgatggattttcgtatcatcacaccgaagagtacgtgagtcnatatgtanagcatatcgactgctagcgtatgatctagcgagttgacatat

SEQ ID NO: 6787 - DNA, 886 bp, Homo sapiens
  misc_feature (1)...(886): n = A,T,C or G
actgggaggtatatgaaggaatattgtagtaattcttgtttagagaggatatagaattgtgggcaaaaagatgttatgagagtgcataatagacatattactacttgtattcgaagacacgaacctcaaataggtaaatataatatagtatatagaggatgggaggtattaaccacaaacgagcgcaagcaccacaaaacagcgaaattacgcaatacatgtcgggtaaaaattatttatatcgttgtattttactcagtgatacgtcagttgacgtggtctcaattatacttcgtagtcggcgcttttatgttgcagagaaacaaaagaaaaagtcttacaaaataataaataaaatattaaccatatgcatttcacggttattcataaacccccacctcttaaatattgagaatagagagagtacaatctatacaacacactttaagaaaggacacaatgctttgaaatttaaaatttaggaaaacaatgccaccctaatcctaaggtgcttcttaggtatttcccaaatttctttgctcttttatactcaagcattttcaggaggagtcattagatactgtcaaggttcatgtgataactaaaaatgagtaataaccttagactcttctatgcattaccaccagctgcctggtacactaggtcaccttttacaggagttacattaaaacaataatgtacattggtgtgtatgtggttggggggatatttaaaatattatataatcacaagaaagaccagagatttattgctttgcccttgggcaactaagaaatttaaagcctgttttattcaacaaaaataaatagtagatgcgacatgtnnntnttntnntcattaaaaaatcaagaagtgtggaggggga

SEQ ID NO: 6788 - DNA, 888 bp, Homo sapiens
tgctaccttaagaagcaccccgctgctacatgttcttacattacacgtaatgtaggagtgatgacgtaattagtaaatatgttttcgacattatacgcgagtattaggaatattttgggcaccattgggaaaccagctggcttatcataggaatagagttggagaaagtagctttgtcctcgtcgctacttaacaatttataaatgtgaaagagtcccggggccaaaatcgatatttatttaacttattcgattgttgaagataccaaccaaaaccatccaaaaattgagtctggcgctctgggtgaacgagttcccaccccttacaaaggtataattatctttataaacagattaccggccatctattttggagcatttcatttctttctttgaaaaaagcgattagacagtacaaaggtccttgtgaaaggaaattttctaccatctttaaactaaaatttaaaggacacgattatgcgccataaaatttattaggatcaacatggcagtttataaggcccttctaatattatctcgaaataaacccagagagagataatttcacccccactgcctagatgaagcgaaacttcttaaaagggttattaataccttttcaagtgtggaccgaggagcgctaatacactttcactgcatatgctcccagaagaataagattgtgtgatattaagtcaagagggtacattactctagtttaatattgtccgagtgatttagactccttgagaataggagagcccaattgtatatctggaacgtgcgcgaagaaatagccaggcacgcatgtcttcacgtggtaattgtggtacaactataagaataagaataaacacctgtacgatgccaccactgtatttcggaaaag

SEQ ID NO: 6789 - DNA, 807 bp, Homo sapiens
tgctaccttaagaagcaccccgctgctttggttcttacatacaggaagggggggggtatatagttatattttttcgattatcccggtgtggattttgggaccagggtaatgcttggctttataaaaatgagttgaaaaatacttgtcccgtcctttttcaataattaaggaaagagttgcgaaaaatctattttttttattgtagggaaaggggaacaaaaatcaactccatttaatttagtcggaggctggagagggtattttaaaccactatatataatatttttaatgatagtgggaggtgtattggcggtcctcattattgtgaaaaaaaaagaatataaaatcgggagcattgagagaaaagttaccgccctgtttttaaaaagacgggaacaagtttgatataagagtgtgtgtatttttgtattagcggtagaatcataaatgtagataatggttagtgcgcgttattcctgtcgcgagaagaagtcggagaaagagagcgtgtattcgcacgcgacgcgcatcctaaacgaaatgtgcggacaacgatgattatatttattagaagctccgattcgcttttttagacacatattatatcaatttgtcgcgagtgaagataatattgatatttaagcgtggccatattttgtataatttatgctatgttgtaaagccaatataggattttttattattagtaatatcgaagatagaggcagctgagagattgctatcacaagtgacaattagagagcgtggtattagcttttgttgccgctgagttgagaagagatgact

SEQ ID NO: 6790 - DNA, 870 bp, Homo sapiens
ctgtctggtcacttttgctgactagtgtatcgcgcagtcggtattgcagtccaaggatctgtgggatttattcggtaaatcgtaggagctcacaagatcgagatcaattccgcgcgacggagagtatccattagtgcgacggaattgtcagcgtcacgtttgggggcgacatgcaataggctgactgggtcgtagaccgcaatacgcactcatctccattgtgtttctcttatattgttcgtctatcgtattgtgggtgttgtgcagtttcagaatgatcgttaaaacaacggttgagtctactcatctgtaggtactttttattcccgtgaaccacaaataataagccttctactttaacgccgtacaacacgaccgatgtccctatcccctacggcagaaatatcataatacctgtccaatgcgttagtgttggctttaggtcaatacatgctatgctaatacattccaatttatcgccaatgccaagttactgaaaaatgttcaagaagattacgcagattttctattctcattgacagatgggggaatcatcgttaaccatactattttgtaaatccggccagttcctataaaagtttaagtatatatatgccatatggcccagtaattgccttatctagatatctgtccaagagaagaactcatccacagaaatccttgtatgtaaatgtttacaggagcaatagtaataatagccataaagtagaaacaatctaaatatccatcatctaatgagtggatagataaaatgtggtatatccatatgatgtaatgttatttgtcaataaaaagggatgcgcccgaggccttacttatttttattacatttctctcggggggcggggc

SEQ ID NO: 6791 - DNA, 879 bp, Homo sapiens
ctaataattttaattacagaaatgtgaaaacagagaaaaaaagaaaaccttgagtaataaccgctagaaagagttgaagaattgaaacactaaagttagagcttgaaaggaaaggtgctgatttccataagctggaaaaggggggcactcaatgagaggcaaagtataaagaagtaaaggcaagaaatgcacaattattagaaaatgcttcaggaatgtcaaatgaaatataacgcagaaatacttctgcaagttgatgaatcacaaataatcaagaatgatctcactattcaggtgactgcacttcatgctgcattagaacaaaaaaaatctaaagtgaaagtattactatcagaattatcctaataccaggttggtcaaacaaaggaaaaaaaattctagaacccgacacatagtatataatgacataaaccttggaatccaacacaaagttaaaaactacaattatttctacaaagttatatatatttaattatgttcaataagttaagttagcgtctgtgagtgaaagaacgtatatcgacgtggcaacctaatagtatattaattatatttcgttttattcaaagtatatatagcatgaatatgagtatgtgtgttcctatagtatagcgatttttaattacgaataactaaaaagcatttagtagtgttatttgaatttcaaataatataaacgctcatcgaacataatttatttatatatctgaggctcttgtagagctgaacgagaaagtgagtattgtaggtgggggagaatattaaggcagcggattactaggaaacctatgctaaattatttaatataaactgtgctatgcgaaaatgggtgaaaaatgattaaacaaagctgaaagt

SEQ ID NO: 6792 - DNA, 2527 bp, Homo sapiens
  misc_feature (1)...(2527): n = A,T,C or G
ggaggcggggggagngnnnantannagggnannattggtggatgggagtgantagnatatnatnatatntntattaattactctntggtnagnaggatgntgannagcggagcgacgnnntanntgtcgctcngtncggcagctngcncntcgccgcgatntgtntngtttttcttgngtngaaccttgnngnngcgngnngcgngagngcacaanaaaancaaccccccccannacgnntcgntctctnntgtcaacttgcnatatngcntantngntcnntcngatncntcttattcatcgcncntccgactcntacgcctacccctgcgcggcngatgcaccacggcgtagtgtcgngtacgatcncagctaccgactcgnctatatcntcntctcntctgatctctcntgtctgctggcntcgtggntcntgctcagctcgccatcactnccgatcgtctctncttatctnctacactcactagtgctcnnatnagnntngagtngtgntgatcgactgcntgngggtntagtggtantnacgnngntgagcagccacgcatncactacagctanatgcgaacggcacgctgagcngncgacgcggcacaacttcncacgtgctaccncgnacagtcntccgcgtccgccngacancacgcactnctgctcatcntcgcgtagtgccgattcggtcagcgtgcagtacagtcgtggtgtggncgcgctgtnancgagcgggcagcnagagnatggggctcgcgngtagagtgngcacgatgcgangcngntggnagnngttactgtgtcgcaggcggcctggtnngtgtgtgcagctgatccgtntgtgcgagtcgctggngtaggattcanacacgncgnaccnacgcngcattacgtctcgtcagtgagcngactacatcntccgcnatgctttcgattncatctctnatagncgctctccntcagctacgtcgctgctcgtcgcgtctgcgtgngtgctgcgacngcgcnccgntcgtggtcgatactgcggcgacacgacngactagcagtgtgagtgcgctcgtccgtgcttgctgtacgctgtctcggcncgacgcgcgctcgctgtctcgtcgntgttctcgtgtgcctccngcctggttgttgtggcatcgtctctctgagccggtggcggcgcggtctcggcggcacagtgcgtggacggcgcgacgagcgggcggcgggcgccgagcgcgtgtggtacgcgcgctatagtgcagcatgtgataggctcccgtcgcgtgtgtgtgtagctgcatcgtagtactcgtctgccgtcgcgctgcgcgcgcgctctagtcgccagtgaccggacggcgggcgctgtcgcgccgccgcgcccgtcgcttgtgtctcgcatactgctgcgacatcagcgcgcngccacgatgtagtggctttcgtagatcgcgccgcctgcgccggtgttgcgagagccgtggcagagctgactgtcgcgctagctctcctctcgtgtcggcgcgcattgccgcggcgcgacggcttgaggcgccgaggcgcgcgcgctgtgcgcgtcgcgtgtgtgtcgtgtgcgcggtgcggggcgtcgctcacgtcgtgcggctctgcagctggtgctcgcgctggctggtggcggcggatgagggcgagcgttcagtgtggtgccgcgcgataagactagntccgcgtatgatcacgactgcgcctgtcttgcgctgtgcgcgtcgtngtgtcgtcgccgccgtcgcggcgcgagttgtntgtcgccgcgcactcgctgtgtccaccacgtgtcgatccgcgtcactaggcgtcgtgtgtagtcttgtgtctctcaactgcgacgcntaccggttgcggcgcgctcgcgcgtcggcgtctctcgctcgctcgcgatactggtgtgtgcgcactctgccgtctatcaggtcgtgctgctatccgctgtgtgtcagcgtcggcggcgctcgcgtcgggctctcgagagtgtgtcgcgcgnggtgtgcnnttgtgagactagntgngttcgagctgcgttcgggcgttacttcngtcgcgcgctctctcgtctctacactcgcagctagntctctctactgacgattctgtncatagatcgngggtgagacagacatcgtgtggaatctcggcgcgtccgtcaagatgcgcggctgatgtcagcgtcgcgcaggcacacctntgtatcgcntgctcacgttatcgtgntntgcctgtcggtgctctcncccactntcattccggtgtagtgtcgtgtcgttngtgcgttctcgcgcacgtactcntctggtgggggngctggcgccgcgcgcacgtatcgcgggtgagtgcgtgtatcgtcgcgcgctccgctgtgcgatgtatgatggcgcgcgcgtngtcgtggtggcggtttcntcgcttcngacgagcgctcgcgtcgtacgcgggctgtacgngttgcgntacgactgancgctcnactgganctcccggctgc

SEQ ID NO: 6793 - DNA, 1903 bp, Homo sapiens
  misc_feature (1)...(1903): n = A,T,C or G
catgaggtgtaggagtctgatcgtcnacttatagtgnattantgtgccgctcagaggaacaacactgcccannnaacngnncggcttctctcgcgtccgagcgacgatcacagcgtcgcgcactgtgccgagtctatatcgcgctacataccctcacgtcgactngagcgcatctaaccgcagccagtcctngncgtggtaactaacaacgaccagtgtatntgtntaagcggctctctgcatcngcgtgcggtgncgtccgcagcccgtctgttgctcactcgtcgtcacactgcaccanccatgtgctaantgcgtgagctttgcgtctcaatcgnctacgctttcagtcgcatgagatgnttgtcttgtagtgcgntgcgtggtatagatgcgcatctggcgtccncggcgctcgcnctaatcnagcatagaagaacagcagtacccatacatcatagcacgactctctcagccggctgcgccgcacgcgacgcgncgcacgaccgaananaccagcgcgtcgtaggcgtacgtgcgtagtgcgcgtacgtcagcaccctcccgtgtatatagcatcgtctatcgcacctctcgtcgtagtactgncggngccagtcgtgncgagtcgaatacacgccggtgcccncgctgctgcgagcgagcggcacgcgcncgtgcgtccagcaccgcatgggtgtagctctctganagtgtgctacgcgcacgtaganagnagagtgacgcgcgcgngtgtctatgactgtcgatcactcacctctacagtatcactccttcgagcggatgccgtctcgcntcatcatcgatcggcgcgacctcacagctgataggacantcgacgnttncgtgccgcaccacgtctcgnccgctgncgacgcantgcgcgtgcgacgagtgcacngcgtncanagntgtagacgctcacatctcgctaccgcgtngttcgcagctgcnacatctggatngcacagtgcgcgncgagctctgtcacgtgtgccgtntgacatacggcattctgcgcgtgcgcgcgnacgcgtgtcgtcggtatngncgccgtcagcatgtgatgctcgtcggctctgcgggtcgtncgctcgnagcgacgacgcagccgcncgacatatgatactcgccgctgtgacgcantatcgacgcccgatgtgtgcnacgcacgcgtgccgtgncgtatatgacgcgctatcgcattcacggngcagagcgtctgcntacacgatgcacctatcggcactncgncgtcccaacatgctcgcgctgcacgctctctagaccctgtctctatngnatagcgccgtgctaccgcgcacaccatcgtcactcacgccgctctcgtgctgtagactacacgcgctgtatgtccgatctgatagtacatcgcgcagcgccgcgcgctgtgtgtcagagnttgcgncacgtgtacggcagtgcntgtagaatntcgcagcatctcgcgcgantggctatcgcaaacgtcgtgccgctcanacctgtgtgtcttatngtgngntcntgtcgcatcgctctcagatgctcgcgatcgactcgtcgtccggcatgatgcgctagtcgctcgctacgacctgcgcgcgcgcaatagacgaatcctactctgactnactgatacagtccgcatggcgccacgccgcttgatacgtacgatcgcgcgtgtgcnacatactgatgtacccacaacctctcngctantgtgctctccacctcgttcctacttctctgagcatccctacctgccgttacgtntcgccggtagagctacacgcatctaccgtactgtacacaatctatncgcagtgcagtgagctgctgctcgacanaccccgtagaacgatctcgactncngncatcg

SEQ ID NO: 6794 - DNA, 1107 bp, Homo sapiens
ccatgctgtaaacgatgctcttaacaataccaccgctacagcgaccaaggaatcaagcatggtactccagcacgaagagatatacttctttctattctccagcaatatgttagttcatttaacatcattgaggtcaattttgagtatatcatcccccttcgatacactgttatttctttctctattacggctaattcataccgaacgtcgggttagctagcgacttgtcttaaattatcatataatacacacttatcatatatagacactgcaatattgcgaaacttaaaatatctatatcattgtatacacatattatctagatcgctttatatagtggattttatcacatctataaacatctatttatactcctgtaataacaagtagattagaatacatatgaaatatattataatattctccatactatctttactttttatataatctctaccccaccgcaattataattaacacacgcgccatttaatttatatctaggtaaatcctatttcgattattagtattaccgacagaccaagttatatcagtctatacctcccaaatattataaatgccaaaatacatcttatacagttacttttatatctaacatcgtatctaatatctatttaccccttattttacacatttaaataagccgctactagaatacccacgccttctctatccactttcacataatatattaatattcagcactatacaccacagtaattatatatccgattccaatatccgtcgatcatatgatcacttgctttctacgtgtcatagatctatacttattcacataacatcacaatacattctataagaatatattataatactccacttaattacgatattcttacttatcccatatttcaacaaacttaagattctacattcacgcaaacacgtaatatttatatacaatataccacgtttatatattacaacaataccctcttatatatcaaagtagtattgtacaactttctccccattataaacatttatctaactctgccacacataatatcttgtcgcacaatttactatttatatttcagcatattagaataatttaatataccg

SEQ ID NO: 6795 - DNA, 824 bp, Homo sapiens
  misc_feature (1)...(824): n = A,T,C or G
cttctcgaagttaactattgacattaacgggcagaggggaaaattatatcataggcatgcatttagtggggcttttcacttatgcaggaggtggtcattattatggtagcttcttccttaacaaataaggatacctctgagatttaatacaaaatgaaagacctcgaggcgaagtatttgaaaaagcaagtgccatgtttgggaaatctggcttaggtaaacaaagaagggagccccacaagcccttattttttgttaactgactgtttaagattttggggttaggcaaaagaaagcatttattacatacacccttttctaaatccaaaaatggtgttaataaaagaaacagtccatattagctccagagagtgtcaaacccagagaaatgtgtgcaaaaatgaaacttttttttgcataagccccaccattttgttcgccaatgattggaacacggcctgaaggcactcattttttaatttatattttatttttaattttttatatccttatgagacgatctcactctgtcaccaggttggagtacagtggtacaatcacaactcaccgtagcctcaaactcctgggctaagatgattctcccacctcaggcacccaaatagctggaactacaggcatataccgccacaccccgctnaattttattttttgaaaagacaaggttccctatgttgcccagctggtcttaaactcctgggctccagcaattatcccagcttgggctccaaaagtgaagggattacaggcatgagtcaccatgcctggcctgttttttcaancaaatgatggatgtgtaccngacg

SEQ ID NO: 6796 - DNA, 1271 bp, Homo sapiens
  misc_feature (1)...(1271): n = A,T,C or G
tttgttcttctgctcttcctcttcctctactttacatatgctggagttcgtcaccagtacgtctgtcggtcgttcagctgaggctgtcgactacctctctctccctcctagtcttatagacgcgcatcactttctatctttgcaattctgtacataacgtctccccctcgtcgtgtgctcactcacacctccgaccactataccacgcacgcccggcgcgtcataacccttctcatcctccaagcatctcctctgncgttccctgacacacccgggcagccggatgacggatctcggtacagtctcacgtgctgaacggaggcgtattacggcacattcttcancacccttacttttgtatatctgtcgttgcatcctactctacacctcatctacttctatacggtgctgcattctctgtgtgtcgccgcggattaacagtgccagatgcgcctaccgcagcgtggccggcctcgcgtatgcctgcatctcgtagcgtactgtctgtcgtccgttgtgtacggagtgtccttgttgtgtcatctatctccacctagcgcggcccattgtcctcgctctcattacgctatctgtctgtatagattggtgaatgctttgcggcgcgtcccggatctactctagttctgcctgctgttgtgcggtccgtgtggtctctgtatctgccgagtgtccggccgcggtctattcggcgtagtcgcgttgccgcctggggcggcgtgtggagtgctactctctctcttatttttgtgtccctttcttgtctctgctcgcccccacaccagcatccattacaaccatttctagcgntcagacacactgctgtcaccgcctcgccccatcgatggcagttgcgtggtggcgtgccggcggcacccctcggccggcatggccgcgtctctatacctgctatgatttcctccctgctgccactcggctcacgcatctgctctaatctccgctcggtcctctcctgccggagcgtgcgtgtgctcttgcacttcgatgtcggggtcgttgtggttggccacgtgcctctctcgttngttacaaccgcacctcttcagctgttcttctcgctctacttgttcccacgttctctcgtccgcctggttttggttgttctccttgtggtcgggctccccccccgccccaccccctccccttttgggctttttttttagctgctttcttgccctcttattcaattttaatggtgccacgatcatttatattgttcaccaacaccaccc

SEQ ID NO: 6797 - DNA, 926 bp, Homo sapiens
ataatgacttctctccactcaatccaccggataccaggcaagagtgcgcaggttctatttgcaagagtgatgctgctagatggtcgctccctaggaccaacaaaatcaagacatctcatctcctctagaatctggcgtagagtagaagacgctttcacgacgtctagtgctaggcctccaaggctaatagcgtcgatatttttctcaaatagccgtgcaccttttgccacttctacccttgctcacaccgattacaaacgacaaattcaagggtctctgggagaacttgtactaactaatctgctaaccagttggagccactggccaatatctcctatatattaaaccccccgctagcaagccggtgtcccgttgaagtgataggctcagattcaaggatgccctggatacatctggaccccgtcttggggttcgaaacctcccgtgcctgcgggagaagcggctctacaccaccgctatagagggagggtggtccaggctcatcctccagagattctagcggactacgcgcttgatatctcgggtcgcagcatataccgacattacaagttatgtataagttgtgtgttatcatccccatcccattccgtaatgatgtgttgcatccttctaatccgtctgtagcagccacaatgcgtactgttgtggtattgtggttctaggcatgtcggacctggtccggattacctatgtgtcccactgaatattgtgtagacatgaccgtatacactctacttcaggtagatagagtcatcaagtccctgtgtctcactccgttacaatgcatagagacaacgtaacacgcccctcgtagccggttcacgacacttccggcttatctgtcattcgtcaagacgctacaccctctttcacagtgcattgtggcacagatgattacaatgaac

SEQ ID NO: 6798 - DNA, 1907 bp, Homo sapiens
  misc_feature (1)...(1907): n = A,T,C or G
gttattatggactttagtattgttaagananntnnnnntatacaccctnnannaccgcacggcaacggcgtttcttgtttcggagagaaacacggagggcagacagagtctatctgactggtcggactagcgctgctgtgagggtcctaatctgatgagagtaggatgacatcacgcagtatcacgagtagatatatcacaacgagaggcccgcgtgagtagtaatctctctnactcgccggacgcatcaacaagggtcgcgcagtacagaagctagaccacgaagcgctgaaatgatacacacagcgaagctataggtagatgtagtagntgtatcgatctctatcgcaccgcatcggtgcatcacgctgccgctggatatatactgatcagtacacacgncagcaagcggatcgtgtcntcacctagccacacgtcgtcgcaccgantcatactatctnacgtcgcgcgtctctcgacgatcagctcactctcgctatntcgctcactcgccatgcgcgatatctgtggagacagcatcatatatatgtgttgctgacttgtcacgagtagcgacgctgctacgtccgacccgctgncactgagctngaaggacatcngacagcgacgncgcgacncggctagcantcaatgtagtgatacgtgatgctgtatntcgctctctcnacgacgctancncantacgacgtgcgcgcgtgtcgacaatactgctccgcaccgcgccgtgcngcaccgactgtcaantctctcgttgatattcngtgtaggnagatgtcactagctncgagataccgcgcgttntgagagtgtgagcagtcgcgcgtacggatgatcacacagagcaacacgacgacgactcgctcgatagcatnctcgcacgcgtcgacacngcgcgactnatanctgttaatagctcagcgtgngagtcgngtgagcgntagagtgaatnacgacagtcaggacgtgcgtttctantngacgcgttgatcgataccacactacgtagtcgtcacagttcaccgtctgtcatctgaggttacagngggtacacgctctagtnanttagcgnatcacaatcatgcacgcatgtacgacagcacgtacgtagttatcgntgttagagtangatggcgctgcgtncntgtactactctgcgcctcgagcgacgcaagnatagtcgtacgagtagtcntngtagagtagagcagcgcatntgcacgctnagncgtgtgagtgcggtgnacgagcatactagtatagtctcanaggacgagacngcgctnganngcggntgctgatttgattacagancggcgctacacanacgatcgcagttctgtgtcgcgacgcgtcgcagcgtngngcgcagtcacgatcgtgactgagttgacgtnatactgnacgtatgtccgatacttcgattacttagcacagtnagactgtctacacacatctnctcgtctcagtagtctgataagcgctactataactcgtcntatgacgcgagcgacgctgtgcgcatgcgtagtcatcagcgcatctnctcgcgcacaccatactctattggcacacctgtagtccgtgatctacgcgtacgcgactgtcgtcgtcttgntnacagaacgatggagcatgtcgcgcacgtgtgaatagaagtctcgactngaatatactgagctgngatgcgcttgcctatatggacgtgtacgcaagtacgaagacaacagacnctcgtcagcctctcagatgagtagtaggtggcacgtggatatcatactccataagcagacngttatatatgttgagaacgtacatacgctgacacctacggtggcaactcctgaatatatatgatgcanaagtgagaacgtagatatgccgantat

SEQ ID NO: 6799 - DNA, 1290 bp, Homo sapiens
  misc_feature (1)...(1290): n = A,T,C or G
ctgtatactgatacgctcatacgcatttctatatctcagttgcgcggtcctcgatgggcagtancgcacatttatattgacgacacatgcccaaaacaaatatattttgatttaggccgctgagtacatcgctccggacttatatagtctaacagatagtattaagagagattactacgcacaaacaccacacccatattgttccgcattatacgatcgcgatattatcgcggccgcgaccagtcaatgctgctccgccaangtagatgacgacaacgacttcgagcggacgatgatgtagaacaaagcagatacaatacaatatatcgcattagcgcatattaattacgatagtaagattgtacactttaatatttgtatagtccatagtccaacgacctgcgccacaatattattcgccacacccaaagatcgagacgacacctatgatacaatagacgacgacacggttatcgcatgcattctaactaagtcaactgacgcactttccatagaacgaatttccgcactacatcgttgtcatcgtctatagtctccattaagtagaccgagcatactgtaccttatgttgattggttttgttttttctatatatatcacactcgtgtacccgatacataatcgttcaccctactagataccttatataatatacacattccccaattaatactgctataatacgcgccttaatagtattattattttatcccgcccaagtatgcgttacagtaacgtacatgcgcacacacaccaagtttcattcatctcccacatccaataataatctctacagtcccgcagcaacgttcttgttataaccttaagttttccaggcgcaacctatcgacgcaaataagcacgtgcaagcccgtcccatacacgagctattagctgcttacacaaattaccttccactcctacagccgcatttacaatatgtgaaaaaacgagaacgtggatcttgcgagagatctgtagaacgccggcggagtcttctctacgtcacgaattgatgtatcttgctctcgtgacgaatacttatccgacagatttataatctataatgtcttccatgtttctatacacattcttgattaatcattgatccggcgaagaacgtctacgtcaagaggtattcatcacccgccgacggatatatctacaaatccttgatcactctaccgcgttcataatttagtcagttccacctttcgacgaatgaggtaatcatcacaccntaccataagcgagttcgtctatgtgtag

SEQ ID NO: 6800 - DNA, 862 bp, Homo sapiens
ctgtttacccccttggaaccaaaaaccttaaaaacacatggtttccgtttcccaggaagtagggccctttagattatcaaataacctggcaccctttttggaatctccaacccttaagaattccatccccccctccccttattttgggcggccccctcccccttcctgctaaaagaggaacatatttttccatgatttttttcaccattcattcccaggcccaaatggagagtcccccctcgcctttttggtaatgttccctcacaaggaagcatgcctttgaaaaggtgcctttttcaacccccagcaattttttttcaaagacccttcgtggaaggaagctgaagatgtttccagcaatagacctaaatcttccattgaaggtggatttgggtggtgcatcacagaattccccccagattaaggaagccaatgccatatgaagacagaggcacacaaggagaaggccacatgatggaagaggcagatattggaatgacgcagctgcaagcgaatgaatgccaaggattaatggccaccatcagaagctaggaagaggctaaaaacaatttaacccagaatctcagagtcagcgtggcactgctaactcattggtcccccatatctagactctggaactaacagagaatgtatttctgttgttttaagccactcaatttgtagtactttgtgatagcagtcctagtcaactaatagaacaaagccaataataagttatttgtgaaaagaaacaaagacgctgagacactgacccaaccgttaaaatgcacaccttgtcgagagattcaagaaactatccaaaactgagagcttagtttcaataaatcacgatgcgggccag

SEQ ID NO: 6801 - DNA, 1274 bp, Homo sapiens
  misc_feature (1)...(1274): n = A,T,C or G
taggtagatgagtaactgaattactattgtttaaacctcctatnacagncccccgctcgngncgtttggtcaccagaagaacacgcgcgcaaaaatgactacatcgtatctgtgctttctttcgtgactctcttagcaatgttcacacatatacctatgggatttagcacagccctcagtgtgattgctctactccgtcagtcccagagcgagatgtcccccatgacaccacgcgctagactaaacagcagagaggtagtctttaggaaatctactacagtccatctcgataatgtgtccacattataatgacagcactatggatatacacagtgtcagcggcgctcctacgtcactctgatgtctatcggtacaccgacatccgatgcgcgcatantatcaatataataataacaatagtcttttattatgtatgctggcgctcatgtcaccggcctatactcattcagcacgcattcggagagttaactagtttacaaagactacctcgatgctcttctatgtcggcctgtgatggtcaagtagcttgtcacagccgccccgctgcggggtgcatgtttattttggctacaaattgtaggagcgtatctcagacngttactgtcctcatataggtggctggtgtatccctgagctcctctgccggactactcccatctcattcgtgtaggatcatcggcctctacaacaaacgtacagtcaatggtagaacgcgagcgagacctgaccctctatatattatgcacggtgccgtacagaactaatacactgatctaccgtgtgtttcaccctatcactgtcaccttactgtcacctcaccactcattctcgtccgttgattctctcgcgcgcgactacaacggcgattgacaatcggcgcctgcgcccgcacctccaccttatgcgcggatacaacactgtgcgaaccacttactcactcatgcgacgtagctccatgtctgaaccatggtcggcttgactattgtaccgagcacagatatatgaccaaagagtctttagtaattttcctgacatcacactgcgcacctctcctcactgttatagcgacccgttgtcttccactaatttctcattgagctccaccatcccatcccctagtctctgcagagacggacgacgactcccaccctctactcgacggctgtaccaccggcacccacagctatcctctaaattctcttgctccgttaaagattcactctatctgttcaacaataataattgtgtatatt

SEQ ID NO: 6802 - DNA, 1811 bp, Homo sapiens
  misc_feature (1)...(1811): n = A,T,C or G
ccaccaaagcagtgtgtttattgcatttgtagccccacaggaaaactggatttttctttctttgtgggggagaggacgaggggaaagtagagaataaaaaagaaacacgaacgagtaccacgagccccacccggccgaggagccctatacttcgatagctgtaaagcagcgtcgctttatttgatttttttcttcgaagctagtgattgtcacacgcaggttagttctctacttaagttgatttctatcacncataacgtcgagactagcacactctcaccctcacgtgttgacgtcgcggcgcgggggcgggcgtgcgagcggggtacgctaggcgtttacggcggccgtcgtcggggacaccaccacccacactaccaatttaaaggaaacaagacagtgagtaccgataacggtagggaagctgagcgagaggcgctctgcagggccaggggccccgtgccatacgcatatcagacggaagaacgacaagagagaccgcgaatagaacacgtatataacagaacgacaacaaaacgactcatccccgcatcattaatcaaccacctccctcagcactttttatagacaccgtagggtgcgctggagcgagagtggtcgagagacggaatcaggcgagtagagggatacgtgcagagatcaactacacaggctagaatagcgacgtcgtacacaaaggcggggagaacgatcaaggcgtgaagtgttaagatcggcgaaggcatggtggataaatagatggagcaagtctggcagcgtgccacgcgcgcacagtcacgagctactcgcatgtgagacaggtagtgtccgagacagacgcacgccgacgcgaatgatcggatggcgcgtacaggagggcgaggccgaggtcgggagtgttcgagcgaagacgtatagatatcatcggtgcagctctacaggatcggcggcgtgaggancgacgccatagcataaggcggagaaggcgtcacggatatatacgacacgtcgtagcgtcgaagacctactagcacgttacgtcgagtctcagtggcgtcgctaccaagtctcacggagtcagcacccaacggtctgtagatagcgtggagacgacagagngacgcacgagatagaagtaggatcgcgatactcaacanacaaccgtacgcgacgttcacaccgaagcgcgcacgcgttagtgtttatatgcgcgcgatgacgatcgagaggcntatgaggtcggactagatcgttgcgtgcgacagcagtcgcnggtgtacgaggatgagggagtgagtgagagcgacgaggatatagcggntgantaatgattgtnatcgagggcgcggagggagagncgatacaggcgcgtgcactcggcgagtatcagctgtcntagcgtntcgtacggacggacgacggcacggtggatatcaagacgtgcgtcgtcgactatagctataccngcacacgatcgcagcaaacgcgacgagcgataacattatagtattaacgccacagtactccacgcgttagagcacaacgagatcgcgcgagcaaacactacagacctctgcgagntagttagacgcggctcgcgtgtacgtgaangcgatcatgactgcggagtgtttatngacgcgatagagatagcgtacgtaactatagtgtcgagacatgattggatagtagcgcgtngtaggagtgcgcactgctaactcagacagagtatcacgagcatcagntgctncgagcgagacaggctgcggcgatgccgttcacattccgcatcgtagacagcaacgngcgcc

SEQ ID NO: 6803 - DNA, 1303 bp, Homo sapiens
  misc_feature (1)...(1303): n = A,T,C or G
tacgtaactttgtcngtgggtnnnnnnttcacacnannaacncagccaggggttttggccccatgtgaaaacggggtgaacaaggtctccatcggtccttgggttctctggtttcttatttggtcagttccccaatagtcccgtggtgttcccatcgcgccctctggtgttgtccttctccgctctcttgagggagcgctccgcaagacctcaggcatactacaaacacatttgtgtatttattatgttatgtctcctcctcgcgaccgttctacatacactggcacgagattcgcctcggtgcgcgggtgtatattcctgtcctcgttacattgtacggcgctccccccaattagtccggcgatttctcttttcatcccgccggggcgtgttacgggcacgctttctcagcacaaccacccctccctattttttcttttataatcgcggtcactgtagcggcgacgcagtgcccgcgccccatgtcagaggcaccgatctttcatatttacnattttactccgtcgtcccctctcgtgtagtgcgtccatcccactgtacatcnaaagcgctgggcggtgggttctcgcacattcgccgagtacagacagtacgtgatcgggtgcatggacctcctattacttctgctcgttatgtgacaccctacttgatcgtttagtacctactcttagttaccgtcaactccctcctcagtgctcgcgtatatgtatatctatctttactatccctccactgactagagctctccgtgtgtcttgttgaacacacacagatgacgtctgggaacttgattactcatctaacactcgcgcttcagatcttcttcatcttatcatttctcatctccactgctaccgtttgctgcgcatgacgagtactctcgctaagtctatttcatctcatctccacaatactccattatctagcgggtgcgtgtcccctccactgatttctacttgagatctccacttccgtacatcggctactctcgtcttatatgctcactactcactattctatgcgtccgcactcacgattattgaacatgctgtctcgattggcggcgcgnatacgtttacggtctgcgtatctctcgacgtttcctgctatttgcatcagccccgctactacctgcgtctctcgctctcctattatttattgctccgcttcgtcatatcgtcccattnaccctgtcgacgtcttcacgtctgccctcgtctctgctacttctgttctcatactttgtctggctcgcattgttgtgtatgtgtgttatcttgtg

SEQ ID NO: 6804 - DNA, 1819 bp, Homo sapiens
  misc_feature (1)...(1819): n = A,T,C or G
gaggttcgactgtcgcagctgttcggcgagtgccagatggtgtagactagcgagcgtagcaggcgagatgangacgacacgatgagagacgacacttacgatacgtaggganagagacaggacatgacgtaantgatgacatgcncttatgnacagctcccgctgatttacgacgcgtacagatcacattgtcagcgctgcatacaacgntncnagagagtgtgattgaaggagctacattnatcataaattttacatcanacacnaaancanacacggggtgcacgacgnagtgcagtcagngcgcgcgccgacacantnacagatatagcgcatnagtacactagcgngcacagngcgcgagtagcatcggcgtcatacaagngcagatcaangcatcgnctgacatgcgatcgatcgagatnagtgacgatgactgatangntangattangnagtcacatcgcatagtgtgcgtangacgccgtgatgngtgagantggnagcgcgtgagatagacgagagcgaccgagcacatgctgantgaagnattagatatacaatgcgcatgctgcacgctgcgngcagcncagatgncangaattatacaatcancnacggtangntntaggcnatcggatnttatcgtgtctctgtctncgtgagtgaggcagtcggaggtgagcgagaagncgcagttcggactnctatgcgagtcgcgacagagctgagtcatgcccgcgagatgacgtatgcactgcaacngnancatatgntgtagttgngtaaaaggatctatacttgattatatcatccacgtgagtagcgatatnagaatncttagtttgtgtgggtatatgtangtgtagtgtgctatcgctcgcacgcgcgcgagcgccgcactcgtctactcagcagatcgctcgcangcagangtgatctagatatgttatgtacgctatacnccgcgatataatctcataagtaagacgtaggcccggcngtaggcgagtgagatatagtgatctcgcgcggttgtcggagcagatacgagcagtatgataatctgaatctgctctgagctatattctgtcgcacggcacgcgacagtgtatgatgcgcacgtgcttccgccgcgatatcgagtcgccgatatctcggagtgtgcgagtatcggaggcgaganatggagcaggacgagatatgtgcagtcgtgacagtagcgcggcgantgcgtagtctggttgtagcgcaangatgtgtccgcgtgcgtgngatgagaacgcgacgcgatctgtatgtatgtcgtgtactgncgtgatgtgtattcagtcgtattgtatgagctgccgactgattagcgacggcgagatgtgagtgatacatgtngagacgcgtgtataatgtagtagncgtcgccgcggttaagtagtgacngcgcgcgtctctgatgtagtcgactcgttcggtagagngttgcgcacgtgtgtaatnagtgctgcaatgatgagtctatcgcatnatgnactnacntagcgtgacacacacgaccgcatgacgacagcnagcagtctgcacagtctcactcgatatagatacgtgcgatgtcgaaagcgacagcatagagacgatcagctcgctcgtcatgtgcgtatgccacatggctcgcgttacgtcaggtgagtgtncatgagtgcgtncggaagtgatcatgagagnangtnacgcagncccnagcgacgcgcgacatcgtacgagacgtntgtagaggcgacggccagaggcacgtatgatatatgtaggcgcaacgctgcgcggg

SEQ ID NO: 6805 - DNA, 1233 bp, Homo sapiens
  misc_feature (1)...(1233): n = A,T,C or G
caaaaataacctggcacatatnnnnnnntttccaaaccctcaccccgccccaacgttttcttcccaagaacacaaggcccaaaagttttctggggtggtggttattaggcacccacagaggagacgagctcacatataccgtagtgatgtnccgcgcgtctgggtgtgggtcgccccggcagccataagggagagaccgcgaaaggctgccgcggacaacaaaagactaccgtcggtgttttccttagtgaccacggcgagacacacataaagaaataccgccagactccccccgcggcgctgcgcctttctgtcttctcatgctctgtacggcaccacacctccccccttaattcccgcgagtatttgttgttggcggcgctggggcggagcaaaatcgcgggccatcgtcggcagcgcaacccagagaagagggagcgttattcatccgttcgactgtatgctgaatcatatgtcgcccccacgggcgagtaaagaacagtttatcaatagagcacaacgcatgtcctttgacagttcacttatctcgtgatagcacccagagcagtgaatgcgtcacttctgcgcgccagccccacactacagaggtctctagacaacgcagtctgcgtggagaatatcgagcgacaccgttcggtgatgccgcgccctgcgcctgcaccccacctagaacacaagaccccacgcgtagccaagtgtaggagtatgttcgccgacttaccctcgcagtgtacatagtccgcgaggngtgacccgtgtcccctcgtgttcaccagggtagctttgtcgcttaacttgtagaggtgtcgttncgcagagttctagagcatgtccaccaccctggtcacaataattgtagatagtgcgccctggcgccggggcgtcaataactagacatatgctcgagtctactcaccatgtcacagaggacgtcgcataccaccgctcgagcatcactgatggtgccgtcgagcagagatgttcaccaattcaatattgttcggctagccttgggcgagggatgacgacggcacaggaataatgtancgcacctctactacaggacgcacacatagaacgacaaatcgatgcgcgcgttgagcacgacgagaccggtcgcgcgactacatacaccttcgcagtctntatagccaaagacaatgactcgtttctgagtgccagcggttcgtgcgtgatgagtgatagtggccg

SEQ ID NO: 6806 - DNA, 2085 bp, Homo sapiens
  misc_feature (1)...(2085): n = A,T,C or G
cgataggaatagcacagncacgcgctactgaagcgacgctangtcgattagacgcgcgagctcaccagtctgcagctcgacngnagagatcatccngnacgagagactcggcgccccaactttatgagngtaggtgcagcacagcgacaggcacgaggcgtacgtgtcagataacgagctcgtgtgtnagcgatcacgangcngatcagaatacagancatctgtatcagctctgcacagcntcggncagacagatgagnagtcgcgcgagagagcnctaagctatatacgttaacgtgggatgatntcacactccgactcgccgatcacttgacgatcgcccattactatcnatctcaccgcacacaacatccgcgatacgacgatattgngtcacgacgagctcggtcgtgacagacgacatnagcgtgcgcatganagtgtggcatacgcatcgaccngacnantctagcggagtagnagtatgtagaagacannattacacgcgatagtatgataaaccatcacagagtgagcactactgacngtatgtcaggcctcnctatcaacattnnatgatnctgcacatcagtantgagatatcagtatagangccatcatgccgccacgagcgacacagcccncncntancaacgatatatattcacanacatcatcatacacagtgatgacacctcacnacgatgagatgtcgaggacaacctggcangcgtgngtgacncagcctccgatnactctacgntgnctcatactctcagtcgcagtcgccgaccgacngaagngcntagtatgcgaattacgactgntanagagctnaacgcgagcgaatacgagtaatatgtgatcatcgaagattagggcaccgcgagagtgagnanaggnatgagcgcgcatagtagacgnacgacagtacgatctagatgtatgatatgnaggtgnagtgtcagatgtcacgctgtagtcatccaccagcacgacgcacacacgcacgcgacggtgactggtncataatgnatatcgcgagcganctaccaagagagagcgtnatataatatgcgcatcgcgacacatctcgnccngcgtcgattagatatcgatcatcatatantcagatccgcgccgcgcgctacntcgacacagtcagatgatatttcgacgacgagctagcacagcgacagaggcagcntanacgcacacaggacgagaagattngngcgagtgnacgaccgcgcgagagatgatagatcagtactactgcgagcgtccagatgcgcacgtaggcanagagctcgacgntgagcgtcgctcagcagactagnaccgacaccgcgcgagttntngncagcgtatgtncgtatcgtcgcgcgtccatacgcagactgaccagagcgagagtagctacactnacgcagtacgtctcagcgcacgcgacgccgatagtanagcacgagagatgcgtcnagntcgtcagtgtgncgctgcagangngatgtgcactgatgatctaaaactcgcgacgatacatgactccacacgtatgtgttattggcgcatctantacgatgtagctntccatacgattattgccgactgantcgtactacaatcgagtcgagtcgcgtcgcangntntactcgcgcgcgctgngcganaccacgcnagtcgaatatagtagncngcnacatcgcgtgagnatcaatagtaacgcgagagtacgtacgcgcattnagantnactccatcnatacgcanctcatgcantgacgctatcgtgtacgcgctgtcacgttctcagttgacgctggacgcantatanactgcgacataggaagagtcatancgatcgcgacgcacgtatgactctaggcgtgtcagcgcctggcggtgcgctcgcccngctngtagcntagcgctcatngatgctgtgagtagtcgacacgtgtgtactcatgatgtgatagnatcgtacacgcacagngcgcagacacatatcgagagtctgcgatacagantgcagacatgacananagcgnacatgagctcgcgncgcgncgcagcgcgncgt

SEQ ID NO: 6807 - DNA, 239 bp, Homo sapiens
ctctcggtcccctgcacccacgcggccaatagtttacgcaagggtgggcgttaggtcacttaacaacttcgtccaatccccaaaatttttttttccacccactgggaaacttaccggtgtatatccattattttttgccacagacgcccatcccattacttgctcacccgtcagtgttttactccccattttgcacctacgctcagtactctcttaattacccccggaccagttgctac

SEQ ID NO: 6808 - DNA, 1002 bp, Homo sapiens
  misc_feature (1)...(1002): n = A,T,C or G
aacaaaactgctactggtnnnnttcactnnnnnnnangcagggttttgcccaagaaacgcgggaaaagccacctggcctggccccgggacattgagcaggcccaaaaccagggatttcccccgccgttggagtctccccctccctaagagggggtccgcccaattgtcggggcgttatttgacaccaagacgtgtgtttgtattatatgcctcggtggggaccccttcctcataaaaaacgcacgcccttatcgggggagctgtttcttgcttccaatggtaaaaaaagtcttcccctcctgagcgaaagaatcttttttaccggggcgtcgggggagaaaaaaaggggggcccacgccacgacataggcctattggcccaagagaagtctcgttttacaaccccccacgcgacacaaggttgttcttaggggtgaaaaatcccggcactgcgtgcttctctttgtgcccccaaatagtttggtggcccctacgaaagagacgactatgcacgtcctataaatccccaccacacccttgtgcgaacccaaggatggcggggtacccctcacctccccccccccaggcaaaccgtggggtcttgaccaagattgaacaacaatgactctctccgaccaagagcgaagcccacgggggagcccccccttatggccaaccaagagtacgataccctcgctatgtaaccgcgcaagggagaatatctccccaccacgataaataaaccaccaccttggtggggaaggacgagttaaaagaggccctgcgacccctacactcttacattgagccaagaagttcaacgaacgcggtatgcgctttgatggggggagagacgcggtcactcccaaaaaaaactagttatccccgcagcggtcatttgtgctggcgcgactaccgaacttctaaggagtgagggccggttgtccgtggtgcgaaaaacacaaatcaaannaagcgggtgttcccagtaacttgagaaccc

SEQ ID NO: 6809 - DNA, 1220 bp, Homo sapiens
  misc_feature (1)...(1220): n = A,T,C or G
aattttagtaaaatagtgtancctnnnnngnnnnnttacactaggatacagaccagcacgacgcattaactnaaaccgctcacgcaacactagctaccgaccaccacgagtcaacttacgatgataatgaatcaacccattatccaccggataacaggcacgtagtcacagtctccttctgtcttcgcatttcttacggcatatgcaatatatataantgcactagtgtctcagtttgcactaataaactgggagaaaccttaaatggctttgtggacttgatacagaatagaacgaccgagaggaatacaactggtgcgtcagagtaactactcttgggcagcattagaaagaaggattcattgtccctacagactcctagccaatacagaaacacttcatttatactaattgaagctcacagggaacccgcggcaatgatacagcatgtcagggcactataaccacatatagacctctataactcacccccgccacataattatcaatcacgctcacgatagatcaacactcttgtgtcttgtgatcgattgccttacaactcatacattgacctacacgtgggctgtaagaaaccacacctgctgtgaccactacaatatccgtggctaaccaccaccccaacctacactacatgtgtgtgtgagtaacaacaacaacaatgagaaacagaggtcggaaaacaagcaacacactagtgaaccaatcaagaagtcgtgggagngaagagaaaagacgaaagntagaagatacacgtggcgtaatacatatttcgacatttctcttgcttcataccatcgatgagatgtgcacatactgggtttgcacagacaggagtcgttatatataatattacgttcatatagatactacgtcacgacattcacacacatccatccacacaactacaagcacgagaggcactanagagatcagggaacgacgccgaaccgcgatgttaccactccctggtgatgctgcnagaatcaactcgcggacagcagcggtggaaagactacnggganaccacgatcacacctacacaaattagtgcagtggtgcgctcctcactcctcgcatagtggtgataagtgtataatatcatttatttcgctgttaaagcagtgtgcatctatgctgatactaatatgagagtgtattgatacattgacctctggctatgtgtatcactggtccac

SEQ ID NO: 6810 - DNA, 1240 bp, Homo sapiens
  misc_feature (1)...(1240): n = A,T,C or G
atagatatgaagttctatgttnnntnttcactctttccccgnagccacgggtttttctcatgaaaaacgcggggataaacgttagcctgtggctgggtctttttgtggtttatttgagagctgcgtactaaaacaccaggaattatatccgcgcgctcgggtggttctctccaccaacttaaagtggactcacggcccaccacatagcgcgattaatcacacacccggtctatggatatttattcgcgctttgtgcccaagccctctaatataaaaacaccggtttagcatacacaatcctcttctttccttgttccaccatgactgcccttccccttaagaaagatacaaatttattttttttcggcgggggggtacataaacactcaaaggctctcgacctctccatggaaccccaaaggtctcggataacccacatcagcacggtagagggttccgcccctctattcccctttatgtgccgacaaaccactatacaatttcactatcttccagcaggcgccctctgtggggctatctgtgtgggaacatataagtgtcaaatcatccactattattcacgttcgttgcgcatccttccatcagacttcgatacatatcagttatgtactcgattgtgtcgggcccctccatgtgtatttcgtgtccactgacaactatcgccgctcgcttgttctccactctgcggatcggtcatcctttatatatcaacctcacaggctcgtagctctccgcacccagaattgacatgaccgttgacaatatctctgccgattttaggtgggtgcgcctcttcgattgtgcgttacaccttgttgcagcaactatgtcgttgctcatcttgtttatcatccgaaaaacgatattatcgtagccgtcctctcgctgctactcatggttacagacgagattatatattcacccggctgtcttatatctctacaacgcgaccgctatgtgtgagctgcagactcggctcccttaccgcgtcgcatcaaacatcacagaacgtttcacgtcccactaactctccaaaagataacataggtaacccacacacctgtctacataccgctaaatgacgccgtaactgaccgcccccttggtatgatggtcttcggtaaagatcacaaaatccactgtctgtatgttacccagcacaccacgcgctgtgagccactaatatatatgcattacttgtattcgttctcacctcaat

SEQ ID NO: 6811 - DNA, 1438 bp, Homo sapiens
  misc_feature (1)...(1438): n = A,T,C or G
tatagataccgaggtacgcgcagacgggagatggcgagaggagggaggggaaagaagggctaagctggggagaccactgctggctgaaatcctcnncgaccggggaccaccacgnaaacncgttccaagacatagagnacgacacggaggacagagatnactatatataacannacatggggccatggcgtgttcggcggcagagaaaacagatacanaacaacggagacgaccgacgcgtacgagtagtaccgagtgtagacacgaggaggaacctagcatatatatagcgaatgagagacgaagtactacctcatacaangagtcagcacgacaataggacggacacagtaacctaacanagcgaagggcgagcgcgcgcncacacataaacgcaacaacaacaaaactttctttttgcttagggaggggcgggacgcgganacgaaaaccaagacagacgacgatcgtaggacttgctaggaaagcgcaaaagcataaacagacgtagaggcaagcataaacagcacagtctgatacgagacagactgattaggagtatagtggtatagaagagtagcacgcgcagcgcccagcgagacaccacagtgcagagaagagaatatatgataaaacattaagccggccacggtctagagtagcgataataacgccncgcaaagtagacactattattaaagtccgtagtaagagcataacgatcgaagatggagaagaagagacgtagacagtagtagcggtcacgcgacgccgcggtcgtatcgccttaggcancaccgagagtcgcacccggatcacagactgtctgcggcgagcgaggctgatggagcggatagatctatacagaggtggtacgcgcggagccggagataggtacgcactactgcgcacaggtcggcggatgaggagagcgagcgcaggatgacgtgttcctctacgaagatagaagacgaagatagtcgagtcgccacgcgcgaccgcgcgcgataacggtgcgctcgctacgcgccacagtggaagatgnctgagngacgagcgcgcgagagagttaggatacgcgcagctgtaggtgcgcatgaagtcggaggactaagcacgcagaaactgtagatggaagagaggtggtcgntcatgacgtaggagaggccgcgcgaggcatgcgaagacagagactaaagtnagacgtgtagaagacagagagtcgcatcgtctacgaaaggacgagatagagtgagacgagagcgggntcgcgcgtgagaagcngtcagctacagcgagcacgagagacgcaacgagagtggtaggcagtagtatgtatagcaggactagactcgacgcgcacacgatcagcatatcgtnaggtaagnatatgcnaacctgagaatggcgcgagtataaacaacgaacgatgcggagt

SEQ ID NO: 6812 - DNA, 843 bp, Homo sapiens
  misc_feature (1)...(843): n = A,T,C or G
ctccctcccccccccccccaggcctctcccacccataccactcccctccaacccccaactctacgcccccgaactcatgcccccccgggccacatttcaacaaacagcgcccccccaacagcgcccccacagacaccaataccataccttgtctcccccccccatgttcccaagtccacgcctttaagaacaacaaatgttcctttagcccccccagctcacaagcaacccaaatgcccggctccccaagccacaagggagcagggttatcactcccccctccatgagaagaaagcccagattttatatgtagttcagcagaaaatgcaaaaaccagccatccccctctcagaatctgaagggagttgtattttctgcatattttggatgaaatatttcaaacatgccacaaagcggagatcctccaaattaattttgtttattctatttttgcaccctatatttttgtgatcttaaaagcacccccttctaataatgcaattttttgcaaatatagtaaaatgcataaaaattcatactcattagatccaggagtaaccaatgtgaatatcttgttacacagttttccagtttccntcccctctctgtacatagaactatatgtcctgcaaaaatgggctcagataatacctaatgttttgtgttctgcaattttcgtttcttatatcacaagcttctttctatgtcaaaaagtagacatttacataatcatttaacggaggcttaatcttccaccctaccccagtaatcaatccactattactgaatgtttaggactctgaatttttttctgtttgcaaataataaaacatgatcggcnca

SEQ ID NO: 6813 - DNA, 1205 bp, Homo sapiens
  misc_feature (1)...(1205): n = A,T,C or G
gagaaggatagaaaggagagggctgaagggtgttagggtgtccgcacgggggcagcgtttcaggggcggtcagggggggaaaccaaaggacacggtattcttaggatgaggagatgatcgagcagggtatgtggatgagtgggtggtgatgtggtgacagatggtgcaaaggtagaactgagggaagtgtgacctaattccgatcatcgagatttcgtccgcaggcgcaccgacgggggtagaacgtgtatattgcaaatatatcgatagttatatcaacaatatcgcccgacaaagatagggcgcaccgaagagtcacacgagactagaaggcgccgagatgaaaataataaaaaggcaaagagagagaaagagatagatgagaagacagaagcgagaaccatccctattgttgatactaagacatacagttggtagtgggagtctatcagcggggcgagggtggtggcgcgcagcgggatgagaggggcgaaatagggttggcggtagtgagcggggaaaagaatagatacgatgagagtgaagaaataggtgaganagagtaacgcggcgcggacgggagagggagaaagacgtaaatgacgactcagccnggaggacagatcacgnggatacaggtcaggtggaaaggattcagagagggcttgaggagacatgacctgtcatgagagtcatgggggcgcgaggaatcacagggctgaggccgcaggggagaggacgcgatcgaggtgggctctaacagacatataatgatagacgagtagaggtgaagcgagaggctgacgacaaacacatccctcgtgtggttgtggcgacggtgcacgcatanagtaagaggataagattggcgcactcagaaactagacgtgcgggagccncgatgatgggcggatagtactggggncaggaacatagcgtgaaggcataactgagtcgaacgtgacaataaccaccgattagcggagaggggcgaggggcgcactatacagggcagggaggcagtagtggangatgggccatgtggcgagaaagtcaatgttcagtacagtatcagatacgcaanagcgtgacgaggctacnacacaaccagacgcgtagcggcgtgtgcagaggagtgtggtgatggtggaggcacagaacaggtcgtgcatacgaaagagtatngangacgggtaggagtgaat

SEQ ID NO: 6814 - DNA, 196 bp, Homo sapiens
  misc_feature (1)...(196): n = A,T,C or G
gggccaagggggcgggcccccgccctagaggggcgggnaggcagattaagaggtcctctcaggnnnnnnngccccctncnccgttttaantttanccccngaccntcggngggggnnnnnnnnnaaaanaccncnnaaangnnnnnnnngnnnnnngaaaanaaaaaannnnnnnnnnnnnnnnnnannannnnaa

SEQ ID NO: 6815 - DNA, 961 bp, Homo sapiens
  misc_feature (1)...(961): n = A,T,C or G
cgccgcggcccgggggggggcccgggcccggggggcggggcgtttggggggcccgacgctcttggtgtgcgcccccggccccccccccttccctggcctacccttnngcccccnccccttttgtgaggggggggggacttctatttcaccctcccccgcccctcnncnccggggtggtgttgctgggcctttctcggggggcgcccggggggccctgccctcgcccctggntcccttctgtgggagctcgcttttacgcctggggcccctctggtttttctgcccggggggggggggtcccacccaaaccctttccttcttaaaaaataccccccccttccctcttcccctcttcccccccccctccccccttcctttccncgtccccctcccttctttcccttctctccttacctcatcttcttctttcagctcttccacacactccccccccctccctcccttatctcttttctcccctcccttgccccccccccctcctcccccctctcccccctacgccctaccccctccccgcggggccgctggggggtgcgggcggcggccggtgggcggcgtgccggcgccgcgtgccgcccgtgggccgcgcgcgcgcggcgggcgcccggcgccgggcgacctatgtaggcgggcgtgggggggggttttggcggggcgcatggcggcccgtgggggcttggcggggccggccgggcggggcgggccgcggcgggcggcgtgtgctcgcgccgggtgtccgcgcggccccgccgggggggngggcggcagccgggggcncgggcggggggggccggggcggcgtgtgggcggcggggggcttgggggggggggcgcgcggcggcctggcgcgcgggggcgcggtgccggggcggcgcggggggggcggggcggcggcgccggggtggggtgccgcgnacccggcggccggcggcgtggcgcg

SEQ ID NO: 6816 - DNA, 909 bp, Homo sapiens
  misc_feature (1)...(909): n = A,T,C or G
taataatgngnnnnnnnnnntttcacaccaccgcaaagggtttcccaaaaataagggtcaaacgcacctggttttgttttcgggacattgagcacccccaaaatcagggatttcccccgccgggggggtctcccccccctaaaaggaacccccaaaaaccggttttaacagccccgctttttttttagccattttgcacctcccaaaaaaaacagcaatacaccccccccttttttttttttttaattggagaagaaacaaaaaaggggatccttttttgcggggtttttaaaaagacaaatccaaaaccccacccgcccgtttttcaaaaacacaatctgggagtccccccctatactgaaaaacaaaattgttgttttgaaaaccctttaattattaaaaaatttaatactagtaaaaattgccccttaccaaaaacatgtttggtgtaaatttaaaccaatatcaagatcgctttatatccaacaaaaataagagttctctaatggcctccaattaattccggtcgactgaatattttcatcctggcggtgatgtataataaaaaccataaaaaactgctacttctgaatgatgaaaacgactccatataacacccctaatttaataacttggttaccacgtgaaagccccttatattgtctcctccctacatgaactattaaacaaagtaacacccccactccattttaaaagccaatcagaaaaataactgtacaatataaaatcttaaccaaaaaaaatctaagtttagaatccttttgcaatacaacacccaacataaaatattcggcgccctttataactaaaatacaataatcaccacttgttgggtaaacgaccaggattaatatcaactttaatttattattcttatgatttttcaag

SEQ ID NO: 6817 - DNA, 103 bp, Homo sapiens
ttttctttcctctcctcttcccaccccccccacccccggcgccccccccgggcgggggttaggggcccaccgacccacccccaaaaccagggaacacccccgt

SEQ ID NO: 6818 - DNA, 1553 bp, Homo sapiens
  misc_feature (1)...(1553): n = A,T,C or G
caaacatgatcatcgagagtaattgtgtnnnnnnnnttccatcaaannnnnnnnnnncccnannngggttgtggcccaccaccaaaacacatcgccggatacacaagacaacnccttgancgcgttgttcttcttttgtgttgatctttgaggaagtgtcgcaacaatatacacaaatagagtattacaaccacacgccgccctattagaggtgtacatttcactacacagttaagagagtggagagcacaaccncctgaccagacgagcntgtacgtagtaacacacaaaacagacgctgttgtggttctatgattataatccttgnttttacaaacttcattataataatacaccgcccgggcgtgccgcgggcggcgcgtcttgtttttctttatgagccccattttgtacaaagtctttctaaatacattttttttttaaaggggggtgggagcccgctctaccaacaccaccacataataaaactgacttataaaagaaactatcttgagtaattaaccagaaaagcgcggccgtcaattagtaacggcgtccncgtctgtcctacagagcactagaacctgtaactacatctcacccgagngtctcatcnccatgnggatgacattcatataaatttgtctttatttaaatatatgttatagaacaagtaaccacaggcacgacttgccacctcacttcttcttcgaacatcaaacacgatcttcaatttctgcttctattgaacgcttccgtatgcttagcttctcgatcagcagagaacacacgactctacattagagcttctctcacgtcnttacattatcgagccactcacgcgagaacgtcgtgcgtgatgatagcttactataataacactcgcacatcgagcacaatgtgctatcgaatatgcgtctgcctctctcntctatacttgncgagctcaaataacactcatagttttctattactgtgtgacatatataataacacacacacacgcacgactaaatacagantantgctattctnttttgctgcgcgcgnggatgactcgtactagacagacacgagcgacgatcacacacaacgttgtgtgctctcccactctctatctagtatgacgtgntgatatgtgtgtgtaactcaccgcatatcactcgtctaactntctatttgatatactatatataatgctcactccactcgtaacgcgagagagaaaacacacaaccccnacgctatctgacaacctctcactgtcgtacatgtggtatgtgtaatgagtaagtactcacacantagatctcactatgcggtnactgtcactgctatatgtatcgtatcacaganacanatcagcactagtgagcgcatcgtctcacatctacancatcatcacatcactatcaactatcagatttatagcgcgtagttcgcggttatcgatgcgatacatcagtaactagatacaatctgagactaaggcatacatgcagcactacgaganatgancnctcacgttgtnancnatgcagatacatagacag

SEQ ID NO: 6819 - DNA, 1332 bp, Homo sapiens
  misc_feature (1)...(1332): n = A,T,C or G
caaaagaagaagaaataaaaaataagacaacagtgagtacgcggaaaggcttttaaggtaatacatagtcgaaggagcggtttagtcgagtaatcacccagattgcaaaccgaaagtctattaaagaagaaaattacgagccagggcttttacaggcttgatatccaatgcaccagatttcgcatatgatcgtgtacaagtaaattgtctcaaaccaatcgcagacaccacccgagagagtgggattaacagtcagtatcttatcgtcgcgtgtaataaacacagcgaatgtgaacaggcggagttgcgtgacacgtgaggcggtagaacgttggcggaagcgagatcaacatacaactgacggaaacaagtcatactgtagcaaatgagataaatcagaaaacgcgccttccctctcaccatagcagtgtcagccctggaactgagtatacaacatgantgacaaatcaatgtaattatggagagagcncctcgacaagctactaacaacgctgacataacctgccatcttgttgttatggtgagagacgtataactacaaccgantatgtaatcactcatactcttacacatatatgggcctagaatgaagaagatccaattagactaatataaattctgcgacacatagttgtgagttcagcgtccccgcgtgtttcctaatcacaaatgactgtacaccaccatctgaatattatgattgatagtggacgaagatcgcagtacagatgaatataggtgtcaatacatgttatcttacacgtcacatcactattaaggcatacaagangtttatagacttcacataatcgctctcgtatcattgatatatagagatgctatcgtaatctaattagntcgagatatgttactacagtggaagggtgagtagtactaaacacgagtgtatgtgnagggttctataatagagagtacactgtctacatacngacagatgtaatcaatagaacanaggtgtcggatagctatacatctgtatgcattccagtctctactatacacatctactcgtgctagtgcctcgtagactgtctctgcgctagctgcgcgatgacagcggantcggttaacagcaacacaatcgtacactcgacgctgacgtactcgtggtgtgntcgatnttcaacaatccgnttgtcttctgtctctntcttctactactcgatcgtanagacacgcgcaatatgntngccgagtgcaacagagaagcaagatgacgtngatagacgtatagagagtatgtatnngcgtgtgtgttngccctcgtctctgatagtcaacacacancat

SEQ ID NO: 6820 - DNA, 1538 bp, Homo sapiens
  misc_feature (1)...(1538): n = A,T,C or G
ctgagctgcgagatgatcgacctcagagtcttccagatatgtcggcgtggaaatgcaatcggctaccacaacgctccttcgatatccagcaatacccgacggttcgtcgggggagtattattacacctcattcagcatgtatccgcaagtactctngtactcggggatgctgtacgtatcgatcgcgacatccatgctcgaagtagtgagtctagatcgtctcgagacttgaggcagggatgtgtgttcaaggcaggcgatcacttacgcgcctttcccagtagtgcgctacgcaatgcgtgatgtgaaagnagacctcatacaaggagtcgagcaacacgaatagtcgtctaactcccacgattactaagaccatcgagcatcaggtgctatcaacgccggcggacacctgtgcggtaatcattattagaggcatcgagtaagatatgtgtaacacatgaagcgctacgatctcatccagctcctccacctttatgatgcgcaatgacagatcaccacagtcttcgatggcggactaaggtagcgctggacgtgcgcggtgattgggagctccttcgcacacctctctccccaaggcgttggccacatttagcgtccagtgaccgtgtgttggttaggctctgtcatgagctgaatggcacatccagttgtgacgtgtaggcggttcgtgactatcgttccgcaccgcttatgtggtgcgaagtgcgcgttgtcgtgatagtgatggcagtatcagcacgcagactgctggtgtagatccatcatctatggtgtggtcacacgtgcgtgntccactggcttgcaccagtcgcggagagtatggcgcgctgtgatcactacgcgacgatggtagtgctctcgatacgcactccggctcnagagccttgagtcggcgcgcccccgcngacgtttgcgtgctcagtcgatacatgaacgaccacacctgtntcgcgtgccgaggtgtgcgacgtcgtcgcgagtncagaccgacagctcgcattaatggattgtcnctacacgtcagcgtaattcatattgatgactcgtgcgcagagtcgtcgaagtgaagcaacacagatnacgatctgcnctctgccacagctcattntgttgagtatatgtgcaccacgtcncgacagcgncacaccaantcgngcgctcgtgtngncatcactnnctcacctgcgccacgcgcgatgatcacgccncagtgtgtatctgnagtgatgatcatacgagttattcgtgctactctgcnaccacagagctattnacgcgagatctgctactncgcgtactatgtatgtatgacgtagattatacnctcactccanctctcctgctgtanatctgctngngnatgcagncnatacgtgcntatggtcnagagatcactacgctanagcagtagtacgaagcgtgcgtcgccgnagatacgcacgcgcagcgcacactgagaggcacagcagttagctcgcgatatcacatgtagtgntctgtgtcgcagtcgaggcgcg

SEQ ID NO: 6821 - DNA, 1809 bp, Homo sapiens
  misc_feature (1)...(1809): n = A,T,C or G
tatagacttgtacacgcatctacactatctgagtnnnnnnntttgcacgaccattgcnacacacaccggcacagncggagtgtcacgcacaagactgaaacacgctgacgcgacatctagagtctgcacgacgagtgctgcagntgaggatgtagcgacgatgtagaccactcatcggagcagnacngctgcgcttcaaagatagaccaaatcgtatgtagtgatcgagangacacgcagagcgtgaggtagatgtgctcacacagcnagctacacactacaaagacaggcgatgagtgcgtgtatcagacagctagccgggcgagagccggcgataatgnagaatcgtcgatgagctgtgttgtactgttgcgcccgtcgacacagcggacgactgcgcaaatacagcaatactgtcaacgatgctagtggatggtaggcgatcgtgcgcgtgatagttgtatgcggagtgatgtctagcaagaagagatcgcgcacacaccatgtgtgtaacaactcatcgtcgatttttatttctgatacggcgcggagcacgtctcgtgctactgccacatgangcggacgtcatcgtcgtntcacagacgctcagtacactagacngatcgcatggctagatgctactcactgccgnatcagacagtatatcgctacgcgatctcgttagangcgacccacgcgcntcgnctgtagcacgtatgaaatcgcttncattatgcgtcgtacgacggcgnagcgcgctgttcgacgtagccctntacgataacagtgagcagcgacggcgcagtagagtgtagaatcgtatgcttgagtctcgactatgtgtctcaccacacatactcaccacgccncgagctgccgtcgtcagtgtcacnagtgcagtcgngatatactgtgtgcatcgcgcanctaacacagntgttagacancncacctctcacancagcgantcacgagagcgctgtaatatgacatcagctnantaggtgtgtaccaatcttgcagcatgtgataagagtaatnactgctcagtgacttatcccntcagcactagttaatcgcacagtctgcagcatgaccgcatagacgatcagtcgatatcatnatgaatgttctctggcgaggacagaccgaatgtgatcgncgcgaangatgacacacgcgatacgtaagacantcagtgcgatancgcttgcgacgcgtnaccgnatgctgactccatgttcgcaatcgctcgtgtgngtgtagtgtagagatcacgcagtcagtgctcagccatcnatactactagcacaaccaccgtgaacacacatagacagctgcatcngtgacgagccgtgaggtagatganatctgcgtgtcaccgcgcacagtgtacactagagagcatgctacgtatacnctacacnttnattnagcnatgcactcagtgactgcatcacgcgncgagtccacgctgatgcatcacatnatatacatagctatatagcgcattgtntcagtatctcnaatgtagtactcgactcncacaagatcatcctacatcgcgtatcagtagcgtacgcgntataganagcactgacgacagatgagtatcggtctatgtgatatcgcgacgtcgatacctcgcacgacgtcacgaactctacnctctatgagtgagcatcatatgcactctagctacantnagtcctgtgtcatcctcgcacacacaccacatgcgacatatntagactctgcgctcgctactccgtcgtcgcgtcatatcgcacattaatatagagctcacaa

SEQ ID NO: 6822 - DNA, 1022 bp, Homo sapiens
  misc_feature (1)...(1022): n = A,T,C or G
aggcctttctttctctttctagacctcggctctctgtctcctttcgttcgcggcgccctttgctctgtgtcccttctacctactctctcgctctctccattgcgctctcgctcctctgtcttccgcgggcgtgtcgggcgtcgttcgcgtgcgtgccgtccctcgtcgtctgcctgttgctcctgggtgcgtgctgccgtgctcgcgtgtctcgtgccgcgttgcgttggtgtggggtctgtttctgcctgctcgtgcggggccctcttgtgtgtctctttgtttccctcccccttcccctccgcttgcgcgttcccctctcgcgtccgcttcccctcgttttcgttgttgtgtccgtccacgtttctccgcccctctcgggccggtgcgcgtccttgctcgccttttcttctgttgtcgtctcctcttgccgcttgctcttgtgtccctctcgtcggcctcccgctcctctctccctcctcccgtctccgccggccgagccgcgcggtcccgccgcggcgtgccgttctcggtgttggctcccgtttcgctgccgcccggtgctgcttgccccgccccccggcgcgggtttgccccgtcttctttgcggtttcgtctggttactngccctcgcgttctgccgtttttcngtttcttcttccgccccggcgcgtttgcttgtcccggtgtgggctctccggtgggcgtgggggctgttgtcgcgcgtccgccggcctcccccccccccgccctcccccctccctcgcggtcccccccctgtcctcgcccgtgcgcgccgccccgcgtcgtcggcgcgccccctccgtgccgcccttcttttctttcttcgtncgccgcgccggncgccccgtcccttccccgccgccccgtgtttttcttgtggnncgcgggtnnccccccncaaactcttctttcttttgttctctttttaagttttttttttttttttttttctcttgggnaccggcnccccatacccacccccaccccttcctccctcc

SEQ ID NO: 6823 - DNA, 1950 bp, Homo sapiens
  misc_feature (1)...(1950): n = A,T,C or G
gatagagcaggcagcagtcntntactcgtaatagagtataaannannnantnagaagagagnagnagngnnancacgagaagagngaggaggagccctttcgntgntgtcgtgtaagtacaacacgaagcaganngagaagancagagtgttctatcnctcagagtcggnngtcgtgatccctnctcntgatgngtagagntaatgatangagcagacaggtgtatgacgtcncagagtgangcnatcgtatngngacttattctctcatgtgtccgactcgtggctnctcgnagtaccttcactccacttacatagctatcnaatnacggagacagcccacgactcacccttatcacgcagcccacgtggacagtgatgagagcgacangacngcacatacgaagcagtagatacggatgtgttgtcgtgtgcgcctcaacacgctaccgtgcgtacatcttatactaatancatcacacacacgacgcaacatgacatgacgntntgtgctcctcgtcanagctgacacgtgtgtgtcaggcgctcntagtgcacatcacactcagatctgtgcngtagtgatgcagcacntcatcaccgatctatcgacgtgggtagncacagcgttttctctttcttctgcatcngcagccgacggtgccgcgactcgcgccatcttcattacaggtcgtcnaagcggccgcagacgcgaacagacgctcncacttgtattacgtgcangatgacacactcagcagcacacagcttctttgacgtcctccgcagtggcgcacctcagcccgcgcgccgctgactcagtctaggcgatagtagcgnttcctccgtacacagtcgcgcgccgattatagtnactcgtcatgtatgtgcggtgagcgcgtcgcgagttgcctagaacgacatcgcagtcagcgacacgggtgatgaaagatgtcagccgcaccgcctatcancagtcagccgctagtacgcacgcgatctctcgacatgtacgtgntgactatcataacacatgtcgtatcgtacgccgccccgtctcgagacncngcgccgtcatatctaatcagcncgtcgcgcgatacactgcacgaccgcgcgctagacggcatgtagtgttgttcgcgtncacagtacaatcgagccactnatgacactaccagtcntctcgcgatnctatcgtccntagcatgncagtagcnagcgtagtcagacagtgcgggccgaaggacgcgagtgcgcatagcnagtagagagctagatgacacgctgtcanagactgactcgcangtaggcagtgactagtcggagcgacgacagctcgcgcncacgacagcgacgatgagtngccgntgctgagtgantgttcggatgtgcacgagcacccgacatgtagtgcacacgtctgatctactgcagacactcgnntgcgctgagcggacgtttgntatcgncgngtangtgccacgcacactcgctggtcgcanatcgcgctgacgcgccgtnacatgtantgctctctactctgactcgacgcatacatccatcgtgttagtgcgctcantctactatcgctcgcganacgcgtagcgtactcatcgctcacgctagtctgaccactgagcgcgacgtcgacgtgtcgagtacnacgtgcagcggtcatgtgtgcnntctgatatattcatatctgtcagtccgtctcgcctgcgtgtacgcagcntcgtgccgacggtggttatcancgtagagtacncgcacacgacacgctgtgtgctatacggnccntcgtcgcgcgcgcgntcgctctatcgcgantgtctgcatgatcacgcgntancacgcagtcgctacagcagcacggtcgatgatgntgcacacgatacactcntagagtgagacctccatcgatgtactatgttagttagcgagacta

SEQ ID NO: 6824 - DNA, 1212 bp, Homo sapiens
  misc_feature (1)...(1212): n = A,T,C or G
atatctgactttgcggttgtcggcgggtatcttgtgtaatacgatatcgtgtgtcnctattctactccgtcgatgtgcgcgtcagcatgcgcgcgtcgtgtaatcgccgtctccgacgatcgtacggggcggacagtttctgtcgtgcgtcatagtcgggactgtctttatcttttctttacgatcccctcgacggccatacagctgcgcctccgcgacttggtcgctgcgcagcatgcggctctgtcctacgctctactgtcccacacccggctgatttcgtctatgctcgttatcagtcgactgcgctctcgcacaatgccataatgctgctactgggtaatatccggcggtattccatcttctactgattctcgtacgcggagtcagcctatatattctcgccgatcgttgtactgccgtcggatcgaaaacgaagaataggaaaactgaacctctatctctctgtatttatttctacattatttgttcattaactgtccggtgatattgatgcgttcggtctcccctagaccagtgccattcgggtactgactatctgtgggagatgtcgcgcacacactataacattatatggcccgataatatatcaaaagctgaaaaattcggatatcgggtaagtgtcgttagacaagataaaaatcgagggaggagaattgaatttcttgatcgatcttgtgatactcactgcttatgacttactcgaacgtaactggagcgatatgataaggcgcgcggagggtgtagactcagtgtcttgcgctcacggatcgtgtacacgacgaattgtctataagccccgataaccgcctgctgagaaatatcgccgggtatcctgtcggtacgcgcgttatatgcgtctatactgcgaggccgccgttgctggcgtcgccgcgatgctcgattatccgccggcgtatacgctacgcctagtcgtagcaacgaaacataaatcttctatctgccagcaattctgtctctgcaagggtacattcgatcatttacaatcaacgaacgcagtgaaaggtgacgcgcatgtgaaggggtgtgccttggctattgtttctgccattttctattagggttcttccgccggcaagacctccaccacctgtgttctccctatattaagactttgttttatattacttgtgacctctctccccacactctcctccccgtggggttaaa

SEQ ID NO: 6825 - DNA, 836 bp, Homo sapiens
  misc_feature (1)...(836): n = A,T,C or G
atagaaaggtatcccgatnnnnnnnncccnnnnnnnnatcccgggttagcccaggaaccgggaacaggcccccgggttgggttctgggttttggggcatctaaagaccaatggcccaaccccccgctatgtttatctaaaaaagagggccctacaacaaagagtaacccaccctcttttttttttattttattacgcccgtacaaaaaagacccctcgccgccggcggcgtgtttgggttcgagcgccaccccgtaacagggacttttttccgggggtgtaaagggcacgcaggccccccgaaggcaagactagcagccacgccgagatagccccccccggagggctaagagtttaaggtagggtcaaaggtgcggtctttcgtatgaagcaaaaggacgaacggccgccctgacaacgaccgtgtgtgatgttgggtcggtatctccgcgggtccgccgttatgccgccggcacctactggtgtttagccacttcgccgatgataaacttcggtaacctcaccttgtcttggggtatttggcaattcggagggtgtggtgtatgagagctattagatgcgtgtctgtatgtgcgaccgcaactaacgacccgtttcagtggccgacctttagatgcggcacgcagggcttgacacctaaattatcccctgcgtgatggatacaatctgttctacggtgtgcagcccatggtcgtcagtttggtgacgcactcatgtatccgttctcccagcgccggcgctggtccgcgtcgaccagacgatgcgggtggtaggccacaccccctcggtgtagtccgagccgaatgtgacttagtg

SEQ ID NO: 6826 - DNA, 1043 bp, Homo sapiens
  misc_feature (1)...(1043): n = A,T,C or G
aatcgagatgttgggtggnnnnnnnnnctnnnnnnnnnnannannngtaagcacaagaaaacgcggaataaggcacctggggtggccttcgggatcttgggcgggggcaaatccagggattccacccgcggccctggggttcctccccactaaagggagaccgccaaaaggggtgttgtaacaacggtgtttttaattttttctcgggggactttccttaaaaaaacaccgctacgagaaagaacccggtggagtgattacccaagacggacaagcccgcgcacaacgaaaaagagttttttttcccggttggtgctgcctggggggggaaaacctaaagattggatcttgctcccacgcggggcccgtatcataagaaaggatcccttgtgtgtgcctcccatgaagagaggaaagcatcttctttatagcgcacggtgggggctccctgggaattattacattggtgtttatagcttaacaacaaggagaccatatactcttgtccgaggtgatttcttgttgttttagaagtgagaaaaagtaaatcgattacccaaccttaatacgaacgaggaaggattattgtttgttgagataaaacacaaagtaaggggggccccaacttaagaggaaggacgactcattgggaaccctggtgaggcgttttggtataaaagagatctggccacatgagtacatgcactgtatcaaacccgataccagtcgccacctggggtattatttctgagagaaaagaaagcccacaacacgataaaaatggcgtcttttactttttttgtaaaaacagaggaaggggggtgtgttttctttggaggactcacctttcctccaagtgaaaccgccgaagccttcttgggttgtgattgatttcttcgttacaaatcgacatcagtataggcattccttgcgtataaaaggttttctccacgggtgggcgccttctttttttactataaaggatgtttgatacacaagagtaaaactgtaatttactcggtaggacaaggagaggtgggaga

SEQ ID NO: 6827 - DNA, 1808 bp, Homo sapiens
  misc_feature (1)...(1808): n = A,T,C or G
gtcatctantgtagttatatacgcacatgactacagctctcatacgatcaggcgcatcatagatatacgtacgaagcgtagtancagatgacgaggacgactacgagcgtacttgatcnttacgtcttttacctcgtanangcatagtaangatacgntagtagttacgttaggtaagtgaactagcgaatcatatttaatagatantacgatggtcgagcacatcgcgcgtcgtgtacattaatgatgcactacacnaacgtcacancactcatatagtcgtgcatgaacgcagcaccgtgatgcancatcatgcatgcagaggcacagtgaccgcatacaacacaccatgtgtgcattagagatgactgcagtatgcgaganagtagtatattatgatatcaagtatacgtacaacgattatactcatacacactcacacatgtaatcanaactcnacatacgagcataccatcaacagcaatcgagcagcaaagcttcatgatagacactataaatataatatatactcttactcagtgcgactgactagcancatagttcctctatatatantgacncatttataattatctatntgatgcgcacagccggcgccgctcnagcgtcgctgctactctcgatcagatgataacactatactgtagagaatacgcagcnagtatcatcacacacnataagtcaaanagntagtatactgcatatctcttctagtgatntctcggntncngtactacatacacaaagcgtataacacacagagntgcgctcgacggatgtactgatatntgcgcgtgggttaccgcaatgtgtcatgcaaatatagacgattacgagcacaagnaaatatacattatatgtctaanaagngctagngtagtantaacggaaaacagtagcgtggtactaactaagtgaatgatacgtatgaactcgcgatagacagagtgtnaaacgatatgaagtaagataatactaaaacacacatacaccaacgaggcaccaacgctaatacacgtaaccgaccgcggagagagtggtatcataacgatcgaccacacacacacagcaaccgaacgcgcacacaccaattgatgttctataggagtactaataaatatatngcgtcgacgtcgcgccggngtgtcacgagttcgngtcgacgagnagncgacccaataggcgacactagagtgagngtatcaagtananagacatacgaaaagagagccacgaagagtagcgacactccatagacaactcatacacagcatcgacacgagcgnctaactacacgagcacatgatcacgcgacgcgctgacacacagtctcatctatcagcatctcgtaaacaagcanncagagcgtatcagagagacanatagnatgtgagacatagatnacaagtgttgantgatgnttaatcctngtgctctgcgctcctctncggnccgncctctctctctcgtgtgcctgcncggcgcgcagatcccgtgctctctgtgtgtgntntcgtgctcttngtttgtctcgctctcgngcctcccgctggcngccgcgnncgcggggcccgcccgncnncncncnnccgtccancaacaagctctctctcncgtgcgcctcnttgtcctctcnctcctctctcgtaaaggnctntttnnnntttccgtctnttactacacctttcaactgtnaaacnttctntacataaacatcctgccgnanaccaaaanaaatcacanacaatntcaatatttataagtanaaaataaaaattaaaaaaaat

SEQ ID NO: 6828 - DNA, 581 bp, Homo sapiens
aataagaagagctggcacaacagtatgttctccatcgcagccgcgatgagtaacagaaggaagtacaacatggaaagagacagacagcgcatagagacggggatgcgacgagatcccatttacttgtactacgtcggtacgaacgggcacacatcctcctcccgctgcgggagagctctcgtgggcgaccgacgaccgggggggggtgaagaggaccccgaacgagctgcccgccctaacgatccggaggccagcgacgatttctaatctcacctagattgacaatcggtgagaatgaacacaatatggaaacatacaccagactcgcccgctccttcgcccggatcagagtgaatcacgtgcgctccgggccggtgtggtttaactgtgccttctcagggcccggccccgcatcccgaccgccgagggtgtaagataaaaaaagaacaagacttaaaaataaccgtaatagttggaaagaggagtggcacccacggggtcgcacgacgcacgtccccacccacccccaccccccacccgttttgaaccccttttcctctgttacaatatcatgactacac

SEQ ID NO: 6829 - DNA, 1176 bp, Homo sapiens
  misc_feature (1)...(1176): n = A,T,C or G
aggcggggggtggcgtcggacaagatgagggnggggacagagagaccgagggagcgagattaagagagctgctcgtcgggcggcgattagagagtgtcagtgagagaatgtgaaaggcgatagagcgccagtgtgaagtattggagagagatgaaagagggagaggtatgtagtgtggacctagtcaagtgagggggcatatggacggaggcgggaagggaaaggactgtgaagatgaggagagtgagaagaancgaagctaaaagcaggtgtgaagcactaattagaagaacaatatagaacacattggggagaagcagggagctaaccatgggcatgggggcggaggagcagccgtaggggggggagtacgtgcgacacgacgcggagacgtggaggtacgtagtgcggcaggcgataccgtgggtgtacaagatacgccactttgtgtgattaaagcaaatnaatctcgtaagagggacgcaataaagagaggagcaagtaagggcgagcgaggcggtgagcacgcttaggggcgaacgtgaagagagccacgtaggagaggatgggatgagggggcaganaacggtggagttaggaaagtcaattgcagaatacaggggagtgaagaggtggagcgtagggtcgctagggagttaggtatggagcgtacaataaaaatcaaaggaaggagtaagagggccagacacaagagcgatggcgtgcgataggttggcacaatgaacgttaaatactatanacatatatctctatgagtatgatagtcgccggtgatgaagtgtggcggatgngtggngggcacgcaggtagtcgtgagagcgacacatggagacggcgtacacagagtggagatatgatgttagtagcgatggcaacacggattgtgattggcggtggtcagtaagaattgagaccgtgagggtggacgaaagaatatgagagatactaaatatgaccaatcatacaaattaataaataagagtaagaaaatggcaacatagccaccttagaaataccagtgcacggagagagcggaaaaaagaaaaagaaaaagtgggcctcgattgtgcatacagccgtggggagctggttgcgtactagaactaaaaataacagcaatgaaacgggcgagacgggagggagagcgtggggaga

SEQ ID NO: 6830 - DNA, 1338 bp, Homo sapiens
  misc_feature (1)...(1338): n = A,T,C or G
aaaatattatagtnttattaggagggngagtatgaatcagcattttttgggttattaaaaaaatccatgtgtcgttttatggagggagcaaagaagaaggcccacttccctatacctcggccggtgcgaagacggcaccctagttaaacgcgatcattatcttagtcttcaataatacatcactatcgacactcgttcatcaaacgcgaataaggtcacgaggataatcagttctgtgtaggtttttaggggttgcagatatggtgtcagggagggcacttaatccaacaacaattccacttaagcatgcatcattctcaaacaaacatatacttacttctaatgcagttaaatagtacaagaaactttgcgtcagccagacgatgtggatctttgttgttcctggtcagacggacgagttatggaggagacagcaacagaatggaaggatatataacccaattttttatattttaacagaccgccaaacgccacaataacacgcgagaaaacgcatgcaaaatctttaagctccatttccgtccccgtctttctctcgtaccacgttcgatcttacggttaacgccgctacttcgctgaccaataattgccatccgatacatctaactgatgtatccgaatacacatccccatatagaggcgtaatccacgtcgacgtcgaattccgtctcgcgaagtatacgcgtagatagttccgagttcacggcctcgtgtgcacatcctcccgcgtcttcgtacgcgtatgcacacatacaatcgccctcccntctgcctctagataaccacccttcactcctccccgtctcccagttataacccttatccatgaccgtcgattgtcctccacctccacaacccctatgtgatcacgaccactacgcgatactaacacaccacacactccctttatgtttcagccaagcaccaccacccttccgctttttaccccgtgggatagttgcgaccccctcctatttccgaatcatttgcgccccacattcgcttgcaataatcacaaatcccgatcccgcgattatccgcgctattcccatgtctttattacctttcacgcattatttcccgccaaaccgcagcacgaccccgaaccgcccaccacaattatttatagatccccccgtcttcgctcatccgctattatcgtctctctaccccctaccatgattcatcacccccgcgcccctatctagcaatccaccagtaaatagtataatcaaggatagaaaattaggttagcaaagccaattacgactcgctctccccccactataatcagatccaaccgttctgatataatct

SEQ ID NO: 6831 - DNA, 1031 bp, Homo sapiens
  misc_feature (1)...(1031): n = A,T,C or G
tagtatgtttnnnnnnnnnntttcactccacagacgaggttttccaacagataagggccaaaagtctcttggtgtatggttctgggcacaatagccacgtcaccatagtccagggatttcttccgggccgtgtaaggtccgccactaacttaaagggcaccacacacagcccgggggtcatataagcaattttgtgtatgatatctgaagtcttgatggagcttatttataattgtttcaaaactctccatatcgtcccgttcttgtctcttatcgcagagaacatacagggaaccctggtgacaatctcttcgtgggggggttttacaccacctttatacgaagacgcgggataaaactatgagtggaacactcccttattggaacacttttgtttctccccctactattacgctccgctgtatttatctagattgctgagatatctcacacgcccagacatgcatacatatggttttgttaccacacaaaaaccttcttcctttttatttgtgaggtacgtagccactattttactattctctcttcggcacttaatctttacctttacactgtctcgtgaacatacccgcttggtcgtagcaatatgtggccatatcgaataccctacttagttagatttccgttgacactatataaatataaatcactctgccttctgcctctttnttacttaatcaacatacacccatttctgttattttttttatatacttactccatctcactcaccgcatgtctagttgttcgcccactataatcctctcactccagtagaacaataaagctcaaaaacagtttctccccctaagacagcggcataatgactcctcgtcactggctcttcctctagtacgtgtctgttacgtttagaacagctcgtaaatatttgcattatgtactcactccaccctccctcgacatgcccattcctcggcgaacgatattcttttttnttggtcacgtctacatttcatcgctgtgatgacttctcatttatcttaatgatc

SEQ ID NO: 6832 - DNA, 1181 bp, Homo sapiens
  misc_feature (1)...(1181): n = A,T,C or G
aaattacatatactgggggnnnnnnnccaannnnnnnnnagnnngggtaagccacagatacagcggaaaacgccccctggggtttgtttttcgtggaactttggagcaatgggctcaaatagcagtgcgagtccataccgcggcctttgttggttctttcctctaatctaaaatggagaacaacgccacattatagcggcggtgcataaacccacacgaggtgtggttgaatatttatagacgcgtgngtgtgggtgctaatataaaaacaaaaaaacgacggcttgctaggagagggctgctgacgttttgctgttanatagtgcaaataatcagtcgccaccctacctggaggagagacatttttattttttgcgcgcggggtggggtggtgataaaatacactacgcagaatcatactccntcacagagtgttacggtgtttataattagggggggcggttctgtctcccgccgcggagagagtggaggttccgaagatatgtatcccttatagcacctttgtagcgacgaacaaactattaatgaagcaaggatcgcacaagtggtaagaaaataagatgtggtttatataccacacaatactagagcttcgccacaactccgcttaggcgcgtcaggctaacgagaatcccaaagacatttcccggccgttgctgtattgttaactcgttgagctataaaaaataactgaggttcctctaagatataacgaggatactcatctggatgatacccatgtgtgtgtccaataaatgatcgatgatgtgatccctcccgatgcataatttcgaacatgtactatataatactggtggctcccgcagatcgctaattccgagtgcgtaacttgagagaagcgatacttttatatttcatagagatgaatggcaaattgaggatcagaaaatatttctccgcagcactttacatatcatcacgcgacatgatatgttatagcattcttaganagaaagagtgtcgcagatgatattgtctgtgtccgcaccgtataatatgtcgtaatattttctgcggactcgccgcgacctaaaatatatagaggtatagatatagtgtgctataatgagtctcgtggaacagaaaagcgacataaatattattatatctcagcagactcaatatatgttatagcccac

SEQ ID NO: 6833 - DNA, 882 bp, Homo sapiens
  misc_feature (1)...(882): n = A,T,C or G
ccccaccccctctctccaatgtttggaggccccgtccctcattcggcgcaacgcatttgagtggcaaacgtcacggtcccctctgggcttacgccattcccaacctggtaggttcccccccttcctttctccttttccggttgaattttcgaacccccaagttccaaaggaaaagccccaaggggaaaggggcgccttttctctaatgcccttcacaagtgtgcgaattaaacttaatggttaaggtagtgagcttaagcgcttttttgttgccacaggtagccattatttatctgaattaacccccccatttaaaatatttccgcatttttaagactcattttattcttgataaccttaaagaaatgttctgttgtaggagatgagccctcaaagattgtaagagattcccatctcattcatagttatataggagcacctctccctcagacctctgaccaagccctgtggtccaactgtcatttctccagaagaaatgacacataaaaatggggctcaatntgagtttcatgagcatagcactgagacttgagtgcaagtgtggctttacaagatcacaaattctcctttcaaacagatcatntggtggggtttgttatgngatgnagantgcccccccccccaccttatggtcatattctttatttattgcaagaagacccttgatgttcagttgaaggtgccctttctctagcctcagggggtaaagcataattagtccaagatagccatagtagttttgccagtgantggtttagacatgggcatccgccccactcttggnnaatgggaagtgagggaacgtccattgggtgacttctgagaaaggctttatgtaagaataaaaatagatgcggccag

SEQ ID NO: 6834 - DNA, 1195 bp, Homo sapiens
  misc_feature (1)...(1195): n = A,T,C or G
actctgctgattgatattnnnnaattcaaccncccccgcccacggttggccaaagaaccacccggaaacgcccccgggggctgttttcttggggtcttgggcaaccacagtagccggtttccccgcggcgttgtggtctcctcgttcctgggggacggccccagggggcgagtaaaacacaaaggaccgtgttgtcttcattatggtctggttggaatatacacaaacaaaatataaacgtctatcacccggggcgcgtctctgttgtcactcatccataccaagcagtgcccgctaattataggaacaagtttctttttccacgtgggggggagatttagacgcataattgactaaacgataaacgactaattcaattaagagacatgaacgataacgcgcctgtatgtgtaccgccccccactgttataaatggaaccacaataactacagcatcttcgtccctcttaggtgtatgttataagccacctgctaatattacctagttatacacaaacagacacatagttctagtctcgcgttgagacctgataaggtgttctactgcgacttagccctcccggacgcgtccgcccgcgatataacgcaatagatggacgacgagaggagtctgttgtatagcccgatgctttcaccctcctgctgaccatgcaagtatcattgaagcggccatgtaatggcnctcgtgggactatatcttctgcggcacactagttctatgaaagagttaaatgtagttcttcgccctctccacgattccgtccatgccgaatactatctccgacgttctcacacatgatttcgacacttcacacagaccattattagtgattcaacgcgctctattcaccgtcgacaccgtccatagcctcagcctccccatgaccgctatatctctgactaatcatactgccaatatgccgagacatatatcgagcggagagtgatatgatatcgcacataacgctctcncgctatatattatcggccagtgaacagaagagtctaacggccgatggagcgaagcataacctcctagcccgctcgtgatgtaatatatatagaatatagtatttcntctttgacacgctcttcgttatgacaatgactcgcgtatcgttangctaggtagataatcgtgtgacgcacgatacagtagggtatatgagcacat

SEQ ID NO: 6835 - DNA, 1584 bp, Homo sapiens
  misc_feature (1)...(1584): n = A,T,C or G
tagtaatcgctctctacgtcgtaccggcgtgtctattgcgagtcgactcccggtgacgcgtggatacgacgcggtgagctctcttctgcgagaattggcgcagagactcacngcagatgttcatatctgttatgctcctgtcgcatcccgtccttcagagcgcacacgagagcagtacacgactctacactacgcgagatgcgatgcgtcattgataatacanagacacacaatcacgacacaccgaatatatgacccgcgattatcacattcacgattatagtccgcacgagggctgacgaggatagcctcgcacaagctggctggattcctacttcactgcgtcgggtgtgggtgtggataagtcgcgtggaatgcagcggagcgtgccgaatcagcgcgcgtatggagtggtagctgatggtaaagagttnagactacacgcgacgcgctgccaccatataaaatatcattacactacatgcttaccacattnggctgagctactccagccgtatacctacctcatgtgctattcatcacaatgagacgcctcgcaaacgtatccgcgattcgctattcccgtgcgggcgtcgcgcgctcaagcagagcagcatatgtatatccgcccgcagtcacactgcaacgcgtcttatatgcgtggttgtaatgataacggaaacgacggcacagcgacgacgcgtgatcggagcatcaaatgcgcgataggtggtgtatgcgatttagctgatccggcggccgcccgagatattctcagntctacgtcatcgcccgccgttcgtgttggtcgatagattcggcgacgcatcgaagtgtgcgagagaccacatatagtgtattgcgatatgcgcctcaatccgagtaacagttcgccgcgcgccgacggctagtgtcgatattagcacgtggtagccgccgcacgtggctacagtcgtattatttgcgangtgtgtagtacagtgctgccacgacagccgcgccatgtgctcgactgcgcaggcgacgcgtcgcgcccgagatgtcgcgccgatgcttggtcgcgcgagtcgggctcagagcgcagagcacagtctatacgaccacgtgcttcgcgcgtctatcttatcgcgcnagtaaccgtatgcggcgncagtgatttcgacgnacgcagtgtcgtcgcatcttgcgcacacgagactattgcgaggtctcgccgtcgacgttatgaatactactaggcgcgcgtagacgataactatcgtactttagctcccngacatatgtgataagcatgcggtcgcatgcngctgatacgtagagcggtcagacgagtcagntngcatcgcatgcggttgtacgcacgccgnacgtacttcggtctgtgcccaatcaggtgtcagtattnaggagagcacgatatacnctaccacgatgatggatacagcattctactcgttcagaagacgtgtctgtatgtagttacantatantnttatcacgcgcgcgctatccgatccatagttntagagatagtgatgctcccatngatacttacagtggtntgcgcgcgcgctcgatgtggat

SEQ ID NO: 6836 - DNA, 896 bp, Homo sapiens
  misc_feature (1)...(896): n = A,T,C or G
cggtccaaggatctctttcaaacgcgcgaacaccccgatggacacctggcgccaccgccccgacatttggttatcaggaaccacaaacagtgtttctggaaccacacaatacagaaacagggtcacccgtgggccacttgtcctctctcctttttctcccttatctggaaccgcgataggtggccaaagtggcaacacccccccaacacacttttggtaatcacaaggcccaaactcgggagaacnaaagccaaaaattctgcctcaaggtttcaaaaaaagctggttctgttttggaagctttcaccacgttctccatccttgtgtgaggccccatgataaatgctacccccgttctggatgacgctgttttggttttcaacccagtataaacaagtggaggttgaagtctttagagtccgccccttcccggatgtgcccttggaagagggtctgtgttcccaattacgtgaagggaggacccttggggcccgccattttaaatatcatgtaggaatttaaaaagcnaaaatantaattatttntttgtagtgtgtaaaggaatgtttttaaaaganaaaaancnaantttttgtggatttttatnaagtntttagtgagagctantttnnaatgnaggtganantnccccccccacggaagatattttttatanttaattgcagtagggactcattcccagacaaagcaatagtcacgacttcatggaaccaatcaatggattgttttttgaagactggcaataaagntgtccattnaattnnaaatagtggttttaagcgacccccaacccacattttttaatgtttagaaattctttctgttatattcaagaaaatgtttttaatccagataataaacggggatcggctcaa

SEQ ID NO: 6837 - DNA, 1859 bp, Homo sapiens
  misc_feature (1)...(1859): n = A,T,C or G
tataaggtaattgccattactgattttaaaacctcatcaataatccctcctcgctcattacgtaatcccaacacacaccacgtgcacaatactactccctaattagtaattggtgttactatcgaccactactcattagtacgcgactaccggtgagagcagacatacatcttcaccacgctctgcatcaatcacccataactattcgagagcaagactccacacgcccacattccaagtatgttaaataccagttggtttgtattagtgtcacatcccctaattccctgattatcaaatagctgtagagtaacgtgtctgctcaccatccgcaatcgctgcggtctcggcgacacaatcacgttacgtctgaggtacccgacttcctataantaatcgacaaacaagtattatatgtccaagccacagcgacgacgctcatcatacacagcgtcatccacccacactagacatcctgctctcatgttcngtactatnatgagtctccacgctgatattgcatatntatgcgtcgcatccgtgtatgctgcgctcccctctccgctctcatgcgctcctgagttgttacgttctaccagcctcacagtatgcactcgtgacggcatacctctantgtcgtacgtacgatagtacaactcgcctagtgcntagtgtatcagctacaagcgctatcttagtgtgctacgctgttgctctcactcacacatatctgctctctctcactactgtgattcatgcatngatgacatacgactcaatcaagancgtgttntcatcncgtatactgtgttnngacncacgtacgcactgatacgcagntgntgntcatangcgcccagntntgtagtgcntgccagcacagatcacgcgtgcgcacgatctgcacncgtgacagtttacgtattagtatagtatatcgtacgtngcgtacgattcgttctcacgtacgcganatgnctatgacngtnacacatcacgacatgatcgngatgtctagtagacagcatgtactgctcgctatcancgnatcgactgttgtacgtcatctagtcntgnaattactgacttactagtcgtcgactncanctggatgntgtgantttcacagtgacttantatngtgngatgacanacgtcncgttctcacgccgcgcatcatgcagcgactcatatgatcgntcgatcataacatagctacgagatacatgagtgacgcatgatatatacgcactcacgacgacactgtcagtgagtcgggaacgagatcgtagnctcacagcgtcgatcgctgantgatgatgnacacggatcgtcgcgcgcgacccgagcagctcgcacagacgcagccgtccangcaatcacgacggatcntgantagatatcgcgacgntactcatcactgaactncgcagncgtgtactaacnacgnctgatcatgcantactcatnatactacnatacatcgaatanacagagtatntntcctganancgcantgactgantgatctactnacnnacgtcatatgncatcntcctgtantacgacctaccatcgcnacgncnatgtagtctactngtagcgcgacacatctatacgatatactnangcnctnccctgcccncgtacagcgctgcatgtacaaantcttcacgcaacgtgacgacgcgncgccagncataatcctctgccganctgacatatcgtatagtgtagtctcgagctcctcnctacncagacacganactcgacccantgctgcgtacacnactacgatcgatacangtctgttctcgtgctangagagtaatactacgagnagtatatcagntncggag

SEQ ID NO: 6838 - DNA, 1115 bp, Homo sapiens
  misc_feature (1)...(1115): n = A,T,C or G
atttttgcagacagcctataatacgactacgtacagcgatgcttagtaaacgactcctgaaataattctataccgacaactctacgtttactcgttaccggcgtacgttgtccttttaacccagcccgcccattaatcctaatccacctattgccgcggacagctggaattactgagatgcctcactacctgtctctattggtgccacgctgcattatcgtcgtccgatagttgcgccagcctgagctcgacattatttccgcgagccatcccacccatcgatgtgtgtccccattaatgcaagagttacaatacccctgagcacgacacatgtacatgctttattcgattctgcattggaagttcaagcagtatccctccacgtctttaacacgcatcatgcacccaataatactcccaccgtagaagacgtcttgtgtttattaatttgccatacctcccactgatggcacatctctaagtgagcctctaagtctaataccgtccgcatcacccatatattccggcgtgactccccccaattggtaggtatatataccgcgagagcaacgtatccatccacttggttccggtacggacgcgatgtattctccccgcactctcctgcacttgtcgctgtcccactcgcgcgatgtcgctgcatattctcgtacaaataatctgctcctccncacaccgctacatctctcgagatactcgccaccgtagttctagagacctatctttgcgtagcccgaactattagtcatttacagcactttcgcgctcatattagtaagttcgtgccggcctgatagcgcagtgcgatttttcacacgctctactgctctttcgcccgctgttgtgtgacgcgccaatatcctctacctaagctccgcgagtttatttagttcttgcgccagatatcgacaacgtctccgaatcgtagagtggagacaccctaccaccagatgatatagatctgtatgcatacgctaactacacactacgatccatagacgagacatcgggccgaaagtgtataagatgtcaccccggagtcactgacaatacatttgcccccggcacgtcgtatgattacgcaacaatcggta

SEQ ID NO: 6839 - DNA, 890 bp, Homo sapiens
  misc_feature (1)...(890): n = A,T,C or G
ccaaccccccacaccctcacacttcaacgcttacctcggcctccgaactctcccctgccccatcaaccatattattaccgccgcctcccctcactaaagagcgccaaaccacccaccccacacccttataagcgccttcagccatctgaccacaattcccaanccgcacaagctccccacaagtgggcgtttctccccccctcgacgcacaaaacacaaaaaacccatcctcttaaaagccccttgtttcttaatttatacggaccgaccaccgcattattttttacatcggcatcatgccgttaaaatattgtcatccgccaacaagcaaccccccgctccttggctggcccaagaagaacctccaaagcccttcccaaaccccccacttgcattagaaaaaggtctatggtcactgtttcgagtctccggctgatttgatcagctcagcctttctgaatccagaggaaactgttacatctgagaagtatgctcagcaaatcgatgagatgccccaaaaatcgtaacacatgnagctggcattggtnaatagaaagggccnaagttttggatganaacctnanttggtgaganttganggtatanaancaatgctttaaaagttgaanaaattgagatatgaccccccccctcacctgtcatattcacctgatatcttgccaaatgactgccacttcttcaagcatatcaacaacttttttcagggaaaatgcttccacaatcagcaggatgcagaaaatgctttccaagagttggtggaatcatgaggcccggccccccccgcccccggaataaacaaacatatttctagttgacaaaaatatgttgattgtaatggttcttattttaataaattaagatgccgccag

SEQ ID NO: 6840 - DNA, 791 bp, Homo sapiens
  misc_feature (1)...(791): n = A,T,C or G
ctccgtcttgctcgctccctgtcggaccctctctccgttgtctcctgggtgggggtcgccgctgtagtcagccaggagagggtacctctcccggtgggnacgccatgagtgagtccctggtgagcagtagcaagaagagaggaacggacaagaccgggccactctggagagtcgccaagggccgcggggggaggagtagacgtggggaaactgagatcagaggctccctggtcaccatagaccacgcttagagcgaccgacactactgactcatggagatcactaacaccacatttgtataagagaagcggccgtccgccctggccattcggcacaccacacctgtggttggacgccttgtgcgtggctctccggcggggcgggtgtggctgtggggaggacgagggtagatggaataggggggtaggagtagcgggggggggcggagtggagcggggacggtgcgagggtgagccgaggctacagcataatgagcgtttacctgacgcgggcggggagatgggagctcttgtcacctcgtacgccgtttcttcgcctttttagacctctccttccttttttggggtgtactggatactccgcctgccgtnctgccttcattaaggttttatgtgntcccctggtanatttcgacaccacttcgtgttcctttttcattacctccttactgcctggctcaactgtattttttttcgaacgcgaaacagatagcaagggagtaacaaaaataaacaaaaaggggtcccccccgcctttccccccaaagtgcc

SEQ ID NO: 6841 - DNA, 1155 bp, Homo sapiens
  misc_feature (1)...(1155): n = A,T,C or G
tagaacaagtaggacagaaaatcaaaacaaagaaaaaaggaaaaagaaaggggtttttttntaccaagaacacgcggggaaagactttaccccgggcgaaggggactcccgggacaaatggaggggaacgccgcaccaagacacagcgagaaattacgccagcgcccccgtgaagacccaccggcacacgaaggagggcacgccgccccaccagcaggcgaacagaccaagacataggacgataagcgcagaggccgcggagggggagctcagaaaaaccgatagagagatacccgcgggaccacggggataagaggcaaaaccagcgaggcacgcatccaaaacaagtagggaagaataatttgtagaaggcgcagaaaagggtgggcgcccgacaagccacgccaaataacccgtggaagcgtcccacaanaactaaccaagggaggaggcagaaactcgccgccgagaacaaaaccgattacacaaaaaaaagccacacacccaaggacacggaggcgaagcaagaccgctgcccgaagagcgcgtacgtggagagaaataaggagggcggaaaagggtcttaacgaatgatacaaacccgtgttgaaacaaacaggagcgctccacgctacgtatcaagacacatagccatagaaaggaagggtccgagacgtgacccccagacacgcgccgccgccgggcaagcgggacggagatcgaccggaaagacagagcacggcccagctccgtgttatacaggggagagaagccaccaacaagactgggacctacatagagcgggaaaccaacgcaaaccgacccgaagaacaagcgcgatagaagacgagggtcaaccacacaattaagtgcgcgcgcgagcgcacatggcacaacctctctagctcnggttgggaaagaaacagaccgctgcgcgcgcgacgcgctgattcccggagaacatcgagggccacgccacacatacgtaccggtaatacacaaccgacacgccaagataatccacagataacacgtgagaaccccacaatgtcgaggtgataccgaggcggagcggcgggagacttctgtcggcgccaaagcgcacccgatgagcacaagaaggcccagagcagctcagtgtaacggatcacggct

SEQ ID NO: 6842 - DNA, 821 bp, Homo sapiens
  misc_feature (1)...(821): n = A,T,C or G
attgtaagaatttatatttttaaaaaatccgataataatggtgtgtttgattgttcagaggaggaagtgaagatatagtgtggtggttggtgtgaattaggtggggggggaggaacgattttgttaaatgggttatagggaaggggagaaaaaaatggaattatttgatgatggtggggtaaaggtgtggtatatatagggaataaaaaggattttttataatggggaaggaaatggaataaggggggtaatagttgttgtgaggtgtgtgttgagattttggtgtaaggaaattgtgtattttgggttagaaaaataagggaattttaggataaagaaaaaaaaggagggtggtggtgggataatttaaaattaaggggtaaagaggtttaggggggtttgagggatgttttttttttggttatagttaaggggttagggattttaaggttttttaaanagtttttttgaaaggattgtgggtatatgaaaagaatttttataagaaaaaattataaagtttgaattttagggttaaaagattttatannagaggatttaanagaattttatttgatgaaagtgagtggatttaacccagtgccagatgaggaggaagaagatatttaagaagaagtgtcagaaaaaaagtcgatgttagataatttggcagaaggggtccaatgattcaagagtgctttttgacttcttttatgacatgggcgcttatatgatatagatactgaaataaaagcaagcaatggaaggactggtactgtagagaaatatttttagagaaataaaaaagacaaaaagtataa

SEQ ID NO: 6843 - DNA, 1698 bp, Homo sapiens
  misc_feature (1)...(1698): n = A,T,C or G
cactctcatcaatgtnacgtattgtcgttacagatgtnnaganannaggacgtattatgaganggcataccgtctgatgtagggtgcgcgaggatgtgagtgagaatgtntttacggtcgtgtaaggtgctctgtatnncgtnagacgtntgantagtagtttntatatctctctgtcatgtggnnctgctctatagtattctcgnngcttntccatatcgtgtatgtgacggtcgggtcgnngncatctatcgtagtgtgatanggacnggagtagattgagtacttganttgngactgtctagtgtgtatgtnagnggagctaacattagttgagnanntntctgtgtggagtatgtctaggctatcacgcngaagcatantctacagngagacgattgtnnngatcgcgtagtatgtgtctagtgtgagttgcgntgtggacagactannagctgttagtgactcttgtatgcnngaccttatagctgtgtcgtagtattatgtgtatgcgtggtgngtngganggaagagagtagattcgtgtgatactnganacgcgtacgcntgcgcagtgatgtgacgtgtgagactgaagtgatacagtgtgngtnactgtgataaggaacgtgatggtgaatgtggtatgggtgtagtgtnggggtatgtagtgtggagggtcacggtggtgtactgatggtgactgagngtgtagatctggntgctctgtgtaggtgatcgtgtggtatagtgactcgtggagtgtgtggacgtgagagngcatgtgggagatgtgcggtatcgggtnaaggtgtagcgagcggntcgtcttgcgctgtgttagtcactcgtgtagaagtggaggtgtagatgaggtggtatgtattgttggtgggggagtagctgtgagggtgtggngcttgtgtgnacacaggtgtatgtggagtcattggaggcgtggcgggtgttgttgcttgtgtgtaactgtggagtaacttcttgcaacgttgtatgtattggagtgtacgttattgtcgttgtgatgaattatcgttaaaccttctattaagttagggtctagtggcctcgattactttactcnnctttctatctctanttataccctgtatgnnntcattcgagctctctctttcttatnnnnntctccancttgtcacattcatttnctcatatcttccctctttggttnncctgacnctcttcttctggcattgtnnggtcgagcgtccgcctacactgcnnncacctacncncgatgtgtttctctatatatcgnacactatgatatntatcttagtcgcgtctagtgggantcacaccttnntctatgtgtgtgnatcacttatnncactatctttctcatanactancactcnnncctatatcncnatcactgcgcatcagttnnnncttcgggctctncntaatcatctatnnnnnnatctattnnnnttttacttattnacatatatacananananaaacatataaacacatcagaatctnnnatatgnnnnattcncnatagtnatcttcnnnncncncaagacatntattttnnnnnnnnnnnncncttatcttnnnnnnnnccnctnnntctctcncntctctctncactttttcnnnnnnnnccntcttctttnncnntntcttnnnncnnnnccnntctctccccc

SEQ ID NO: 6844 - DNA, 1188 bp, Homo sapiens
  misc_feature (1)...(1188): n = A,T,C or G
ttaagaaactggagcttttaaggnattttngtaccaatgcnccccaaccgacaagggttttgctccagagaaacgtggtgataaaccccacccgggacttgttttttatgtgtatcttcggggtcaggtcccaacattacagggggaattacgcccgcgccgtcggagtagactctcactggtacctattaaggggatatctccccaccccccgcaggaggtttttgatagagaccacttgttgtggtagttgctagttgcgtcgctcgtatgaaatagcgctagataagaagccgacatctcttctccaaacacctccgcttgctttcagtttacggttcaccgaaccgcacccgctcccggtatgaccgttttctttttttctggccccgcgcgggtcgttcttattgtttcaccctcgataatcgtactggcgggtatatgtgcgctcgtatctagattagctcaccgatatgccaatgagctgccacagtccaccgttgtggatgtgttgatcactttggggtatggcggcggcatcgggacgaaccctgtgccatcacaatggagaggagcagtaatctctgtgtgccacacattgtcagacaagtgagttcgctgtgcaacctgtgtcccgtcaacgttatgaaggcgagccctggtcccttccagttttagtcgatgtgccggagacaacaactcgatgtacatgtcgtcctggacacaaacagctcaagttcggtgcgtagccaatgaactcaatgagacacgtgttctcggcctatctcccacaactcacgactgttattaagagagggaagtaacgccccgcgtgttccgactctgcggcgtgttgaacatgtgttgtcggactctcgcatacccaccatgtatgacttagtgggcgttatatgcccgcgtgccgtgctgaccaactgtgcctgtcgtgtgctgctcaccccttactcttcctgaccctcgtatgtcgaggataatagacgatatggtaggtatcgtcgaactaatcgataggatcgttcatctctgcttgcgtcgagaggaatggacgatcggacccccgcgtcctaccataacagatacgctaacatcacgcacttttgtgtattcataccacaatggtcacttctacctcttcgntcttgacggtgagagtaaatgacgagtcgg

SEQ ID NO: 6845 - DNA, 1235 bp, Homo sapiens
  misc_feature (1)...(1235): n = A,T,C or G
ttntattcattgtaagtatagtatttatgagtaactcatgtcggagtgtaagatgatgaggnanggtaagatattaagaggatatgggangganagagtataaacgagccgcacggtggacggtacagtgacgttgcgagcgatagtatgtgtcgtgagggtatagagggcggggatgtccggtgccattagnggtagtggcagatangcgagtagcgtatagatgagtgtagacacgggtaatggcgggangacgtaggntagtcggtgaaggtggagtgatattgtgatgtataattaagcggcatcttgtgcagcggcgntgttgcagagttaatcaaatatatatttantatntncttctatctttctgcttgtatcacattacagttaatatcatctcttgtaactgtagcangnacanagaaatactacaataantaagacgtccgatcgngcgactccgcgagaggtttanggtgagatctgataagtctgaangtagcgagtatggataaagcanagtgaataaagagtatatnaacgaggagtgcgacacgcatgcactcggtggagtggcggtggcgtgnnagcctgtggacaggacagaggaaggcgcggccgcggtgtgacgtgagtgttgtcgagttcgacatgtncagagtgacgtaagaacggtgtatatctaagtttatgtangtngntncacatgtgaatcactattagtcttgctacacgtantactctcaagcatgttgtgacacattctagannccatgnacaatgcncgacggagagaataatgtgatnntataacatataatctacancctctcgtnncatananactctaatatacttnnncatactgatacaaacatcaatnaacactaatncatacaganaaactnacatcacgattccctancacactatataatatctataaacatanaactaactaacatttttacgtattataacgctaatattataacacatgactatactacgtatccactaataacntcnnatntanaacttntcctanacttaattnanaaaacttnnaatacatnnnaaccttntnaccgcccccttacnattatacaatcctaatcaattnncctnnncnnnccnnctctnnnncccagcncattnnnnnnnnccctnnnnnnnncctnnnctnacatttcacttcnnnnnncattcnnccccttnnnnnanncctcctc

SEQ ID NO: 6846 - DNA, 1016 bp, Homo sapiens
  misc_feature (1)...(1016): n = A,T,C or G
ctttacctccacatctagcccggctccgcgacagaccgtcgcgttgtaaagcttgagtcagcgcgtcaaatcaaagccgaaatataagaccaatatgagcctgtactaaaatattattaacacgccgcacacggccgacgaagttgagaaacacagataagaagaacgtagtaggacatcgcgcgacgcggactgatttgcgggcacaagaaaatatcaccactgtcgtcagacgcacgagtaacgacgaatattataaagtctatctccttcattccacaccacctcacacatcaatacgaacaccatatatatacaaacaacaacgtgcatattactagaagtaaataaagacgaatattaaattccgcgccagtatccatggaccgagacaacaatccagaacacaaatcagctataaagagatagatgttagaaaaatatatatggagacgtaaaaatatcactatacactacagaaaaagagaaaataaaggaaatggcggtagatagcagccgcgcacgggccctcactccctctggtcggccacgctaatgagagtagtgggcgctatcagaatgggtagcgctgtataaaataaagaaggggcgcgctgaagccgagcatagatttccctacatcacccctctcactacgcggggccacctccgcccacacaagtaatgttcgtgcagcgaagtagtgtcagcggtctagagaagttgcgaaaatcaacacaggccagtggttcgaaggggtatcgttacatagaagaaaataaataaagacgagcgaccctacacggaccatccgccgggccagtttcgggatgtttttccccttcccncgccccggcctcttcccggttgtctcctcgcgtgggtgccggtcctgtgcgcgncgcgggcccccccgctttaaatttttttttttctgtttctttcctagctccctcctctctcttctcttccaccccctcccactcctttcccccatccctannctttctattccc

SEQ ID NO: 6847 - DNA, 895 bp, Homo sapiens
  misc_feature (1)...(895): n = A,T,C or G
taatgatttaatgatggtggnnnnttgccacaacaacgagcccgggtttccacaagaaaggggcataaggcacacggttattgctttcgggaccttagggcagggacaaaaccagggatttgccccgggccccgggggtcctttcagggactaaaggggaagccccaccacggggtttttcacgccgatggggttgatcaagttggcttgggggtctccacaaaaaacacggaccacgggcacccgggaatttttcttagcttttgctttccactaaagacaccaagtttttttacggggggggggacaaaggagcgaaggccccacttgtttacaaaaatctcgtgtccacctcagcgctgnccttccccccctctcacttgggaaaacaactaagattttaaatagaatctaccccttatattacgggtggagatttacataagggggaggggggggcccgctctccgggatgctccgttgattataactatcacaaaaatgtcgcaaaaaaccacctcgccgttatgaatcactatctaaatgaagaagcgcggcccgtgtcccgtccccgcgaatatatggtctgtgtttcctggtttgtcacggtgaacagcagacagatatctctgaaatcgatcgtattgcaaaaagaacaacctggggtcgtcgagccgcaatttacacatccggctattaccgcgggcccttttgaacacagtgtccgtaatcaatctacgaggttcgtaagatgatcgtgtacacgcacttatctctctcgttctcttatgaacatgtgaatacgtagcgtctcctaatttgctacccacgaacatatacagttcttataaacaacacatgtgtctcacgatagcaagatgtaaaatacttcatc

SEQ ID NO: 6848 - DNA, 1401 bp, Homo sapiens
  misc_feature (1)...(1401): n = A,T,C or G
taacgatattnttntgtnnnnnnnnccagtcagcatgcaccagggaaatttagggacacaaagtcagcggagtacaaaaggaatttttgtttgttgttccgctgacataagggggggccgcgggtccctttccccggttatccccgggggctctgcgacagaaagccgacaaaaaggatagaaggacaggctaccaaaagacataattatattcattaccgcgtgtgggcgttgcgcacgccggttggcgacaggaacacactgacacactccctacggggcgggggcggagaagacatcggtccctcgcctatatccactccactccacagggcggagtggtgtataaatgttattcccagaggggggggggtacacatctataacgctgcggcaagtagagcatcatgagaccggttgtactctctatacatattggcgctgcgagatttaacccaccgccgaccacgaacgtgcgactagttgtgccgttctctcctcgcgtaggtaccttcttcgcnatcgcacacagctctttacttccaaccctnatccgtatgtatgtacatgcgtgtgcctacagtgtagatacgttatgagtattgctacaatacagactacgcgagctcacacantgtattcgcacgagcgtacacagtcgagaccccactctgtgtgcagtctggaaatattcgcacacagatcacacttcattgtaaagattgtcgcgtgcttagacccagacaatagctgtcaacatcacgacgtgacgtatgcgtcggntaagacatgtggcaactctctntgagatagtcatatacatacgcacggtacgcgtagtgtgtcttcgngcgacagctgtatgagatcgtacactatggctctcacagatgcgatccgcagctgtgcagatcggtgaataccacatctctggtcacgacattcaccaccgcgtacgcgcatgtagtgtgatgtagtatagtcgtctcatgctatgttgtgtgacaggctgtcacgcatgcacaagcattcaatatgctcatactattcccgagcagtgtcgaatataacacacgcctggcgcgcgtaatcctagacatgctactctcgagtactacgacaacgatcgacgagtgactcctgactgatgatcgcgtctccacgtatacagtgtgactgtactgacttacaactcgtgtagtctgtggcccgtcagtgtcagaggatncgtcaacgcactgccgcgactcactcgagtcacattgtgtctgccacatctgcacgacatctcgagtatgcgtagcgcggtgaaccgtgatcgcatcacgccagcacgcgtatgtgtgtccgcggcgctcacgatgtacgcgaanttgttatcacatntgacagtatactacg

SEQ ID NO: 6849 - DNA, 1002 bp, Homo sapiens
  misc_feature (1)...(1002): n = A,T,C or G
aaaagaatttttaagtgnnnnngggggannnnnnnnncccgggtttgcccaagaaaaagggaaaaagcccctggcgttggtcttgggacattgggaaggggcacaaacaatggttccacccggcccttggggtcttccccacttaaagggggacccccaaacaggggtttaaacacaaacggattgtttttttttttatttgtgtggaaatatattaaaaaaacccctgtacgagcgccctggttttttaactgggatatttgggacccccctctaaaaaattttttttgcggggggagaaacttttnattcgggggccccgaatcgtatattgagggggcgaacccccgtgtggggtttgttcgccccccgacactattttggtaaagggacccacaaaagaaaaagctctttttcttgcgcccctgaggaataaatatctcctctgtttccagggtaaaaagaagggttatgggttccggaacaagtgttttttgaaacttttgaaacccacacacaaatactttttttaatagagtgtagctgggctgccttttagagagagaaccttcattataaaaaagcactggtgttgttggtcttgccccttttaaactcccgcccgagggcattgtgatttatcatacacgaatagctataaaggaggggtggggacaagaataaccatcttttcttttttctcccgccacccctggtggccggttgggtattgattacgagtaagtgggggtgggtggtaatactagaagctgcctactcgcgtagtatgtttttaagttctgtttctgtagacggacggaccagccatgatggtcatgggtcctgtaatatcgacgggcccaagtaagtcgtttttctacatcaacttttatcctcgcttggacggcaagaaccgtctggcttgctataaaaatatatttttgttgtatatagaagcacatcgtgggcagtaaaaagggaaatagaagtatgctcgtctgt

SEQ ID NO: 6850 - DNA, 945 bp, Homo sapiens
atttttctttttttccacattaccttttattatttttcccccctgtgtttgtttttgtcccgtttttccctttttttcccccccccctcccgttccgtcccatttcatgtttcattgtcattaccaccccacttttctattgtctccctcccctcttttatttttgcaccattccggttggaccgtttatattaattatgtcacctgtccgtgtgattgtgcccgtgttgccccccatgtgttggacaattacccatccccacagtgtcactttcttacccctccacaattcacaatgccctcatttgttcgttgtttcgacgcgccacatcccgttatttactgtggtttctccccccgcgccctttgttttgtcccttttttccccccttttttttttttctcttgctgtctctaccctccccacccttgttctccccccctttttttcccccctttttccctttttcttcgttgcttcccccccccactttcagccccattgttggtatttacttttgtgtacattggcttgtcactacccccgcaaatgttccaatggtttgttgtttttattgttcccccccaattattggttagtatgaacacatttatgaatgttgtatcacctttccccatcccccatcgttttcccccccctttttctttctctcgtttatattccctgttgtcatctgctttccatatgcccacaatgtgattttttattccttacccgtccagtctacatgcagagtccgcatagtagtagattacggtcaggagtacacacataagtgtggtcacgctcatccttattacatgtcactttgggtaatacttactctctgaccctgtcctctcttgatcaaatgggcatacatgaacatcttatcaataagatataaatgacggagcccgtttttttttttccccccccccttt

SEQ ID NO: 6851 - DNA, 668 bp, Homo sapiens
acggtccacgctgatcctacggatgtataaaaagatcctaacagagaacccttcctttttttttttattgcctgcattgaagctttgtgaaccaacatgtgtttcctaaagggtgttgccacatgaattttttacttgccttccggtgggggtgaggacttaaatttggtgtatatggaaatcaagcctacctcattgttgccctctcgtatatagaaagagccgcacttcttcttcttagaaaatggaccgaccacttttgtgttttaatggtttcaaaaaaaggttgtgttaaacgtaaaattccccattttttttgggcataggccttcaaaggaaaattttgcggggtctatctatcccccacatggcgtaactaatcaaacctttctgttcacaaaaaataaaactatatttgttacgcaatctaaacttattaaaagaatttggagtttgttaccactcctcaggacaaaccgagggggtgggagtttacataagggcaagaaattattaagggtggggtacttgcaaaattctttcaaccctgggaggtctataatggcaagtggctcacatgttcacattttctcctaagccaaacaacaattagatgcgatgcacccgctccctttatatgggaatggctcctactctttaaattctcg

SEQ ID NO: 6852 - DNA, 1279 bp, Homo sapiens
  misc_feature (1)...(1279): n = A,T,C or G
cttattacatgctatttcactcacatacctcggatcctctattctacgacgaaactcggcttgctatcgttttactttaaaagtctatttataccgcatcacagatattgcgctcgacgaattaccaatcggtagcgcaagatcgttcggccgcgttacgtacactatcacaccatacgtaacctccgtcaatagacgatcgtgccggaagaagcaggatggcactactcagaaccatggaatgacgaagtcgaaacagtgtagtatntcatatactacacttctctgtggcagataatcaagttcgtacctctcgccgcgccgcgtatcgtcctatattttacgcccgcattaaagtaccactgccggttctctcttctcccgacgtgttgaacgcagagcaaagcaagcggcctgactctcaattagagctaatctgcaaactgacccgcgcgcagcccgcgttccatcttggtaatatactatattacacgccgtctcttctatttcatataaccccacctcacccgctccgcttcatattattcccctctttgccctccccgccctcttatacttatcgatactatccactatcataccatacaccaatatgtatcctccgccgccgccccctacgtttctgtttcgctgacgcagtttaccctccgctcgccgcaccctaatcatccgcacctttcgcatcattagaatcctccatacaccacgagacatcccatacgaatttaccaccgtacatacgcgcccacttcacacggatgatacggacacccggcgcgngctcactctttagcaccgaatttacgtcgaggcaccccacaagatcgcatatcacatataccctttcgcccagccgcgccggttatcccttgctgtcgtcgtgccacgccgcgtatcgtcagccacgactttcatcttttatatattatgtatatatcgatccatcgcgttcatcagtatagtatccagacatacaagcatcatcatgctcgatgttctactctgcatacatctaatatctccgctaacctgtcgtcatttcgagagtaatctgatcaccgctattctccggcgcgctattatccgctctacgcttcctcgctctagtgcataattcccagcgctagtcagtngacgnctgtcatgctgtagtctgatatgcttgcgcgacgtcgtagatctcgttcgatctcctcagctagaggtacgcctgcntagacgtctgcacggtcgagctgtgtctaacgcaccgtacgcg

SEQ ID NO: 6853 - DNA, 1466 bp, Homo sapiens
  misc_feature (1)...(1466): n = A,T,C or G
gggctccttggggggcncggggnngcctcccggccgcctctccggcgttcggggggtatttctcttttgtgcgccatttgtgcgcgcgttgttgtatccacgcgacacttatctcgacccgccgcggccccgagttttttaatgcgttgtttcacgagccgtattggtctgacgggagtggagggggaaaaaagaaaggaaagtgcgagttaggtttntataagcaaagaaaaacaaaattcaacgcgcctcattttccgccggcgggccgccgggcgatggtttgttggcggaggggagagttctcgtagaggagaggtaggagggctaggacgtggactgtctctagtgagggtcaggatcgcgatcgcagaaagggcggttgttgcagatttgttgattccatccgcatgtggtttaggatatatagagtatataagagaggagcgacccgacacacattccaagagcaaggtttgaaatggagtgtgagagtgttagtgacgtcgcgatggcaatcctcgtatcgagtgcggcagttcgcaggcatagcgtcagtacgcgtacgcagtcatggaccaatgtgatgtcgtgtcagcggtgcaggtcgggagagtttgtcgggagtagagtatggttgggagtcggctcgtgattccacaggtgagtgtagagagagtgagtggccgcaggaatgtacacagcacgcaggacatgaacgtgaacagatgaagctcggacggcgaaacagcaagtcacggcgtaaccacagaacaggccgatggatagaaaagagggacaggtattgaggataaccagacgatgagcagagcagatacaccaatcgcatcgcaacggtgttgagagcagggacataaatcacatcagttgataggtgtcggtctcatacacacctaagatgcggtagtattgcggtgtaagtggtcgacacnacgcacattaacacaatttgctgtagacaccaaccgcacacaagtagacggatgtaagcactcatacatcacgcttgcgtatgagacatgaatatagcatactgacgaatattagggacgactagtctatcggtcgatataagaacgcagcgacgatcagttgtataccgggcaacaccattatatagcgtcggtggttggtcgatgtagacgagcgtctcgagtcaagcacaacagtcagccaacgagtggagtaggaggagtaccgacagaagcgcaggcacacgaacacanagacatagtgatagagacgatagcacaccgccatctatatnattcgagtagaagtgagatntcgtacacaccnagcacgtgaggataatactttacaacgcgcacgaggactgccgatgagtctctcggcggatgctgtttcatgtccgcacacaccacgcttagatttctgtgtacgctcgactgcagtcggtgcgtgtgcgtgtcgcgcntcagagg

SEQ ID NO: 6854 - DNA, 880 bp, Homo sapiens
cattatgaataaatgtgacccggagtgtttttatatcatgttcaactttactgccctgatctttatataccacctaacagcgttcaggggtttgatttgcgcaaatgtaggagaggtaaaacaacataagtgcacatccttttttaaggggtgattttttgttttcagagcagcgcggggggggggtttgacagttatgcaggcactttaatgtggaaatgtcttgattctttcaaagaaaacatttgacattttactttgcaagtggacgtcagagttgaagtatgttcttctgtgccggacagagacttcaagatcctcccaccagacacattggcatggaaaaatttttgtgactctccacactattgggaaacctgattccacaggataggaaagctcttcagtatgtggtccctgagaaattcatacaacaccttttaccacacttgacttcaagcaatccaatatatatatgtgtgtttttctcttgtagtagcctacattttacatgccagactctgcccagttcagctcatatcctggccttgttactgcctacaagaacttgcctctccctgcatttcagatttgatgtttttcttaaaacttcaagtatttaaagtatttttaaaactttgcaaaatcccattttctctgtttacctgatattgttgatgttgttattgtaaaaagtaagtagaatatattcctcatctatgtacgtttcaaaactgagttgcagctttttttggtaagacccagagtcataaaagactgcaaatactgttaagctgcttaacagaaaaacaaatgctggtaaatgtgttcactggaatactacccgtcatttaaaataaataaatgctgatcggccagc

SEQ ID NO: 6855 - DNA, 792 bp, Homo sapiens
gtgccaggcaggacttgatttttcccaaccatttccatcagacagaggatctgacaaaccagaccagcacacttctggccttagaagcagacctggatattcaaagaagttcaagagaagttatgtggcttatccaaatcacacaccaggacagcaattcatagagcactaattagcaagagaatggaaggtcactgtgaagccgaatgtcttacctttgaagtaaagattgggggctgtagagctgaattagcaccattttgctgctaaaactgaaagaaacattacaaactaagcaccagctgcgagaggcaaagaggtgaacattctctggctgcgatatcagtgggataaatctccctggaccatctctattcgatctggaaaggtaggattatccgaagccatgctgtcccgttcccattgtatcaaggacataccctttctaggctggggaccttcttccaagcatacactatatcttgttgacctttgcacttctaagatgctagaccacggtcttattcacgatttttattagtttaatcaacgggcagcatctggattctatattacccccggttgataggaatagtctagacttgccccaccgccatatcgattttgaagacggttgctccctttttaacacgccggataccgccgattcctcccgtattgaatcaattgtctgacaattgaaatgtggtgctctcaagtataatgcacaaccgtgcgattttaccgggccaggtttctcaatcggctcgcaagacttgctgtcatatattg

SEQ ID NO: 6856 - DNA, 883 bp, Homo sapiens
ttttggcagaatatggttaggatgtacagagtgcctctcgggaacggaaaccgggaagggttaatgcagcggttaacaagaagcggttcatatacctttatctctttaagggaggaactgtaaaatgttgatcaggtcagggtggtataagcacaaagtttagaataaatgcccccgcgcgggggtggattgtataagcttgagcaaattttcttagggccattcaagtaagaatgaataaatcaaggttttttaagcagtaagttccccaaaggcatggaagtcagggcccttataaccatgaggcagagtggactgtaagaagattaatcagttactgactaagtcacatttatatcccaacttcgggctttctggactggtctgcttagcatgtccacaaaatagcaaggctggaagataatagaacaacaaaaggcagtcctaaagatggaacgtttctcagcgggttcaggtgaacagttaaatggaggaagaaattgaaacaaactgaaaaaaaagaaaccatagaaagaaaaaaagacactttctaagaatctcttttgtaatcctgcaaaccctgccctttcagagcataacaatggcaaactgaggcttaccttttccctaatttgccaaaatttggagtcccagctttccagcagaagaaagcatatatcacagaccatttcatcgtagaagatttatagtacaccatcccagaacagaagaagtaaaatccctctgcgctgctctagaaaatgtccttctctattcagttaagctggcttcctgtagagatgtaaataaaagaggaaaaaaaatctggaacaagacaacgtgtaaaatgttttaaaataaaaaataaaatgtgatcggcaag

SEQ ID NO: 6857 - DNA, 1558 bp, Homo sapiens
  misc_feature (1)...(1558): n = A,T,C or G
tatatacgaccacagnacgcgtacgtgcgtgtgtcagancccagcgcgtgtcgtcacgacgagtatcgagtcgatagatatgtatatatgagtgacacacagctaagntgcctatgtgacgtccgnacgaggaacnantatgtatgcgatcagcgtgctataatatatgagtgcgngcanatacgtagagtatgtagtcactgctatatctcatgantgagttgcgtgactgcgactnacgtgcgtcgttacacacgatcagcgctgcgccatgtgactacgaantntagactgactcangtacgctgcatcgcagtacagtnacgtacatcgtgcgaactacgcgctgcgctanctcgcgngtcgtctcagtgtgaccgcgcatatcnctcgtagtcacacacctgtacagttacgtacagtagtnanctacatacgctatcactacacactaagtgtacatangataagcactgantacgntactaccnctattgctantcgacatacttacaactcgtcagccctagcacacnatatgtngacntnncactactagtatgatacgtcgctacatgcgtctaactacaaacgctttcatctaatgacacacatgaaagaatatgtcgacgactctatcagtatacacacgatatcgcanatatatcgntacataaccgtactcgtgtgcgcgtcgacacggcgacgtcanctacatnagacatacatcgctacatatctgcaactctcgtcctgcgtagtatctgtatcgtctcnggtgctcttgtattcgttctatgcactctctaggcatcctctacacgtatctcgccctctatatatatacacctctcaatcgtagacacaaacggcgggtacacctactcgaatacacacacaataanaatgtgcctaaaaactctatcattcacgccatatanaacatgtcgaaaaatgactctctantactacaagtaaagtcgccagcgggtcggcacgtgctgattctcatctaattatacaacctagctcggtatagtagagagcgagaggatgagagagtcagagagactcattacgatcatgtcaacactcactctcgactgaacacacaaagtcacgcatatataaagattagatagaggctgtcgactcgtcgtcattcatcctagcataccatataagaaagcaacggcgtcgcagtggcgcgnanagcgcgaggcgcgcacaggacacgcgccagtggagtcgctgccgcatgcggctccgcacttacagcgcatacaagaactctcactngttcctcccgcgtcgtctctccgctctgctctcgccgattcgtttgagtactagctntctccggccagggctcatcgcgttntnnacactcacctnctcgncccacngcaccaacaganagacgaggacgaatacaacaatnactcanattatatctataacaattaaaaacaaagaactanacacnaatcanaaccncaggcgtncacttcttttttttaaaacacttcgtatctcttatcgttatatgctgtgaagg

SEQ ID NO: 6858 - DNA, 1198 bp, Homo sapiens
  misc_feature (1)...(1198): n = A,T,C or G
ggagttggtgagagatggagcagtgggacaagcgattatacacagatagctgagatgcaacggacacgtcgatacatatatcaactacatccatacgctactggtgcggagtttatatgcttgttattcactcccgttattggatatattagtgagagaaatcaagtatcgagcaactgataattaaagagatcacggactacacgtcaacacaaaacaccatctaccgcccaccaactacaaaaccaccggacggaagaagaaagagtatagcacgacttatccgtgtcgtacggtggcgtcgccgcccgcgcggcaaatagatggcataccagcgtcacatctagcgcctcgatacgcatcgttnttacaacgtcataattagacgcacattattcgtatatgtggcctggatgtacagcatatagtgtgcagaattaagcgctggtccattggtgacagaatacatttggaaatgtggagatcggggaagtgaacacataggcgctacaaaagatanagtcgagtgtcttcacgcatctgctacatcgtggagctaaggcagtggcacgtgaatcatttgtgtatcgatcgtcggagtgatggtgacaatacccaagagatcgcacgatatatacaactgcagactccacgtctactaaccgcttaccgcgactcatttggaggtactggcgacactataccaccatgtagcagagacgcgacgcgtcactatctacgcgtgagctcgtatgatatagagacggtatcgtcgtgagtaacggcgcagtgactacggtattggtgtgtcacatatccataaataaagagtggacatatccgctgaaagaggtcgcgaagccagctacgtagcgtccacgacagacacaccgatcacaaggaatatgtgtgcacatgtantgactctaggacgtataataaacagggatcgcaaagtgcagagacaataggcgaacatggtgtctgtggggtgcgatagcagcaatttagtcatgagtagagcctgtgcctgatgctccctgcggacgcacatgaggtggtgtagacatttaatgtgacgccgaaggagagnatctgagtaggtagctttcctctattgggtgagcggacgcgccataagatgatgctcgtatggtagtnggagtatatgcggtcagaacgtaggtaggatcgaccg

SEQ ID NO: 6859 - DNA, 786 bp, Homo sapiens
gatgcttactaccgccttgcgggatctataccagggggcgtatccagtgattgttctgggattataagcctaccacagctaaagggaatccgcacgctgtgcttttatcgcaacagtctagaacttaagccgttgcgacactttaaatataccaccggtctgactatgggagaaaactgccaatcagcccccttgtatattcctttaatgataatgcctgacgaagttcccattggaattttattcacaaaaactatttccagtatcttattaaaaaaatgggctaaggaatgcgttactctgactgcaactttggacacgccgggctgatgtttatgaagaatctaaggtgtaattgtaaaggctgaatgggctccctgctctataacctgaggtgctctgaaacacttgtcaaaaacagagatctaactcaaattgctatatatctacacaagattcccagaatcttgtttacaaaggactatgtctggctggcaaaaaacggacacttgaccagactgtcaaacgctgattctttcaaaaactaacgtttcgtaaataaaagatatctgtgcacaatgtttatttttctgtccaccaaggcggaaagagaactaaaacctgggccacagaacctttgattaacagaggtgctgttttggagaaatcgcattttactaatatgggaaggttgccttttttcgaaacgcgaattttgggcttttgaaacaaacttgagaaacttgggaaatttagagaatgggaaaaaaccttcttttcaaaaat

SEQ ID NO: 6860 - DNA, 1927 bp, Homo sapiens
  misc_feature (1)...(1927): n = A,T,C or G
cacacattaatagttaattgttgtgttgcatatgtatatgtcgtcngtgtaggagatgcaatagaacgcgtcattctctataatctgnggatagagcgngactatctgactaagagatgtaatacacggcancgtcgtgagcatganagcaggcggtgtggagagagcgtgcaggttgnctgctgatgtcgatcccgacagagtcgcctagagcagcgatagaggcagatgcgtcgccgtattgacacgcggagtgtcgctgaggatgcgccacatcttgcatctatgagacttcccatccgtctacgcttcactctattagactctcttctgtcgtgtcgacatatgcacgagtgaacngaantaatatgatgacgagcagagcaccgatcagtcagcnanctatacgtggtcgtgagcgtatgtctcgntgcaatgactcgcctctatctatcgatnctacgattagtgactgagcgtatggtgtaagattagactcgttcctagtgttgaggcnacnctgtcgtagcaatccgcatgacgacgcgccgcgnctaacgtcaccgcatgcgacnctcacgatatctcacctagcgatcgccgcacgtgtgagtngtcntctcgtagactgcganacgacntgcatgacttcacatgtgcggagaggctgcagnangtgtacatatatgagcgatngtgtagcattacctgactcataatctctctctattacgatcaagtctagcnctctctcgtatgtgacgacatagacgatcgcgtcgtagcgcagnacgacgtctagcgcntacgatggacgcgtcgcatctgacttgcagtatcgactcatcgctccttgntcacacgtacacntctactcacatgcggatgctcncgactgatacgctgntcagcatgatntgntgcatcacnancgcnggccgcgagtactgcgacgcatactacnangactgncgcnatgtcacgcgtctgagcgtcactctcgcactgcctcatacagtctgtattacactcgcgcatcgcagtcgttggtatcgcgactgctctggntgacgcntncgtgagatacgacatagctgncgtcgcgtgtantcatgcagactaagtaagtgtgcgatagacgtgntgaggacgatgtgactgtatgcncncgatctagtcgacgcatcgacgaacgtctanataacgtacctctcgtacttacgtatgtacgntgtagtaatatgctgcatatgagatgcngacgactcagcgcgtgacgggctcagatagagagtngcatgcatgctcgtcaatcgattgtgctntgnctagatatgcgcngctcacatcactacgatgcgctgctataatcatacgactgcgctgcctcatgcncatgatcntcncgtatantcgtctcagtgtagtgtgacatctctattacggatacgcngctgcgagcgacaaagcagcgacgaccntgcagtcatctgctcactgacatgaatacgtacgngnctgcacgtgcanacatnagcatgtatgtcgtcctangatcagagactcacgtcacatcctctctattcatcgcncgcgcgtagnatctgttgantctcatacacagattaaagcatcgtgagcgtagttctcgcactagtgagtagatcgacggtcgttgtctgtgtgtatatgtctatagagagtacatgtgtantatatctgtcatgctagtgcatgnatgcgtgacaatgaatgtcattcgtcgnctcctgtgtgctgagcttgtgtataccagcgtngcgtagatactcgatatgtagatgcttcatatcggtgtctcgtntgntctgctaatgcncgagagtgtatctctagatctgtctgatgacgatgtgtntcactgtgtacaccacacagcatgtgtgat

SEQ ID NO: 6861 - DNA, 1469 bp, Homo sapiens
  misc_feature (1)...(1469): n = A,T,C or G
taaatttatgtagctgatattttncttttgccaacaccccgaaatcgtagtttaccacaagacatttctccacaagggccacgatggtggtttgttcggactctgagcggcacctccattagggtggtttcaagagggtctgcgtaggtgttcacatgaatattaatgggtcatacttcaaccttccgagaacataaaaaggagaacgctagttgtgttaaatatcgcgttcatcatggacataaattacacaattagtaatatctagtcntgaatatttgagtcacctcttcttgctctaagcgcacgtgcgtcctgttatcgctcgccgcgtgcacagaactgagtcaccgcatgtatatatataacggggtgggcgagagtactgctctgataccgcatactcctcctcatccaatatttttaaatggtctctctatgacggtatctttgggtgatcacagatcgtcactccccactccagcttcgtctgtgattagtgtgtctgttgatagtctcattgtatactactcgttgatgtatactgcgactacctatgattcagagcgtatccaagtacctgatggtattctatatcaacgccccatatatgtatagacattttcgccgcgtgtagatgtctgtaattcgagccgctcaataatatgacacacaccggccggcgcgcactcgtcgtatttaatactaaaattatgtggaccgatagtgtacgagtaacttacttcagtcctctatatgaatcttacaatcaaatcattaacgctgtagtatgtcgctatcaaacgctgtaagtacccctgtctctggtatataagctgcggctttctctctcgcactcgtcgctcatatgctattagctgtgactacttcgtcaccagacgaacctaacacatgtgtctgccgtctcaattatngtatatgtgtatcgtacgtgtataagatgtctcgatggattataacacagaccagctccgatactatgtatactactgatgcgatgctagactgtatgtctatgttcgctagcagtgatgtcacgtttncgaacatntatgttgagacatgtcttgattgctgtaggagcgcgcgtgagagctgcacgagtcgcagtctcgctcgatctcgagcgantattactattacatatatcgctactcacacnatcttacatatcgtgactctcagctancactcactacagcatagctctcntgtgattgcgtgtatatgtgtaacgcgataatcagantgatttgactcgcactcacntcgctgcgcgcntatgtatataaactantctgagacgctcgcatgtatccgtcattattatattatgagtgtgactatctgtgattggccatagccagtgagacggtctagatgctngtaccaggtatacgcagtgctctacacgcatacgaatacttgtntacgctacntcatcanct

SEQ ID NO: 6862 - DNA, 338 bp, Homo sapiens
cttctctttttcgcaaaatttttacttcacaggaacccccccgcaagggggttgtgttagagagcccaccaccacaccacaaaaaaacaattattttttttttccggcccaccattgcgcagggcccccctacgacggagcggaaaccaaagaggggcgatattgttaccttggggggggggcacggcccaccctccccccccacaaagagaatgttcacaggtcccattgacgcaatagaaatgagacgccctcaaaaatgtgttttaagaaagccaatcgccaaacatcccccgtgggtatacccagtcaatttatttggccatagggcccttttc

SEQ ID NO: 6863 - DNA, 683 bp, Homo sapiens
ctgtgtgggggtttatgcgtggcgcggtagctgcgcgccttggggagccctgaacctggtggtcagtgcctgtgcgtctgactcccccgatttcgcttgggctgatgagggagtgtgtttttcgcctgtgttctgcctgggaggtgggagcgggcctagcggagtagggtggggctgttaggggcgggtgcggaggaagacggggagcggggtatgagggcgcggccggtgggccgcgtttccctgcccctggtgtgcgcgtgtggggtcttgtcagtgcgtttctccgcgcggaaggggtgggggggtcgggcggggtggggggggggggttggttgggggtgggggtgtgtgggtggggtcgaggcggggcggcgagcgcccgcgggcgagggggccctggggggcaggctgggccgtcccgggggggggggggctgggtgggcacgcgcccggacgcgagggctcactgacgggagcgggcgacctcaaggcctgatacaaaaggcgagaatttaaagcaataaaaaaacgaagaaggctttttttttaaagggaaaggtttttttccgccccccaagccggttaaaaatgtagcgttttttttatcccccaattttttttttcgcccccgggggggggtccctgtaggtttcaggcctttaaaaaatcccgttcccctt

SEQ ID NO: 6864 - DNA, 1623 bp, Homo sapiens
  misc_feature (1)...(1623): n = A,T,C or G
gctttatactgtagagtcanagctgtacagtggagngcgnngnnggnncgnnnctctgcacacgatcacaggacactctccagactgtacacagctgtgttgttatacgcgtacgaacagtatagaacacgtgcgtcgtcggtgataatgactgatccagtctcatagaggtcgtaagtagtantgtacttanagtgtganacataatctcgtgtggangacatatgctcggacgacgcnactantntactgcgactngtaaatatttcatagcgatggcgcttcgctatctgngagtgnctctctccttcgcagatcacttcttacgagatgngcngcgcatgtgtgccacacgactgacacaccacacgcctgagtncanangaactacaacacagctggtgantgtgnttntcatgtactacccgcagctgcgtcctttgctcaacgatatagtantacacaatgacagtatgactcgtgtgtggggctcatccgcgctgtcacgcgccgtgctggtgtgctagtcgcgtcgagtagcagtagaagcggcggacgccaacttacataataaatagaataggcgcantggaattatgtatatgttattgagaggtgatgcggataagacgatctacgtgaagnccgcgtcacatcacacatcgacgtctgcgtcattcatcagcgtgtacacgagtacagtacanctgtactacacaggcgcttatcgatgatgtcatcatgcgccatcacgccatatcagacgacncatggtatatgtgtaatacaacactaagatcgcgtagaggagtacgacaatgagactgttctctactcgacattacgtgtgtagtatgatntncgtgttgcgctaccatatacgccacctcaactgacactatgtgttcctcaatagattatccgtctagtgatcaggaacaccgttagtattacacaccgaaactcttgtgcacgagatatctatctgcgctctgcgactgcacgcacgcacggcgacgagttgtagttagcacttattaggcacctgtagatcagatcaccttagatttgaaccgtgcataatttccgacttcgtgagcctgatcgctgcatccagactngcattgcacgtggttcattcgctgatgagctctccgcaaccccgtctaccgagtccgtctgagtcttgttgatatacacctcctacgatcatcaagtgctctctactacgcgtgtcttcttatgtatgatttacgctgccgtgtattatacatcggttgtagacggtatatagatcgagtgcgaccagatcgcctcgcatgtttctcgcgctgcacatacgcgtcggtgcagtagacacanttctcgactcaatcttatctgtcgtgatgccgcatanactattcgacagtanactcacgtagtctatgcgtggtgtcgcgatatcatattagctctgtccgcgatgcattcacaacgacagtacagatcatcgcgttgttgatataagcactctacaccggagacggatatatgtagtttgtgctatatatcgtagcaaccacnacgaacactgattacgttagttacgttatcgagactatatantatgttttgtataca

SEQ ID NO: 6865 - DNA, 1628 bp, Homo sapiens
  misc_feature (1)...(1628): n = A,T,C or G
atgatttggcctgtaggatcgtgttgtgtgtctctantcgccacaactcgtcacccnaaccagccggtgttttctgtcgcagacaccgacacgcgcgtgttaaaagtgtgagccacgngcgcagttcttgctattattatactaatcgtgcgcgccggcactgataaaggacgtgttagtaccgcgggcgctcacgtgacgccctgcgccacacgtcttagcgggcggcgtagtccccaccgacaccagtcggcgttcgtattcaatataaccgatgctggtactgcacattttgcgcaggtgcgtacgtgagagatgtaatcagtacacgagnatagacgagacagtatgcgtactcggcngcgccgtatcgcgtgcgctgagacgtccaccatgcagatcagtgtcactgccatcgcgcgttgcgtagcatacgcagtccaagacaatctactgttctctgaggcgacgacgcgtacatcgtctagcgtcgatgcgcgcngcatacggacagcacgctgtcagtaatagcgaggtgagtgacatgtaccacagaanctcgctcacatcactatgcgctccacgctcctccatccataactctactaccttcactcgcttcgccgagcagcgcccgtggagctgctccgttagtancatgtgtgattatcantatcatagagggctgcacactagctatgnagtcactaccgctgacgcacctgcagctctagatgatcggattcgtgagagcgaccgntccaaacgagacatgacagcatcttctatacctcaccacacgncgtagcgagtgccgacaccgcgtagtctatgcgctcgcatgcancgcacgtacatcgagatgatggtgatattcacagtcgtgagcnacgtagaccgccgcgttatagtgctnatacgcgtcagctgtccagttcntgnagccatgctctgccngtacttcgcgtagtgngctgtcngctgatatactacaactangcacgcantcccgacagtacntatgactcgtcgtatangatgcagtgtgtatcgctgcgctcactgacacacncgaantntatctccntatcgcgcataaacacttcgacaccgacgattgacgctccgtcgnatacgtctcgatcgtcactcgtgtcgtcgtaacgcgatgcgtgtaccagcgcagagacggttgtanatcatgtgcgtcgacagacgtatgagancgctccaggatcctctcatggaggtagtaagttgcgctcgcttctcccgtcgatactcatcgctcgcgcnactcgagtagctctatgacgccctctctcgacgatatgtactgagcgnaagtgtgccttcngataacgttgacatcgttacgnctgcgactgcgtctgatantatacgctatcacggcgagacgncttcactgacntatcacgctgcgcaccacgactattcgcngnacgagtgtctctatagtngtacgactncgcgaacgatcgttcgatctgtactgtgagtgtagtgctaggaccgngcagcgcatcacgcagtantctncgcatactcgagtatataccntgtngcantctgtcnagcgantgtcancgtcgtctgcgcgatcaacg

SEQ ID NO: 6866 - DNA, 1547 bp, Homo sapiens
  misc_feature (1)...(1547): n = A,T,C or G
atgncanttcctccacacgccacactctctcacntacctctctacgtcgcacactagttgntgatcgtagtacgacgcgatctgtagntgaagcttcgcatgtatgaggacgacgtcgaatgtagacgntcgnatagnttatantactatacactctactcgcgctcggtngctacatttcgtgtctttctcacactaatatcaatgctgtcacggcatagatctgcgacgagtacantctgatcgggtcgatatctatgtgtctgtgtctatgcgctgactacantgtcgtgggtgtcngcgactctcgcgcnctcacctcgtcgatgcttcaccacagtatacacatgctagcgccggtccgtgttgtcaggtcttacaagttggctgagtgatggtgggcggatctccgccggtcctgctgacgtctcactagaccactcggtccgtggtccagtatctttctaaatctaatatcgagatatacttaaatctgcaagcctctcgacgataantgtccgcatgtactatatagcacacatatatagatcgtgtcggatcgtgggccgtcggtgaacgcggtcgctaattgtnacatcgtcaaggctatcgagggttgaactatgttggccctcctttcgngtctgcgccatccagacacgtagagacggtccgggtcctccatctgttctttgtatatcgcattaggcggcgtcagcagccgacatgtgcgcntgcctacgaccgtgatctcgttgccagatgcgcgtgactgagtagttgngcttcggttagtgatatccgnggagagtgagctgtccttgtgatcggtctggcacttgacgtcccacttcaggcccgctctattgccgcgtcacnattctcactattcaatcaacaccatnantatgtatcaatgagtgtaatataaatacattctatctccctctgcnagatacaaccacccgntcgtcttcntctacactcgctgtcgccgcgcgtccgcgcgccgcgcccagcgtcgtatatgcgttgggctgtgggcgggtggagganggcgggccgccgcggtcgctgcgacgcggcgtgtcttgtgnagtgtatggtgggagcgcatgcgggtacggcgtgccgcgtcccgtgcgccgctggtgcgtgcctgtgtgtngtcgatgtcgagcatctgtgtgacggagtgtgagagttacttgtctttatattaatgatgagtatgtagattgtattcatacgcgacccgcgtccacgangnactgttgatcgctgatacgtgaagcgtcgcttcttctctctcgcgagctaatctgtcctcccgtcagattctcgcatgcgctccagcgtggcgtttagttgtntttaggtgangggggttaagtacgatactctcagagaaaaatatgcgcttggtgtntgttctctctctcctctttagctctgcctctctctctctgtatctctctatctattctcctaccttctgcaacgtaacttaccttaccccccacccccatcactatatatatcttcct

SEQ ID NO: 6867 - DNA, 844 bp, Homo sapiens
gtgtttgtgatatggcacatgaacccccactgtaaacccacacaattgttcttgaacgcccttggaataaccaacgggtgaatcccgataactttttggccaaaaggcccctctcccgttaaatgttacgccagtaaggggttctccaccaccgtttcggacttaagccccagtgctttcctcattaacccccctccaaataggaagtttctttttgttttcacaatggagtttccagtagaaaaaatggagcccatttttaaagaggagagaccatgagagcttgcatccagtggttccagctgggagccctagtctcagcaagaaggaagccactatatttttgattcaagtagaagaaggagaagacagatgaagatccagataattttgatatggagggaagtttaggcaactcatgtcagatggtcccaaccttctcagcaaggagagttcatctgttgagagtttcaggaaagaaggtgtggatgttgctggagaatgcctagataagtcactgtggaaaatgccattctccatttctgtctgtttggcaaaccccaataatcctccaggactcagatcaaacaacatctcctgtaccctcccaagttctcagacagagttgggagctctgttccctgcacttgtttttctattaccttattagtcatatcgtattataattcttttcgtttctgtctctcttttcctcttgcctgaaatccttgagggtggagaccatattttactcatcttaatttctccaactctaatctggtacaaaatgatattcaggaaatgtgtgttgaatgcataaataaataaactccgaatgcgccca

SEQ ID NO: 6868 - DNA, 901 bp, Homo sapiens
ttgcaccaaaacacctacgaggctaaatagccacgccgttgagtatcgcgtccaaacgattcaaacccttaccacaggtgattgtattcggtatgcgcaggctaagaattgaaaggaggccggcgagggggattgacactttgggatggtcctcgacctatccgccagaggagtacctgcatcccaattcggttcgaagagcgagtccaagtctgtgccagaaatagaaagatacaaaggtccggctcatcaaaatccacccgggtcgagacaattgaaagaaaatgaattcagcacaggtgagaaccaatatctgggaataaaaaattagatttcggtatccccaatcccacaatatattgcccattcctgagagataagaagagggcataagccgcctttaagaaaatatatttgaggatgtagtccaccagacattccctaactacggtaaataagttgaggcgcaaatccaaagaaatcaaaagaactgcagtgagatactatccaagatgcccatccccaaggcacatagccatcagattttaaaaagtcaatggaagagaaagaatcgaaagacagctagagagaagtgtcacctacagagggaacctaatcaggctggcagtagacctctcagcagaacccctacaaggaagaagagaaaggggacctattttcattgtcctataaaaataaaatacaaccaagaattttatatccttccaaactaagtttcataagtgaaggagaaacaccgttcttctcagacagaaaaatgctgagggaatacaatccaaacagacaagccttacaagagatcctaaaagaagttctaaacatagaattgaaagaacaacatcggtctacacaacaaaacaacaaaacgagttccgccaag

SEQ ID NO: 6869 - DNA, 852 bp, Homo sapiens
cacacgcccctaggcggcgtcctatggggtgaatgagcaaatacccccgctcgctagcccacaatggttttattgaaccctggggacataccacgtggaaataccggggattttttggccaaagcggcctatcaaagttaaatcgcggcgcgagtaagggttttaccacacggtttcggaattaaggcgaaggcctctttaaaattgaagtttatttaaaaaatacccttgggggtcacaaacaccccattttttttgcccactgaagttaactacccattaatataaatcataccccccagagtgaacaaaaagatgtggattaaagtccaaagcaaaatgttaaacatcggatgcatttcgagaacaaatgtcccttgttttgcaagccctactatacccacctacctaggtaagagtgagagcatcttgcttgacatcttgtcgagtatgtgtcagaatcagagccaaaacctccactgtctttccaagacccatctcatctgctaaaattccaccaagcaactgcggcccagaatttgggtactcacgaatgatgctgaggaaaaaaacaagataaatcacatcataggaatgtgaatacaaattacaatgttcctaattacttttcctaaagagaactggaagcaatgcataaagcctaagtttattgaaactatattttagggcaaagcaattcaaaccttagattacaaacactagaactgtgataaccaaaaaaactgcctgagctgacaagtaactctgcagaaatgagtggtagttaaaagagaacacgtctgccttctttctatgacctttatgaatctatgaataaaaaatgatcggcca

SEQ ID NO: 6870 - DNA, 1244 bp, Homo sapiens
  misc_feature (1)...(1244): n = A,T,C or G
actcgattggtgttgctgtatgtcacgatccttgcgcggtgctctacgctcgcactgactgcagcacagcagaacaggcactatgccgatcgcgatggactcggcgcgctgagcgtcggcggcgcgtactcttcgtgacanttcgntatactccacttcgatcgtccactattcagctagtcgctgacgtacttcgctcagctgtgactacaccagagagatctcatatctgtaatacagtaccgcggagcgggtgagtgtggtgttaataacatgacgaaatgtagggaagaaacaggtgtgttcctggcgacttctgagtgggncctctggtgaccatatctggacagcttgcacgactcagttgtacgtctgtctctcttgtctcgaaacgtcatctcacaatgtatagaattcatatcacatngtcggagcgcgtatcttcatcgagaaatatggagagaatattgnggcggatatcggcttcctaaccatgtccacgtagggtaccaatcgctcttcgcttggcttattgcctctgatctatatgtgtcttagcagtaatgaggctgctacactatgtgcggtaagtcgtgcgcatgacgacatcgcgacggtggcgattcgtgaatacggtctcgacctctcgaccgtctcatncgcataacccaagctcgaggccatatgctttattcttatagacgttgaagttgccagatctctgctatccaggcactcacacctcatatacgtatgagcatctttatataactgcgacgacatntgaagcgggaagcgacctgtcattgtcgtcgtctcgaggaaaatggcacgaggggggtgtgtactatgctaccctggagggtagtagtggtggtgtgcagccgagagttatgcatgactaattaagaaataatgagatagtatatagtaattgtcagcaggagacatcaagtgtgttagatgatctttcagacgctcttactagatcagatacaaattcgacgacaactgtcatcgaacgtaaatatatgattgagagaggaatggggcgtgttggagatacggtgggttgacttgataaagagcgacgcgagagttgctaagatgagaaagacgcgctaatgggtggtaaagtatttattatttgtccgaccacggggcgtctatataatgatattagaacataggacgggttgcaggagcgaaataaggaaaatgagctactccggtactctgtaatc

SEQ ID NO: 6871 - DNA, 123 bp, Homo sapiens; identical to SEQ ID NO: 4101

SEQ ID NO: 6872 - DNA, 934 bp, Homo sapiens
  misc_feature (1)...(934): n = A,T,C or G
agtaaaaggaaaaggtggggggggtggggggggggggagggagagggaagagggggggggaagaaaaaacttaaaaaaaagacaagaggcnnggttgcccgnacggcccacggacgaggggggagagagagagaaaaanaacgggaaaacagtggggggaaaagaagaaaagataacgcagcggcgggagcacgccaaaaaagccgccccgtccctctcccgctggatagccgccctggcttggcccatagcacgccgagaaaggacgaacacaggaccgcggcgcagccctcggccgggcgctcgcgcgcgggggaggttacccagttctcatggtcacacgtgcaccgtgagagtgacgacggtaaatgcagagnaaccatggagatgttcggcgcgcggccccacacaggccggcggacgcgtccgcgcaggggcgcgcaaaaggagtgggcgaacgggggggaccggcgcgggaggcccgcgagcacggcagacggggagggagagtagtggagctgtgttcaggttcaaacaagaaaatagcgggccagataagccgaggagagttggatctgtgccggcccggcgccccctgggcgcttgggtatagtggagagcgagccggcgtaggcaaggcatgaagagtgtagtggagggtgggaggagggtaggggagagaaaagtatacacaacgctaaaagtgaccgagcacgtgcgggtgctacagtacgggtcggagggaccgcgagaacagagacagactagggcgaggcgggacgaaagagccgggagggccgcggagaaaggagcgtcaggtcgggcaagagatggaggcgtcggctgggcgagagtgtggagtcaggggagacgagcgcgggaggtagacgggcgtgggcgcggacgcgccgcagagaaaagagacacgagagat

SEQ ID NO: 6873 - DNA, 2027 bp, Homo sapiens
  misc_feature (1)...(2027): n = A,T,C or G
gcagtagtgtgtgtcacgcgagagtagtagtgaggatccagtngtgcacacgagccgcagcgntgactgcgtcgacggtaagacgcgcgagctcgcgtcacatcatatacacacacgacataatatactgtatttatgtagtacgagataaatantaccgagtctataatagacgagtngnatcngagtgccgctggcgcggtgcggcgcagagtggcctgtgcgcctcgaatactgtaacgcaagaagcagatgctcagcgagactgancacgagtagtcgtcatattatgtactacatgtagtgcgnacgtccttacggcgtnacagtgcgagatcgtcgcacgcacgtcagctgtcgcgccgatatcagcgngcacgagtggcgtactgagtacgncacngctgcataacagtctcacgncgcggctgacagagcgcgcgcgtagtgtgtgtngtatatacgcgactcgcggtacagagctagaagcgncggcaagtaataactanatcgatgctacatcagtattgatgtatgctatatgaacgcaacccacacatgcgtnagcgancntacgctatggagtgctgtcgcactcagtacgtccgtctgaganagtacacgtgactgctacctncncncgtnacagtcactcctatcatcncctgacactaactatatagatacatacttactgtgatgtancactncacgcgcgcagcaagcgcgtcttcagtancgctactagatctcagatacactaattacagacatgaatatatatcgcnacacgactttacctagacgctgtcagacatatgcatacgttatgcctgacagatgttgatctcncaccacttagcgcgtntctcatctcgccnagtcgtncncntgcgctcgatgctctgagntgtactctcacgtantcatacgcgcgtcgatttttnagtganacgtacgtgntgtccagcgagattgtctctgactgagcgtgtgtctactacacgacngctgcgnctgatcngtctgtctcttcctcacntagtgntagtttctntaactcgacgagtacacacgtcntgtcgtntatcagcagattgcacgacnagtcagccnagctcgcgatgganctatancatcatcatcgcacatctctagancgtcacgtactgtcgtctcactgcagcgntactcgcgtgtntgactgtacgatagctctaactacaggttcctntcangnctacgaccgctcatcacaatcatttanttgtatcatacnactcgcgtcattcgntngtcactcatgatgctcgacatgtacgactatgcaatgtgacatctagtatatttgataatctntaactacaccgatactctataccgcgcgtgtntactactcgtctatcgtctgtcgcgagactctcagcgttctctgacgcgtagtgtcacatacatatgatatcatatgctatctacgtcttccatcctgantccgcactctacgtcgctcgtcagctaacatagtctcactatctatatcacgcgcgtatanatagacactgtctatactcgtnagtcgtctgtacttacgacagacccgnctcgctacgcacggaggacatagatgtatgcgtanattgatacagcgtgctgctcgaaccgagcgncgtgtgtaagtagnagagagancacgatatgtntntcgacgctgctncgactacagctcgtgtatctgtagatntcagacaatattcacccagctggcgcgcgctgtagtcgntgtttatacgcacactatccacgcacacgtgcgatgtactgatacatagctnaggcacccgcnatgtttgtcagtatatncatagttacacagtcgctcgcgtatgtgattatnactgatgtctcaacctgctgcccatcacgtatntntatatctctntgtcgtcgcgtgctcacggcgtcnattctgatacgagcacatactgtatcgagcatcgctatatatgagtactatgcatacgagtgtg

SEQ ID NO: 6874 - DNA, 1543 bp, Homo sapiens
  misc_feature (1)...(1543): n = A,T,C or G
agtgctgttagagcgtgaagtgtgcactcgcgctagcagcagtagtatgagacgcgctagngataggagcatagtcgagctcgcgcgcgacacgtttgctagagaagttcagattacaatatatgcttaagaactatatatattgtacgtatcgctaaagtgacactgcagantagngagtcagacagtaaactgtatggctaccgtgtacgccgcgacgtcgatatatgctgcgtggcgcgacctacgctagtttgtaccgcaggaggncgcnatcggacttggcgtgttgttngctgcgcgcgtgtgctgtagtaactgtttgtgcgtgatatactattgattataacgctctaccatacgtctattgtgatgtatcttcacatagcgtgctagcgtgcgcacgacaacgcagcgcagacgtcactgacgctgntgngcgtatgatcgagcgngctgttacagtcgcacgngatgagcgcatagctcagacattcatatatcgatacaatatatatagagtgactcngtactcatcgtctcgtcctgcgcatagtaantatatgtgctgctgtacatctgcgcgtgngtgcgatctgactcgtagnttatatttgctgcgattgccatacttctatcatntacgctcgcgcgctcatcgcgttctgtcagcgctggatgtcgtgagcatgaattacgaccgccgtgcggtgtagcggcgcaggtcgcgtcggcgtgttgtngtttgaatgaaatgagtcgtaggtatatatgcactgacttaacgctcctctgtccatcgcgttgctgtatacagttcgtgtatgttcgcactgcgtgtgtgtgcctcacgcttctctcttcgttcccgattctctccacgttctngtcctattctcgctcatncttcgtcggtgcccgcttcgtccgtctacatctgcgtacggttnttatacgagacantcactgaatccgacgtagtatgagatgtgaagctcagaagcacgcgttatgtgtcaatctcgtagtcatcttaccacgtctgcgctcattcatcgctgtcttggcgctgtaatagttgttgtatgcccggtcgtgcggttgcgtgtgacgatgacacgagttgatcggtgtcgcggtagcactacgcgcgtggacgcgcgtgaatagatataggtatgtgcgcgtgtcgccttccactactcnatatatatctgcaccccgccactccgcatataggttttgatcattactggcggttgctgacggggcgacggcgattggtttgcaggcgcgatggcgtatgcgcgtcgttgcgcgcgcgtgtgcgtttgctttgcgtgttccatgncgtctcgcantcagttctgtatctagatagagaagaacgtgtcgattctggtgtctgcgcgttgtaatatattatgttacgcaattatatcaagtgtcatttcaacctcccccattttatgatacggttcgcgcatccgacacgcgctctatctcagtaagtacttcggatagccggcgaagtagtagaatg

SEQ ID NO: 6875 - DNA, 731 bp, Homo sapiens
cttttgggggaggtgtatgagggggggagaggagttagtgaggggtggatagaattggggagggttttgtatatgggtggaaagaggaggaaggaagaaaggtgggggtgtgggtgttggggaggatggaggatggggtagaagggtgtaaaatttttttataatgtggtggggggataaaagggggtgaataggggttgtttttggggaagagggggtttagtgggtatagggtaaaggggggggggttttgagcgaaattgttgtagtttaggggaagggtatttttttaattagaatgggggaggggggtgggagaggtttttatgagggggaaagaaaggggaggggggggatttttttagtttttggtggagaggagggggggtaattttttagagggatttttttaaggtggaaaaaattttttgttttataaaaaaaaaagaaagtatttttttttggggggaaaaatgggtaagaaaggtgaggaggggttttaatataaaaggggggtttttaggaagatatatttgggaaaaggggggggtgtagattgtgtaaattaagggatgggtaccccttttgtggaaaaattatgttaaggggggggtttttggtggttgttataaaagggagaaggggtttttttttggggaattttttgggtttaaattttgggtttggggttttttaaaaaaaaaaaaaattttttttttttttttttttgc

SEQ ID NO: 6876 - DNA, 1072 bp, Homo sapiens
cttgttggtcggtcccgtctctcttcgcgcctgttctcgcgctcgctttttttcttcgttgtctgctcgcgtccgtcgtttttcctcgcgtcgctcctctcggcgctttgcctccttctgctgtgttcttcggcctctcccacgcctctcctttggcctcgctcttctgcgcgttcctctcgctcgccggtgcgtcgtcgctttctctggccccgggctcccccgcccttctcccgcgtggtttcgtggcggtgctcttctcgttctggctctctctccgctcgtcctgtctcgtgtttcggtgtgcgcgtctcggcttggcggtttctgtttcgtggggtgcgcgttgggctttgtgctgccccccttctttcgtgtcggttgccggttcgcctcctcgcccgctgttcgtctttctcgttgtcgttttttgtcgctgtgtctcttgggggtttgcccggcgtgcttcgttcggcgcggtggggcctgggcgcgttacgctgctttcgctcttggtgggtttgcctctcgtttcgctggcgtgtccgcgtgcgcgtctctgtgtcgagttcttctgggtccggtgtcgtctcttccgttcggtcttcttcgtcggttggcgggtgtctctcggtttctgctctgtcgcgtgtgggcttgtgttgttgctgtcctctctggtccgctctcggtcgtcgctttgttcggtcgctccctccgctctggctcctgtctctctccctgcgcgtgctcgcgtgctgcgccgccggcgcctcgtgtccccttctccgctctctcttcttgcccgcgccgcgcgcgcctctcgtttttctctcgcggcgctcgcccgccggttctctgctttttgctgcctgttctgtgcgccgtccgctgcccgctcctgtgcccctcttctctcttcccttccctgcgcctctccgtcgcctctctttccgccgttgcgtccgcgttcgtccccgtctcaagatgcgtgcgcttgggttttccccttaaggtgttcttgccttttcctcctcgccccgtccgcgtccgtccgcgtctcccgctcccc

SEQ ID NO: 6877 - DNA, 1527 bp, Homo sapiens
  misc_feature (1)...(1527): n = A,T,C or G
tcactgttctctcattaccgtattctaactcaccttactatgtatacgctgngtatgaaataaggtgagantatcttgtgccgatcgtctcgcaacctccacattatcgtctcgcgtgtctctcgcggtcgtgcgcttgcgccgagtctctctgactctanttaacgatatgacgacgacttaacaccaggagcgcgcgctcacggcntatcatntactcggagtgccaaagtggattnggcgatctagatactgtgtcggcacgtcanctgcgtgttgtctgcganaccggtccagcgcatagaatacacatagcgcgtcagacaatatcgacgcgaaacgattgcgcaccgctaccactcataccccttgctatccgaggtgcgactgggtgtgaggatgcactacacgcctctcctcgtagcatgagtgatgagtggaacgaaggcgtatagccagatcggttagatatggtggtctgctctcctcgtcagtattagcaagacgacgcggtagatttgaagacatctgttagcttcgtctgcctatatccctctgcgctcgctccatctctgctgcgctagactcacattaccgactacgcctagtcagagaaacgcgaccaaactccctctcttgaatcaaacatagttgtaataaatcagaacggcgaaanaaggtctgcgctgtcataggtcgctcatacgtccttattacactacgccacgcggtcatcaactgcggcacgactatatatgcagtgtctgttgtacttctcttaccaacatatacacgcctccattcaaggccgtatcgataataccgtcatgttactcccnaacgacaggaatgcatagcgcccgcggcgtctgctgctatcattatagtcgcactatcatacgctaccactcacacgctctgaacanttcctcactagtgtacgcaagtgagctgtcctgagtcatcgtcatatcgtgctctgtgatatgtagtaccttgctatgctagagattgcgcgagtgtcgtgtactgctgacgngnctgtctcataatcgtgctgtcgctaagcctcgttatgtngatgactctcatatgcgccgcggcgcgtggcgattagattctgttgaacagagatagtcttcactgtgtgcttatcgtcttgttgatcgatcgtgtctttatagctgcgtagnagagttgtctacgtgtatgtaagagatgtgacgccccgacgctgagcgcgctcacccgctcctcctgctccntatccgcgagtacatctatacgctcgccgcattctcatgctactatcagctgtgtatgtggtctgcatcacgagcgagcatgatagtgtgtgttcgtccacaagacctncncnataacgatnacacacgatgcgatcactatgagacagtagacataatacagccnacttactctctataacgctttaactacgcgcgcgctngnttcgcagagttcgcgcgcgcnctctcgctgcgcatgcgcggctgcgccgctagtagg

SEQ ID NO: 6878 - DNA, 2256 bp, Homo sapiens
  misc_feature (1)...(2256): n = A,T,C or G
accacatctcagtgcgcctccctgtctcagatcgtcagtcactagtggagttgatcgtggtgcggactganatcagcgatatgccnagctcatnctgatttatctgatagatcgatgtcgaacgatcactacacgcnatanagcatatgtgacgctatctcgatcatagtgatatctagcgacgctgtattcgcnagctgatnntgctcagcagcacgtctctgacacagangagagagagttgtcgagtatcagtcttgtagcnganagntattatgaatgtactgtacacgcagcagntggtagtgatcagatctangagtggnccanctgtagccgtcgngctcgcgctnacggtgcgncacgctgcgagcagcacgaccggtgacngctngtatcgcgagtgcagaaggtntatcgctgtgatagtacgacgtcgcgnacgtncatgctnctgttctgagcnggacgcaggctacatgctgacgtgacagncgcatcgcagtctcnagntcntcagcgactagctgtcgcntcgtcgcgtagactgctagtagcactacagcgntcatgagtctcgtcgcantctgatatcgtntgatcanatncgattgcttcagctcagtccgcactgctacgtacacngactacagtagcagtcncngcttcganactatatcgntgtcagtacgtngcagcagncgtgctgatncagcgtgagagatcgnggncacgcgtcgnactatnagcgnatgacgcatctnagtcnatgctatgcgtgcactangtacangagttcagcntacatgacnacagtagantgtacgatcgatgnacgtcgcgnctcgtgatatgtatatgacgcgcctgctcgcgcatcgacntcgtcngtaatgactcgtgtantagttatntatagtcgtatcgntgantagatcacgcaaccctgaanatgagcgtcngcagcgacatcgcgcatccnntgtangcgtagcgtgnagctgactctgccntgacctacgctngtnaatcagcgcagtcngctcntctgcagctcntctagcagcgtgnatgcgatacgtaatcgtatgactgcgnttcgcactagatattcagctctgtactggtgctgctcgctctnatcgtagacgtgcgcatngacgntgtcntactgntcgagtgcgtgngtgacgtatncnatcagcgtctcnagcgctcgatacatcgntganatcgagtcncgtatgcgctataagtagntcctcntagtcgagtgtcngctaacctcntcgtgnactcctgtganagcacgtcgatgcatctccanacngatgnacgncagtcagcgntgtcagatgtgtgctgcactctcgcagctagacagactatcttgatagcgcaccgcgcgtcancattatcagctcgcagacngntagacgtacttactaactcgagnacgcatctcgctcgtngcacntacncntgtcacnctcnagancagctgttcgctggtantcttnattacgtgcgacgcgtgaagctcgaatgattactattatctgcgagtgcgcgatctacgcgcgcggcgagtctgcggcgncgtgctatcatagtactagcactccgaccccngtgcgcgatcggcctcgcnngcgactcatgtnatntncactctaatgcgtanagtaatagtcgncngcntatgaatctcgtntgacgncacgncngaatagcantnactaccganactantgctgtgantctgcngcatcatgtntaagtangtaanganntagatgatacgaacgacaatgtcagcgacgantactnatacgctcgttaatgtgcctntgcattcactgtacgtccgtatcactcagcaccgcactgaggtncagatcatcatgagagagtagatgcgatactcgacgctgtgtagtatcgtccncgnactanctagatatcatctactcgttncncgtcngactagacgcgtagcgcgccgactcgtgacgctgcgcgttacactgttangcgacgactagtattactnagctgacagctgatntatngtcgtagtagagagtntnctgttgctgagcacgtnatgtnatcatcatctccantngtccagcancngnacgtataagtacgatgatagcgtcgaacgccacacnactgntctgcgcatantatncagctcgatcagctgcgtcncngacagtcacgcacgtgactatcctagtattacgcgat

SEQ ID NO: 6879 - DNA, 1038 bp, Homo sapiens
  misc_feature (1)...(1038): n = A,T,C or G
cataataggaagtgtagggttgagaagaatagggtgcgtgatgagagcggcgtgggtggcgcggtgatatgtgatgatgggtatgaagatagtagtaaggatgtatatatagcatgtgatatagggacgataggtgtgagagtgaaaaaagcatgtgntacttagattgaatatggagagntatagattcgtatatgagcgagnaagcaggacatattgtgagatnaagacacaggtataaagtgagtggtggagatgtgtgtgagtttatgtattgtaagaagantatgaatgtgtacaatagatatatggtgatatggagtagagtgttacaagagttagtatctaggaatagaatgagagaggaggaataaggcgngataggactaggtgatagaagtggacaaaggaacggaagcggcggatgtcgttgttagtgtgcgtatngaancgtgagaattcatgttcgtggaatatattaggatatttgaggcgagatgtgtataaatggaggtatgagggagggagacaaaatggatgaatatatagtaggttgtttggatgtgtatgatgaggagatagatgagggacgggatgggagagaatgagtgggatgaaggtgaaaaaatatggagggggtaagaattaatggggggaaggattgaagggtgagttagaaaatagagaaagggttttgttttgatgtatatttgagagagatgagggagatggggaaaaaaatatacattttgggagattataaggagggtatatagggaaagggtggtataaaggtaaggggaagggggtttggtttttttttttttagtttggtgtttggtaagaagcccccaccccgcgggagagaaataaggggaggggggaatggaagtttttttaaggaagtttgaagagggtgttagaggtttttagaatggttagattttgagggtcggaaagaaaaattggtttttatattaaggttgaaggttgttaaatttaaaaggagtggttttttcacccatcgcgcggaatggg

SEQ ID NO: 6880 - DNA, 1055 bp, Homo sapiens
  misc_feature (1)...(1055): n = A,T,C or G
cgttcgttgcgccgtccctctttgcgcgtggtccgcgctgctctgtcgcgctctggttttggcgtgtggtttgtggtcctcttgtccttcgctgcgctctgtggctctgtcttgtctgtgcgccgggcccttttctgctcgttgcgttgttgtggtgtcgggcgtcggcggctgggccgggcttccctgccccggggcgctggggcggggcgggtgcgctcttgcgctggtgcgtgtgttggttcgcccgcgtctatccctgtgccttgttggttcgctgcgctgttggttctgtgatgggctttggcggtacgatgtgatcgttttcggcgcccgctcgaccgttgcggctgtgggcttgccggtcttccgtcgtcgctggctgcgcgcctgtcacctggcacgcgccgtgttgttttttctcggtctttggcgtgtttggcgccgtggttgtgcgggggtttttgctgtgcgcctcgctggtgggggcgtggtgggttgttctgggctcttgttggggcgctgtgtcgtggcgttttgtggggtgtggtgttggttttgtgtccgttggggcggttgtgctctgtgctctggcggggttgctctgccttgggtggccgctgcggggcttctgtgcgccgggggcgctgctggtgggggggggggttgggtgtcgtccttcgggcgttggtccgtcccgtgcgcgtgtctntggtctctctctccgtcgggtcttcctttccgccgctcttgtcgcgccttggttcctgtggtgttttctttctttcgctgccggcttctcgggctctcttctttgtctcgctcctggcgcngtnggtgtttctcttctcttctctctggtggtcgccctgtggtccggcggttncttgtcgctntctgtcgcttttggtgtcggcgcggccggttgtcgngcggtttttctctcccttgctacagacactcccctcgttcgtctcgccgtgccagaagctgctttctttctttcttcttctgtgcgtgtgctgcgttctctgtcggtgcttcggtggtggccg

SEQ ID NO: 6881 - DNA, 1358 bp, Homo sapiens
  misc_feature (1)...(1358): n = A,T,C or G
aagtttaatttatnanataangtggtgnnnntnngttnnttgataatgaatntataattgtaatgcacaagttgttttgnttatagggnntatagntgtaatgagtgtgttaatatagtnngcgtanacggaaggcctttanaatagtaaatgaaatgaccanatgagtanacaaanacaatatctttttttcttgtgagagaggccgagaacgcccgcnntngtgtnntatngtctcgtccatgtctatatctatctaactatacagtttntgtgtagtgcttattatccagtgantcactgtanatgcgtatatnatactgacatttaannaganaaanagcntnagcttcgcacgtcgcatcgtacgcgcgcgagagacagaacagcaggtccctctacaacactcntcacaccattcaccgcacataccattagaccactgctcactcgacgtacgacaacatgactaattccactctatacatctcacgcttctctacatatgacgtgtccatgatctttacgtaattaacntctatattttcttcctccacgctaaccttccagctaccatattcttctacatatcctcatttatccgataacgccccaacctcactacaaactcacgtaaaaagantcctcgacgctgggaggaatggcttcccctccactcacagatctccgttttaaatcttgcaccagaggcgccacaccgatgcgtacacgacgcacgtatccgcaacaccgcgcttctgcacaaaactaaattaacgctactgtagaaaacgaggatcacaacgaaacaatacacccaaaaggacgcaacatcatatctcaaataccatgtttagataacacttatactaatttaaactatgagaatcggaagatgctaattagtgtctactgtttatatatatacactccacacgccactggcacccactctatattatagttgtgaatatcaacgtagttgagtcagtgagattgggaataaaataattgttagtatattagatatctgtaagattactatctctgctaataatcaattgacataaaaatcccccagcgccgacagtgatctgccgcctctctgcttatcttttctattcttactctcccagcgcgagaatactcatgtctgctcattactgctccctgcggctaacgttacacctagtccttcatacgcctcccaatcgtacattctatctcttactcgtccgccctcccggtccataaatcgctactactcgtactttgcggtctcttaataccgctcgttatcgccggggcggagatgctaaataggactcgatacctgaaacatacaaccacaacaagca

SEQ ID NO: 6882 - DNA, 1385 bp, Homo sapiens
  misc_feature (1)...(1385): n = A,T,C or G
tgtggatttttatggtttctncnntttntttntttagtgtttttgncggacnntctttgtatattttatgatagagatgggtggtgtgaaggtaggattgtgntgtgtagattgccacttagagggtgggggtttgtgtgtagaatcataatcctctaaagtactaaaaagttatacagtgttggttaggcggttagtcaagcgtttcgtcgtggtcagacgtggacgagtggtcgtaattagtggaacgggacacgatgagagaagaggtgatagatgataaagtagaaaatatgagaatgagtaaaaagtagaagtgaggcggtaggaagagagagtggagggggcagagaaacggacgggtcacaagtgtaagggaagggtaagtcgtgcgtgtttttgttcgtgcctctgctgtccggtcagggtgtagtaggtttagagaggcgtgtgaatgtagtaggtgtgttaggtgttgcgaaagtgaagatgagaagaggtgggggggaaatggcgggtataggagtcgtgaaaaaagactgcaaatagagaattagtgtatattttatactaaagagagatgaaggcgtaggagactaatcgcgagttcagatagagttgtacaaagacgagtagaagaagaactgtagagaaattataagcattcaacggcacccctccacactggtgtagtagcgggaggggctgggatgggaagatagttggtagataatgtagtgatcggtatgaatttttttagctctcgttgacatgagtggtaaatggatggattagatgaggcgttgcagtaatgtgagcctggaagagagtgttgtgttgtggtgtggtgcgaagttctgtgatgtatgacgcagtacgtgtatgtnacttcgtgattgtatacgcgttagaattgatagaggtagtagatgaggtaagtagctcatatgattgnatagcatagatacatgtgtgatgtagagacacactcgttgttagcgagagagagctacgncgcgatactggtacagtacgagtagtaaatgggctggaattgtgtatcgatacgtagtacaaggctnganatgatctaggcaagatagagcatattattgatgtgntaattagatgtctgtgttgtgtgcagtatatagantgtacattcgttgtgtgaattcgaagtataataggcaatgactcacatgagaaacactatatatgtgtagttgttcttctgagacagcgcatagatcagtaatctacgtgtatgtgatgtgtgtagatgtatagtggcgtgcgcgtgtgtagtgagtgtggtgagtagagcgagtggtgtgtcgtngtatgtagatatgctctagtagaatgaggcatggttatctaag

SEQ ID NO: 6883 - DNA, 876 bp, Homo sapiens
  misc_feature (1)...(876): n = A,T,C or G
attctcaagagggaagccagcttgcacatgcatgtgaagatattcaggcggaccctgtgggggggcctcatagaagcttagagctcgacttcttcctggtcagatccagtagaggaacactaggattacattncaagcagcctttatagtnctacttaagaagatcattcttgctctnatcgnctatgagtgacttactctncaactctactatctttttgctatagtgcggggaccatcncaacatgaatcaaataagcctgcccagtatttcctattatttacctcgatagccntttaactgaataatttaaaataccttcttatccaatttccatctacccccgaccctttatcatttactcanataccaccaccatctcttcatttaatctatagagtacctcgcaatgctgtacgaccccccgttactctttttttattttgttatctattctctcccgcctcacggtagaaggccgattccttgccataccactttcatcaatctactagtgattcagcaccttccccatcgaccattcttcatcccatgcacgctctatatgtatcctctatgcagccttctctctttacctcgtattttcatctactatcctcaccttcgatattatacatttgcgtatctaccttgatttttatttttatccttgctaccgcagcgtcttgttatcaccctcatctgccctacctactcactcatctatgtcttcccttgtatctgcgtcaattcctgttgctccttatttgtctcgcctcctatcacatcccgcttttgtaggtcacgatgtgagagggtgacacaaaacttaattttaaccttaataaacaatactcaccttttactccatcact

SEQ ID NO: 6884 - DNA, 777 bp, Homo sapiens
  misc_feature (1)...(777): n = A,T,C or G
aacaagggctttgttaccactcctaatagttcccaagtgcaggccacagcgcatgtaatacacatccgaaggtgcaggcctgtatctcccagatctggacggggttctgcaaaaactcacacccgaataagaagccttttggtgttgcgtccaggtgggcagaagtctcttgatccaacttcagagatattgttgttatgaaggtagacaacctgcatgtacttatgctctgccagcccaccaggtactctggtaagcttgttgttgtccaagtgaagctccctcagatgaggcgtgttggccagagagccattgtcaacagcagagatgctgttgaaactcaatcccgacttagccaaattattcagtcctttcaggctagctgcatcaactctgctgattttgttgccatcaagatgtaattccgtaagggaaggaggaagaccttgaggaatgctggtgatattggtatcagcaatgcggatgtaggagagcttcttcattccctggaaagccccattttcaattcctgagctcttcagcggattggtgcccagttctatgacaatcatctggttcagtccattgaaagcaacttttcgcactttggtgatctcattctcatgggcacgcagctcctgaagagttttgggcattttttctggcaattccttcagctgattcttggacagataaagtcgttccaacttcaccaaaggtgtaaatgctccaggactaactttgctaattttattgttnacaagaagtaatgccagg

SEQ ID NO: 6885 - DNA, 346 bp, Homo sapiens
  misc_feature (1)...(346): n = A,T,C or G
tccatatananngaatttaaaaaggnnnncgccctccgccatcggtttttttactatctattactccaaaaatgtaacctttcattaaaagcanaatatattntacttttatcccctgcgtactgggataaaaaattaaaattnnctttttaatnaataccctcattaaattttttcttcaattaaaaaaaataaaatcaattaaatttntaacaaatcaccaatttattaaatcccccaatttttttnttcaatataacccaaccctacttacaaatttaattaacctttttcctcggggggggggttttccttaaaccaaattccctttttaaaaaaaaaaaaa

SEQ ID NO: 6886 - DNA, 869 bp, Homo sapiens
  misc_feature (1)...(869): n = A,T,C or G
aggaaaggaggaaaagtatagggtgaagaataaactgataagaagagaagatataatgtagacgtagatgtgtgggaggtatgntaattgaagtggaagatatgagagaggaaggagaaagatcagaatagaatagagagaaagataaggagaatgtatggtgaggattgataaggggaaatgaatgaggataaggagtgggggtgagggggtgaagaaatgataacagtatggagaggggtctgaggtgtgggagtaaggtattgggggttgtgtccagtgagtatgtggggagagaagaaaagagaggatggatgtgaggtaaggtgtgaaaaagttttataattatgaatgggggtggggggaggaagaaaggagggtttgtttttactatttgggggatgagggggaaaaaaaaaaaaaaagaaaagagaaggtgagtgaggagaagggcggagagaaaaaaaaaaaaaataagaaaatatataaaaagaagaaaaaaaananttaataatttattggaaaaaaaagaggtgtggtttttgtttaaccagagtttgtgtgggggggaaaagaaaagaaaaaagggggggagtagcgtaaataaaaaagnaaaaaaggttttttctgggggggggggaaaaggggccgaagtttnnccattttatgtttttgggaaaagaaagtaatttatttcccccccccaaagaaagggggggggaannaagaagaaagagaaaaaaaaatatttaaatatgtttttgtttttttgtnatatgggagggggggggggggttgggtaaaaattttttgtgtttttggggnggggggnagngaaaggttttatattttacaaaccccgtaacccg

SEQ ID NO: 6887 - DNA, 798 bp, Homo sapiens
cgtcgggggtattgattgggctttggacatctctgactcctacttccgcgcgcctccaggccccgttctttccgctgtacgggtgtcgcgtgagagacggcgcaccgctaccgtccgtggcagtcgcgtacgggcggtaatagggaataagagtcctcggcatctattggctacatagtatgggctacgctgatccggggcgatgaccggggcggggcgccttgtgatagacacatttctgcatgcgttttcgtctctcttctctcggagcgggccgatttgcggaacgctctctgctagtactgttcacgttgggaaggatgctaggtatctactgtttgcggacaatacaaaggaacccggtcgttcaaggttgctgaggaggtgcgtgtagtagtgggggacagcgaggagacaaccggtgggtgggccggaaaaagaggatagaccgggcgagtattgcgcgcgaccggggctcccactacgcaccgcggccgtgacgtagcgctagtcccgaatcgagttctcgtacgcgcaccaataaacctgcgtgaaaaaatgggggctcggctgcgtgcgttggatacgcgcgcgcgcgccggtccagaagagggggacggtaatgtgcccgctagactgtttgcggcccgtcggcaagagtactgtctgtcgccgcgtgcatgtcccgcaaaaaatcaatcctccccactactatatacatactcaggtaaccagaaaaatcacccgttgcgccgagttctcctttcgtggtggctggcttcgtgctggcgcggcgcg

SEQ ID NO: 6888 - DNA, 832 bp, Homo sapiens
ttctggacctgtgccagccacatagaaactgcttaataattatttgttgaagaatgttctaaatgaataatccgcagcaaagccctgagaagtaaataccccgaaataaaactgctgagtgatgtgggcaaatgtcatttaattttttaggaagttgccgatttgtgttttagggggaaaaataacccaacccccttggaaagggggtttttgtgtcaacaatgtgccttggtgcgccagtaaaaaaattgggggaaagtttagttaataaaaaaattcctaaatggttaccccagggtttatttatttcctgaggaggaagggatagccccttccagtggggtggggacctgggccctctgtttgtgtttgtagggaagagttgaggggagcattcaggggtacacctcggtcggctcatttttatttagtatttgaatgttaggtggttgttatgtgaacattaagaagcggagaggttgggtggagaagaacatgatttttgttttgtgttgttacatatgtactccagggggtggaggtgtctctgtgttgctataatagaaggacgtggtaagttgcgggggaggaggatatataatgcaagtgtggcgagcgagttaagtgtccgttgcgagggtgtgggcgaattacggggataacacggtgatctgggggctgcaaattggtcggcacataagcggggtagggctgtaaacatgtatgggtgttgtggaaatgggttggagacaagcgagagtacacgtgtagggaacgtgagtcgccctgttaatgatttactatccgagagcgtgaacccggaagcgggcag

SEQ ID NO: 6889 - DNA, 930 bp, Homo sapiens
  misc_feature (1)...(930): n = A,T,C or G
gtggttgtagggtagaggtggtaatataataataggtatgtgagggaatatgtgattttgggaataataaggtggttgtgtgtattggatggggagataatggaggaggagggttatggatgtggnggaggggtgaatgggtgaaggtgtaagatggtgtattgtagagaggggaagtaaggtggattgaagaaagagagggtggaattatataggtgtgtgtaagtatgagtggttgttgagagaaggtggattgttgtgtgttgttttgataagggttggtgaagaggtgagaaaggaggaggaaagtgtgttagaggtgagttattgtttaaaggagattagttgttttttttggggggggttaaataaggagataagaaaagtttgtttatagggggtaaaagagaagggggatgttttaaaaaatttttaatttttgaaaatttatttaaaaggagaatgaaaaaaataatgtgaaaagagtgttgaaggttgaaaaaaaggtgtaaagtgttttttttaagagaaaggaaaataaggttataggataaaaantttaattggttttaaaggggtttttgttttttgttaaaaatgggggagttttaaggaaaggaaagagggaattnaaggaagttgnaaaattttgttttttaaaatttaanttagaattttggagatccacattctaaaattggaaagattgtgaaggaggaaaacaaggaccattgattctcaatgggaggggcagcatttatttattgattaactcatgggtaatttcnaaacatntatagtggntttgtgtttagannannangngagtgtttagagtacacagaatcacagaataatgtttaaagatgttttctggagcataatttatgaaagtaaaaagttagaggaaaataaacatggatgcggaag

SEQ ID NO: 6890 - DNA, 1206 bp, Homo sapiens
  misc_feature (1)...(1206): n = A,T,C or G
tgaccgcgtggagatgtacagtcattaatcttgttatccagcagatctcctcacacgatcgattataatacgtcacgcacgctgcgctatcgcacgctttcttgttattataacgagtcgacttcatacncctcgtacagcaatccagtcgtacattctcgctcgctatgatccgcgcactcgcgcgatcacgagtntatcgaatcggtacgtagcgaaagacatgcggcgtttgcagcatcgatgtggcgcggataccgtcacatgctgttcatacatctcgctaactggccctataacggcatactgctctgcagcgacaacagtcagcgatagtcggcgtcagtgtgaagtcatagaaatgctagtatagataactataacgatgttggacgtctagttggttgcctgtgatctgatatcttcgtcgattgtagtatganttntngtaatgttatcaacttcgtcacggtggactggctatgncttatcgagtactagtaaaactagcgcgacatacgctctcgnatgttgatgtatcgtacttggattgcgtatcacaataatcgtggtagacacactagctgntgcatgccaacatgcgctgttagtgtaggaacagataaggctgttgatatgtgtcggggatggattatggcgcggnagnagttgtcatggacgtaggtgggagatgtattgtatattgtgttacataataggtgtgtgatataatttgagtggattaacgccgncgctgttcgagtttctgcctgcgttggcgattcctcgttagtattgctgattgcgcctgacggatgtacganacgcagacagacatgatggcgtcattatctccaactatcttgaaaaataaaaaatgtgtctgtattgacacacgatagtgccccttctgagtcctcgcttggtcgaggccctagcacactgattagattctcttcactgctatccggccgaatcccgtaacaatcttataggatgcgctccggtgttccaacacttcctatgccagagtctgagtagtgcataagaatgcactagaattattgtttaacagatgtttacgtgcctgcatgcatttatgttaagttttcttgttagtggacacgttcctctcggtttcccgtcacaaagtttttttctgctgtagtttcgggtctgtgcttattggttggtatagcgaggtcg

SEQ ID NO: 6891 - DNA, 1851 bp, Homo sapiens
  misc_feature (1)...(1851): n = A,T,C or G
cgtgcagtacgtgtatagngangagacagnagttcatgacgatgtctagatcatcaagaaagtacaaggacgatactacgcatcattacnattcatatcatgttatatcatgcanactggactgctatgtgtacacacgtgacaaacagcgcagtgagtgacgtagtcgntgacacgcagcatntntntgtgtgcgatatccagctgctctactatcgataaactcangtagacnatcgcacacgtacatcagatgantcgtcacgacganagacangagcgccacgcagcgcgcgctgagatctcatcgncancaatnacgtcagntcgnactgagtanangaagngggcgagatacgagtgtacgactgctacgtacgacgatgacgtattcantagtatancncnacagacatacatacatacgaacacgatagctactgtgtgtgtgtnacacagcagtagtacgtcgatgcggtagtgagctacagtgattgtgtgatatcagcnacactacactngctgtntgctctacacacgacatagatatgctccgtgaacacagcagtgtcgtgngactctaccacacaacgtggcntcgtgtagctgtagacgcgtcgacagcgatgtgcgtggtgtagacgagagncgtctgcgcttcgtcgctctgcactctctncgtaagatgtcatganncngcgacgtcgtnatagctctcgatgacgaccactccaacgtacagnctacagtctntatatgtttctatgtatcacacaccacagcacganacncgctcgagttagctctaggatacacacctcgaagtagtagttgtagcgacacagtgtatntctcgacgactancccacgattctgcgccactgcatctcgagattagtntcgtngatgtacagacgcactgacgcacacntanctnccacaatgtcagtgctaccgaagcgtctacgcagcagtgaacgccacagatagntagctanctagatgacgacactncgtgatcgtctaccactngtcagtctagcnacatgagcactcatagagtacgtgcgactagttagtccagtcatgctnactagtgcaacgacgtactcgcttcgtngtcgacactcgatgcgataatcnatcgtctgacactgatgtctatgtgattagtatagagtggagatcgcacactgacatgtanaggtagacagccacgaacaggtccgatagtagcagnacgtcagncacctagagaccaggcgtgacgcactgcgatagagtagntatagcacgactacagcatcagctcagactcnctggtagagnacatgcgccgcgngacaggagatatgccacgacatcagacgcgtctgcggtcgggacgcgtatggagggtgacgagttaatttatctcagcagcagtacgatgacaagcangtnctagacgccagaagttgagtgtgtgaanacgagttcgagtacgcgcagagtcactgcgtgatacaacaatagacncgtgcgacagagccggcgagcacaagccgagtctactcgaccgggcgactctatgctggtatagtgacaataatctcatgtcgagtagtgtgtggagtaggagaaggacatgcccatgaatgttgtcatgagtctataatcggtgtggggttacacgatccggaccgcacgttgaatgcaccggactgccgcgcgtttgatcgtacgggttgctggataggaagacactggagcagagaaaggttacccggagattggttgttccgcgagaccgaaacggtcttcgagcttatctgatacagacgcgcgcctgagatcgcgtgctggtcgtca

SEQ ID NO: 6892 - DNA, 916 bp, Homo sapiens
  misc_feature (1)...(916): n = A,T,C or G
tggggatatatgtaaaaaggtggttgatataattaatggataatgaaatgtgtataataaatatttggattgaaagaagggtgagtgtgaaatataggtgtaaaggaataaaggtttttaggttagattttagagatatgaatgggtgtgtttttaatattatatgaggtgagagagggaaagtttttttgtgttgaaggtattggggggtattgttaataagaggagaaaaaagagaagtggttatgagatatgaatttgggtttagagtttgtggggattatgaaggggttggaaaatggtttggttttttgagggaaaatttgaaatggggtagtaaggtaaataggggttgtgagaaaagagagggggtaatgggttgaagtaanaataaaaggagaggggttagagaattatttatgggggggattaatgaaaagggggagggnnttgagggaattatggagtggttttaaaagggaaggaaaaaaggaggtttaggaaggaaaaaaagggtgggggnaatagattgggttttaaaaaatattatgtgtggaggggggttatggagaggaaaaaataatgattatgaattatttaaaatggaggatagaaaggttttnaggatgtgatnnatgtagatgtaaatggggtaggttaaggaaagccccccccccggaaaaaagggnctttgnctggcttggaggggagtttaagtaaaagcttctgtgagttttttntgagtctcagcntntgttgtggggagttanganaancaccntnagganatnttntntnnnatttnnngnnatatttgggtncacccctctaccccgtgtgttaaactcatggtggtataaatattaccaagacatgtctgagaaanaaaagacnataataaattggttgcggaaag

SEQ ID NO: 6893 - DNA, 1085 bp, Homo sapiens
  misc_feature (1)...(1085): n = A,T,C or G
ctttttagtgttgtctggttcgtgtctccggtgggttgtctgtcgtgcgtctcgctcgtgcgctctcgttcgctctccgcccgcgcgcgatggctcgacgcgtgtttcttgtggggtcgtccgtctcctgtctgtctgcgccggcggctgtggtgccggtctcttcgcggcttctctttctgtgccgccgcgctctgtcgcgtctggcttgttctctcctgctgcttctcgctgctgccgtctttgtcttcgccgcgcgcctgccgncgggctggtggtcgcggtccggtgtgnggttgccctcttccttccgcccttcgcggctccttcttcgtngctcccccgcccttccccgttcttctctgccgtgcggggcttctctgtccgcccgtggcntctctcttcttgcgggtcgctggtgtgctgtggcgccgctggctcgcnggcccgctgccggccccttttgttcgtttcgttcctgcctcccgtcctcttggtggcgtccggctcttcctgtttccgctggggctgggcgggtgcggggccgtggtctgctggtcgcggccgtgcttgcctcccgggtccttgccctccggcggggccggcttgtggccgtcgcccctcgcncctcttcgggcccggggccgccgccccncgcttccgcgccctctgccgtctgttctcttctccgcgtcntccgncccgccgccccctcccccccctccctggcgggcgncggccaaaaactcttttttcttttctggtcgcctgtcggtgcgcgggcgcgcgggccgggtgtggggtttgccgcgtccgtccgggcgccgcgggcgtgcgcggccccggcggtgtgggggggggcgctcccccccttgggcccgcttgcgtggcgcggccgcggccggccntttgtttccgtcgngctcgcccccccgccccccctcntccgngcggcgcnccnnngcttttgctccggttccccccccctcaggcccccccccctgtcctccaaaaagcttttttttttttttttttttttttttgcaggaatngggcatntttnatttcgccactcatctctccca

SEQ ID NO: 6894 - DNA, 1001 bp, Homo sapiens
  misc_feature (1)...(1001): n = A,T,C or G
gtgctcggcgtgttcttcgcccggtgcgcctgcgtggtgtgtcggcccgggggggcgcctgttccggggtcgcccgtatgcctggcgcgccgcgtctctgcgccgcgcgtcgtgtcgcttctgtctctcccgcgccctctcggtgtccgcgctcgcgcgcctccgtcggccctgcgcggtcgcggcggccggcgtgttggagccgtcggtgcggggcgtcgcgtgccggggtgcggggcgtcgcttctgagtggtgggttggggggtggaccgccgccgcccacgttcttctgcgcgcgccccgccccccgcccctcgcccctctctcgcgcccgcgcgccttcggcgccggccgtcgccgcccttctccgcccccgcgcgggcgcgggtggcggggcgtgcggtccgcccgcgctgctccgggcgcgccgcggcgccgggcctagctcgtcgtccggcgctctgggggagtgtccgcggtgcgttggcgcgccgctccggctgcggtgggggtgccgggcgggcgtcgggccgccggccgcgccgccgtgcggcggcgcggncgcgcgtgggggggctcgcgggcggcgcgtccggcggccggcgtgtcttcttccctcccgcggcggcgcgccgcgcgcccccctcccgccgcctctccccctccgccggcgcggggcgccggagcgggcgcgccggcgggggcggcctccgtcggggggcgcgggcgcgggccgggcgtcggcgcgtgccgcgcgggcncggccggcccccgcccgcgcctcgccggccgcgcgcgcgccccccgccggggcgccccgccgccgcggggcgggcggccgcgcccgcggttcgccgcgccggcttaggtggtttgttgctgncgtgggggcggngcgccggnctgcgcccccgcgaggtttttttttttttttttttaggttttctcctcttctcctttccgcccggcggcccgctttttanaccccccgttttatttt

SEQ ID NO: 6895 - DNA, 907 bp, Homo sapiens
cgcaagacaccagtaatgtgaaccagatgaaacaaacactctggacacgtgttgcggccaggtgagcccactatcaagagccggcagtgtttcgtggcctagaagtgtgcaccccttatgttttaactgttagccaggggaaggaaggctcaaaaacccggccacaagttgacaccccatcccgtgttccagcccaatgtgtttccgtggccctccccacgtaattagccagcgaggacaaggagctgttcaaagcatcagccgagctaaataacaagtctagcaacctagagcatgaccccgagagacggggagtacgcgcgcgcaagtgttccgtagccccctcttaactgttccataattaagcagatctggggggaaaaaaaagtagcgccagcaacacgttggtgataattatttagtcactcgctatagtattatattaacgcggtcaagctgggaagagatagcaagcgagaaacggctgtatcgatgttcgccagtgtctgagcagcagaaactagtaataataggggatcttcaaggtagctttagaaagcttcgctccttagagagctcagtgtcagattcacagaattcatcctcccaactgggcaatttgaataattccaaccgggtctttttgtactccagtaaaacaggtgggggttgcttctttctgtgatagcctagtgcctcctttctgtctttctagttctataagacccagttcacaatttttaaatcagaactctgttcaataacctgatgaagtttctatattttgactagagcgactgataaagaagtgtttttaactgtgaaacgcattaaagaaacattaaaataaaaaaggatgcggcaagctaaattactacaatcaacaatattgtgtaataacaacaac

SEQ ID NO: 6896 - DNA, 924 bp, Homo sapiens
ccctagcacctgatggtgatccgcccacggcctagcgtccgtagcgtggtgtggcccgctggtcccctcatttcactgcattaccgtatctccgggccaggtttgactcccactcgatatgatttgtgcggttcctgcacgccacccgtcctgcgttacgagtgccccctgtttataccgacgttcgacccataatccctagtattgtctactgcccggctccctgtattttcacttaccattacatggttatgggatccccaagatcccaataattttcctcacgtaactagatggatatacaccaacattctgcccccgcgcggccggggggtacgcaccgcaacttattccacagccggccaaagttaatgaacaaatataccacacaagatgcggggcaaaaattgtcccagggccggtgccgtccccacgagaacctcgagaccccaatgtagctcaggtttgcgcagtcaaagccctttcaataagctccccccaggttttgacgtagctatatgcgccattttccaacggccagagcgtgctttcttagttattgtggcacatcaggcatccttctattggatcaatgatcgtattgtgtacacgcgatcaagatggtttggcctttgctgtaagtttagtgccagtgcctctagagtatcaatggtgggtgggatattgtctgatagattcagataattattgcctattaagatggaaaagtaccccgtaatattcatgaagtaagattttgaatctttctaaatgctttcttggagactgtcaagatgatcataagttgtgagttatattaatatacttcctaatactgggcaccttttgtgaatggtaataaaaacttgttcgcgaccagcccttccctcttctacaaacgcatgtggggaggcgctagccacg

SEQ ID NO: 6897 - DNA, 1869 bp, Homo sapiens
  misc_feature (1)...(1869): n = A,T,C or G
atcaagaacatcacgcagtgactgtgatctgtatgtacaacgttgtgtacgagtatacgagtacgcatgagcagatgtagcgacagcagagtcgtgtcgactgattggacatgtctgtacaatagagagcgaagagaacacaccgagcgtaagtgtcgacagtgagagcagccaatggctctgagagatcgcggtcgcacgacgcgcgcnttatcgtgaagtggtntgatttagatncagcgtcgagtcgncagtagtagtgcgtatatcataagtatcgataaggatagcccacagacgtcgacactagccactagctgtgcagaacactcagacgacgacgcagatgctaggnacaatactatatatagtatgcagcctgcgaccaccgactgactaatatgctatgaatatagccgccgtatcnctatactgtncgatatatgtgtacctctgacatcagtcganctcgacgcgcgtagacgccgccgtgacgagcgcagcagatggtgcgcgcgtgaggcgagtataggatctatattactcacntatcgctcgagcatcaacgtagcagagtgattagtacgtanaacacgcgcgcgagcatatgtatagtagttgtgtagtgcgtcntagccgtgagggatgtngtancgtanantcgcagtgtgaagtgataactatatcagtgaanctaggatgatagtaatctcaacgatgcaagcatatactgctgaatgtatntgctncnattagatatgtncgcgcgcncnacgtttgtcgtcagcgagcgcgcganagaanatattacacagtcgtggagtcttgtngacatacggccgaactgtntgtcggcacactgcacnctaacntatgcgagagaatcgtgtcatgtcggactgtatatatactgacgcgtnttnatggtagatagtggatcaatcacatnatgagtactgtatgatgtgtcaacgagtgtaacagtacagcacgcgntgtcgatcgctgatattgcgcgcgcagtacgctacgatacagtgtgatcgtgtgattgtatgtatctccacacggcnaccantcgtgacgatagctatgtgntatnctcgcgtcgccacagacgtatggtcgtgtcgtacgtctgaacggncgtagtgtagcatctcacanaccgtncagatancgtgatgcagtgactanagcangacgactgtgtgtgtaacaancgatacgacgctgtatatcacgatctaatgtctnctacgtacgagacgcgacgcatatagctatatgatcgnancatnntacgcagttgntnantcgacgctncngtatcatgcggtcgcgcgatcgacatgagacattatgagtaactnagtggcgcgtcgatatgtgagcgacgctgcgagatcactacactcgcgacgaccnctcagtatctgcgaccgacgagtgtatgtnttgngntncgtgagcgatgnctcngagcagacacatacacgttactncgtacgatagctcgatactacgcgagtcgtatcatagtatcgntgtgtgngcctctgactcgcatagcntgccagacatgcgacatagatagctacgtagctgtatcntcgaggcggacagtnctcgcgcggagtatcgtggtnagtgacgaacnantgtagtagtgcagtncatgagagcgcggaggcgtacgtctcgctgtgtncntcgcgcgtcctgagttcgtcgtcgtcngcnctngctgancgaggagcgcatcacctaagtgtaccatcgacactatcatcatgtgtntagattgcttgagagtgatacatgcatgcagctcgcgcagggtcgngcactagatccgataggtgcgag

SEQ ID NO: 6898 - DNA, 1551 bp, Homo sapiens
  misc_feature (1)...(1551): n = A,T,C or G
atgatgaaataanaatanatatgtaaaaaggaanagaatagagagagaagagatgtagtatgatggaggcgaaacgtagagagagagagtaagtagtgagnagnaaggagatgtggatatgagggtttatgtgtgttggtatagtacccatgngcgagtgtgctgtgtgagatgtntggagagtgaggtgtagatgaatacccanaatnatataatgaatanagagnaagttacatagagacgaaggagaggganagatgttatgaataaatctacgtaaaaatacatgaaagaagatagtagagancnagtgattacncatatgacgtatgnagatgtagtgacatactcgtagcagagtgagggaggagtcggtgagtgatngtagatgtattcttgagatagatcactacgatcgtagtgctagagtactacncagatgatngtatgggacncgctaagacggagcnagagagagtggatgcgcgagagcgagagagtgctagaagaagcgtgcgtatgagggcatgagtacacnaatgagtacgtcagcacggcgaggtacganccaatgtatcactggacagcgatacgagctcgtgtgctcgagacgttaatatacggacgcagagtggangatgaggagagatgaggagcagtgtggtgataggattatacagagaaaatctgagacgatgataagacatatatagattaacataatatcacgcgattagtatagattaagtatatagaactaacaaganatcactagacantcaagacagtaatactctcaggagctcaatatagtaagatagagtagatagagggaccatgcgcgtgatgtaacgtatcgtagatgtacgangaattatngagagtgatntcgatggtcatgcngcggttatcgattgatgtgtatcacgcatacacgcgagtaacgaagagaagtatgagataatagtaagtattacgcagagcgtgagatacgcaatgaatagatgagagaatngataatcagctagaatctacagcgacgactatcgccgggacgantaacagaagctgcgagcaagaaccagaattgagcgaacaaagcaataaattataatagatagtagagagntagtgatagagatataagangctatatagtagaagtagataatgggatgaatgagaggagaagaatggggtaagggaggatgatggttaatgtcatagagatcggcaagatgtaaccatacgcatggagacgtaatgaacgcagccagccacgctggcgcgtacgagaatgctacgaaacggatgtgacgagtacggcacagngatgggacagcgagcgttagagaaaagtaagcncaagactcgacataaactaacgacgtcgagcacacttcaagataacattatattagcgtatacacacaataatatatgatgcgtagttgagtcgagatagagagtagaagaaatatactagaacaatatcgaaaaagtgataagcaattcacataaatgcattgaattgcanaacaacaaataatg

SEQ ID NO: 6899 - DNA, 1468 bp, Homo sapiens
  misc_feature (1)...(1468): n = A,T,C or G
cctggacatataacnacatatcagaaactcactcatgcctgcgcgacgncactgctctacgaggtcgagcatgcatgcaggatgtggggagcgtgagagagatagtgacgccttgtgtggtctttcacgaaagtgctatacanangagcgtcgttgagtgcttccncacaccctctatcntntctcatgatantntgtatatcgggcactnttacagatccataaanagtgtgcgnnnggtccggggaaggggaggagaagagcggctggcgcgagcgggcatatatctacgttacctccgcagcgcgaacgcgtgcaccatctgtgttttgctcaactgcacgcccaccacacatcgtgaggcatatagcacgggggacagagagagcgaggacacaggggtgaaaacgcaaacgggagcgcagcgtgaggctcacagtaggcgaatgtgtgcagcgcggtgtgagngngtgaaccggggactcgatgtgtagagcgactagtcaccagggcggaactaatgggaggagtaatggagaggagtcgacgaggtcgggtatcgatgaggtgtggaggtgtgggccgcgtgcgaacacaccaccactaaggacactctcggtacctcggtgtttatacagcgaacgtgtggagtatgaggtgttctcagatgcgcgtgtgcaacgtcggaccgctaacggtagccactacgacgccacgtgcgggtcatcatacggtggcgcacgaacgcggtagcatgtcgcgaaggcgcacactctgagaccgcatcatggcgtgcagtgccgcntgngactcgagcaaaataggagcaggcacgcacggtctccgttatcaccgacttgctaggacagatgganggcgctcgtcacatgataacttcagctaggaacgtattgaaatcacaggagggtcacccgcgcgnnagtgctgcggcaccgcacgcagcgcagcacgcgtgtttcaaccgatcgtgcatgtgaggnnggatgataagaggtagggtgtcgcgatgtcatcatgtgcgcacaagcgcggcgacgccgcctnggtggcggttgcgcgctgcgngacgcgagtcgcggcatcgagggacgaccgcgcgtggagcttgggcctgactgaccaactacgcggactaatcatacgcgacgctatctggcatgcatatataagaaccaggccgaatatatcggaggacactatcgcggtgcgnagantgcggtgacgacgttagacacgtacnacgacataagactatcggagacataattattgaactatacgaacactcagagagacaccaacacctanttctattagagcgcgcgacagagcctgtgtgaggaggagaagagatggngggagcgctgctgcagaacataacaacaatcgagccacgacggtagaatcaatgtcacctctccctccagggncccgactcaggaccaca

SEQ ID NO: 6900 - DNA, 520 bp, Homo sapiens
agtaagcctccatctagacccaactcgccgccactctcgcccgccccttttggtgtaacgcgacgacaccactcccaccactattcttttcccacgccaccacacccattgttcttcttctcacccccacacgaaaactcccctcttctctcacaaatacacctcccgcccccccccctctcccaaagcacaccgacaaggacactttttcttagctcttctcaacccccttacacgttaaacatttcatcacgccaatcggcgtgctctttttgtttctaccccccacctctctcaaccaacgaatcctctcctcctcccgcccacacacagaaagggtcccccgaacccccattctttcttgctttgtttggccgggctttttctttcttcttttgaggtcttacaaacgttcttcctttaaagctttggtccaactccagtctgtgtttagaaaataggcatttacttataaagtcaccgccttttacaccccttaaaattagtaaaaaaaaaaaaa

SEQ ID NO: 6901 - DNA, 1060 bp, Homo sapiens
  misc_feature (1)...(1060): n = A,T,C or G
cttaaagctgcagctgacctcttcttaatttataccaccgtctacagcttcgccttgactcccccgctcgtagtagtataacctacgcatacggggtagggcgttaccactgctggtccccatgtgcttgcaatgtatactcgcagacgaccccaccgcctcatcctggnctttcacgattncatcgacgtcaatcaaatcccacctccagtacgcgataggggctctgcgccgctttaagtgtgttctttgtaacctattccccgcccctctcatctcatgtatttttcccctagtttttcttggagaagcctcagagcgcttgttatttctcccgcgtgatttcttctgtcctgggatcatgcttgttcgctggtgcttttaacctatttctactctgtcttccgcccttctctctactgttcctttgtcttcatccccctgtttttctatacctccatgtttcttacctccgctctcctttgtttcttgtttctccgtnccgctctcctttcccctcttttcctcttttcactttcttttgttctgtgtgcacccactttgctggacgtggccccttctccttttctcttatctttctccttcttgttcgtctttattattccttgcgtccttcctccctcttctcatctaataattattgtctccatgtttttgtgttttctcgccccattcactgttaattcgtatcgcgttttacccactttaatattttccgcgcttgttttattttntcctttcgcttctttccttctctttttctttttttttgtatttcaccgcctcctcttcctttttcttttctttctgtgttcgccctcctggcgcttttcgctatttatggctctgttgttcttctcttcttttttccgctcgccctcttccctctgctttttctcccctttttttccaccatttcttcccgcctattctacattatctctattgttattttatattccccaactcttcgtttatattaacccctctccattatttattctttctgtcatcgccttggcttcgcgtagatgttctc

SEQ ID NO: 6902 - DNA, 1804 bp, Homo sapiens
  misc_feature (1)...(1804): n = A,T,C or G
cctgactactacacgtgcgcgntcattcatgactactctntacncgctgtcgtagtctgcatcnctatantananangtactctactncatttcacctcgatgacagagcgacgtcagctcagtggacagcagancagaacgtactctgcgcaccaganatcgcgtagatcactcgtcgctagagcgtgtagtcngngngatacgctgancgacgagctctnatanactnctactttactagcgtcgacgatactacgatcatgttcagtcgtactgctgngcgatagtcttttanccttatcgcacgtgacacgcattcggnagtgcagtctcgtacgcacctnagcatactcgtnangcacgactnactctacgnctcngttgacatctgtacgagagacaactgtcgtagtcggcctcgtcgatanagtatncacagtctgcgtatcgatcgttcactacgctctcgacatgantcgtccgacgagcttctcgctcctgatgagacgtacgacatacacgntcgactgtcanatatgtagcgttaggtagcacatgttgagngtnatcatgctntcacacgaacacatgagcactacacgcactatagtacgtcacaatcgacgcgaactgcgacntacatgtaagcgncatgtacatacgtgtgatacgtcgtctgcatacgcntctgagtgtcgtcctngtnttatctgatangtgatatataacatgtacacagagngacagagagaatggaacgacgtctccgtcgttcgacacgtatgagantatatgtagaagtatcagcgctcgaccactgtcggtnatgcgtgtcgtggtnggagttcttgtcgagttgatgcttgtantgtctagtatgatgccacgtnagngntgagccgatgcntgtaatacgtcgacgtcacgtcctagtcctgactctncgagtcgctgcctctgtctcgtccgttactatcgtcgcgnctacgagatatctatgtatatactctcactaaccgtcctgacacgcngcttgttgcagatctcgncgngtactccctactacatgtcggacacgcaccgcatctcgtgtcgtntctacctntcntnctnactgcntcgtagantcgtcactnncntgctctcgtgctncgtcgacacgcatcgcgatgtacatacactatctatctcanctnttcgcctctantgtatcagtatgtcgatagtgagtatgactttagtcatgtgtcagtntcgtatgnatcgntactttancatcaccacagtancgnctacgttctcagtcccgcgttnagtcgttgcctctcgtgtagcnctctcagtcatctgtactcactctctatacatcgtctcgcgtgccccctctacgtgtcgctgcgcactccccatacttactctctactacaatctgttaatttattatttataataatttctcatcttaactattaagatatacaatatatactaatcactacactcttcgtacacgcacacacacaccatcaccacaaaaagaaaactataacttcacaagccctcaagacagcagccaagccagacatcccgtatcggtcggcctcgagnggaatcgtgtggctanattactgtatcaggcaggatactcgcgctncgcctatgcacacgtaggctaagacctccttaacaaaaaatactattcccctctgtccccccccctcaactcccccggctcgcgccccctccgacaccacaccgcagcaaatccccttctacttcactcccccccactaaacataccaa

SEQ ID NO: 6903 - DNA, 1227 bp, Homo sapiens
  misc_feature (1)...(1227): n = A,T,C or G
gatctgcgcgctacatccggccgtctatatagccagccggagaaatgtaggcggaggggacgcggtaaacctaacgcttgcgactacgacttggcactgcaatatnattaccacgcggctntacagagaanaccttcggatagatcgactcagactncagaggagnagaggactcacccctcgttatatgcgattacaggaccggtgtacgatcgattgtcgtctaaaccctcagccagccccatttagattcgcaacgagctgaattcattcaggtcgagcatagtataccgcagcgtacgctcagaggccccccacacgggtctcgcagtgacgtgttccatacttgtcgcgcccccctctcggccatagtatgcagtagcgtaacattgcgcgcccgcccccgctcttaccgctggttacgctcgcacgggttttctaatgccgagacgccgccccgcgctcggtgatgactatcggcaatcgttgtttggagtcggaaccccccatcatctcatctcgccccatttacgagttcgcctagtcgctaacttgactccacccctcatctcacttcttccattttttctcatcccgcgctatctcccaccggtgtcagacacgaccctaccgcgcctcgatggttcactctgttcacttcccgagtccgccccgccgccgttgagccactacgccaccacgtgtcggtatgctaaccccacaataccgcgtcgccgccccatcccattaccggcgccttcgcccacgaaaccctgataatagtcgggtggcggcgcctcccgccagtcacacgtactgactggcacgcttgttctcggttttcccgcgcttcccttaagatagcgtacgctcggccccccagttgttgttgcgccgcgcgattatcgcttctacttccgtatctccgccggccgattacgacgcattatgtatgcaccgcgccgcgcggctttgccacgcttgtctacgaagtctgcccgcaccccgcctttcctgatcctatggtctccccgtccgtctcattattttatccccgcgcccgtccgccccccgttttcacacccccttctttacctcttattctcgcgcctatgaactagattccgctatacactagcgacacaggcgcaaacatcggcctgttattatgccgcccgcattaagacacgatgttcacggcacggtagctgcgcgccacaatccttg

SEQ ID NO: 6904 - DNA, 1458 bp, Homo sapiens
  misc_feature (1)...(1458): n = A,T,C or G
gtgtcttggagcagtagccaacactagcagtgttgcgcggtgtgttgttggtaatgtgatttctatttaatatgaagactatgttgattgtgtgatcgtctcttcccaagttntngtcgatctcgtactcgcagtcattatatatggtcatgagtaacgatncacacctgatgtgtcaggcgtcctaggtgcacattctctgttgcgtgntatagacaatctctgccggagttagatcctacgagctaggtgctcatacctacggtggcggacactaacactggcgtgcggctccactcttcgaactagacgtgtggatgtatgcgcacgatccaactacactcagcccctctgcgtactccatacacatcattggtagtatgaccacctggcgatgatgctatgtgataacgcggtagggtgcgtgtgataggtgtgattattcatgtaggaacaacaacaatggtgtgacttgatagtgattacactcgnggcgccctactgggctatgaactcacacactggatcacatcttgcgtgcataatagcgtgcgcatccgcgactactcgnttgagacgtgtcactctaccacacaaacacccaaacacaagttttgagattcggttgttgcccgtcgttatttacttcgcgtggtcgcaaactcgctctatcacatctactccttgttggtggtcctctctctcaaactacgtcaccggtgtgtgtcatcatcatcacatctttactaagatgatgtgtgtgtgtgtggtgattgccgtatttgtatcatcacgttacttcacaacacttgcgcttcctcggtgggtggtgcgtatcacgcacacagtggggtggacacaaacaggacgggttggaccatgtcaacagcaacatccgccacacggggggcgtggtgcgngggcacataacatcggtcgtatgctagtgggggacactggcgtcaaacacagtgtgaacacaacacagtgacgcgtggtgtggtgtagatagacaacactctgcacatgtgcaccatgttgtttcagttgtagattattgccttatcgaacgactgctggtgttggaatacaccgtgggtgtgaaatccagaacaaaacaagactggatgggcgttgtgggtatttaattgcaccgtgggtatagtataatagatgagtatanaatcttgatgtgtggtcacggtacacttggaacgagcggtgtcgcgtaatcaacaaatgagtgtgtggtgggaactaatatgtgggatcgagtggtgtaacaaactcttgagacacatcaacacgctattagaaggtgcatgggcgggtcaaataaaacacaccgatgacacatgattgttgttttgcgctattctggtctttgctcttgaatataacaatgtgggtgatagtatcctatctggtgtagccgtgatattggtggtccataaatgg

SEQ ID NO: 6905 - DNA, 1189 bp, Homo sapiens
  misc_feature (1)...(1189): n = A,T,C or G
agctcttatctaccactagactcatcttcttcgcgtatactggctctctnccacgtccatgagcggtgtgttgtactctcgtttagacgtctcgctcacatatagtaatctgcatactgagcacatccagcccggcgacgcctcgtcacgttcatccttctcgacgcgcgtgctaccttgtgtcgtttgtcgtgtcgttgtgaacactatacttaanatatatgtcgtatgaattccgtctccatcatcgttaatcagatgaactaccgatagttcggctatgtgtgtatccgcatgtggtccgcatgttcgtctcgtgaaataaaggtagaccatggatataatacatcactcatctattactctaatctcgctcacttctnacattatactctcatttatctatcagttctctcgtatcgatttacttttaaacagatccgctatctggacacgacggagttagtgaagtgtctctcatgcacgtcacatgacctctttactaaacattacaccatccacctcgcgtcgatacctttctcttggatcttcttgagctatgcaggtagtccgggtgtatcgctgattctnggttgactgttactactatcgttcagcaaagaagatagctacggcatacgacagcggtcagcccgcagcgcgcctcaaattgacttgangcgacggtggtacctcatcttattatattaactctgtgttattactatcatttattattgttatataatagagggaacttttagtaatatgaatgactccgttgctgtatgatgctgacgagggagttatagcgccttatttggttggttttttgtgttttgtgtgccaccgatcaccgatatgttatggcccagtcccatgctgccaccagnaaccagcatgttacgaggtggggctaaggctagtgtgggaggtggtggccccagatcgaaagtagcnaggctcaaaatatagatcagatgggagagagctccaccctacttcattcgtttgttcgttgtgtttatcagaactcatcctctaggttgcgggtggtgatcaggtgnggggtggcggtctgttagacgcctgccccgcgcgttcccctctaacgcctctaccttcccccacacctttcctgctctctcctctggttattcacataacatctcctcttataacatattcc

SEQ ID NO: 6906 - DNA, 954 bp, Homo sapiens
cttaatgcaaggactatcttcgcggtatctgtgactaagcagtcacccgactagtggtacgccgggttcgttaccttttccactgaacggccttacctcaaagtgtccacacgttgagcacggtactatgaatattcacgcgacgcaagtcacacctacagtacactaaatatacccaaccaaaattttacccatcaatctatattatataccccattttgtctgaccaacgatggtgtcgcagtaattaccatcataagcttaccttgccgaatcatccaacttctctattgcgcccaggtgcaatatgatacaacaatctatacataccccacctacactagcacgagcagtcaggactaatcttgatccgtcctcaatattataccatcacccctatctcgcgagcgagggggggcaaaatagtctatctggctgcataggggccgatacttattcagtgtgatcccccctgctattcccattacggagttcccgtcttataaccaaaaaacatctagcacccaccccacacaatcctttatctagaggtaaaagattattcatatccagatttgcatatatccacacacaagtgatctgtttttcatctagcgaatcaaagggaaagtcattcttcagagttattgacagatagggagttttagatttcagataatatcaagtttatcaaccttacatagaaattcgcggatagcagcatgtaaatttcaggcatatagtttttacaaaggaatatagatatttttcaatagattttcctggactataaacacaacagggttcacctaggtttctataagattttaccaatatggcaaagcaaggaccataggaaactcttgatggtcatattgggggggaagcagttataataaagagtgatgcggcaagctatataaaacagcaacataatgttgtagaatcgcctct

SEQ ID NO: 6907 - DNA, 794 bp, Homo sapiens
taggaacttaaatgccatctcttcatggaatggatgccttttattcacccctacctaagaatcaaaagaagatggagcagagcaaggagcccaggcacaagtcatggtacctttggtagtagcatcaggatcctcagcggcagacattgctccagggactcacacctgagcaggagaggatgaacgcggtccctgtccaggtggctgctgaataaaagcccaggacctgccagcttgatctctggacgacattctaaacatcaagtaatgcttcccggctaatttaactaacgacaagccgtgattcaaaggccttaatcactgactcactcgacaaaagtacccaccacaatctcccccctattgctcatacatgttttacacctacgggacatgttagtaccccccgtatcctgatttcgctgtcccgctattatcggcgtgtcccccgattacacactttggtcacattgatcaattatccccatttcttattcatgtcgtctatccactttatataccgccgcttttcacccgctatcattccccccctatttctattgtttttattcgcccccccctactactatattactataaataccgccctctcctattcctcagataatgtctgacatcctttatttacaccgccccgtacccccccatatccccccgtcatttcacatagtttcccctataaatgttgtcttattccctctataatctaatagactctcaatattccctccccattatcacccattctgatgccacagttaggtagatattct

SEQ ID NO: 6908 - DNA, 988 bp, Homo sapiens
  misc_feature (1)...(988): n = A,T,C or G
gttgtcttggttgtgtgttgggtgtcggccttgcggtcgcgtggctgcggcgtgtgtattgtggtggatgctcgcctggcgtcttcccctctcttcccgttcgcgtcgcgtcggtgttcgtttgtcgcggccttggccgcccggtcctcgcggcgtaccgttgcgcgccccgtcgcggggtgggcgcggggcgtgggttcccctgggtggtgtcggtcggagccttgcggtgcgggtgtgtagcgcggaggcgtgagggtggggggcgcgtctccgcgctcccgcgcgcgccgcgcggccgccgtcgcccttcgggtgtncggtgccgcccggggctccccgggtcgggggcgccggccgtgctgggggggcgcggcccggtgcgggggctggcgccggcgtctgcgcgtgttctgtgcgttcgtggcgcgcgccgctccggccggcgcgttcgcgcgccggtgccgncgcggtggtcggtgtcctgcgcggggtttggcgtgtgcgtcggcccgtgccgcgtggttctgggggtggggggggggcgtcgggggggcggcggcgggggggggcggggggcctggggttgcctctctgtggggggggcggcgcgtcgggcgccgtcttcggcccgcccgcgcccgcccggcgcgcgcgccnggggttttttaaaatttgtttttgttggtgttggtctggggccggggcgcgggcgggtggcgcgtggcgcggcggcccgcgcccgcgcccccccccccgccccctctcccgccccctccgcgccccctccgccctgggccggcnncggnggggccnggccccnnnccnccnccccccccccccccccccccccccccnnncnncncnnnngnnnnnncgcncccccggtcccccccccncagcccccccccttnggtctcttataggcttctttctttttttttcctcttttgttcccgcccgcgccccccccnncccgcttaggagc

SEQ ID NO: 6909 - DNA, 343 bp, Homo sapiens
aacaaagacaaagtgcacattgaacatgtaccgcacatttaaacacattattttgtaaagcggatcacattagaaggtgaagtagttacactagtagataccaggacgtagagtgttccaccgtatatcatttttatttgtttataatatatcaaatggacgggttaaagggagtttagtactcagtcagttgtgtacgataatcatgatctttcgttgaaaatacagcgtgactatgtgggtaggtccattcttattgagattaaaagttgattaggaatttggtttctggcagtgttgtatacatgtgagtgtactagatagcttaccaccggataatcgt

SEQ ID NO: 6910 - DNA, 595 bp, Homo sapiens
  misc_feature (1)...(595): n = A,T,C or G
cccgcgtctccggtgctcacctccatggcgtagcttccgctattcagtacccttcttctccccttgctatcaaatactcttcatgcactcagttacatgtgtacagtccgctccccactgttccccgcgcgcagatcttctgtggtctctcacactcacgaagccttctgtatgcgcggccctcttctgtcggcatcgcagtgtgtctggtgtgggaggctaccggtagattgtatacncactgcgagttgggctttagaagggctgtccctgcatcttgcgttctctgcccctcaaggcgcgcgctcgggtctaccccggggcctgtctgccagtaatttaatccggggggggggggtgtattgtacgatttcctctccgcacttgtcatcacaggtgttttggctgccttattccacgtgtggccggatagtgggtagtttccgtccaaccatggtcatgtcngctacnnatttntcatgcattnnttttttttttttcaattttttttttttttttttttntttttnttttttttnnntntntnnnntnnnnnnnnnnnnnnnnnnnnnnnttnnnnnnnnnnnnnnnnnnt

SEQ ID NO: 6911 - DNA, 1989 bp, Homo sapiens
  misc_feature (1)...(1989): n = A,T,C or G
tatgtggnacacacctcgtagtcgtgcgctgcactcaccacacgagtggtgtctgacctgtacgatcgtacacacaccgtgctgctgtagagacgtcatatatatnctcactcacgaggcgggtataatcgtgaggacagtagaccggaacagtcagcagataataatgaaccgcgtctactcagtacgacacgggcgcgtaggggcggtgggcatcaaccgcatcaccacgtatgtctgtataacgctgaagcaccgtggtgcgtcagagcgtagcaggtaaacatcagtatagcaccgtaacgcagcagcgagtgatagtatgtgacaatatcgtgagatgtcnatgatnatatagtcactgatgcaagcacgtcgatgggntgtagtcnagagtgngactagacatgaggcnagcacccgacagtgctaccagcgcacgtcgcgacatgctcacgntgggcgtcgatgcgagtacncatcactcgcacacacagtctgacgacacagcgtnagtgagcntnangtgcgagcgtagngcactacacgcgagcatatgacacgacagcgagntagtgnacgatgccgtccgcngcgtgatcactggtgnggcgantatcngtcactgnagtgnntatcagcacatcagtncgcgaactaanctgacgcacggtcacacatcacgtacnacagtgtancgcaagtggacgtctgatcaggactcagctancancacancatcnagcagttgtcntgacggcgcgcagnttctcgtctacgtcnctcaccgncagcacacgcactcgctacatatcgtgtngaggttagatngcactnctactagntacgtcgngtttangngctgcngactcacgtatnacntatacacatcangctggcgctangcgagcggatctatgtcgtatgcacacatagtcanatgcgcagcagtgacgnctcacaattcgctgacgngcgcagcgtcatntcagcgcacatcatgtcgcganatcgcancaaacgtntgagatngcctntagctgtagcgacgtatctctccgtgatggtganccgtcgatcgtagactgacntgatgtagcgatcgnagatngcgcgactgcaatcaactgctgcagctcacgttgtgctntctgataattcagagtgcacgatngttgtaatcgacatatcnacanantctncgatganntatnctanagtgagcagngcgatattagctagttgncgtctcatcgcacatcgaccancttgttattggtcnagangagtnatantgaagttagcgatgtcagtcgcgctctatacatgatagtagtcatnatcgcgtgcgatctgctagtctggactgcangatngcngatgtctncctcnatnccgactctgtgatcacagtanagcgagcntcacggtactacctcncacantanagtgatacacatcatgcagagtngnagacgtgtacgaagnctcggtncgatgcagagcagtgcagctcgcgacagcgctggcgtcnagacgcagggcagacgatcacgngcattcgacnacactcaggccaggactcatatacaccagtataactgagtaatcaagacttcgcgagctgccgcagatcgcagcgagctgcgtccgcagncctacaacctctggagantcatacatcagcaatcaaacacacggccgacgttgatacgtgagtagtacatagacgatatgcacatgagtagtacgcgatgataatcgagagngcagtcactctncataactactngtgtgatgtagccgtccgtaatcaacatcagacagaagcaacatactatacagtatatgnanagcgctacgtactgcgnatgcgactgatngtcctcggcnattctgcgatatatacataccgtacacttgntgtgacatgcgagcaactcacctacagcantgcacgcgtancgcacgatctgtcagcncgacagc

SEQ ID NO: 6912 - DNA, 1328 bp, Homo sapiens
  misc_feature (1)...(1328): n = A,T,C or G
cggcgtgggtgtatttgtgagtttgggtgtgntgataagtgcgagtagagatttgtgttgttcgtagtccacttttattatagtttttaagtgttgggtgntggtgagagaggattaacaaaagaacaagaaatataagatattatttatgagtgtgattggtttgagtataatgagagtttttacagtgatataagaacacatcgacatgagatccaaaacaacacccaaactacagatcaccaatatacttacgttaacatgatgtatcatctgtctgattccgagtggtagagcatacaatgatgagggaaatcacaccccgcccacccgcgggcgacaccggcggacacagggatcgccgacaaatataaacattttatattagcgtcctcgtgatgcacccgacacggtcaaaatgaggggcgacatatgatagtaacggaagaagcgctctatttgatctgatataactacaactgacagtgtttttttttcccgcggcgcgcccccataataacaaccaccccctctttttttccccccccggttcccccgatttttaacataaatcaaatatcatggaagcgataaacctgataatctcgctttctctctattgtcaggtcgactgtaagttgcgcgtgacgattttgtctataggtaacaaaacctgaaggatatgcaaggggtctttatatcgtaatatacgcgctctttcgttaccatcctcctgctcagaattcgacgcagggccagtacttccgcactcgcgttaaccacgatccctccacattttcgaaaatactcttatcttaactatcattacttctcatatctgctatttcatcacatatgacagataattcaagccctcaaaaagcgaacatagcaaacagacagtagaacatcatattgctactaataaaatacatccactcacctccaccacactcatatttcagtatattctcattctcgctaacaggattatttagcatctgcgaacgtcaacataccagcaacttctgtaatatccgccctcatgtccaccacgcactctcggccgcttatattggttttctatgtgccctcgatccctcaaccacatatatctatactcatctaccggtctaccgctcttgccctgccgcgatatgtgtgttattgcgccgaagttacatcacgctaatactactgttctgcgccgcgccttctccagtcaaacacacctcactccaacaatccagctgagatcggctataaatatacgactcatatcagangtgaacgaagatttgcagagaagtaatagcacatgacagacg

SEQ ID NO: 6913 - DNA, 220 bp, Homo sapiens
  misc_feature (1)...(220): n = A,T,C or G
ctttctccaggtttcccctgttttttcaaaaaagacagacgggggcctgctgcggagacaccnnnnaaaaanttcagcgcgctcgggcctggttctactgtacattgagcattgcactgagtcccgttatgacgcaccgccggggggcattgtaatatatacacggtggtccctccagttattttattgtgcctagccgcctatcttatgtaactttgtt

SEQ ID NO: 6914 - DNA, 1238 bp, Homo sapiens
  misc_feature (1)...(1238): n = A,T,C or G
gcaccgacatcaacccgcacgggacttagagtggtaccgcaaacggggggtggttttgttataccaccgagaacacaggtctctttggntggtaagccccacacggagacccgcagacaaatgcctacaaaaaaacagatgataatatattacacacacgggtgcctaaggtcttcacctacatacatcaaagaaatgcaatctacctatcctaccgtgctgactagtcaccgctcgcgtactatctatctcctacatactcgtcgacgacgctnaataataaaaaaatacgtctgaagatagcaccaggcacaccgcgatgtgtctctccctcttctatatgtcatacgagagngcaaagtacagaaactgttgctcgtatatattcgatccggcgcgtgagtgagcggccncantacttctccgcgtaacgtgtttatcgacatcacatgaatatgcangtagatccaacgcactcgataaccggcagttcatagtaacatcaaatactgcgaagcgatcgtcacgtgactatacgcgccaagcgtattgcgagagtcacaataaccacgcgtacacaccgtcactcccgattatcgacaaacatacactaagagtatcgcacnaacacgtaaaatatacaggtaattaactcntccgcgtatatcgcatcgggtacgttataggacccgctataccgcccangtcaagataaantcgcacatattataccgcaaactattcatggtatgtaaagctaagcatacatgacatttaatcgtcgtgagcangcaaacaccaacaactacaccgcggattcgagatcatacgcgaccagttcatatataggaacaacagggtgccgggagcgaggcggacactccgggcgcttatcggcaataacatacactgaatcgtggagaaaagaacggggatcaacgcgggcacaaaagaggggatgcgacacacacggaaacacggaccttggatttacaataacggcacagtaaggaagcggtatacgacagagtaagaaactgagggaaaaggtgggagaattcagctcagaataaactagggagggggaaaagataaggatagggaaacaggaagggaaacaaaaaccactgaatacaaaagatagtgggatcgaagaggactaccaaggagggaaaagatgatgtcgacagcggatggccgggaattgtcgtggcccgggcaaaagaaaacacacaaag

SEQ ID NO: 6915 - DNA, 1289 bp, Homo sapiens
  misc_feature (1)...(1289): n = A,T,C or G
agatttgacatatgtcgatacagtggtccgctactctattacaatggcnctgccactccgattacacacactccgcgatatacgattgngatgttcacntcggtctttaccctatattcgtattanagcgnacgcgtgactacgaacaagatagganacccacggcgtcggntgtataattacagcataggttctcgtgtgtatattgttagtctgttcgtatgatagacgtgtgcatgtaccaaaacttatgccgcgattggtcaggcgcggcggcaaattcatctccagccttgcaaggcgcgagataacacataagctattaagttacgctccgattgtcagcgatatnatattttacttattttatatctgatcctaatacctcgcattccgcttcatctccctcctctataatatactacaactacaagtttagtatctgtctccagcctatttcgcatatattctcaccaacacggatcagcactaagagcggcatagggcgaactctctacctccctctcagcctgcattacagttagaatgacttctanttttgtatcatgnaaattagcatgcaggtacatactcgcgacgccagctactcntcgcnctccctctcgcgtacctccatgtggtttcggcgccaccagtataatgttttatcggagtatatcgttaatgaatgttgagagagactaacgtcggtggtttgtatggtgtgtatggcttctaatgcggtagggtgtgttactaacaatataattacgtcttcttctaatgccggtatcatctctctaaattcgtactatacctaacgtactgtgataatgtaaaggaacgctccggagcgacgtgttatcattttctgcgatggtgcccacttgttcggcatattttgttacttggttatttagtttgtagttattttgtttctgattgtatcttttgtttagtgaagagtcaatgattatgatttgatggatggacgtctggggtgctatatctaggcgtgatcgcgttgtcgcttgcgatggaggaattgtagngtnaattttcaccggattatcggcgtacgagatggacgtgtattaactgctacgtcaatattaaatgtgtgtttgtgattctagggctgctccaccccacgacaaactctcctcgctctttggtttttctctataaaaatattacacctgataaaccgacctcactatacccacactatcgtccgcctcaactcacagcacactccccaacacccccccaccctaccccatctacac

SEQ ID NO: 6916 - DNA, 1017 bp, Homo sapiens
gtcgagtatatggcagctcgattattctcccgctcgtgtatcgatgtcgtgccaacctgctgggctcggcgagcagctcggacagggctgggtcacattgtggactcacgagggggtctatcttaactacctgttgtcgtacggcaggggtatggtggtgataaatgtcggtggggcggcacgatggccactaagtgcgatgttgccattattcagattaatggtgggtcagctggatatgcatatgtatacgtctgtgaggagaggcgtgctcgtgctatgtcatctacgtggtgccgacggcattatatttgtgtcttcgtcatcttacactggtcaagtgggatcggtgaggtgccaggacaggcgacgaatgggcactgtgtgcagagtgcaatgatttcttgtccaacttgcattacgttgttcatagtacagtggagagttctgctcttactacatctcccggtgtggaaagtcgtctcggacgtactcggcccggttgtgcggcactcaccttcgtgtgtatcgcatttttttagggattattatatcatctttcttcttcgcccgctagtgatctgctgttctctctcaactgatggctcatgcatcgtgccttgtttctcgagataattgtacgaatttgggcttcttttcatgcatgggcgcacggcatgttgggttaggtttagtgtttccagacttaatgaaatcaggcgtgggcccctcaaaaaaactttttgtttgggctccatgaagtcttgatgtgtccactctctcctatctggtaatataatgatagtccttccctttgatgcctacaattaagcaaacagccctcccatcaaagttgtgtcggtcaaaaaacattggttcgggttatataaccgaaaaaaaaaaataaaatcatataaataattataagatgttaaaacaaaagagactttgtgtgctgctgaaagaaaggcttttctgcttcttttctctgtgtcgtgcgtgtaactgttagggaca

SEQ ID NO: 6917 - DNA, 1232 bp, Homo sapiens
  misc_feature (1)...(1232): n = A,T,C or G
gagaacgaaggaggcggcgatcactctctcagccctgcacacccacggttgtattggactccgatcttttctcgtcgacgagttaccgcgtactccattcttatcacctccgtctcccacttccgcacacaccctgctcagcagaactcccacgggattgtaacgtaagctggaatatttcaattatcttcttgctgtgatacccattcgccacgaccgaggcgcatataactgcaaataaatacgttagtttcgaactgctccgtgtggccctcctcgccacgacgaaagaaagccgcgcgagctaagtgaagctatgtggaagcgtttaaagtagacaatttaatatcatccgatatcaccgcagtctctacagctatatggcacctagaattttataataattcatagcgggctcgtcgattataatgtctgacaaagttagtacttgacatcgatgctgatgactgccaccacttacctggctgtcggtcctccgttctagtgtgtggttgccttcggtcgcgatggagttatgncacaagtactactggcgcagttcgcggcccacgcgcgagcgatacagtgctgccatccgtatgttgtttgtcattgcgctccattccagagctgtgtgtctagtgcgatctgacaccccacgcgcctacttgtcacatgatgctctgatcttacataacgcactccacaatacctacctatctacatagtacgaccttgaagagtgaatgtatgcgcgactctctgcctgtaatcttagtagttatgtgtgatttggatgtactagcatactgcatagtctctccgtctcctacgtgtaagggtgaggtgtggtaggaaaccgcaaagatccaaaacataataaggagacgtctgtggcgagatcttctaatcacaggtgtagatgagagaactcccgatttgggcaccgcactcgaatacgttatgcagctgctttgcacgccacaagcacgacgcgagaaacacctcctgtgccaacgtataagacggtcgaagctcagcgacaggtacaagtgcgtcactccccagtgaggcggcgcttctggctcgtagatatcacagacaatatctcgctactcgatagatataactcgtgatttaaataccgcggacagtaaaagaattgtgttgctttagtccacgtatatatttagtatgttccgtttgacgtggcgctgacgacttatcgatct

SEQ ID NO: 6918 - DNA, 1323 bp, Homo sapiens
  misc_feature (1)...(1323): n = A,T,C or G
ctctttgtcggtcgggtctgctggcgcttgtgtcgtcttctgttgcgcgtcgcctccgttcggtgctcttcttccgttgctctcccctcgccgtttcctctctcgcccgctgtgcgcctccgcgtggtcctgtgttcatgcctgctcctgcgcctctctgtttcttcacgtgacctcttgtctctcgttgtcctctaacgggagtgttgtgtggcgtattgtgctcttctggtcgttgggctgccgcggcttggtctcttccttcgctcgcctcctctctgtttctccgctgtcctgccgtcgctcttttctcctttccttgcccgctgttgtgtgttctctctgcgctctgcctttgttgggcgtgcggggctttcgggcgttggtgtcttctctgggtttggctcgatgtcttctgcttcgtgctgggcgcccgcggtcccgtgatgtgtctttcttttctccctgttctctctcctatactnccttcctcgcgcctgtgcggtgcgtgtgttcggttgttcgtgttctcgtcgtgttgtcttgctggctttccgccgcgaggcgtgtgcggtgagtaggtcttgcgttgtggttccgtcgctgctactcttcgttctggcggcccctatagtgatgttggggtctgttatcgttgggggcgatctatatctccgtgtcggtgtttgctacgtcgcgaccgctttgctgtcgttctttttgtctttcctgttactgtcctcttgcccgcgcacatccatcaccccgcgccgcgcgtactatcctcgtgtcctgtggcgttcgctgctactctgtcctctctcgctctgttcgtccggccccgcggctcgcgccgcgctggtgtttcattgtgcgctgttcgtcgcggcgctttgcgctcgcctactcgcggtgttaccttccggtcttgccgctctntcgccggtgtgcttcgctctggttggacgggatgtcttctgcgngggctgtgtctgtgtgcgtcgtctcgtgttgatgcgtgtcgcgcttcctctttctctgggcgctcggcctctgcgcgtggcggcggtgggttggtattggggtgtgtcattcttacctcgcctcgtcgcgccgcgcgctgttgtagtatcgtactgggcgctgctgtcgctgcctggtgtctcggttggctccctgctcgggtctcctgtcctgtcgtgtaaaaactttcncgtntcnccgtgtgtttcgtccctcanggncaggngctcgtgttctttttgtactttggtcgctcgcgctcttccttctctctccgctccccgctggcggtctgtttca

SEQ ID NO: 6919 - DNA, 1207 bp, Homo sapiens
  misc_feature (1)...(1207): n = A,T,C or G
gggggcatacaaccagcggaaaaccaaacaggacggcccgcggggtccttggggaaacaacacgccctcaagaatttgagtcttgatacaagccctgggcgggcaacacacaacacaccggagttcctatccgagtagtatttgttgctggcgctttatgaagccatccccctacgcgtacatgggaatccgcgcacgccatgcngcggttttatacacaaaagattgctgtgtcactaataagcggagaatgtgggcgactggtatcatatagacccgacgtccttaacaaacgtgcccttgagatatcctcgaaggtcgtggatacaacggactcactcctgggagggcggttataactttattgtagccgcggtggcattgttcgtctatatccagcgaacagcccaccctctcccacccgcgctctcttggattgtgtatcagaacgaggaccgccgcccactccttacatggagcgcaggcaccccagaaataagggatctccttgacgtttttgcccgccacccattctaaagctctactgcaatgggctgggccggggaaattatacaaaagagacccccttcctggcagcccctccaccttgaccgagggggggcgtggctgtttccggtcattccaccacggaagagcgggggcggctgaaccgtacttacctctccctaattaagcgaaaactgcggggctcttattgagaaatcacaccccacagtggtccgccgcgcgtatttatcactaaataggggagtatcgcgacagacgctgtgcaggtgtgcgcgagtcacttcggattacatccgccccccttagaaggagagcaccaagcgcactgcacgaccgcgagggcgggcgggggtcgccctcttaagtgttgggtgagtggcgtgattggcctctcaaacataactctgcgatatcctaacgtgggggcggtgggcgagcgggacgtcgtacatcacatcacgaagggcggtgagcgtttattatgtatgttatgtgggggcaccaaccgcgctcgtatgtgattgtatctcgccagtcttgctgatctagtccgtctcactgctagattcatgaagaacatttgctccgctctttagtatcagtgctctgcacacatctagagccgataatccggattgtattggcaatgaatgtcgagtatctccgtctggacggttct

SEQ ID NO: 6920 - DNA, 1505 bp, Homo sapiens
  misc_feature (1)...(1505): n = A,T,C or G
agcgactcagaagtggagggagcacgcggggagagggaggggcggggaggagggagagccctcactgtgggaggaaacanagcgcgcggaggggtggcctctcctacgcgggcggaggacgaacccccgagcgcngngangctggctatagggataggagaaggcagagaggagagagccgcgtctgtgagggaggagggtgagagcagagcatgcgacagaccggcacgaaagtaggcagatacgaggtcgacacatgagcgaacaagntacgcgctcacatacgcaacaagactgtggtggagatgatcgtgagagggtgtcgactgaagagcagagatagtctcgcggtcgtcatacaggtagcgcgccgctgaccgacantcacatacgaaataagacagcacgtgcgcagcggaacaccagaagtgaaagcgggtcancctaggaggtcgcgtgcgattgcgacggacggcacacggacgatggctcgacacaaggaacgagagcagacgacgagcgcgacagacggccgcgacggagcgacgtacgaccgagacggacgtgaggcgcaggacggggcgagcatggtgcaacggagtataacgagcacgcgctgtcaaatacagaagatcgcgggagantacgtatacactgcgcggcgcgaacagacagcgacgagagggagaacagccgacgcagtgaataggccacgcgcagagaccacagccgcgccgacgactgtagatcgcgcagcggccagatgtagagtaagagagacaagagcaagaagatagtgatttataaccatagataatggaccacaccttccaagtatagtggatggactgtacatcgtataggatagtacggttacgatgagcgcagagcagtggacctacgcgcgactacatcgagcactagtatggcatcgggaatatcttaanagaatacgactacattcccgcgctgcacccgacgatcgggcagaaagatgaagtgtacaggaggagtacgggcaaggcgtacgccgcggaccgagaggtgtgagagagagaactacaggcagatgtgagagggcgaacgcggtgcggtgatgcgggcgcgtatatagacctggcagtcaccaacgccctccctacggcacagagcagaagagatgtgagctagcacgaggcgtatgtctcgtcaggtcggcgtcatgaggaagcagagagagatagtataacagacatgtaatagcggagagaggagagacaaggcacagaaataatacgaacggagagatgagaacgcacgcgcgcgcatcgctgaccactctcgcgagnataaagacatgatgaaagggaagatgcgacgatatcagcgccgngtgtagtacatgatntcatagatgtacagacacaatcgcgtggtagagtgtgagtgagagatggacgtgntgagagcgagtcttgactggatggcaaacacaagtcagcagcgcacagagccgacgacgagac

SEQ ID NO: 6921 - DNA, 773 bp, Homo sapiens
aattagcgttggtgttcatcatctctacggagtctttgcagtggggatggtttgagtgggaactggcaatgtggcagttagcagggtgtacaagaaaaatcatatcaagactttgctcaggcaattgcaatctagctggggaaggctgacacattcaagaaaagagaaacagatgattaagcaccaaaatgagaggaaacctgcaacaggcattcagtaaaggatgagagcagacaatacaggaagcatgacaccagcatctgctcagcttctcaggaggcctcagggagcttttacgcagaaggtgaagcggaagcagacacatcacatggctaaagcaggagcaagagtgggaagaaggtgccacacacttttgaatgaccacaggaactcactatcatgaagacagcaccaggccatgagggatctggccccatgattcaaacgtctcccactaggctccatgtccagcaatggagattataattcaacatgagatttggaaggggacaaatatccaaatggtatcacctggaattgcagattccctgcagataaaagtgcccttgagagtcccgatgccttgtgaatcaacccaagcccagaggttcattcagcaaattcatcagtagcattatttcaaggtttttcaatttacaaatattatggtttccatagataaaattctggaaatttcataaattcacaagaaaggaaattaaatcaatggtatttattattcaaaaactattttttttggttggtatgtgtcc

SEQ ID NO: 6922 - DNA, 883 bp, Homo sapiens
cttctacagttgcccccggtcaaaagtttcccgtgaattattccgttccctggtcagggtcttggccacccacgccacttccattttcctttccttgtccagtgcgccatttttccccatcgtttgtttttcgcccgcagttccttttctgtgccaatgttgtccctatgtgtctcccttgtttgtcaccctttccaggagcacaccggtttatctcagcgcacctttagtaggtattatttttaggtctccccccccccccacactatgtatcctagggccaaaatcccaaatttcagttaattctttccaccagggtatattgtattacacggtatttttattactcacagtacctatctgttttggttaggaatgtgcgcacactgttttatgccttctcctttggcatgcacacgtttttctcaaattggaatcatgctatctatactattttgtgtttgcttccagaatacagtgtattctgaacacttccccttgacctgaagcattctattgtaatatacttttttgtagatatgttcagtttgcctggcaaagttagcaactgaaaaagaacctgaaaaggcattagcatcaagtaaagattttgttccattcaggaacaaccagaacatatttttgggctgcggggcaagaatctacggagtgattgaagagaaatatttgttgaatgaatgaacagaaggtgaagatggtgagaaggcagagagggggaggtgacaggagagcaggggtggccttgagaggaaacaggtatattttctgatggaaaaatatatatttggagctaaagaattgggctgatgaaggagagaatgctggatggtgttaatatttgcaataaatgcggatgcggccg

SEQ ID NO: 6923 - DNA, 1791 bp, Homo sapiens
  misc_feature (1)...(1791): n = A,T,C or G
ctcntatatctctcancatctcagctggngtccnatcgctgngnnacctnctacctcatgcgtcgttcnactctctatgctctagngngncncacacaangaccgagcgangattgtcttattcgacgcgcctgagtgcagncgtgacgatgctacactctatattgannnncgtctatacncgtnacttacctatgcggtcagcactctcactggcgtgcgcgtacangngaggcttctcatacancgtgcactcactctcgcttcagtacttatacnctctttctctcgangtggngagtgtctcgattcatctgcgacccctctactgngncnctcctgctaccgtctgcgcggcatgacactcgaggtcttctactatnanantctncatctctactgtnggtgtcttgtcggtgacgtacacttagactacagngngactacatacatgtagnannctccttctctcgnactctactgtctactctnnnaacatcatcgacagngnnaactcacgctgctcgcgccgcggngatactatgtgcgttaggnngcgcgcactagcgtgcgagtgatgttgtgtgnggcggcgctgtgtggagctgtcntgangnngcgcgactctgcacacacctctcgctagtagactgtnangtgnganactcggtgacatgagtgatgataagcggtgcgtcgactcatgggaggngccggttgtgngcgtgcgntctgcggctgttacgtgcgcgtgttgttgtcgctagcttctcttctgcgtgttnacacntctctcgtnnntcatgatctccgcacttctgcgagctncgactactctcatcctctcgagagnganctctctgtcggtgatctctgagcnngtctcgtttcctataacatatggtgggacattctgtngggcntcgtttgtanctctcacctcagcctctcttganaacccaactaacctcatacacactcacacatttatactcannnnnncacatcgtctgcganattgcttgatgagcaacccacgctgcggnngctcgctattctgtacgatctctctgcngngcgtcttctatcncntgttgcgcacgtgtactcgcctgtggnncgtcgcacactcagactatngnncactgtgactacgnnctctactacatgttcttcactatctacgttngacagtnnanactattaatcgtataccatccatatgatatctcgcaatanaagaatactcgtcactcattatcatatntcggtttctctgtctcagtcngnacgtcttctgnccactttcacaagcatacctccatnaaaatatatannactcattngaaactatatatancacaccgtatcctgttcacaactcctatagttagancnannacctcatcacagtatacatacactcacctatccatctacactcgngacacattcctctnctcttnnanctcctctctnnntcnncnancaccccaactctactactatacctctctntntntctnncccacactctctctncactcttcactntnnnattcctcatctccctttnnnnncccttatcctcttcactctccttctcactnttntcattctcttnnnnntctttnnnnnctcttctcctttccttctcttcttnnnnnntnntntnntctccttncttccncnntntancacntactttnnnnnnttctnnntnncttactnctcnctnnnnntncctccttcttntnncctncctttnncnattcnttnnnnccttcctct

SEQ ID NO: 6924 - DNA, 870 bp, Homo sapiens
  misc_feature (1)...(870): n = A,T,C or G
gccatatggcccggatttactcctatataacccccnaggaggagagctcgtcacatctcttcttaatttaccgccgatactatcttcatatatcttgacttaagagctagtcaaaccaaatgaaatataaccaccagaccaaaacaattttttcttttctacgacaaaggaaaattccttttcttcatatggatatttatagcgccttaagaacattgctgataaaagtatctgaaaatatttgtgacagttcgtactggggagatatacattcaggccgggctctgtgtgaatatatatatgttagatgcgcaaagaaagatactgaacagcgctttcgtgttttgtttacaggcctgattaatccggcccttattcacactttcagacgcaattaataactggacctgtcaggtcggaagaacttccatcttgtgacactgtaaatgcccgaggacgtttatgctacatgccttaaatggaaaatttacctttccctccctacgtatccgtactccatacctgtatttatttcgtgtctacaaagcggccaggttgaaggcgtggtgataacccccggcattgtgaaattctcaccgcttttagtaatccccggatgtgcccgacttcgttaccccctcttatcccagaaggagtccccccgccgctaatctcttatagcgtgtttcccccaccgttttggttctccgtaacacattatacacatgtctccgcgccccgacgccctgtatcgccccggtgtatccccttgccccgcctgttaggcggttggcgcggaagaggatccgattcctcccgcttgtacgcggtcatttgcttttgtgtcgacgcgtctttgagacgttttgt

SEQ ID NO: 6925 - DNA, 879 bp, Homo sapiens
accattcttcttccaaaaaaagaaaatcttttttaataggaaataaggggcctaagacaatttctaaaaaagatctaaaaaatttggccagttggccctgggaaaataaatcaggctgggctctctctggaaataatatgttaatggccaaagaaagatattgaaaacggcttatttttttgtttcaggcccgaattaatttggcattacgcattctattagattacaaataaataattgcccctgtcaaggtggaaaaaacttcctaactggtgccaatgtaatgttacaggcattttgagttttacaggccttactatgtaaacttccctttttcttcattacttaacaaaatcccaacgtgtgtatattttgctctccaaagcatccagctatgaatcatttttccacttgggaattttcagattgaaccacttttaagcaacccacatcaagttcttatttggttatttctttggtagactaaagtctaatcctctctctaaatctaaagttagttgcaactttgctatgatatttgactcttgaataaatatcataaacaactacagtgaccgaattatgtatgaatttcaaaagttatatttagtacaggtttccagcaactgttttagtaagtttagcacagcgtggtttcatttcaagtggaaaaggcacttggttcctcaggattcccaggatttaaaacagtcagtgaatcaacaaaacaaacaaagcaagaaaaatcatattatttttgaggaataaacaatatgtataagattataaaaatcaacaaaaaatgaaaactatttctaaaaactcttttatatttaattattctaatttcaagatataaaaataaagcctgatcggccg

SEQ ID NO: 6926 - DNA, 864 bp, Homo sapiens
  misc_feature (1)...(864): n = A,T,C or G
aactcacaactaggcacattgcacaaaataatggaaattaggagaaaagcgtgtcaaaaatcgatttacgggtactatatatggacgtaacagagagaagaacacgaactgatagttcctataaataacactttatatataaactaacatttagtttattaaattaaatggtaaatataagtggatatgtgtatctatagacaataatgggatgtagataatataaggaagaattgntacataataaactaaaactaaatcactgccaatataaataacacaaaattnactataatagaagcattcataacgggggaggggaacaagcacataaaaagtgaangaataaaagataaagaaagtaggagggaggaaggaaagaaaaaaagaaataatatacaaataaatcgtgaggattttaaatagactactttattgattttgcaaaggcaattaacatangaacttgaccatctctaaaatgggctggtatttgactaattctacaagtaatacttaaaatttaaatctatcttgttctaattcatcatgaacgtgcagtaacagnagatagtgagctcattcatgatggaatgtaattcatcaacttgcaaaagtatttaacacatatctttcattacaccttcctcaagcattttcaataattgtgcatttcttgcctttacttccttatactatgcctcccattgagtgattacatttttcagcttctgaatttcagcatctttcctttcaagctctaactttagtctttcaattcttcctctttcagaaccacttctgaaanttnntnntctaataaccaatcttnctncattacttccattnnctttaatttcctct

SEQ ID NO: 6927 - DNA, 1793 bp, Homo sapiens
  misc_feature (1)...(1793): n = A,T,C or G
ccgcactgtcgttactntgtatgcgtgactcatacacagtgctctctaagaaatgtgacactcaaatantatatctaatagatacacacaatgtcatatacgcacaggcgatcatccactatagtatgtgcagncaccacgagcatcacgccagaaaagtatcaagcattatcatcgttacatanattggtgatacatacatccccctcgtatgtaatatgacgtatgactatctactactcatctactatcatacctcntcangtagactactactgtgctactatacgcgatactctgtatcgatctcacttcgctagtagtnctcgcangnctgtangtgtagtatgatatcataatganctcatatagtagttacactccatatcatanatcntagacacgtganctacagcnacatatcgcttcttactgactccntgtantactcanattancactcatcgtatcacacactctcntcactcgcntagtancncgcatanctcgagnanatactcaatgagcaccagcagcacacaggtacagatatcgtgtcaagnagagatattgtatacgnatcacgcaagctagctntacaacagncncacatcgcacgcacacatagatgtacactcgaccctnttgtcgcgcntgagggtcatctacatatatcatatatnaatatanatacanangcgcgacgcncgggtgtcgcgcgctatatactctactcatatcnatngatnantctaatcgtatanactcgcgtngtcanatataatcttgctagtgacgaacgatacgacgcacatataatcatcggactggtgtcttgtaatcacgattgtcaaatcaggtgaatctctttatgtgtgcatcgcacacgatctcagacctnagtctactcgngtcacagactctaactcacatctgacttcgttactggntctgctgnatgtntacatatnagtatctaatcanactagtaggtcggtactnaaagcgatacgacacactanatctgtgactctatacactganatatatcgtgtaagatgctgacacgagcagcntttatgtctgtntattgacgcatacncctaatatataantatataacgcacagcgtcatatatgtctatntatattctctctctcttagttctatttctcttatcttcattgactacgcgacagcgactcaccatatcacgaatacgctcagatatatnctgcgagctcagatgtagatagactcacgcncgtctangcttttggctgatatcggtcgtcgtcctactanggntccctgctctaatgtcctnacaantcgcatactactataatatcactgctatacgtactacttcacagatctagctggtcgtatacttgatgaatacnatgtagcatattactagcacatgtgctagtcgcaaccaatgcagctaacggtcgtgcagcctctgtgacaggcatcttatcgatatgtgcacttggactgatacgacgttagnantgctgcttacatgattacttgatgtcatctgtcactaactttgctgagtgctatactatagcaggctgtcgtatagttatctagagcatatatgtgttatagatctcttcattgtacatagttgtaccgagncgtatcacatgcgtccgatgtcttaagtgtcatgactgtgtttacagtgtaagatcatagtaatctacgtacttgtgactgtgtaagtgtcagctgctacgtcattagtctcattataatttacactatatgcgataca

SEQ ID NO: 6928 - DNA, 1650 bp, Homo sapiens
  misc_feature (1)...(1650): n = A,T,C or G
tatctgactgatattcatcggcgncgagcatattatcctggaacggatcttgatgtactaactggagccgctacgcgcagtattatgcaccgtgacgtggtcacgccgacgacacgtcatctatagaatatggcgcgcgtcgattattcgtattatggaatagagagtataatagcgcgccgtgagagatatatataaacaccgcacgtttgttttattctcgttatgcgcattccgccatttcatttgtattcatatctgacccaccgtattttatttcgattgtattagtttactgttccgcgtctattcctatataacggggacgcagatgcggtgtagcagccgcgatgcagtgttcgcggtgtagcattttttataaattattcgctccacgcgctgagcgcagtatatgatatatatacggagacataatcagccgccgcgagctatntagttacgtgaggtagtagtatttccctatgctaacacccgatatcgctatatcgcgatgtggtcgtccgcccacgcgcgcgtattgttagatgtgttagtgtcgcgcgacctgtcaatatttatatagatcgatatcaccacnatgatgctatgatcgatccgacgcacgccngtgaatcacgtcatatatcacggacaagataanatatgaataantatatgcgccgaccctcgatcgtgtatacagatatcatgtcgcgagttagntgcgaacggaacaagcgcggcactatnatagtcgcatgacgtagagtccatcggactcgagatgcggcatcagctcgctatatattagtgttcgcttctcatctgtttactgatgtccaccgcagtcccgccnatcgcgcggacggatgatacgccgaagattacagtaagatgtataaatatcgataatgagtttgaccgaccagcgataantcatatcctagtcacagaagcnacgctcttattagagaataagcctgagtatcgaatcagagttgcacgcacatatatataatccgatgatgggtgnacacatgacatagaactagacaacacacatgatacactaccacgacatagtcgtctgatatgatacaccgcccataatttctgataatatacgtgatattacagacacggctgccatactatttatctatctgtacgcccgcgtcgtattattaactgtaagcgtatcgcgtttacccggcgtgcgccaatattacgtgtgtagtataattatattatcgcgcgcctgacttctcgctagattgacaatctatatgactgatagttagcagcgcaccgccaccacataagtgtcaatacgactatgttggctacgcgtgagatcgatagcggcatcttatgttatattgcacgcaggcggccgacgtattcatcgccaccncgttatatgcncgccnctccgctgtactgtntnacagcgatatactatcacgcgcngcaccgcagttatatcattatagtatcgangatgcgcnagagactgacgaacatcaagtgcgcacatgatagtcagcgcgntgtgattgaatatggcgccacncgcacatatttgtagactatgaaattgtcgccgntatgacgctatatctcatgcatacgctcgcattatatgatgtg

SEQ ID NO: 6929 - DNA, 800 bp, Homo sapiens
tgtggcctagggaagccaaaaaattggacactcctgatacacatggggagaaactcaagtcctaaggtcatcattacttttctgaagaaaaatgtcgttgtgggatgaacattctcactctgaacagagggaggtggggcaggtgctgtgttattatgtgcctatattggacaggggagaagcctggggttttttatgcagggggggggtacgcaagagtatttttatccattaagtaacgtcttattcctcaccctctttctacactgataaaaatgcagagggtatggctcgactaatgtgggcggggtacaggagtggggggcggaggtatgaggggaaaccgcggggcgtgggactattaacgtcttgcggggtgtcgtgggagcagaatgcggtgtggagggcacggcagagggaacattaaaacgaaaatgagaagaacaacggataatggggtggtggtgtttggcgggggggggcggaaggtgcagcgctgagtgagttggtgtggttggcgaacatacgactttataggcgttttgggtaaggttgtgtagggggataaggggggaaggaagggggaggggcaatttatggagagacaggggctgcgcagagggtgaggtgggggaacgggcaactacggggtgtggagggtggggacaacgggaacaggtcaacggccggagttgggcgtgggtgcactatgtgtaaaattaggggcgctctttcctggaaattatggtgggaggtgtggaaccatggcggggacaggtggaggtgtgctgaagtgaggg

SEQ ID NO: 6930 - DNA, 870 bp, Homo sapiens
  misc_feature (1)...(870): n = A,T,C or G
atcaattcttattgatctatgntacaatactatggaaactttgtattcaatgtatgcacatatagaatgtcgggatcattcaatgaaccccccaaaaggggtatcctaaagcaatgatatgccagactttccttgtaccacgaactattggagtctctaacgagctttttgaccttctgctagatcatctgacaatanatatatggagggaacgcatacccaaaatggattcaatgtgcatctatgatctcttattgacaccctgncctaaactaattatgctatacatngactataaactacatataaacactgcaccaaaggccacggacacaaaaaaaaagnaaataaatataaaacacaaatatgaaggggggaccttatatattatcctttttttttttttcttagtcaccaaacagtccattatttaataacagaagtggacacagtaatatattactctaaaattcataaagtatcttcctcttctgtttgggctttaaaaaaatgaaaattgccaaagtaatccaataacaatgtcatgtgattattccagtggaagagtaagcatttatgaagtcacctcagtttgctgggattagttcaggaccagtgaaggaaatgtccttctctccagcatctgcatccattcggtcattgtctgttttatcccagaatgtctcttaagttattctcatctgtagttcatgcctgctttgtagcttctgaccgctctaaccaaacacccatttacaatggtatgcagttggtcctnccatattcacagcttctgcacctaaactcttnntnnccctcctcatcttcccttnccccccaccccttcnttcctnctcttcccttttcttt

SEQ ID NO: 6931 - DNA, 841 bp, Homo sapiens
  misc_feature (1)...(841): n = A,T,C or G
tttcattcttaacccagtcacttgatccacaccattttgtttttgacgaacaatttttttgagccccaattctccaagatccatgacagccaaaatatggtatatttacagattccagggatgcaattttttgttaacgcactttttattccaaaagaatcgataccagccctggtttctccctgggtcccctgcttttcccccttgaggttcatttataagggattcagcaattttttaagtgagtgggagcaacccattcaaaattcaaagcgttgttaaacttttaataatttcattgctgggttaacttttcataatactttttcataataatttcattgctgggaccatttgctgtgcaagatttacaagcattatttagactatagtgcccaaacaanacagaaactattttttaaagccataaatgattgaggtcccacaggaaaaaaaaaaaagatattttaacaaatatgcactgtgtctccaaattttgttataaatacattttatattactatgttttgtattatcaaataccgtctagaaagtgtgttaatttttatttgctccttcatgcttcttgacagttggagaaggctggaggaatgtgtgactcagagacttcggcaacaagagttttggcctttcagcaattactcaaaatttacttgaaattcactgctgatgagattttgttggtactacagggcagaagggagcctcagtaaagtagttattgcacagacatttacttcagtggtggtaattcttgcaacaataagacaaaattttgagttcctcatttactccttatcagtattttgtgtttgtatta

SEQ ID NO: 6932 - DNA, 1473 bp, Homo sapiens
  misc_feature (1)...(1473): n = A,T,C or G
gataagagaaggagcggcagcagagaatgagggcggagataatagaagagagagagagagngaattccattgtctggtctgatcgnactngctggngagaatcccataggcacgcnganatncaagcacntgngagcgacgagagncaagcggcgagatataattgatgatataagacacagcgctgctatacacattcacagtcgcgcaactgcgcgnacgctgtcnataccgcgtactccncngcatatttattagcgctagagtctgtgcagatccaacgagcaatctatgtatagcgtncgaactcagagtagaaagaccatggaagtgtatgtcagaacgcgttatataagtatgacgccaccgccgcgaccatcgatatagatgaaaagacgcatatgcgacccgcccncgaatctctcaactctgttatgattctcacgtatttcttagacgatgagagatgcgcgcagcgantagtatatttgatagacgcagtgcgctgattgtttaaggagcgacgccgcgctcgacaccgatggctcgactcattttgttatagtactctagtagtagtagagtatcggaccaccgcggcgtcctatgtagaanatatacgcagtatcgtcatcatcgatcgccgaggtatattacgtagcgcagctcgtaatgcgacacttcgacagccgcncgcgcgtcagtaagaagcagtcgtggattacatagtcacgcgagacttatgtgttccgctgctgtagtacacgacgatgntgcatgcataggagtcagtgtgccgaaacacgaacaaagagcgtcagtagagaagctccgccatggcgtntttagtcgctctcntntcctccgcgacgatgtccgatcgatagttgttgtcgggtgctgtgtgagcacgcncggagttgtgacgcgatagagttgtggcgtgagtcatggtggtggcatgatacgcgacgcccgaacgcttaatatgttgaggtgtcgtgtgaggcgcactacntattattgtattcgcgcgccgtgtatgtgatcgcgtacgcgtgatcgatgtccagaccccgtttgtatttatgcgtagcatggtntagtagttgtcgcgncncacacattctctcatagactcagattatatgacagtcagagacagcacgcgccactcgccgcttagtcctcagacatcaagatacgaatgtaaagagcgatccgcgtcgtntataagttcacggagcgcggctcaccacgcgcggacataaatgcgacgccagttttgtgtaacgcaactgatgtattgtaacgcgcaagtaagaatcactgtagatgtattctcactatacgtaagatacgcgacgtacactgcgancggaggagaatatatgncgcacggctgcgactatagctgatactgtactattactcgtgacgcataatcacatcgcatgcgatctngtgaattcg

SEQ ID NO: 6933 - DNA, 834 bp, Homo sapiens
  misc_feature (1)...(834): n = A,T,C or G
tcccataagtaccataatgccagtcgatccgtttatataatggtagcctatcattttcaaaggcgccacncaaccgactaaagcagcaaatagcttcaaccaaattcacatgtacatggtctcaggaccacaaaagataacttaatttccaatagccatcctatcaattctgaaaaaaataaaaaatattagtggataaaaataacaaaaacaacaaagtatctagataagcgacacagtcaatagatggttaggaataattttttaaaataacgcaataacatgtacacgaaaatttgtcgtttaaccattaaggtgtcgaatcagtggcaatcaagtaaatgaaagaatcatattatttttttacagtataaacaaatggggcaaatatacatccttatatatactttgtgcaaatgattccataagatagaaaaactgtaatgtgtgatgggccaatgatcaagagtaataaaaacgggttggtcttttcctacgatcactacattaccattaaacatgattgtttttatttcaataggtttttgggggacaagtggttttggttacatgaataatttctttggtggtgatttctgagattttggtgcacccatcaccagagcagtgtacactgtacgcaatgtgtagtcctttatccctcacacccctcccaccttttcccacgaatccccaaagtccattgtattattcttatgtctttgtgtgatggtggtaaattttaattctttgagggaggaatgctttttggaaaccagcaaagagtcattctattgatttaaatgtgattaaactggataataaagtttggac

SEQ ID NO: 6934 - DNA, 1086 bp, Homo sapiens
  misc_feature (1)...(1086): n = A,T,C or G
gttataattagggcattttggggcggatttttggggggtgggtaattagctggagacgactctgttaatattcacgcgctacagttagtctgactgcgccgcgggatagataacatacggatacgtggatggggttagcagggctgggcctagtgcttgcgagggatatatggcggagaccactgttcggtaggcgcctagatttcattattattacgagtgaatgtggcgtggagtttgaatttacgcgcgtctctgtcgtatgattatagactatcggcgcgtggtgtgccgagagttaatgcggcgttcgtatcagtggagcggtgggagttttggtttcgcgcggttattgttgtgatggtcggtgttgtcgggcggtgttatttgtacgagatgtataatttgccgggcgtcgttagatattcgtattattgatggccgtttgtttctttgttattggtagcctgatgcgccgtgttttaatgtgttttatgccctgttcgttttcgttttattgcagttgtgagtcgaatagaagtgatcggcacatatgcgttggtgcatctgccttagtggttcttacgcttggttgcgcgtattgtcagggaggtcaggcaattaatccattagtttgcgatatatgtttcatttagcgcgcgatatattaatcttgttaccgtgtggacaatagttttgtctccgcgcggtttattctgggatgtatggttcgtggcggcgtctgtatcgtagcgttattgattatcggagacgccgaactacagttatgtgatattatggagtagattagacgcgcagcgcactgttctatagagtaagagtgagtctgtatgtacagtcagttattatattncgcgcgccgcgcttccgcgcgtgtgtttcgcccacgtcgtgttgtgtggcgagctgtgtngccgcgagcgcgtatgacatgtgatgagtngctgtcgatggtggtgtagtatgggctatatctaaggctctagtgttataatatgcgcgagcgatattgtcatgtgtatgtatgcatgcgcggaagacgtcgcatgtgagtcatagtgtgcg

SEQ ID NO: 6935 - DNA, 1002 bp, Homo sapiens
agtctatactcacgcccctatttcacccccgtatataagactgagcgattcggttaacttatgccttgccaacgtacctctccttaattttatcccccgcctaccaccgaatacctctatgcacatagcgtcggtaatgctagtatatagtctcggcagagcctaatagagaactctcttcatcaataatcattttttcccccaggccgtgctcgagccctttctaatatcagatgttatagcgagtaccggcctgtcatgcacatcacaaataaaaaggccacatatattgtaaccgcccgaaacctcatagaggcctaaaagaaagcccccccgtcctcaaacccactagaatccaacattattctcatagcatccgcccccacctttgttatcaccgcccctaattcttacaacaccgccccatcccgcccccccgcgataataataacatatgatcttcctacacataacccctccttctcaaattcccttttaatgctctacccacatcaccaaccaagcacattcctaccttcccccaatattcaccctcattatcctaacgcgtccccaccccactttcccctctcctacttaactacgatcccccttaactgcgaccccccccttccgcttcttcctcactccccttattcaccctcgcctcccaatacccacattacaaacttctcccatacccccaccttaccggctccgacccccatcactctccccccattttccccccatccttccccctcacttcccccttttattcccccccctctctttctcattccgcttcgtctccccacccccatttccttcccttgtaccagccttccttttttattccccccgcctcgccccctctattcccccccgttttccccatttctccccacttatatatcttttgataccagattaaaccccaccccgtccctatatagccccccgatatctcaatatccatctctctctcacacgccctttccg

SEQ ID NO: 6936 - DNA, 482 bp, Homo sapiens
  misc_feature (1)...(482): n = A,T,C or G
cggnanaccannngaaacccacaccaacagaacgaaacgacaaaaaaaaacagcgacgggcnnnncggcggcnnaaaggancgccggccncgccagccacnnccaagccgccggggccccgcnnnaagcggcgaaaacccccaacnnncccaacaganccggcgccgggccgngcgaggaganggnaaaaacaaacaaaaanccccaccgcgccgggcgcgncccgggggggcaacccaacacaaaaagaaaaccaaaacggggggggccgggccccnggggggcccccccacaaccaaggaaaaaaacaacccggggcgggcccggccccaggggggggccccacaccccagggcaaagccggcccccnngggggnngcccaaaagggccaggagcccccccccccacccccgggaaaacccaaagggctctgggtaaaaggcccctngggcaccccccaaacccagggnaaacccaacat

SEQ ID NO: 6937 - DNA, 1490 bp, Homo sapiens
  misc_feature (1)...(1490): n = A,T,C or G
aaccaaaccaacggtggagcagaaagagaagaggaaaggagaggaggggccctagtagggggaactacgggacgcgagcgccttcagagggagagaccaacaagaggtntaaaccgacgcnggatagacacgcgacacgaacggagagatatttattttagaaaacgaccgcaaacccantatacacgcggaacacgcgtcacgaaatgcagcgggcggcccgcgagagggcccgacgatatgcgcgtccgagcgcacgcaagatgagatacgggaacgggcgctgatgagacgaccacacaatacaggccacagcgacagatcagagggagtaggagccgccggacgtcgggcgcccgagaaagnaacagcaccacacactctacttatccgtgagatgcgagcgacgcactcgaggacggcctacggtgagagcagacacgcagtccatcgaagctcagagcagtgacgcaggtgtgcagaggaggcgcgtatatgaccgcacatgcgacgatccgccgagacgcgcgacggtgatcgtgtgcggagtatacgatacagaatatgcanaccgcgcacggccgccgcgcgaaacgagcgacgatcacgcagactagtgaataggtatgtcaccaggacgctcgcgccgcgattaaaaacagtacacaaagagccgccgccaggccgtaataagagagaagaggacgccgcgagcgaaagacaaacacgagcagttatacgtgtcagatgcggctgagtcggaatatgagcatctgngcgggcgacgcatgatcatacgatcgatacggcgcgccgacacgacggtctgatgtgcgatacacgcgctgcggcgagtagcgagccgtgncgcgcgtaggcgacgcgacagcgtgaantcacaggangcacgccgcatacgctagtngtagcgacgacgganctgagaagcgcgaacacgacncaangatgaactaagactagnatacggcanacantcagacgagcgaagagtgatatgcgacanangcgcgccgcagcgcgcatgatganacgcgcagcacgaacacttanagtgtnacgtcgcacgagcagacgtgtatgacacgctcgccgacatgantgcgtcacgcgacgaccgcagtggaaccgcagagccacagatgacgcgcgagtganaggagaatacgcgacaantgctctgcgtagaatgtagtacgaccgcgacgccatacgagactacaagtcgagcgncagtcacgacacgacnanacgatcgacggcgatactaccatacgagtggatgaganacgatgcacgctagagtcgatcgtacgagacacagcgagactcacactgtacacagcgagatgcgccgtatagtctatcggtatagcagtcacgacgcccgtcgcgcgtcgactgacanagcaaactattacgaagtcacgagtcacacgacagactgnagtnagatccgcgcncggacgcgg

SEQ ID NO: 6938 - DNA, 1199 bp, Homo sapiens
  misc_feature (1)...(1199): n = A,T,C or G
gaagaacacgagaaaacgagcgggaacaacggaaagacggaggggggggagcttcgcgcgggagaccgggaaacgggaagacttgcgaggagggcaaaccgacgaggaggaaagccggagagaggagggagaggaacagaccaaaaagacaaaacnacgccacacccgaaaaaaaccagagcgcacgcatatagaaaatagagcgcgagaccgaggcggagagagagcgaaagagaaggaagagagagaagccgagacgagcgacagaacagagcaaatcagtaagcgagacagatgagccgcgcaacaacgaagagcgacgacgagcagcgcacagcgacagacaggaatagagccgggagcggaggagagaccagacgaaagaaaccaggccaagaatacgaggggagaggaggagcgtaaggaggccgcgtaacggagcaacgaaaggaagcacaggccgggaagaggaaaagatagccgcgagtgcagagcgacacgaacagcgcgacgaagacaacacgccgcggaacaacacagagggtagagggggaagaggagaagacaaaagacgcaacgcgccgacggcgccagaaacgcggaaaaaaagagaaaaagagacgacgacgccaataagaccacagacggacaccgccgagaaggagaaatagggagacgcgacgcacagacacagcaggcaagagacaaatcggaggcaganaccgagcaacacatagacagcggcgagagacgaggacaaagggcggaaccggcgcacgaaaaagcacgaagtagcagcagaacaaacgaagccgacggcagggcgaggaagacacacgaagcaacaacagcacgagggaagggcgggaggagaggcaggagataaaaagcaaacaggcaagaggcatatcgccagagagaaggtaaaaagtagacgcgaagaagacaaaaagaagaaagagcgagaatacgagagcgccacaaagagagacggcgcagcagaaagcgggaccgccagaaggaacgggaggagggcaccggaacggaagcgaggtgcaagcggtcacacgagagaagcaagagaagagaagaagaagaggagaaacgaagcagggaggggagggcgcagagacaagagaaagagagaccgccgccagggaaagcgaagagagcacaagaaagagagacaaaccggggaa

SEQ ID NO: 6939 - DNA, 420 bp, Homo sapiens
gttctccacacccccctctggtttgatcattattttatcggcaatacccttcacccacgtgggcccacacaggcgcaaaattctgttaatgggtacacgccagcaccacactactgggacagactagcaggtctaccccccgtgcacaaaccccccgatacccccccgaccacaaatatttccggcacaaatagaatatccggctctatcactaaaaattggccccccgggccccgcaaaaatcaccaaggacaccaaggtcacaggcaacagttatcccctgtccccctatcccctatcccccccttgtcccccgtgtaattgtgttttcccccccctccaaggtagaccagaaccgaggacgcacagtcgttattgccctaaccacacgtttccataatacaccctaccccatcgttg

SEQ ID NO: 6940 - DNA, 1019 bp, Homo sapiens
  misc_feature (1)...(1019): n = A,T,C or G
atggtatccgagccaaagcagtgagcggcgcagcaggggaggggggctggtagtggccagggggganggggtttgaaagggaaacccnggggagngggagaaagagaggagaaggaggagtttaanaggaagtaaaaaacctttctcgcggagccgacgaaataccgcgcccgcacgtcgcgcagggagcaatccatccccggttgtggagagattcggttaaaccgcgccgaacactacaccggctccccgagagcatactttcgctgccgcgcccgcccaaaatataagcagaaagcctttttttttaagaagggcgtcgagccacggccgggggagacgggcctctcccgtatcaatcagaatcctagggcgggcggtcacagacacanatcatacagccgatgcgacatngttttcctatatttttccaatatcgccgaacgacccaacctacctagctgcaagtatgtcataaccgtcccatcccaatgaaccggctctacccgcgaagtataagtaatcgcaggctgggggcgcgtcggcgacgtgagcgaacggacccctgatcgtgccacaggtcccttgtaaccgttcgcccgccaagcgcactgagtccttataagcggcgtacgcatgcgactttgctaatgtgtcacgcttcgtatacccgtatacgagagagctcgcaaactaacatgtgcgcccggatccgccttgagaggtatgtgaaggaggaatgtccgcataagctgtattagcgggttcatgtactgcggcccgcaggttttccgtgacgctgtcacttcgcatacccagcatgtggaagcgaactacacattatgtcagcggccgacacgctcagagcaggcaacactcagggacacctcgaatcaagatcgactgactccactcacgagatgtgccgcctagatgtccatagccacaatgtatgagtggtgcgcccccccgatggtagtagaggatcagccggccgacggtatacgcgcagcgatcag

SEQ ID NO: 6941 - DNA, 392 bp, Homo sapiens
cccccgcagacggaaatcggaaccccacgttagcgctcgcacaaagtaacctgctgggcggcatcgggcgctatacaccgaaatcgctacgccgctccaccgctcgcacgccacaggcggactgcgcattaccccggcaaagcacacgttattgggcagtccactcagccccgaataattggtcgtcgcgctatccactccccttgggttcgaacggaaaggattatttacctcggctgttacggcgacgtccatggctctctcaacgaaatatcaggaacccccccacacggtaagtttctgtgccgtctcctaacgaaaattgaaaaaaaggagcgcggtcgtacagatcaggcaacgacccatgcgccgaacaaaatataaaaaccaac

SEQ ID NO: 6942 - DNA, 1919 bp, Homo sapiens
  misc_feature (1)...(1919): n = A,T,C or G
gcagacgtgcccngccgcgagtcngatacgggnagcacgggaggagagcagatagcggccgagacggcggccgcagacggagnagcgtgcggcccttccatctgcgggnagggaccccnagcgggngagcagnngagagagccctcncgcgnggnagangagaagcagacaccgaggnnacgnccgcagcaagcgcagcgcgcggagaggagccganagacagcggaggaggcgagagacanattactaaaaancacagagcaacgagacgacncacagaagcgcaannatcagcgccgcgagagacggcggcgagcgaagaagananacgcgccggcaggcgnccgcngacgggcgacgagcgaccggcgcagcggacgacacgcgngcgcagagcgagacggcgcggagacagagagcgncgcagcgacgcgagccaggaccagagagacaccgaggaagnccgcagancaacagcgccgcgccgcgaccgaagcacgaggcggacaggaaaaacgagccggagacgacggggccgcacgcncaacacgacgagacagacgacgcagacgacacacannggcgacgcgcgaccgaagagcgancagcgcgaggagcaccgccacaagaggagccgagaccgcgagagaggacgatcagcaactcgcgncagagctagacataccgaataccacgcgcngcagcagcgtaggcagagtaaaagcacaacagagtagatacacgccgcggcgacgcgcagcacagacaggagcagccgaaatagtaggatgaagcgcaagcaagacgaagcacgagacacgcgcgcaggccgccacagcgaataccgcgcgcaagagaaggacggganangaacgtcgcgacgcgcctcgacgcgcagataggtacacgaacgcacaagacgcgctcgcgcatggcagagcgcgcgagtagaatacagacgcccgaggagagacagcgcgaagaggcgacagcggagacctgcgcgaagacgcggacgcccgaggaatgacagatgcagcagcagcgagagcggaagagcagagacgcgcataaccgcgccgcgcaacgacgcgcgngcccagacgaccgcgcgacatcgnatagcgacggagcacagccgagcgagcgacagagaagcgncggcagacgcacgacgcacagcgacgagtagtgtgagcgaagcaagagagagaaagggcgtaacggcgcgatggagcgnacagcgaagcgcgaagcagcgcagactgcggccgacagagaggacgacggataggancgggaacgcgcggcaccgcagtataagacgcgacgagncaaganacagcgacgacgcagggcgccgacaccacgntagacacgcagcgatagacagcgccgccatangcacacgcgaanacgaccnagcgacggacacgacgcgagcgagagnggcagatctgaaccgcggcagacaaacgcagcgagatgcgagcagcgaangatgccaccagcagagngaagcgagcgancacnacgagcgcgaacagnaccgcgcagaccnagngacgcgacgacggacgacggcggngngctgccagcatgtacagnacgacactgctgtgantagtncgacgctcgngtgacgccncgnagncagacgancacgctgcgcnagnacaatcgngcgagtcgacgtaagnannagnanngtnacgagtacagcacctgacnacccgntcgagnactcngatncagacacgnacgtcctacngtcacgtcagcgcgcgngcgacngcntccgagtgcagcactagtaantgaataaagncaagacgnacgacgncgcaatanacgagcagcanagnagcgagatgacggntgatcagcggangagcgangacagcaggacgacgacagat

SEQ ID NO: 6943 - DNA, 1564 bp, Homo sapiens
  misc_feature (1)...(1564): n = A,T,C or G
agtaagcgacggtggccggaccaatgtcgacggcaccagacgcgagagggaagcaagcctaacttgagggagtactagacggaaggngaaggcctttggcaggggggagcaacccaacagtgcatacgaccgagctagcgttggagtccacggaagcgagggagatataaattaaacacaacacacaaaccatnccgattatctacccgcgagcagtcganataanntattatcngcgncgacgcgcgacgcgcagaatgcctcgagatgatgcctagatgccagaaccagcgccggtagatcattacgtatgacaatacgagagctaggngcacgcgcatatgcgctcgagatcgaagcgcggagcagcgtatgggcggatgatagtagctcagcacatatacgccgacgcgcccgtcgcacactcataatatagctacatcctcacgcgatactcgacgagagtgtgaggaatcgcagtagttgcagcgcgcctgatcatgccnctgtacanagtgaacaggtcaccgcgagaagcgagtagcatcgtatgacagatgatagcaagcgcgatgcgtagtagagcatcgaatgaggcgcagaacatatattcgacgacgcgctacagatatgcgagtctgcaggtgatacgtttgtgtgtagtattctagattactatcgccactgagacgctgcgcgacggggttcattctatcncacgagagatagctgatgaagatatgcaatatcgngacagtgcgcccgtgntgataattcggtgnatgnataaccgcgcccgcagacgagtgagangatagatatatcgcgtacgccagcgttatgtgtacgacgagcgtcagcacgacaagtcgtagcagacgatgaccgccgcgagcgtagtagtgatnagtcacgccagaccgatctgaggatcgatattcgcgccatcacggacgcgcgcgcagtacactactntcgctatantacagcagatatacactagacgctgacgcagaggacgagcgcgtacganttgatacncgcaagaacacagcgcgccacgccagagagatgacatcgaagatgtgtatccacgatgcccgccgtttcgagggagacgtgcactgtcggacanatcgccnacagtgnagacgcaacatagccgacgaggaccnatatcatagcagctgacaggatgtagagcaacacgcactacgattagtatgagacagcancctagtaagaataggacgagagcaagaagaacgccagccgagacagccgccgaagatagacgacgcacgcctaggcctacatacaaagaacgcacacatagcggttcaatgcagcagtagacgnggacagtagaatgaagagtacgnaaccgacgctgattagatcaccaggagcgtatgtgctcatcagtaggngttacagctagttacgagcggagcgtcgaatagtatatagtagagaagtgtacgagcaacgccgacgtccgtttatagtatagctgtgcgtcgggcgccttcagtagtggcgctacgcgaccgccgcggtcgag

SEQ ID NO: 6944 - DNA, 1672 bp, Homo sapiens
  misc_feature (1)...(1672): n = A,T,C or G
gaagaccaacgcgacgtccggntcacttttgtgtgccaccgtgcgaggagaggcgagagaggcctcnaatttggggaataccgcaggaggtgggggagcgcctcgagaagggaggggacaaaccaccaggacgtgcacctcgtattangtacatgagtccctggtgcatatgcacgttttatgatanacacaacgaatcagcacacgcgctatatctaatggccagacgatcgcatatgtgtgagatnagcgcgcccggcgcgcgcgtaacatgangcgcgagagtgtagagtagtctatagagacgtcgagcgcgtagcgtaatgatatacgaccanacgcgttcgtgatactggagtagtaccatcttatgggagccgtatctaacgtattagcataatatataatgttcctctgctcgtagcacgctgcgcaccgtcatatagtaacgtcgcagcctantatgcactctttatgctcgtctaggtcgctctcggcatcaacaccacgcgcagtagtccatatggaatacacatgctacatatcgctaggacagattagatatatntgagagtatccagtgacgaggcagtgtcagtcatcgtataggccgagnttatctagtgccgccaccgtagccacagattcgtcatgcacttgcgtaacatatatattgcctgatanatacaacgctagcaacgagcgtctatcagcggcatctattggcgcgctgctatgtgtatcgtattnatattatatatctcctcgcgcgcgattgcatatgtcgtcgcatcatgtacngcgccgctctgnctgaagtcgatatgttcacctggtcgtctattgagttccgatcacctgctacacgataattcgtacattagacacgcacgatatgatatnatgtgcgcgcagctctccatgtatctagttacccgattcgacgcagcagcggcatatatacagntcatcttnatatcgcgtaagtttgtgtactaggaccgnatatatagacgacgtattatttcgctgatacagtacagtggcgctgccgagtntaatgtgtgcggcgatgatgcagcagagaggcgcatatgtcgcacaggcggcacgacgcggacntncatcgcncaactctagatgacacgtagcggnatgtcggtcgcgcacaatatccgccgcgaggataaacgtagatgagtgntgcgcgagcgctagatattgctaggtcgtcngtactcagcgatantacatatacgnagcagncacgctcgcgtatcatgtaancgactnacgacagngtcgccgtatagatagtagtgaagnagaacagtngntcatgcagatgtgactgacgctanacgacgacatcggtgccgcagactacatgcacgcgatncttccatacgctggacatacgatgtccgcgtcatntagtatgtctcgatcgtattgactgtacgcgcgcgcagcnagtatgtcgctatcaacgtagagcgtcgcattgtcacataagagtcgctacacgacgacgagactctngtaggtcacgacggtatagcgacacngcncngncgtgcgtctcccgtatcgtcttcggtaggatgttgactagctcgacgcgcagcntgtncgtgcagcgtactgcgcgacgantacnagtganntatgg

SEQ ID NO: 6945 - DNA, 580 bp, Homo sapiens
gtcccagtgcaataaggagagaggccttgggagggggggctggggaaccggggtgcggggtggggggctttgcgcgccgcctctagatcatcatcggggagggacccggaggcggggagtattgtagaaattccggtgctaaccggttgaaagtgacactgggaatttgctaattttcggggttgcggccatactgtcgaggagtaaatcgagataatgagcaatagccacactattttatgtcaatccccctcggggaacgagaatcatgactcccaattatatacccacagcatatccactatcgaatatggcgagaatctcacaatattcatggaccataccctatagattatggctaagggtgcagacaaccagattgattggccttggtgcggaggtggcatttagaaacggcttagcatttgtgcctattgctgtgggagttatcagtaagcgctgcctaaaagtatgcagatacgaaggtcggggtttcactgtctgagttatgcgcgcagctcgaccgctatgtacggaggtatggaccgactaaaacgacaaatgaggatatggagcaggg

SEQ ID NO: 6946 - DNA, 2008 bp, Homo sapiens
  misc_feature (1)...(2008): n = A,T,C or G
aggggagaggacgcgagcgcacacaggcaccaacacgcaacacaggacgagacacgcgagcgacacgggacgagggcttacgctcggcgagggagaaaccagagcnggagagcggcagagagcgcatctaccacggacggcggagcgacgacaccacncgaggaagcacagacagaggcacacgacgcgagaggagacngngaccgcgacagnaggngananacgcaagaaanattaaagagnangagncagaagagcaggacacacacgaagcacgcggcatcaaaancacgcacgcgcgcacagccgccagtacgagatgagtataacacgcgcgcaggncngcgcnatgacgataaagacgatacnctacagagaaaagannagtcacncananancacaagcncaagcancgcgcacgtacgcagaaggagncgcaatnancacgtcagcagcatcggagggatcgagacagcaccgcagccgcagagaccgcagtagaacggacacgtccgaagcngngagaagacgcgagagagagagacaaagncnangagtccagcagtggcgcacacagcagtcagcacgcagncacgagataanananaaacgtgccgacacgcagtgaaagtcggcactntgaccaagcgtgcgagagtgcancgacagcgagtaggcgagcagcgacacggacacgacgcatagacacgcatacacgagcgagagcgcgcagacgtcgcagcgtnacgcagacgagcggagcgaggacncgcgtagcgcgagagcgcagggacgncgcgatcgaagacagangncagcgcanatgacagacgcacacgagcgagcgcgcgcagcagcggcggcgggagngcggtnagaaagaacaaagacagnantaggcacgaacgcacagcggcgaccgcgccgcncgncagaacaagtggcgcgctcanagagaggagcgtgaatagacacacgacgacagccacgcgaagagagaagtaacatcgagagacccgcccgcgatcggagagccggaatagaacaccgaccgaccgtcaccacgagagagaacgagcaataacaggncgtgagcagcgcactgaccgattangagcgagagggcgcgcagacccaggagcgtggagccgcgatagcggcggcgcggcgaggtagcagcgcgtcgatataacgcgacgtaatagagcagcacgcacnagcggcgacgacgcggcgcanagacggcagacgtcaccgagcacacggcacgcgcacgcacgtantagacgtccgacgaagacggatacgcgcgatacggcgcgacagtgagagacagccgcatacgacgaagtgacagcgcagagagtcagcagccgcatcagatgatacagagagtaagtccgagtcngacgcagcagcgncnatacgagcagacgcggcagctacagcacctgatcgacatctcgtgannacgacngcagcgctcgatanacatagcanaangagggacggacgtcgagcgaangtatnagntactgagcgncnacacgcgacncgcagagncgtagaatcagcagcagctnagngtcagncgcccgcgacgaacgaacgcgantgcaagcgcagacgacgtgagcatacgcncgcanacntacgctgcagaacgcgnagncggaggtcaggacgactagctgcggtgacggcgctgtcagatgcagacgagcngacgacgtgcaggncngactgcnatagcggacgagtacgtacaanagcggagcagacgcacgcagcggnanatgagctgcgtatgcaggnacgggacagctgtgatgaccatgcagagtgccgtcgcgcgacgcgcgacgcgncagatagtaagagactagatgcnagacgngccgcggtcggcgacgacacgtngagaaanatagagtagnagcgantcgaccgcancgacgagcacgacgcgtgagagcngatatagacgcgcagcacgcacgagcatgt

SEQ ID NO: 6947 - DNA, 1514 bp, Homo sapiens
  misc_feature (1)...(1514): n = A,T,C or G
tgtggtgcagagaggcgcactgaagccggtggagcgagggggaggcggaggcggcctactaaggtagaaatagtgagggcggggagcctgcggggggaggnaaacacagggcgtgggagagagtagtaggggtgaacgagagaggtcacgttttatagacgccgcacgccacacccatatccccacggtgatcacattcgagacagccgagcgcgagctcgtgggatatgccanccagagtcgcttgaccgaggagcttgcattgagtttgcacctgtgatcgttgaagtacgcgtggcaccaacgcttcacgacgagtcggcgagagagcaggatgatagactgaccgtcgtccgcgagcancgcgcagtagtgantaattatantgcagatagcatacacgctgcngatctattacgatcgctgacgacgcgtgagcacggcgacgatcatgcncagacgagtgcatcacgcgaccgccacagcgcgngcagtcganactacgatatgccgcacgcagcgtcacagagcnagntcgtacatgagcgncgtgatacagattcctctcgcgctgcagcacgcgacgtgtatgttgattcgttgtatctanttgtgtgcgtatgcgtancgagtgcgacagtatagcagagcgtgtacagtgcatatatgcatcgaactgatgaagagcgagatgatgtactgagatcttatgtcgcagaatatatatttgaacgattcagtantcaccgcgcgcgatatcactacgcntattatgatgagcgagccaacgagcgtagaatactacgtagctcgctgatagtccagagctgagaacgaatatctatagtcgcccgtggagccttacatgtgctcattccgtcgcgctccacgtcgagtatgtcgttacgcgacatntgagtacgctgtctacgctacatcggcgattagtaatacatagatgaagagcacgacacgtatgttagatagcgacggcgttagcaggagcgcacgatacgcaagagctgtcgtacgcgcggatatctcgcgcgtggatatatagcgntcatagcagaatcgcgcgcgatgataatgcgactgaaccgcaacgacatagatgcgcgacgcgtatgtgtcacagtgacgcagcgcgcgtggtggtgctagctggcgcacagaagcacgactaacaacttatggtccagtgtgttagngcatcgcgatagcantnctcaagatcatacgtggcgtcacccgnatactcttacctgttgtcgatatgatcgcgctccaccacgtgatagcgttaggagatgtgatagntgtagtncgtatacacgtacagtggcgtgacgnagcgtatgaggcgacgatagatctcatcacgtgcagtcgagtcgtagtatagtgtntatgatattcgacgcgcangcgcgtgtcagtcaactgcaatatcgcgtctantcgcagcacgtcgcacgagaacatgttagatcgtcnacgaagcagnatcagag

SEQ ID NO: 6948 - DNA, 852 bp, Homo sapiens
  misc_feature (1)...(852): n = A,T,C or G
ggtgttaatgatttatttcgccacgactataaatcgtcatctaacccactcgaggcatgaaacaactgttcaaaaaaatgtatgcacaataaggcagcttgaaagctccactctcggccaaggtgaggactctcgtcccacgccctatatcgaaggtacgccaagaagcaatttttatttgccgcatggactaaaccctttgaagggtaggaacccacacttataaatgtttcggtattttcgaaatgctatttcatatgcctattatgatgcttccaacaccttacccattggtgtatataaataagggggtgctttttcagcttttcagattaaaaaatcttttatgttggttgagatggcctgggtctgtaaaatttaaaaaaaaaatccagaattcttggatggcaataatctatgataataataaaaaggcaaaccagcnccgcctcagagataaggaaacaagcgcagagacctggagatgcttatgacactgcagcctgcttctgcaccgtgacaggtgcggggaaagagaggcagacatgggaaccaccgtgggggcttcacagacactgggtcctgcaccgctccctcaccccatccacgtcacttgcttgatactgagcttccatgtatgattttgtctgcggaataggagagttctcatagaaaagaaaaaagcctttagctataactagtatagctgagagattaaaagtatgtctttaaagtcaggtcgtgccacttctaagcagttctcaaacaacaaaggatgacatttagctatactgaagagaaacaggtacaagtatgtagaagattatttgtacaataaaggaagatcagccg

SEQ ID NO: 6949 - DNA, 1802 bp, Homo sapiens
  misc_feature (1)...(1802): n = A,T,C or G
atgaagaagctagccaatagtgaccgngactcgtatagtccatatcacgccgcgggccgangcgagtggagcagagtcgcctacactatagggggagaacccagcanggagacgcgaagaggattctttttcgagacgcaacggcacaccacaccagacagaacgatgacagtcagcgcagcagatatcgaccgcagctagagtatgttagagcgcatactactataatntaanatcagcactgcagtacaccacacagcacgacgaatcagtcaacgcaccgacgcaaacatcaccagattcacgtagatatgagtcgcgtgcggcgagcgcgcgcgcgcgcgaagngtagctccgcaagtgacgagtacacacacntagcacggtaacgcacacgccgacagtcaataacgcacgacgcaatgccgtgtgntagtaaggccncatcgaccagcagcatcagacgcagacgcaggatggcgaagcctcaacantacgatatggtgtntctcagctgtcgcgcgcggagcgcagcgcactgacatagaatcatacacgcgcagcacgacgtcatcaatctcgtagcagcgccgcaacaactccgcacgntgtagcgatcgccggatgatgacgcncctagcgtagcgtgacgcantgagcctcatattaccacagcagtgatagatatcatatctcgcagagctagacgtngatagacgtcgtattagacgagtcggtattgcatgcgancggccgactacgatcacaccaggcgctgctnatgcggatgagcgcggagtgcactgtagtagtcgtaccataccgagcgcgcatgaatgtgatcatgaatgcacgcgcgacagtaagatattacgtagatcatagcatctctccgcagcgcccgcagtagagtaatgactcactactagtcacgcgccccgcagatagtaatngatcgatgtgatatgtgcgacgcgccaccaggcacacgcagacgtgcatcgcaacaaacgaatgtcagacgcgcgtgnacggcgcgattcacacgnctcagcgcacagcgcgctcgcgattgcgaatagccgcgatgccgacccacgcngccagcagcctcgccgattatgccgcacgatagagctgacgatacgctganagacaaaagcagacatgtatgacagatacagacgcacgcagcaanacacacggatgtatgtccacgantatatantacgaccgagctccgcactancgagcgngccactcggtacgcgcgcgcctgtgctcgcagcacactcacgcgcgagtgtagcacatacacgcgcgcatcagtccagcacacagtagatgctatacgcagtcgatcgcgcgcgcatgaatnttgcgnagtgcgccgcgcgcaagtatgcgctaatnattccgcgcgcacgcacgtagtgagcgatgacataggagaggcagcatcgatgagtatgatngagagcgagagaatatcannctgnctgtgttcngtcgtacacgacgataccgactgcacaggcagctgtatanacacacatcaccacacgcaccacgagacgacacagnacgcacaatagaagancacgatgaacgcacagatactgcgaaccactgtaatgatcgacagcgatgcggangcncgagcaaaccacgacactattacgatatatagtaacagngaatctcgcaccgcgctgtgtcggcacgcacatgtagtgatatgcgatatagcgacaccgtccctactcgtgtctcngttcagagtgacgagaccagctcgtata

SEQ ID NO: 6950 - DNA, 872 bp, Homo sapiens
tcgtccataaaaacgaaatacacttgaagggctacacgtaacacggaaagggagcgtctcacacaccgcccctcatgcgacacaacaatatccgcttcaattttacattacaagacaatagaagaacatatgactactgagtagtatacaccagtcgaatgtataatcttattttattcgatagtacgttgcatcggacccagcgtggcacaggtgcctatccaagacacgtatgaataagtcctcaggtcaaactcagagttcacccaagaaaatccagccatttatgagctgacattgtccataacaaacgtcaacaacgctcctcaccgaagaggaaaataatttatcttctctctccgacaacataaaagaggatatccttatcattttagtggctctggtccccctcaccatgcatgtgaaccatttacctatgattaagcacagtataaaaaatgctcggaggtggtagggttatctcacaaagtcaggtaagccagtgaaataaaaaatagcctcctcagcccttcttccaaaattaacagcattatgagtccagccattaactatgaatatatttaaaaaaaagaataccaacagagtagcagccgctgctttgctgctgcttggtgacttggagacaaggcttaggattgccattagagccctaactacaggcaaagtcactctataaatgtacctcacattccacaacgggaagatttccggaaatgtgacgtgtagattgaaatcaataaaatgactcatttatgcagagatgaaaatagtagttgtattcaattacataaataaagcgagatgcggcacgtcctcttgcgtgttattgataacgctatgaattccttcct

SEQ ID NO: 6951 - DNA, 1272 bp, Homo sapiens
  misc_feature (1)...(1272): n = A,T,C or G
aattctcccaacactcttgtagtcgaggcggcgatccgtggcgagagaggctacctaggtagaccacgcgagagagaactcgatcgggacggcacgacggcgtgacggacgaagtggcggtagcaggtgtttcccatttttangagtccataaccaacccattatatccgcagtgatacgatctgatatacgcggcgggcctgctgcgtcaccaatcatcataaaaaccgtggactcctatgtaatgacacctacaccggttgtttccgagacccgctcaaataagcgcgatgtggctcgtgttatatatccttcgcccgcgcccgcagtaccatatcacgtaattgactatcattatatgatgatgtctggtgcacagcgcgagctcgcatcntacgaccgatcggatgtcgcttgtggtcttatcatattcgccggggtcatcgcagggtcattagagatgattaagtatcatcgacgctacccgcccgctatatatcctatatgtctaatcgaattaagcatgctcagtgatcgtaccgcgtatagtacgccactagtgtctcaattatataccatgttcccgaattattctatgccatatgccggcgcgatctgtagagagattatagtcaccgcgcgccatcgaatccgtcaccgttcatcgtcgtcgctacgctataattagctcccccggcatgccaatncattgttcccattcagcgacgacttgtgagtcgtcctataatagcctgtatagacgtggcgcacacgcagcagcttagtaatacacaacgccgcgacgccgcacgatatacatccttagatagattcgcggtgtctcgcagtacactgccntacatacgctagcggtcgccgtagtagatacggagtccaacagaggcacagtatatcaacagatgcngttgctgatcacgcggactgattgtcgcgtcacgccctccgattagagtaccagccgcccctcttatgcgctcacgatactactagaactnatatgtagtatgagagttccgcagtagagtgagtgcgcggtgccgtgcaatagatcgtagagaccgagcacagtatgagtgtcataagataatatattagtgcggcgccaccgtacgttccacgatacgatgcgcttgatgtatacacaatcgcaccgtatatatacgtgatttattccgcagcaccactcgcttatgctcatcatagagagtaccatgacggataggataggngatgctgagagacaaggatatg

SEQ ID NO: 6952 - DNA, 1092 bp, Homo sapiens
  misc_feature (1)...(1092): n = A,T,C or G
aaggaaccgcacacgacaccaagtaaggagagggcagaaggggaggaggcttgttaggaggacgagggccggaaggagcttcgaggggggagaaacgaggnncaaacaccaccagaggaggcaagggaaggacacaactttanaaaacagcaacgaagccccanacacacgacaacgcgacgaagacacggcagggcgcgagaagcaaccgaagagaagaagcgcgcggaagccagagcaaagaaacgacagagcaccgcgcgggacgcgcagcgaacagcaaggaaacgaacgagaacanacgaagagcggccgagagacgggagcgccaaagaaaagaaagccacacaacacaaatattcttgaggagggagaggcgcacaccagagcagacgcgcgcgaaagccagagaaccaacagacgaaaagcacacagggcgtcagacacgaaagcaacgagacaagccaccagacatacaagaggagagagggtaagtagaacgaaatgaaccgagaaacgcccggaagcacaaaatgcgccacagaagacagaaatcctacaacacccccagagagaacgagaagaacgccccgagggagagaagaaaacgccggcgcaaccgagcaagagaggcgagcgaacggagcgccagaaaagatgcccgcgacaagacagtacgagaaggccgccgacgcagcacgaattaaaggaagagacgcagagccgacaccgggaaagagatcacggccgccacacgtgtaggcggagagaagcgagcggcgagagaaagtggaagcgacggagggaagatagcgagcgccgcgcgcgcgatgcaccgcgagacacagagccgagcgaagtccgtcgcagcagctggatgacgcacaccaaggacgacaaaaaccgcaagagagaccagcgaccaaagatgcgacgacacacaggtcacgacgaaagcacaagacgcggcgcgaggagagaaagggcacacgagaaccagagtacggacgagacaggcggaagaatcaagtaagaagtccgcacagcgaaaggcgtataagagaagaaaagagatgatacagagagcagaag

SEQ ID NO: 6953 - DNA, 860 bp, Homo sapiens
aaacctctacatatcacaagaaatgggcttaaaaagagaaggaaggtgggaacccccattttaacacagtctaagtctctaattcccagttggtatccccaagtgcaggctcccagcttgtttgcctatgtgggcagtttaccttaacagctggctcttcggtaaaaatgattgggggtggttttccttaaaaaaaaaagccttagagggaatcccaaaccctaactatcggcctaagtgatttcttcttaactcctgtatcggtaagagtcaagaattttacccatccctccttcaaaatattgagttagttttatagttaataaacagttaactgtttaaatatcatctgttttaaaaattttactgaccctcttgaattacggtatagtatagctacatttctggactctgtactgttgatctgtttgccctatttatgtcaatacgtcttgatcactggatctatatttatatatttatccctaaatttaggcatggtaaatcctccaacttggacctttatttatttatttatttatttgcaaaattaggctactgaaaatcctttccatcccccttgacaatgtttaatgtaaattttagaattggcttgtcggttttataaagcggttacttgggatattgattagggatgtatcatatcttaggtcaatttttgaaataatctgcatttttaatcatactgaatattccaatacataaaaagcatcttcccatttcttttttgttttctttaatttgtcttagcaacgttttagtgcacagatcttgtattttttgataaatttctttttacatgttatttgacattattaaaaataaagctagatcagacg

SEQ ID NO: 6954 - DNA, 1263 bp, Homo sapiens
  misc_feature (1)...(1263): n = A,T,C or G
gaatagagtagcacaggtcgagcgcggattatgactaacagggagtacagagagccgaacgagtagccctaagctatgggngaaactagangganganagangagagcttgnagcngagcgcagccacacgnacgagtcgtacagtcgcaagagatatacatagagagngagatagaaagatgagtttataatatangagcgncagcacagcaccaagtatatgcgcgcggcgagtgtatatagnatattagccacgcgngacacggcgtgaagttcgccgagcagttgatatacatcgcgatcaccagccaacgtttattatatgtatccaaagtgagatttgatgtcgtcgctgtcagtgtgtcagacgaaagatagctgcgagtggtgcgcggcagtcgttaccacnctgctacattaatgtctttctattaacacttgcttgatgtacctcttgcccgcgtatcgagggatatgagcaggcgtttggctcactatnttggtaacccgcctgcacagtcggcgatcatgcaatanaatatgctcactctacgcacgagtagtgggtgtgagttagtataataacattatgaaccgtgcatcncgatagccagactccaatcaccngctatggagtcagatataataaggataccgcatacatatgacgatgtcgcgccccagatgatttaatattacggctccgcgtgatgcgataccactctataatctactcctaggcgaantagtatagcgcccgcaccataccttttcgttagctccgcaaagcgacccgcgtactgcgntacttacgtcggttagggtcgcgtatgacgtnaacaataccgagctcggtagtgcacccgtnatatacgcttctgcgcgtagagactctggctccctcgttacgccgatatgtcagatcgtcggcgaggccaaatagagcgcgaatatttatagactgcccgacgctaacagttgcacaacaaccagctagataagacaaggcgactgacttatgcgattaccgcaaatatgagaagacgcagtcacgcgttgtattgatgatcatcatcacttacatgtgntatcacgctacccatatagagctgacagttggatagagcacgcacgctgcatcgtggagcatgttactctcgtaatatcactgaccagcgtatgtgattatattagtagcacccgccttactctaatatctgcttattccatcaggtcgttgtacatgagtataacgtagttat

SEQ ID NO: 6955 - DNA, 1130 bp, Homo sapiens
  misc_feature (1)...(1130): n = A,T,C or G
aagaaataaaaangaaagnnagaacgnaggagagcacgccacgcgccacgaccaacgnctcggcaaagcggcacacgcacgaagcttgcgcaccaccagccctccctcctccacaccttttgacctacacatctccccctggcttgtatctcatacccgaggcggcgacaagcatgggaattcgttgtagccccagagtcacccggcgcgcacacccccgctcatataggaaagacgaggagtgtatggcctttttcggattcactgtacttgtagtctaggcatggaccaccacgcatattatgtcgagcgtaacaccaagatnagcagatatagcagagccgcggagctccggcattcaccttctgcccgggctcgacgtgagccgacggggagctccacgaggtcacccagcgagaaacgccgacgatccagtaacaataattaggcgcaccggagacaggacagtgttgtttgtgtaaggaatagtaatccaccgcaaacggaaacctgcgaaatcatacccccctgccacggacagcataccttataaacacattaacgagaggcagagagattgtgaagcgtaggacatgttatgagaagtagtatatatcagattcaacttcatataatactctaaatataacccacacaccgttactatcttcgtcctatcgtagtgatcggtagccacgatcagcctggcatcacacacaccgatcaagtgtttcgtaagatgatactttatcaattaacctacactttcgacgacgttcaattgtcctatatccacactgttgttatactcactttaaggttattctggctgtagtgatgctgttggtgggatnacacaacagagcgattgcatcgagtttgtgacggatgaatccatgtacggtatgcagaacgctgaggcggggccggactcgagccagcgcttgcctttgtttgagaactattggtatgatcatatttcgtgcagtcgagttgcagctcgacacgtcaccagtgtgagattcagtttcatccatccgtctatcattggctggcctagcgagtaagacgcattagtttgaatcgccgtgggctaatatctctcttacgtaacccgtctcgtggtagag

SEQ ID NO: 6956 - DNA, 1432 bp, Homo sapiens
  misc_feature (1)...(1432): n = A,T,C or G
gagcaagggagcccgacggaccggccgggagacaagcagcacgaccggaagaagngagaggaggagnagagggggcggctanagngtnagacangggaccnagcggnggncngngagaacgccctacggncacgcagncnacacaagacgacgaccacggagcacagncagagaagcaggagaacgcagcagcagagaggcaacaaganaatattcnaagacaaaccaaacagccacacccacaaacaccacacgcgcgcgacgcagggcaaancagcanaganacggagagcgcggaggacgcgcagaggcgcgacncncnagacagcgagagacacaggcgcaagacaaccgcgacagacgagagcaacgacagaagaccagcacggcgagaacgcgcgaagcgagcacncggaggaggagagcgagcgacaggagaaggcgcacgacggagcaaagacaggcacggccgcgcggcgacgcagcncgagcgcacagagaacaacgcgcagcgccacgaagaagnagagaagcgncgctcaccacagacgagagcagcgacacgcaggagacancacagacagacacggacgcgaagcacgagaagagcagacgagaaggccgccgcggggcggcgagcgcccggcgagcaacgcaaaacagaacncccgccgcgcggcggaggaagcaggggatgagccgagagagcagatgcagagaacaagacgcacgagcagagcacgcgatagccagagagagaacggagaagagacacaaaggaagacgcgaacgcgcgaacagaaaacagcacagaccccgcggaagcagaggagagataagcgacgacgaagaggagagcgagcgcgcagaagacgaggcgaagcgagagggcgcaagaagacagagcgccgcagacgaggacgaaaggccgaacacgccccgaaagcaacaccgcaaaaacgcgaagaacaaggggcaccaaggagagcgccacagacaccagcacgcgcgacgcccgcccgagngaagaccacgcgcgggcagccgacccgaacgggcgagagcggacctaggcgcacagagcccgcagagaagagggagcaacgagcaggcgagagaagagccggaacaaggaggcacgcgccgacgaggaaaaacacgacgcacagcacagaggcacgagaagcagaaacggaggaggaggacgcgagaaagaaagaaggagaagacgaagaaaaagcgcgcaagagcggcgcaaagcgcgcgcggcaagaacaaacacaagagcgacgaagaaagcgcagagcggaagagagcgagagaccaaccagaagagacgagcaagaaggagaagaagaagacacgcgagcccgcacggtagaaagaagaagaaacacggcatcgcgcagccanaccacgcgcaaccgagcag

SEQ ID NO: 6957 - DNA, 1017 bp, Homo sapiens
  misc_feature (1)...(1017): n = A,T,C or G
tttttcaggcgatcnggctgcggaagtcactcaccgcgcacacgnnagtgccggaggnacagccgaatggcgaaacgaatgtaggcganaacggacgagcaaaggagcacacgaataatacgggggcaccagggaggccaggcgggccagagagagcccaagagggaagaggcagtgacgaacacccggggcggcggagaccaagggagaacggggaagagaccagcgacgcgccgccgcaccaaaaaccgacccagagggtttttatatgcggagggggcgcggcgcgacgcaatccccacacccgcgcgaagcggaacacggcgacgagcgcgccacagagccagaacagacaccgaccgagcgagtacgggtgaggagagtagacgaaagacgcaagcagagcccgaccgccatcaagccgcgaaagagcggatgagcatcgcgacccccgttcagacagacacgacgcccccgcgggcgaagaggatataagcgccagccgagacacaacagagagcacaaagcagcagcccgcagcgagaagacgagccgcccggacgaatgcaagacccgacaccgcacacggcgacgacggaggccgcggcggacgcgaccgcgccacgagccacaaagacggcgcacgcaccgccaccggaagaccaacgcgaacggacggcgaccgaaggacgcgttacgccagccacgccgcgactatacgacacacgccggcacgcaagcaccggccacgagccggggcgcgcccgaggacgaggacgccccaggagatggccccggagagccgcagggagcagccgcaaagaaccggaggggtccaggcaaaggcggcacggcgcgccagnacgacccggacccgcgcgcgacggccatcggaagacggcacgcccggcgggcggggcgacgaccagagacgcacaaccgaagaaagagacaagcacacacgccccgacacgaacgacacagacccagcgagcgaggagacgcacgcaagggggg

SEQ ID NO: 6958 - DNA, 843 bp, Homo sapiens
  misc_feature (1)...(843): n = A,T,C or G
agtgcgtgggaggaagcctttggtaaaaaaaagcccacttaagacccggattggtaaacttttccctatagcagcctcggaggatcctgttttagggaactcaacttccccttacttttaccccacccaagactctcctgggactctgtggccaagctgtccaagcccagatcatcaaaccaaatgtctttgaaaggcagaagataccccagagaaaattaattagggagtgtatgaaactaggatgttctgtttccaagatacgacttccttttcagggcttgcagttctgcagcattgactaaggtaatgacattcaggtagtttttccctcntagcacacatgctcccatcagtgtgttctagacatacatgcctcctgactcagcagactggagaccaacaataggaaataggttttaattttattttccagctgtgatcaatagacaacaactaactgctatgctggattgaggaggagtctaacgtaggttttatctcagctcagtgaggaaattatatgatggattagtgatgtcttgcatggatgaagataagaggataaagagggagtaatcgggggatgaatgataatgcctgcgcccggtatttgccatcctagtctagatctaagagagagatgccaagagagaggtacaggattctctctttcaccactctatggatctgactcctcttccatgacaaatatgtgaattaaggcctcctcacttcagggaaaaccttacctaaccacagcggcccaattgccatgtgcaaccatgttagattattgcatagtagcttcaatattcacacaaaagaaacactgatcggccg

SEQ ID NO: 6959 - DNA, 821 bp, Homo sapiens
  misc_feature (1)...(821): n = A,T,C or G
tattttttatgggaatagaccctatttgatcatataatgaactttagtacttcttataaagatgcagaaaaattgaaaaactgaattgtttctataaatattgaggggtactggtaattaccctgatgattttgtagggaaataacgactgctnagtctccagtgcctagtaacaaaagaaaaatcagacattatacacttataattcctctggaataatgctcacaaagcctccagncaaagacaacaatctaggcggctctatatcccctcattaaaggatagggaaaagaacagatccacatntgagagcaaaataggcacaatgttggatgatgtggagttgattcaggtgcgttagtttaggggatgtgcgaaggcaactacaaggggataaaatcagcaagaaaaaaagagcatgacacagttccctagaacatagtaacagaatagtcaatggtaatgtgaaccattcattcattttttcggtcattaaatcagttatgaatacagagacagaggcccagggttaggatcataaccaaaataaacagcttccgatgttgattttgaatttccatcttgacaggtacagccttgactcattgttaaaagtagttgtagagccagcaggttggatgccaaggagaagagaagaggtgtgctttatgtatgggttccatgtagctccagtcgcacaatcagttagtgcacggtccttacatgtaggatctactgcatttccgcaactcacacnnncccccccacatcacccttaccaaccnnncacccaccncccacctnccactcccattccaatc

SEQ ID NO: 6960 - DNA, 1318 bp, Homo sapiens
  misc_feature (1)...(1318): n = A,T,C or G
atgtacgcagagaacactgataagaatccgcgcatccgcgcggaatacaaggtttcgagagtacttgtgttggcgaagcataccgcggtgcatagtatattgcgatcgagtattcagattgtctccgtgtgatgatggatcacggccgtgtagtgagagtacgcgtgctatagttattataggggcggtcgtgcgcggaggtgctgaagataccgtaaganacgtcgncacgggtagtgatagcgttgcgctgcgctgtagcccgaatcattcagctgtgtctcatacttataccgacgatgagtagtatacgtgtgtgtcatagatgcgcgacatacgaccaatatatattattatttttatttatatgtagcgtatagaaattcgtcagtgacgatatacatgtgaccggctcctgacgcgttcgttttgttcgcgccgcgggaggggagcgcgatgtatataaatatntnagaggtcgaacaaacacgagtatagattgcagagaagaaatagcggcgaggtatnctaagacgcgggtgcgccggtagcgagacatgtcgtgccgtcaatgtggaggattagatcttattagacgcggcgatctcggagacgtccattgttatagcgaacgatatgccgcgcgcgacgcgatgttatatttgcgtatattatttatacaccccgcaacgataatacgcgcagagatagcgactgtgctgcgtgaagcgatagaattcggacgttatagtatagagggagggccgatatcacgcgagtatgtatcctctagatataacgcgtccacggcgcggccgattatatgatataatatttaatatttcgtacgcccgccgacactatatgttcacgcgataangagatgacaccgcgcgccgcacgcgccgctcttttagatacatagactatactcggcacgctacgaagtgagagtggataatatcgagatagattagcgctcgaaccgtattatgtgtacatttgcagtaggtgagactcacgagacgtaccattctgttagtgcgatgagtacggttattagtgcgagcggtgcgcatgtatatatttgctaggatgtccgagacgcgctcgtccgattatttgtggtatgttataggtatgggttaaccagagtgatggcgcaggtgccacgcagatatagtatatgcagatcancttcaagtgctacgccagtcacgtagtgcacagatgancgatctgacatcaagtagaggacgtctcgcatcacgtcgcgccattatctcctggtatagacatacgacagacatgtcacgtg

SEQ ID NO: 6961 - DNA, 849 bp, Homo sapiens
  misc_feature (1)...(849): n = A,T,C or G
tcctttcaaatttggagattttaaaccgttaggttagtatttaaatgtttgtagaattcccttgtacgccatcaggcccaaagcgtttttttggataattttgaattacacttcaatctcctaaatagttaagggctattaagattttctaaattttcttgattcagtctcagtaggtttggggtttctaggatttgtccatttcatttaagttattcaatttggtgcctgtaaaattattcatgttactgtcttatacccctcttaccattttgtgtaattggtagtaaggtcccccctttctgatttttcttatttttttaatgtgtttatagctataaatttcctccttactactgcttntgctgtgtcccacctgatgaagtccttccagaccctaaccaatttttcagggtttgggctacctgcaaatttgattctagcctcttttccagtgtcagcaggacacatggatttcccaactctttaatatatggtgatttgccatgttctccagcttgcttttgaacacagtaatgccaataatgatctaacaatgataataataatgagcatttgttgaggtcataatctagattattgtgttgtccatttgtaaatattcatctctaagtactttctaatttctcttgtgatttctttgatccattggctaagagtgtgttatttaatttacatacatttgtgaattttcctgctttcctattgattttgaacctcatcctgataggagatgatcctttataccctagctatttttttttaaatcgattgagacttaagttgtgacctagtatgtctctatacggaaaaagccagttccgccaa

SEQ ID NO: 6962 - DNA, 1494 bp, Homo sapiens
  misc_feature (1)...(1494): n = A,T,C or G
atacataattacgaatatcgtgatacaactcggagcacacacatacagagtcggatcgtgcgacgcggagacgacagcgtggtgcgnggaatacaaagcggtgtcngtatctgtgtatctactctaggtcgcgngacggatctgtcgtccggctgcggtgcgctactgcgcgcgctcgcagangaagtgtcacgatagngcctgatcggtggggatgcgacgangatgtgatcatagnatcgnacacataattagtctgtgngcactgttangacccctcatcanctcgctnaacatcgatttgtgcgtacacttatannatgaacactcgcggtggncacantagngnagacacacagtaaagatnaggatacnctctancgtgancgccctacacgaggnggatatctgagaccgtgagacacacacgctgggcgagcacgctgagtgtgcgcgagtgtgcacactattggtctnnnatagacaggagtgtcagcgtaccatgatactaagctgtggacggactgtgggcacgccagtgacgatgatgtgaatgatgagngcgangacctacataactagtctcataganangatgccacatacattagagaggggagcgngtgtcactgctctcgcgcgaacgccgcgcgtagttgcgccgctgcatgactccgcgcganngcctgtgcgaagatagtcgcgtggcatatgtgctcgtctgtggatagtcctagaagtgttatgtatgtcctcacgacaaacagagtgngacagctgtgngaccgtctnggactattgtcaatccagtatngncacgcgctcacaaccgagaacactgatattcaaagtagagaaacagtacataanatataaagaaaaactctcatcaatacaacangnnngaactacacatacactgtatcgcgacagctangtgtattccattacttgnggagaggaggtgnnnatgtaactcacgctacacaacgaggacaggaggtctgnacaggtgaactgagagatgacagagagtcgtcgtatcgggagtctcctgtacagatatacggctcgcctgtggcanacggcgacatgttagagtaaganatactgcctgctactcgcgcatgtngccgtcgctngcnccctccgtcgtgtgctgtcattcgtgtttggggaggtgagcttcgtcgaacaacatcaagtaccaccggctctctcttatgctatgnnactacctctcgcgatgcttntctcagtatccatcactatcggtgcatatcgcgtatctccttgcgttcactgcnncaatgnaagacgtgtnnncctaggcgtcgcgcccttaacacacgctcgctttcttcccttggtgtcctcccctatnaaaancttnntnntnnttnntnctctctcnttcaatctcacctctctanncantnntcattctcactctnnncnctctcttnnccatanntttcacttttntcacctacc

SEQ ID NO: 6963 - DNA, 2175 bp, Homo sapiens
  misc_feature (1)...(2175): n = A,T,C or G
atcagtatnatctgacgatcnagcagtgctgncntagtcttcncgcnctgngttgttgtgactantgtcgtcttantgatgctgcacgacttgtcgtcatngatctgantgncgatngtgcatgacnggtgnacgctcgactgacatggtcantggacgacgttcagtgcgtaacgctcgtagtacntgncatncgttcangttcantttggagtntanttgnattgttagtnagtactgtgcattactgagatgtctagcagttacnatcagtcagatctgatagtggatagtatagtgtancgcgtcgacgaatcaatgntgangtntngngtcgtatcgatgtgtacntctgtgatatgcancatntcttcgngtcagggacgcttcagtcgtgtngtccagctaggagncgtangtcagtngnatcggcgtagngatcgntgngtcangtnctgtgtctcagcntggcgttggtntggtgacntcngtctgaggtagtgcagntcngnancagtggtnngtgtgacntcgacgtgtacgctagttagatgtgatngnagntctgatgaggatgcagctgnatngacagannacgacatngtagcgcgtntncgangatatgctgagngcaagtacgatgatcagtggantagcnancgtctgcacgtagacagactcngntcgacgtcgagagcagnctgcggcgagattcngaggcnganggtgctgactctgatgtcgcgngtgntgattgagtctgcacagnatngctcgtngngangtgctncgnctgtctanatttagatgcncngtagnctncgtncgctngccatgatcatagngactgccgacntcatncgtngcngcntgtgtgctcagtntgctgnctagntgntcgtcnctagtgatcgatactctctcatngcnatcgtggtatgcttagtagtagtgacgntgtatctggagntcattanancgtgagatncnacggcacgatcagacgannagtcngcatagcacngcgtgatgcaganagacgnaggtgatggtcggccagtcgtggacgngtcgttgatggagtggtagtggtgtcgatgggtgtaagnntgagcnagtcgtatgctgtggcgtgatctgacgctgctgcantactcaatntgaggatcactcagctacanctacantgtgagcntatgacagttgaggggatcggagtgtgtangtagcgacgtcgagtggagtgcncggtgttgnacntaacgagnagcgntggncggtgtgtgaggtgtactcgtatgngtgctntcntgagtgacgtgtcgntctatnagtttacgatatgcacanatcccacgactncganatcanatnctntactacgagcagnagcatgacgatcgcgtgagtnatgtgactganctagnagcgnaagcatactnanagaagtgagntgtagtgtagtcgagnangtagnatgtgaggtgactnangcgtgtncagtgcgcgatgaatgtgaaggtcatctgatntcnttagctnatagnatncgatgacgacnagctgcgtagctactagngtgtccgatagctagcagcatcatcctnctaagtgagngaggatgagnagntnagtcngtgaccgtgatatcatcgtctacgtgatngtntctacgttgactacattgcagcagtcgtanggacgtactgcgtgtagtagtntgtagttgntatgcagnagcatagtagtacgaancgtagtcanagnagtccgcgactacacntagatacacgatgtttcaatganncatcatggcaatgacgactagnantgcgatagtgtgangtatnatntgantacacancancgtccatncccttanctgatcacagnattgancgtgtagnagtagantgatcagatgctgcagatcaatcagtaaagatgtcatagtantntcntnctnttnnacatatnanagctnanaattnagangagnncacngcangtnatgntgcntgcnngcncaaaggccgctatnctatactnctnntatctcagtnntcatactgataccaacnnntctntnctctntncctctctcctctcctttnnnnnnnnnnnctnncnctgnnnnnnnnnnnnctnntttnttnttnnttttctctttttttt

SEQ ID NO: 6964 - DNA, 1498 bp, Homo sapiens
  misc_feature (1)...(1498): n = A,T,C or G
catatcanaacataganatcacgtatgnnannaccatatgagatngatcagagcaatgtactaaacgtagntgncatagcgagaacgtgtcggnngncatatcacgtagngngcannagagagtactgacacatagagtatanactcgcgcgagnaatacgtaatatacatacgantnnngccgaatcagacctcnacaccgcgggtgngantcgtcctncgagcgtgcntcacacatgngntanactctncttactngcgcgacntnctacnanggcgacactgctcgntngcacatagatntnngnagcggngaagaatcatatcgtagagcgaganatcacantcgngncgagagatgancggtgtgcagagagagctagtgagtcgaacaatctagtcgnanaatagcgactagaaggtggntgatacagcgacgaacaatgatacactatntngngtagtcgtgtatacggnnnactactctacagtgnnaacacagtgtgcatacgcgnagtaagagcatgtggatactcgtatcatagagacacactagtaccacatcatagtgtnnngaatatcagcgacgggatatatatcactgacagatgacgtntngggaaggaagtnngngaacacagaccagcaggacgtatacatcgcgcgaggngngacatcgacctacgagacgnctcgagcaaaatgtatatgacagtganttgtngaacaacagtatagcaggtcgagagtagccgagctgtcacgcagtaggagccangcgcgaggacagatgagaactgtctacatggaacatatcaggtcgaatctgggngatcatagtcgtactattgtgngacattgcttagcgtcgtacgnggaagagggggtgacgagcgtgacatagtggaagtaagnagctangagatcacaggcagatcaacacaatanagtgttntnaagtgtagatcgagtacaanatttaactattatcannntcatcatcccagntgctcttattnngcgatcagtaccattgtgtctgagtcgtgagagtgnaatctatgatgatagtgngngagtactgtatcnacaagtctgctctgtgagctactgtctaggggnnccataacgatcgcgacgcgtactatgtagnttgcacgattgcttgatgagagtagttatatggagagagcaggcgaatggtggattggaactagtaactctcgaggcgatncctatgtnatgacgcgtgtgcatgccattgtacaataatagacacctgaatctatgtcatgngcgagatcttggcacgcagagngnagattactcactgtcgtgatgctcatgcacggacatncaatataccagcgaacctgtgtnccctnactgtgtctgtctgttccatgctgnncatgctgacatcgntntntcnatgctacagtctgttatatatacncnagacgcnattcttcncgtttctncctgtcaaagaaaantc

SEQ ID NO: 6965 - DNA, 2099 bp, Homo sapiens
  misc_feature (1)...(2099): n = A,T,C or G
ctgcgacgtcgggtcatgtatgcagatcatccngtagtcgtcatgagtacgactagcgcagacggtatgatctctcagtctgacatgagtatgctcagctgtangttcatctcactctctacgatgcnctnactgctatgcntagcggatcacacntcacttcgacacatgcngctgcnctnctacagtgcatatctggcacgantgatgncactgagcgtacagctactacatcacatgctanacgtgcngcctgcttatngagtatgtacgtanangacanananctgatagatcgagtgactcagctgtatagctcagtgcatcgtcgngcattactgtntcgctncntcagtatcatcncataacggcacnctgcgtagcgacgtgcacagcatcagtgtagcgngtnatgtactgtacagatgaagagatgaatgacgatagntatagcgcgcacagcgttctgatgtctgtcacagtcactggcaccagtcatcgagtcagtagcacgcagtacgtatcgtctagctgcgctcagttcgcatcgtacgatagagtatntgagtnagatagtagtacgtagcnatctaatatcagactgagcanctatgatctgaggagatataccagatagtngcagagtagtagcgcgagcngcngagtggagtgacgcgagcngagcgtcgaagtgcagtgtgatntatgatctctcctcgtagtcgctgtagctgcatgctgtgctcagctcacncccatcagagatcgctcgtcgtcgtcaccgcgcgcacaacgctcgtactatcgcgtacgttacgatncatcngctcaanagcacgtagacactgcgagcgctagccgtcacggcgtcattacgcactcagtccctatnancgtcacagtgctactcgtcncgacgctgacagnantcgtactgcggagcgacgagagtgatcatatatgtantagccantcagacgacacagtcgcacacacccgttctagtgttgtctcgcgtgtcacattttctcacacatgtatatagtagagcgtacacacacgtttagtgctagtcancagtaataccgagtcgncgtcgtcacgtacgtgcgantgcagacgtagagtatgcgagcagagtcgtgatagcagacagcgtgcgcgntcagcgtgtgatctcggcgataggacagtcgagtgtgtacagangcgtatcactntatgcgcactagcgtactcgctcaggcacgtganagcagagtgagagagtgtgtggccaggtagnacagtgtcaagctatanagacatgtgagtactagacatgctggntagtgtaaagtancagcacgcgtatatgcctgagagcatngnacnagcactatgtgtcagtgctcgactagtgntcataggctcatatagtgntcgatactcgtgtctgtatcgatcgtgatgcgtctgcgctgagngagcgtagcgctcgtgntatcngtgagtatctagtagtagtncgtgagagttagagntatggcatgcgntcatgtgcgccgtcatcagantgncagttgactgcatcgngagcattgtnaggagtatagcgtcagagatttgatagtcgccacgcgcgctagtagtgcatgantcntagtagcgatagtactgncgtagcgtcatcactcantcggcgatatgcgttctgttcgtcgctgacagcgtgcgatcgtagtgtgctcncgtcagcatcgcntcntacgtcatcnatcggtacnactacgtgagctgtcgcngacgcntcntcgatgagancntgtagtccatctnatngtagtcgcnacagtctcacnagcgacctgcagcgangtagagctagtcttanctgtctacggtcgatnatgctgcgctcgcgatnctatgtatgtagtgtgatntacgcgaagcatgtcacantagatatgataagtgctgaactgtgatgtcgcgacatgagatgagatagtacatanctgtaacgacgagtntgtcgtgtttagcgntnagtagcacgtacagctgtctcatgagttggagagtgagatagtagacgaatgtcangactcgtttgg

SEQ ID NO: 6966 - DNA, 877 bp, Homo sapiens
aacaagcaatgttctacacaccatctaacctaaacgggaaacatttattgtttacccacattccaactcgccacttccccgtgggcaaaaacatttaattgggaaggcttacctactggcccccaatctcgcaattattcgaggataccccgactcccggttccacatttattcaccaaaacacaaccacaccccaagggcctaacccagaaagtggtcctcccactttaatccgccccccataccagtttattattttattcccgggaaagttacaaacttttgcatcacaaaaaacgcaggcaaattaaacccttacctcggtatttttcgccatcgaacggagacaaaggactagaagttatgtggaggtttacgcaaaaaagaaagaaaaaagcaacagcatcagcaggagaaagtacaacagaagaggagcaaaaggagggggagaagtaaaaggagtactgtgtttcactagtgcattttaccttctgcacggtaaataattagtacccccaagcttataaataacaggatggtgtcctctgactaaaattagggctagtttttatgttaggaatttataatttcctaattgctattgagatttcttgcagcataaacaaacagatgtgcttttaattagattagcatcttataaacaaatgcgtgtctcaagttcaatccaattttttcttagtttcttgttgtatgcaagcattttaatttgtttactgcaagaaatatgtacaattaaattggtttctctgtgattaaatattttataacttcttttatttgatttttaatttttactgataaagaggtacaaaagtaaatgaatgaaaattaatataataaaccatgtatcggccag

SEQ ID NO: 6967 - DNA, 836 bp, Homo sapiens
attgcaaccaaggttgaatccatttttcttccccctggtgggctgggccacattgtccaaccccgattttctattgccaaaaaaagaataaccatctcataagttccggagccaggccaataaggtatttttaagcagcccctaggccttacccaaagaagccctccatccccagggatctgtattaattttaatcaagaattttaacagtaaaaggcaccagccggggcgggtggctcatgcttgtatcccaaccactttgggaggccaaaaaggatggatcacgagtcccgaagttcaagacaagcctgcccaacatggtaaaaccctgtctctcctaaaaatacaaaaattacctgggtgcagtggcaggtgcctgtaatcccagctactcagttggctaaggcaggagaatctcttgaacccaggacagtggaggtttcagtgagccaaggtcgtgccactgcactccagcccgggcaacagagtgggactccgtctcaaaaaaataataataggctgaacgcagtggctgacgcctgtagtcccagcactttggaaggccgaggcaggcggatcacgaggtcaggagatcgacaccatcctggctaacatggtgaaaccctgtctctactaaaaatcaaaaaatgagacgggcgtggtggcgggcgcctgtagtcccagctactggggaggccgaggcaggagaatggcgtggatccaggagatggagcttgcagtgagccgagatcgtgtcactgcactccagcctgggtgacagagcgagactccacctcaaaaaacaataataaaaataataaagcgagatcggccag

SEQ ID NO: 6968 - DNA, 939 bp, Homo sapiens
  misc_feature (1)...(939): n = A,T,C or G
tactctacatttcggaaaacgagcaccatcacatcgactttttagatcaatcatgagtaacagtaaataaagagatgccaacaagatgcggcctctaggatctcgtgtctctgtccaatgggtgatcgaatgaacgaaggttataccactcatctcgaatggctcctctttaatacatttgacctctatctctagcacgataaattaagaaattatatcgangaggtggaatcgaatagggaacaaatangtccctaggctccccccaggacaatcagggactaaaccccacagactcacgtggagtaaacaaaacacaaaaaaaaggaacggaggggcactgcatttcacaaggtttggaataaataatacaaaaaaataattaggaataagtgttcatattgagaaagtagccacaccggaagctaatcgggccttgcgcaccgccggcctttgcattggggtagtacacacatgcacacaagacttcgcgctttgacgtccatgctatgtaaagacctcagagattcgaagaggctcaactgtacctttcagatagagttccctcagcagcaagctgaatattagtggccagcagtgctgcaacagtttgtgtaaaaaaattccagggtctgcggttagtcgtgtacatagatgtttatgtcttcctcccccacagcacgaattgtatcatcagatgccttggtcacaatgtgcacaccacacagccacgcagctggaggcattttatacggcacttgttaggagctgaaagcacgcaagtgggtcactcatggctaggtgagtcagccacgccagactggaccccagccggtttgccccgagaagcagcgatnctggtttgcaaaaaagccnnngattttttttttttcttttttttttctcctctccccnncccccnccannnaacttaccctt

SEQ ID NO: 6969 - DNA, 846 bp, Homo sapiens
tatttccccccgcccgccactccccgcctttcaatctcatacaaccccctttaaaaacagcctcacccctgtttccaagttcctttagagatttcccccccgtcaaacaaaaaatctcctttctcacaagtccgcagcctccaagttttttggccctccaacagaaaagtatttgtccccttgcgcgtcccttgtgcattcccgcacgacacatcaacccataccatggtggggtaggaccccccctgatagcagagataaggaaccacccctccccggacccgcagcctgggcgactgcagcttccacggacgacaccagccccggctgttacccgcggggatgccgaaaaggacaactcaggaggctgaacaaattctgcttcagacacagaccccatttactccaggatgcaaagccagaataagagcaatgaccaccacgcctgacaaacctgctgctgcatacatctgtgctctccaatcaataagacctgatgcagaaaacagaaaaggggaagagttagggattcagtcaggatggtgggaaaatttgtaaaataaaccttcttggagggccagaaggtttttgcaaaagcttcaggatagagttaatggctgaaggcagcctaatcctctttgagctataacaagggtaactaacataggaatgtagaggagtctatctaaatagcttgtttgctcatgtggtcctaagactgacttttgaccatccacgggtgcatgattgctctctattcaggggttggcaatggtaattaccttctagtggtgtttattgagacttttgtcatttaatgtgggctgaataaaacaagatccgccg

SEQ ID NO: 6970 - DNA, 779 bp, Homo sapiens
tctcactctgtagcccagtctggagtgcagtggtacaataatggctcacttcagctttgaccttccaggctcaagcggtccttctacctcagcctctggagcaactggaaccacgggtgcaccccaccacgcccagctaacttttgtatttttttgtagagacagggttttgccatgttgctcaggggcactggagaacactggagaactctctccctgaaagaacgtatacaaagtcgtacaaagcaaatagaagatttgaataaagtatttttaataaataacacttgatcccaatatcatcaccagatgagaatatgtatggattcatgaacaagaaaattgcttaaccatttgatcaagagagattggaatatcaagatgaagcaggtctgggtgaaagagctgtgaatggattaatggaacagaaaggaggtgtggagatccttctattacatgttaatgatcaccaaggaacatccactacaattgaacaatccactaaatcacccggtagaacaaaagaattttgtggcccgttgactttggccagtctctggcttagatgtaaatgtcaaacaacggacattaatggtattcccttggttgcaggggtggggggttttcttggattccacaattcacatttgcagtttaaaatttggaccagccaggaggggtggacaaaatatttaccttccgaaaccaaaaccgaaggggacccctatccttggatagggctgagtggggccagcatttaaaggttgaaaagtagggct

SEQ ID NO: 6971 - DNA, 892 bp, Homo sapiens
  misc_feature (1)...(892): n = A,T,C or G
ccatctcccaccttccgctcagaactctaacaattataaaggccccaaagactcgggagcgatatcgccccggctataatacattaaaggcccgcccacacacaaacatcgcacgcactaaaccgaccgtacaccataggacaaatagcgctattggatttcaccacctaattacataaaacaaaaaagccacccccccgccccgccctatctaaccatggtcaccatagtacgacgtagctagaccccacctaatcacacttcccatgacaagacactttctcaagacacccaggcttgcgacattattggccttccaactccttaaacccaagaatggcccttattccttggccaagggcctaagctggcggccgcatttaaaggcttagacagttagttatctcccaaccatggcatctcccattacatcccatcaacccaagtggctccccttccttagaaatgaggtgcatgagtggacaagctccagcttgacccaagtggaacaagctctaatagtcccatcagatcatgcaccatccagaagctgccacactaacagagtgatggaaaggcctgttgaaggcatagtggatgagccacaccattgcaaggggcagcctgcatccaacaacttgtcagcacaggactataaaggccttaccctttgcctctgtgaagcatcccacagagaggtgcatccacctctgaaggtacatcccagcttcaggctcccagtcactttgggcttacccagcctcttcgtctgccctgcttttctccctccccttccttcctgcaggtttggatcctgagagcgctccctaataaacctcgatgcggcagaaagaannnncnnngcaacccccccccccccttccgcacgacc

SEQ ID NO: 6972 - DNA, 790 bp, Homo sapiens
  misc_feature (1)...(790): n = A,T,C or G
tattaataatgatattatcatatataatattataaggagcatgaatcgactattgtagatgacaaaaaatttggaataagaataggcctctcaacgtcgactgatagcggtataaaacatagtccttgtgggatttttagctagggatcatgattggcaggaaaaaaaacattacaggattcatataaaaagggatatttgaaaattatagaaataggcaagtgggctataatgtactcaagaaagnaaaagtaaataaaaaataaaggtagggggagggagtaataaatgatggtgataagaattgtttaattttactgagttctacgacatcagggcaatctggtgttttcggctccagacaatgtatttttatatgagtttcattagcttatataatgctcaggatacgtacactggcatatatttagcgccattaatcagatgcaatatcaattatttttctctaagttatgcaattgatagttgattcgaatttagtttccttatagttatttccaattcatgcaagagagacacatttttaaaaatatataataacattaattattatccaagtttgcagtcctccaagcattcttcattcatcatcaactctaaaagatgaacttcatatgcttaattccataagttttgaagaaaaccatgataataagtgcccataatcccagaataaagcccccaggtaggatgccatttttcagtttggtttgaatctttttnccctctttttttcactttttcccacattcctcttcttttctttatt

SEQ ID NO: 6973 - DNA, 869 bp, Homo sapiens
  misc_feature (1)...(869): n = A,T,C or G
cgccacaccaccacccgcacttccagcggacaacatcaccaacccccgcacgcgctctcaagccgatttttcccggcgctcatcacacctaactgaccgcaaactccccaactaagacacctacgccggacaccccaggatagtataccacgcctcctccccatccccatagcaccaatacgatatgaaaatacgcccaggccgcgaacgcgcgaaacgataaaaaatgaagaataagaccattgtaattcaataacagagagctagtcgaaaattctggtactttaaaacaaaaaaacaggtaataaaaaaaggacgatagtttctttaaaacgaagacattcataaatctatcgatttttatagtttaaaaagagacacttttttcctaagggtctaaaaagaatctatctgttcttgcaatcccacaagaaaaagtgggattttaaatatcaagggcatgatcacngaaatatcatcagctgaagaatttccaaaacaccagcggggatttttgcagtaatggaatgagtatgtctataaagttattgatcatatttctaaatacttctagaaattatctaaagtgttaattctctttctgatgtttaagaagcatttttataatcagttttataagagtataaactatctaaaatattcaagtgtaccaatattaaccttttttcagaatttcagattaataagatcaacattatccctgccaagactgttcatcactttaagagatctgagtcatgcaaattatataaaagtgatccttgatcactacacatttgtacttcatttgcatagcctctatggttcctgagtttctgtaacttccaaataaacaatgatgctggccg

SEQ ID NO: 6974 - DNA, 1080 bp, Homo sapiens
  misc_feature (1)...(1080): n = A,T,C or G
ctattatagtagatagacaacgaaaagcgggggggggggggggggcctgnctggcgaccactctgcttaatttttccacgggtacaacanctatganggaagtaaaatggtggaggccaggaaacatgtagttgttnaggagtgtgtggatgcgagcccccagcaggagaggtaatgaactattatagatcgatttcaacgagtgttcagaatggagagacgggattgtaggagtaattcaggggggtcgaaggcgagagagatgtgtatgtgttatggctaattaacgagattaatgattattgttttatttgcgcgaggcgcgatggtgtgcggggggtggtaggtacggggatttttttttttggggcgttgggcaggggtgtgtgagagagtggtaataggggggggcggcggttcctccgcggtgttgtacgcggagggatagtttagagtgtcggggaggggagcgtgttgggtggatgtaggtcgtgatctattatgcgcgcgntatagtggggtggggtttaggaggctatagcacgagtctcgcgtgtgagtgttgcgatatatattttaacaggcagcgggttatttgcaagtagtttttgggcgggggttgcggagggatagggtcggcgatgttgtttagggtagggggcgttggtgctagtatggttgtgatttgatagggtgatgcgggcggggatatacgcttatttatattttgtgagccgccgaatattataagatataagagttggccggggagcggggcgcttaattgattaaagttgtgggtggtaggagggggaagatggggttgtgacggggggtgaagagtgtttgtcagcgggtatagggaggagtggggaggtgttggtatgagtgtggcggagcgccggcgttgtttatggtggcgatcggggctggatatattgttggtgtacgttgggatattatattgtcggtgagtggtggtaaattattaggtggcacttgatggctgcgcgtacggattggagtttgttatgtgtaaggagatcgacgcgtgagtgggggtaggggtgggggtgggga

SEQ ID NO: 6975 - DNA, 912 bp, Homo sapiens
  misc_feature (1)...(912): n = A,T,C or G
cacttatccctccccccactcccggcgatccatcttctccgtcccctccccccctaccctctccccccccgcccccaccgcccatgtgtgcccgtggtccccccaccctcgtgacccacctaccgcccgttccctccaccattctacccctctccgcctccactgccgacacctcgcccacttctacaccgcgcccgccgccgccagcggctgcaaccccaacgcttgtgcccctacgccccgtcagttacccagccagcgtttctcccgtgccttcttccgacgcgcccctatttgctctcaactgctcgctcacccgcgtcctgggcggacgaaaaacacgagcggaccttctgacacaacgagaagatgaaacgcaaccggggacgcgaggagtggagcccccattgttcgtcgaaaaaaaaaaaattaaacccgggtaggtcggtccacgggtattaccccccgtcgttcaagagagggtgaggagtgaaactaatcttttcggccccaaaaaggagggaccggtggaggaaaaaaacacccttgtttccccccccggggccaaggtataatcacatttttaaaaaaagagaaaaaaaaaagtacctaaaacttgtgatatggtttggccttgtccccccccaaatctcatattgaattgaattatggggagaggtctttcctgcgctgttcttatgatagtgaatgagtttcatgagatctgatggttttaaaaatgggagtttccctgcacaagctctcttttgttgcctgctgccatccacgtaagatgtgacttgctcctctttaccttccaccatgattttgaggcctccccagtcctgtggaactgtaagttcaaaaaccccgagcggccggggttgncgcctncccttccttacggacggc

SEQ ID NO: 6976 - DNA, 1481 bp, Homo sapiens
  misc_feature (1)...(1481): n = A,T,C or G
gtgtagatatacagaaatggagatattgccgaaagccgcagccgaatcatgatacccgctaattatattaaaatcgcgcgtcccccggatcgtgtctattcgggttcgggatatctgaatagtgaggtataataatcatagcacctcgcgtggaacgttagaagtgaagaatacaaaatatcaacgaaatctccgaaagacgcgtataggacagactacagatgaaataaattacttgccgtgagctatacgtgcagagcgtggagcagatacgccaagatatagtcagtgagcagtatcataaaatgcgcgagccgagaagatgtggtcgtgtgtggtcgtggagagactaaccacagaactaattatgaaatatctgtcttctttatttattatattagtgcagcatagagagaatgagttatcgatacgtaagtgttgaataaccacgcgcgagaggcatcgcgtttacgatatttaacgactccacgcccgcgatcgacgaatctgttgaaagatgtagacaccatgatatggagggngcgcntaggcgtgatatctctcgcatgatagactgaggacccggctattgtattaggcgagaagtcacggcgtgctcggagacggatagagacgatcgatgagatatatatacgagtatttacgccggcgcactgactcggaccggtactttagacgtggcttatacccgccaacgcccgcgtatatgcntccgataatatattgtactgcccgccgctatgttgcgcgcggatgatatggagcgctaagcggcgtcgcactatacaatgaagagattgtaaataagatacgcggcggtattatcgcgagatgtcttacaccgagattataagaccgatacagccgcgcggtatgtagtaagctatattagtaaaaatgtcgttgtcaccgcctgccagttagtataatactgattatatagaatggattcnggcagcnaccacgcagcgcagatacgcacaganagtgtagaagatcataaggagcgtatattcgagagcgatgattgtgccgcgtgtgacctgcgcatgacaatggaatagcatatatacgcagcgcgtgtaagtgagtagtgtgtgtcgtgagcacgctgcagtgtatatcgcagcgatactaattcatcagatatcgangcgtagtaggcggcatgcgtcgcgtggcagcgtcgcgacagagtattccaatatcacgcgcgctagcggcgcgcagtgcgaatattntatatatggtatcatgcagttaacgcgngaagtacagttctcggacgcgcgccatngctcatgtatatgagaatgtagatccgatgccgtctcagtttgtaggacgtagcgngcantatcgccgtaagagcggagntgcatgtatgacatgagacgtctgaggtggacgatcgctgcgancggtatagatagcagtcggacatagtagcgcgcgagnag

SEQ ID NO: 6977 - DNA, 516 bp, Homo sapiens
catttcagatacgggatactcgacctgtataaaatttgtttgaaatgtggaagcgaagcagcagctattattctgaaggtttcacagtaacatacaatgagagacagatacagaggcacccagaaagttccagcttttactctctctctctttcgctccatgtccagctctttctttggaccagtggtcactttgctgaccaatactagcccaaacctaccaccagatgcttgggtgcaaacctacagggctttgtaagacaagccttacatggcaagagcctcccacagtgccctcctcaagctcctccttcataatctcacttcagtggctggatatatttgacttctcagatttccccaacagctccaacttatctacccattgtcattgatttggacgatctggttagtggactcctctgatcctccaattccccattccagatactcacctcacttagtcccctcaaaactgtaacaatctaatttctacaataaattccgaatgcgcccg

SEQ ID NO: 6978 - DNA, 1059 bp, Homo sapiens
  misc_feature (1)...(1059): n = A,T,C or G
ctcatctaccctgtcnactagtcagtgagcgtagcatgcgtgatcgcaggacatatggtcgtgcactatgtgacatgcgtctcgtncgctgacatatcgatgtcgaatagtgagtcagtcataatgntgtngacgtcatgtacgcttacgacactatctccgcacgtctcgtcgagngtctattcgacagtgtagtcngnttgaatatgataacatatagcgactcactatgtgcgtgatgtcgtcgacgatagtgactctacananacaactagtgcgtaggatgcatggcaggttgactgcgtcgtggcgtctcacctcatagagcgtagtgcggagatctgatctataatccgcagcgcgcagcgctaggtcgacgcgccaactatatgggtccgcgcgatgcgacngacggacgatatataagatnatntcnacacgcgatcgtcggcacggtctacacacgcagctactctcgcggcgtgactggtcgcgcntgctaccgacttgcatctcatgacgcgaacacatggtattgagactatcatagctgactacttaacagcacacgatatgatatgacaagacacttaatgatatctgactcggtccgctgtgcctgtcctcatatggcacgaccgagncaatgagacgatctttgcgagaggactgttagtgtgcgcgcgtgcgacatcggcgatacacgttgcgggcatcgtatgttacatgcaatanagaggtattatgctaggcgcaaacgagtgcagtgatgcgctcttacatcttgtctgtcacttatactaatgctcactcgtggccacacgcatattacacaatcatagacgcacgagtactagcgccgcgatctgttctcttacgtcgtaatactcacgaagtaattgagtgacgagtattgtttctgtattctttttgctgttgtggtgcggaccgcgacgaggcagtgactcacattatgagagccatgagcgtcgtgcgccagcatccacactggcgagtgcgagaatgcgngagccggcaggtcctcttgccgacgctgca

SEQ ID NO: 6979 - DNA, 606 bp, Homo sapiens
  misc_feature (1)...(606): n = A,T,C or G
cctgacctcaatctgccctggcctcccaaaagtgntgggataccaggcatgagacattgcacccagcctacactggcaaacttctaagcacaactccacattctttgatttttagatttccttttaaaaccaataaacacacaatcccaaatggcagactttaggggtgtcctcttctctcccatagtcctaccctcagacttcataagagaaatctttcttttattcgtatttcaactctcagcctggaacaaagctatgacaaaaacaaaaacgtattctgaaagcatccattataaggtttataaaagtaaaatttcaacaaaactcaaatattcactgtaatgtttcacactagatccaccgccccatgttatcaaggcctcaatatcctctgattacataaaagcagaatgacttcacaactcatctcagttcaacaactaatatgtatgtattagtgaaagattttcccccgggtctcctcctttatgaacaaaactttccctttaagcatgatctatccatcgaagtattctagctttagcaattttcatgaggcctgtgtaaaattgtgctatatatgaataaaaggagatcggccag

SEQ ID NO: 6980 - DNA, 259 bp, Homo sapiens
caacccgcaccacgcatacgctataaaacctgtaaaaccgcccgcgccccaacagctctactatcgtgtcttaccattttcaacccctcccaccaggagagatcccacgcccttccccagtcgacacgaaaaaaccgacaaacacgcccggcgatttcttttacgatggccgctcgcgccctctccccccccaaacacaaaaccgggggggatgtataggaattcgccccacacccccaatcacaggttaccaccccgt

SEQ ID NO: 6981 - DNA, 834 bp, Homo sapiens
ctcgagcgagcttcccttagcttgaaaaatggaaagttatagtttgagagttgacgtggccaattatcggggcaaatgtttttataaatccagggaaagttcatcatcctcagggtggggtggtcccaatcccttttttaggaaaaaatttttcccttgactatggttttattctcttaacctgtaagtccccggggccctaatattttgcatgtcttctctatccacccctttaaaggttgctgtcaaaaaaattcgccccagggatctagcgatctcaattctgggtatatatcaaagggcatgaaatcactaagttgaagacatatctctgcttccatatttattgcagcattatttacaatagccaagttatatgatcaacttaagtgtcaactaatgggtgaatggataaagaaaatgtggtatgtctacacaacacaataatattcagccttcaaaatgaagggaattctgtcatttgggtcaacatggataagccaggagaaaattactctaagtgaaacaaaccagtcacagaaagacaaatactgtatgacctcacttatatgtataaaatttttaaaaagcccactcacagaagaagagtagaatgatggttagcagaggctggggggagggaaaatgagggaatgatggctaaaaagtacaaagttgcagttagacatatggaataaataagtatttaaggtgctggatatggtacttgattcagtctttgcacactatacatatatctctctatataataacatcactttgtaccccataaatatgtacaattacaatttgtcaataaaacgagatcggcca

SEQ ID NO: 6982 - DNA, 806 bp, Homo sapiens
aggcatgacacgatgagccccaatgttttccggccattgaaaaacaaggggtaacccgtatttttgccataggcccatccgttaattgttacccagtagtggttttacccacagttggacttagctcagtcctctttaataacccccgtcaagatcgtccttcatcggcccagagtcaagcaagtgccctggcctgtatcagcataaacgtaatttatccccttatttttaagcaagatggatagaagtggaggtcataatactcagtgaaataatgcagaagaagaaagtcaaatcccgtaagttctcacttataagtgagagcaaaataatttgcacacatgtacatacaaagtggaataatacacattggagactttaaaagccgggaaggtgtgggggaagtgagagctgaaaaattacctattgagtacaagttttctattcaggtgatgagtacactaaaagcccaaactttaccacaacacaatatgtaggaatgtagtaaatctgcatttgtaccccctaaatatattttttaaaaattaaaaaggagaaataacagccagactgatcaatgaatacatttgaatctaaaacaaaatagtctaaaaattctggaatataattatttctaaccaaaaatttgatatccagccaaactctcaatcaagcattaaactaaatatgaagatttttagatttgaatggtctcaaaatgttcactttccctgttccaacatgttatgcaaaataattgataagaaagataaatatatagtaccaaataaagagggatcggccag

SEQ ID NO: 6983 - DNA, 622 bp, Homo sapiens
  misc_feature (1)...(622): n = A,T,C or G
acttcttaagagaagcctgcttgttcctcagtgaaatggtgactattctggtgctgcatttggcttaagcagcagaaggtccagagagctgtataatttatagtaagggcatggattgtatatgttactcctttgaagtaatgacaaaggtgataaaaagtgactatcttgtacagcgcagtgtaacctacagatacgaactgtgttcaaggttctggaggcctggaagctgggctgaaatgagatgaatctgctcctgctgtgtggctgcctggcttccaccaagttcctgattctttagccaagtaagaggatgcagtaagagatgggaagggcagggatggtggctcacctgtctaagtgtggtctcttcctgccatcataaatgttgtagctaccaaaagtgaatcaggaatagaaaacctgaatacaatacaatgctcattaaagaaattgaatctgtaatgaaagatctcccctcaaaaaaggccccaggcccagaaggtttttcagatgagttttatcacccactcactatattatatacaagctgtttgaaagacctaggaccaacagggaaaagctatcctactcatttaataaatgctagatgcnggccaaa

SEQ ID NO: 6984 - DNA, 852 bp, Homo sapiens
aaccccccggttcttacgccgccccccaaagccgagcaagtgctccacccctctttcgttctcccccccaccccttccttaaacccggctgccccaaacccccatttcccgccccctttcctccctccacaaaaaaccacccccggttgtcacctagaaaagaacttccccctcaatagtcaccccccgtgcccccaggggccatccaatagtgttccagtcccttataagtagtggccagccccttagagttagccctcaagatggggaccgcggtgtacccctttttgtgcagggtcccgcatggcagtcttaagtcttgcccatggttttcgcatgtatggttcccccaggttgatatttttgctgagattagacccccccgtcttaagtatgatggagttcgtctggaatcaaatgctttagtgatggtatgtactagtattagaagtcagttatcaccatagtgtatttggatagaccagtgttcttccggttttgcgggaacattgaacaggtacatggtaaagcataaattgcacttgagattttgaattatttggctcttccatttgtggactttgaggtctaagccttatgaattgaccccccccttagtaatcaagtaggtcacagattgattttttatgatactttactttatgctatgtgtttcgagtgagatgatacctgtcatccatatacgcaaactttgtggcttagggctattttttaatagtagcattcttagtctgtactggcacccgtacccttgagagaagttttttgtccattggttcaataagcaatacataaaattagttctttagaaaataaatgcggatcggccag

SEQ ID NO: 6985 - DNA, 1074 bp, Homo sapiens
  misc_feature (1)...(1074): n = A,T,C or G
aacggacggttgcatgagaatcgggagagactatcggtttaaatggttgttcttcgtgtcggggtggctagtgtggtctgcggtagtggtggttgatggtgatggcgcggacagcgggcgttggtggggtatgagtggttatgcgtgaggatagatctaattagtgtggggaggttgctatgggaggtcgggtggagcgttgcagatgataggagatgtggaggagtgcgtggatggcgctcgggagatgtaccaggcggtacgagtgtgtgtacgagactcgacgtggaggtgatccagcggcatatatattgtgtagtgacttgatggttgatgggtgagagaagtaagaggatagatagatagggatagtgcagagtgtaaggagatgatgcgataagagatgtgggcggacggtgtgggatgatgggggtatagggctggttgcgtggtgtgatgttggttctatgagtttctaaactagtgaagatgatgaggggagagagaaagtacaatgcaattctggagtgataacatgatgtgaggtcatgcatgcgagagcgtggtctctagctgcctctcgtgcgcnctgcgataccttgtatctgttgtttgctttcataatgagtgtaatttgtttgttgtgtattgtgtttggtagtggtgttagcgatgtggtgcgcgttggcgaggaattagatgtttagtgttgtgggtggtgtgtgtatcgaaggagagtagagagaaggtaagagaggtgctcaggatggttcgttttatatgagcggttaggttggagagcgattgtgtctctcgagagtgagactgatgcgcctggtcaagtccgatagtaacgcgaaatctttattggcttatcagactattttgttaagtattaggccttctcagtcatgtaactggaaagttgtatattttgatacaagttttttctccattggttcaattagcattacttaggatttgtttcttaaaaaaataaatacagatgcggccacntttttattttttttcacatttttctccttcgttcttcttttttctgtttctcctcct

SEQ ID NO: 6986 - DNA, 836 bp, Homo sapiens
cttttgtaacactacatccacccccaaaaaattaactgtccccggtaacttttttctctctcaaaaagcccaagcgttttttccattgtacccaggtttaccatttaagcctttgaaccttgtgccagattcatttaaacccatatttgagggctttccataaaatagaaagtgtgttctccccgcgagctccaaaagaatttacaagagaaaatctgctaagtgtccccctcagaatgagtgtacagtaacatgtccacaagatccagtgtcctagagaaagtcattctcaaaggtcctgactctttgggcttaatgggttgaactctgaatttctttgctttctcctagtcgatgctgtgtgtcttattttaatacacaatttagcaaaaagttttcatgaagtaaaggactttctcaataaattacaaaataattataaaatacgaatatgtaggaatgacgacatttttacatcagagaaattgagttatacgagcatatttctttttgatgctattcattcaaagacaatatattaagtttttaaaatgatgtcagaagtttagagggcatgcatacatcttcacactctatgacaacaactgtggttttgtcactggtactattttgtgttcaggttactgtatctgaattaattttcgatccaaaacaagttatcgtgtgtgcgtgtgtgtgtgtgtgtgtgtgtgtgtatgaagctgacactaattcagtattgcaaaaacccttttttgctattccatttaagaagagagaagataagatagaaggtcgtctttttttttaagaaataaaaaatggatgccgcccaa

SEQ ID NO: 6987 - DNA, 855 bp, Homo sapiens
aaaccccgatcatgccgcggaccgagtttcaccttcctgtagccaactaccaaacaaacaacccccgttcaaacattgggtgtttctacaacaaaagttcgcccccccccacaattacccgtctattcttccaccaacaaccctctttctccaacaaaaggggatttgcgctttactccacataaatgttgacgcatcttcccttaaataaaaaattcaactttccttttgagaagccggggccctgaacccaggattctctcgggattttcctaaacaattcttccatctcccatacatttcttaattataacaaaagagccatttttggtaatatctctgccccgaaaaatgtaaatcttctcaccccatgttatttaaaagctcttcatctcctgatagaaaataaagataataatccgaaagtttctatattgttaagttaaaaaacagaaatgattctggttaattcccgaatcggtttttattttcccaaaagcatgaaaaaaatgtattgagttaaaccactagctgttttgaaaataatccatttactagaatagctagtcagagttattaactctgttattttcaaataccaatttttcccccccccatcttttaactaatcttggcttttttcttttaaattgtttgaacagcctaagtttcctgcatgtggtgttaagttttatggttatcatggaaaaattattttaatgtagatgtgttcctttgcaaagccaataaaacacctgttttccttataaacataatctacataaaagtgaattttttaaaaaataaatttttgaggtttttgaccattagagttaataaagagcgatcggccag

SEQ ID NO: 6988 - DNA, 1306 bp, Homo sapiens
  misc_feature (1)...(1306): n = A,T,C or G
tcgttgtattactattatatataatccgcttgcgcccgagttagaataaccttattttattaaagtcgcgcatccccggtcatgtattcgacatcagagttcattttactgcgagaatactatttcccgccgttttggttattattattctatgatatatatacgtcctaacgcagtaaatcacacgtatgatcgacactcgactgattacgtaaaggtgacatatcatcccggttaagtttctggttaagatattgcacgaggaatttattatcgagagtagaggcgagccgatgaacaataacgctttctatattttattatactaccatagagatgtaagcatctcgcgatttacgtataatcccgcatactcctgtttattatttttagctgcgcgctccgatagcgcgctgtttctgctgagatagacgcgtatgcgactagccacgctttataaattccaacagtgttgtttgtcgcggaggtattacatttgcggtttttggcgcgtgttgcacagattcacctgtgatggtatattgattatattatatttatacctcgactatatagaagcgtccataattacgcatatcgttaaacccgatcgctagacacgtacttgtatacgtattgttattatttaacccctcttcgaatagcgcaacacatatatttcgcggctatatacgatctctgttattcaagagccgaggttcataagccctcaccgccggttacatccgcagttataataacgttatgtataacgagtaatcggcggctccgatttatctctgattattgtttanattagcatagcccgcggcccgtctgtatcgcatagttgtagttccctagccgcgcccgtctcccgctttcgtagttagtgtacgattaggatcgatattgtgcgtgcgcaaaattatatcagacgaattgtgccacgatatgtgattgtattagtgtaccttcgcgttatgatcccagagtattcatagtggtggatgcgagttacgcatgcgatgacgcgcgctcgcggttggtattatagtgtgacgagtggaacagcgagcagacggatgtatgtgtnatttgtatattgntaatcacgnattgggatcatagtgttccgtcgaattgtcacatatatctgtattatatcgatatcgctctctgtagagtgacgcagcggccactgtcgcgacatgtggtgatgctttagtttattatgtgtcgcatatggtagcgatcgtcctgtgttantgcagagagtcatgagcgatgatcacggtatcagaat

SEQ ID NO: 6989 - DNA, 586 bp, Homo sapiens
tttttaagctagagaactcactctgtcacccaggctgcagtgcagtggcatgataatggatcactgaagcttcaatttcccaggctcaagcaatcttccctcctcagcctcacaagcagctgggactagagctggtgcgcgatcaccaatctcaactttcaaaaaaatttgagcattactttgcaagcacaaaagaccccagaatgggaaggaatggatccatgacccagttgtgaataagccaggtgaatcaacttttgactctgctagaaaaggattaactgccggagatcacaaatgatggtggccctaccaagaagggtaaaacaacttcaaatcgctatactctctggatgaaaggaagggggaaatttcctggattggcccaaaaccactgaagggcctggttttcatttccaccatcctaatctttgtggagaaggggttccagccgtgccagcttcccaaacgagattcacggaggcactggccttagcaaattgtgggtgaacttatgttcgatctcccgagattgggcctttttagtgtagaaagaagctcaaggctccatttgtttttatacaga

SEQ ID NO: 6990 - DNA, 885 bp, Homo sapiens
  misc_feature (1)...(885): n = A,T,C or G
agtatcgtgttcagttgttctcaaatgatttctacttcaagataacgatgtgattataaactagttgatgatactataggaatacttacccatcaccatgggcttgttcgattttacctatagtggacaaggtcgaaaaaagtgaaggccttcagtggaataatatatttttctcgccaacacaacaggtaattggttccaagatagaggaaatttgcttgtaactgctaaatagtaagcttgtggcgttttcaaaaacgtggacaggccattggcaaaccaggggtggacatgcatccaaggctctgtcgacaagcaagataaacaggtaacacaatagaagttcagcctccatagtatgtttgcctgagaagttctaagcagaggcacattacatgaagaaccaaggatgagagggtgttttgtaaaaacaaactaacaaacaatcaaaaaacctctaaaatgcacattanaagagagctgtaagatttcaatggaggttgaatgtcaagccacagtattgaatactttaaaaattctcatttcttgtaccattcaaaatcctcttctgagccccctgaaatcatcaccattacatttcaaatgctgtttcagactatggagtctaagccatctgttactgctgtttttttctaatacattttttaaattttaggcaccgtataaggtatgacattgagtaaacattcattgaatactatctgagtgccaagaaacatgctagacacagaaaaaaacaaaagtaatcatttattttcccggctcctatggtgttatgtcaattgttacaaggtaagtacgaatttaaaagaaagatagatgttcacaaaggaaaccaaatagatttaacaacgatgcgggccg

SEQ ID NO: 6991 - DNA, 1635 bp, Homo sapiens
  misc_feature (1)...(1635): n = A,T,C or G
atagtatgtacacttgtcggngtacgattganctattctattatttagcgcgctcgtgtatgagnnnaatagataagcgagggcagcatagagcgtgtatggacctatgacacactcactccgtcngngaatctttctatgctttcgttgngtagttctcttatctagcgtggcgcgagccttgtggctgtgttcattgctatctgtctgtgcctctacattnagtggtatatctaagtgtttgtatagtcgtgagtnagtctatggaggtcgtcgagctgttggaggaacgtactgagtganagagattatactggngcagttacgttgaaccttattacagtggggactatcgtccttgggngatctgatattgagagttacatatagtatgagnaccagtaagtgggatcatgagtcgtgtggatgtcgttagatgctacgtggtnnngacgtctcgcggagtaatctacgttgctgtccgtattggtggagtgattggnagtagagttggcgtatcgatcgtgttcagtcctctcgtnnntacagtgactccacactttacacgcgcgtgctgcatgttcgctngtaagtgtggacgagnancacattgtctagagactcgtatatacgtagtgcatgctgcgtcgtggtgcgaatantacatagatcgattnngcgcacggacgtgtgcgtctagcgcgctngngccatnttctatggtcgtagatgtgctnnngncatattgtnagctttcttacgangtgtacttatcttatagatgtatcgtgtngnngtacactcatntnngngcntattacgntggcttcgtacgtgngttgtatgtgatnngagantggatcttacntcatctgacnattatcctantncgatannngacgagtgatacagagaatctacatcatacatacnattatctcgtataatatctcttagcngcgcatgcgtgnggggatcctacacgtattggtagctcttatctaactctcgnnnaactactgctantctcttgnnncaactagttctancngcgtctatctatctactagttcatagtgagcgctggnnnncgatntngacgtgagnaactcgtataatgtgtgtgtatgtatacgcattacgatnagtnacacatatactagcattgtgtgangtgtgtggagcgtcgttgacctatgtatacatatatttactcatgatcatatnanancctctcgagacagtatgagtgaccactgtcactgtcagactatatctatactgacgtgcatgtctatcattcgatgactcgggtatgctgatctgtggngactatacatatctctannccttctcttctnnctntctatctctcatcttttcatctcatctcntcnntctncnccttatctcactcacatcctactnnnnncatatttccntttttnnnnctcacatttatctatntattnctatctcactactctctctnnncncttnnnncccttctcatctcctttccnnnnnnnnncnnncnncccctcttctnnactctnctccttctcnnnnntttnnnnncctacttcnnttnnnncncnctctntnnncccctttnnncactttnnnnccactctc

SEQ ID NO: 6992 - DNA, 377 bp, Homo sapiens
gttggcacccctagcctgagggtacactaggcctctgctcactggaagccacagcctggaacaactcactggccctgtcttcgggaacgagctcatcttgtcccagcaatttcgcctcctgtgaaggctgccaatggtggccaggagactccgctgggattctcctgactgcagggacctcatcaataattgattctgcagaaggcagtggagttcctgaggaggggcccaggtctggaagggaaggttcacagccccagtcactcggaacctgggaccagcagctccacaggggctcgtttctcactggacaaagatggccctcagatctttgctccgcactctggctgggggcaggaataaacagggatcggccg

SEQ ID NO: 6993 - DNA, 892 bp, Homo sapiens
cattattgactttgggatctaattatatgcattactattatcatcgcatgccctacataatagagtaactaggtatcttgacatatttttagatgcatggttagttaatgaagatataataggtcaatgtaataaggacgagagggcgcatcttgttgttagcatatgatgaacttaatatcctggatatagcaagatcaataagaatggtaattttgactaaaaaggagataagttataaaagcaaatacttccctgataaagccttatggataaacgcacagtcctagggaacacgttgataacatcctgtggtagttaatgttgtgtcgacttgatagaatgtggttctcagtggatgggtaaaataacagtccagatgtaaatgtgaagggttttttttttttaaatgtgatacagatttaagtcagtagactgaataattatcaacattcatataagtagactttgagtaaagcagattctacccataatgtgggtgggcttcatgcaatcagttaaaggccttaagagcaaagaaagattgaggttgaccccaaaagaaagagttttccttcaagatagccacataaaatcccagcttgagtttctagcctgttcatctttggtatgtggactaagattgccacatcaacccctgccagaactccagactgtgagcctgccctacagagttcagatttgccagtccccaaaaatcacatgagaaaatttcttaaaataaatttatctctttttctctttaaatataaaagaacttaaagcagaagatctcactaagttatgcctgtatttctgatccacgaaaatataaaacaagatgcgacatgctctctatattacaatataaaactgaaaaaaataatagaga

SEQ ID NO: 6994 - DNA, 899 bp, Homo sapiens
cggaatttcctatctcagtaaaacaatccaagcacatgcggcaggtacatagaggataacaatgtggacgtatgcgcaaacgagccggaaattcttccggagattacgatatataaggtatgtacctgagattgaaattaacggactaaataataagtggcctctgggcgttcgatggtacgtaaaagatataagatattgtagtagaacatatgaatagagcttcgaatacatcactagagaaaagggggcgacaaaataggagcacatggttaaataatcgtcgggtattaggacaaaaactatttaaagtacattatggtggaggagatcaaataaatcagtcacgtgcaaatggaagatggagttaatcagtagtgataatcagaggggacgcatatctagtctccaatgagatagcatgtcttatagtttaaaataagcttttatccaaacgcgagattatacctaaggctcttgtgaatgtaagaaaaagggtgggaatgtaaattagttcagtcattgtggagcccagtttggaggttcctcataaatctaaaaatagaatggtgagatgatccagcaatcccactgctgggtgtattcccaaaagaaagaaaatcagtgtatcaaagagataatggcactcctatgtttgttacagtactgtttacaatagccaagatttggaagcaacctaagtgtccatcaacagatgaatagataaagaaaatgtggtacataaacataatagagtactattcagccataaaaaagaatgagatcctgtcatttgcaatgacatagatagaactggaggtctttacgttaagtgaaataaggcatgatgcgacacgctattttataaacaataataaatcgtacagatagtctgttgc

SEQ ID NO: 6995 - DNA, 934 bp, Homo sapiens
  misc_feature (1)...(934): n = A,T,C or G
aaaaatacaatagggcatatagacaccatatctcaagactacacgagagactatgatataaaatataaataacaggaactattattggattattgttgaattggattaattttaaactaaatataattatattctaaagcaccatacgtattgtcntattctctattctaaatttnaaacaatacctaggactgagggataataggaaataaagaggaaagtatggaataaatggcttacaatggnaaaaaatgcactactaatggcataactggaacattcctgacacgaaacatgaagaatataaaagtaaatcaataaatgagagatagggatttataacagaacacatcatgaaataatataaagaacacactaaaatacaaaacaggaccacagataacaatccgaactaaaaagagttggtcttctaggcacagcatcgcgactgngataacgacactatggctacatatatacnccactacatcataggnatctattaatttactatatacacatacactctattaacacaacacaaancacctattactcttcataaacgactatacagaaaaatgagnggataattaactaggtcaacggaaattaaattgacctcattaccttatcacaaacgcagtgcaaaagggaaccaaagacacaaaacatcggacatgtgtactgggagtgcactgggaagaaaacacaacaaattcagttgatattggtgtgtggagggacaaggaggcattcagaaccatgtaactctgtgttaagctaatcttcactctctcatttctaagcagtgcattactgttataataaatgtcttttcttgttctcagaatattcatgttcctnaccaataactcttnncttatctctatctcaatttctcncctacttcccccctnctatcacctcaccc

SEQ ID NO: 6996 - DNA, 1488 bp, Homo sapiens
  misc_feature (1)...(1488): n = A,T,C or G
aactgtcacatctacggncaacatcgnggccatccatcacgaagacactacacagggngcgtgtcgtaggcgacggcccgcatccactanccgcacgcctatctcacacggncacctcaccgataccaggggccgatgacatctactctcgaggcggttcggagtctgcgtcatgggtctacagtacttacgagnngcgtgacactctctactgatatctgtgggnagtacggggctcggggaccgcacggcggacgtaatantgatactcgcagagggcgacggtaggaaagcgtgacatgagacacgctatcttgntcacatagatgcgtaccatacttgactgaatctgtctactgnnncaactcactcagtatctagagacatcatgtgtgnnnncacacgtgtgtgtacttacggatccatgcttgntgtgcgtgaggngngacgctggncattcgtagcgcaactagtcacatgngagcatatgatacaacactcatgccagtcactcctagggacggcngacagagncaatggagantgatgatgatgcacggactcacagacacgcagcantggcgtcgatgtgngctctgctgtgcgctctctcacggncatacacgcgcgccactgtggcnactactgctcgtagtatcntgactcttactacatgacnatgtgngcgtgcggcgntgctcacggacgctcatgtcgcgatagcgataactgcggcggtatagctctgtacaanataacgtatnacagtctccggggccacacatatctacaaatctctagtgacaacactagacttgcacatgnnngnccactaccacgatacgcnatcncttctcatgctanncntcggcgcacatcacaggnngacaggctggggncgctcatacgtggacgacacgacacagtgtggaacgangnncagtacgagcgatgatacgacagtacgcagtanagagagancgtatgcagatngttgangcgacatctgcatgtgtgtggccactcgnggnncgtctgtggcantcgtcgcagcatacgctctgttcaaacgattgtgncgctgttgtggcagtatgcnggtgctagntgattatnggtatgtgccatcgtgtgtntggtgcgtcgntgttgtacgtatnactacactgcatgagtgagcgagtacatactcttcgctgcggcaccatttcntgctctcacttncccctcttctcatcaccctctacacnntcacgctatcgtgtgtcatctactgctccgnnncacacatcatatactttnnnacactgcttgcatatcactacacatatctntcgctaatcttnnnncctnnnnnctcttnncccaaaatnnncntcnnnnnnnnnnnnnnnatctttcccncacttacttcctcatnnnnnnntnnnnncaccacncacttnnncnnnnccncnnnnnacnttnnnnnccnctttnccacctatc

SEQ ID NO: 6997 - DNA, 833 bp, Homo sapiens
gcatagctgcagacgagctctcttaattatctcatccgctgcaggtcgtatgggattatgaggatgctgccctataaatatgagttcgggaggaggccactctgcttctattgagtgcatataggttcagaagaaatggtaccaacttatctttggccctctggaacaatcacggctcgagaatccatttcggacctggacttttttgatatctgctacgcctctgaggagcatcatcagcattcctggaaactcagcagattgcccctggcctctggttctatcagcgatagcgatcaccagataactactatgcccattctggctactgaccagcagtgcagatctggcaggggtcgcaatgggtgactgtaagctacagcgtcctctgagccctacgagcattaacgtcttgctgcagttactgatcttttgatgaattcactggccattttctgcttctccagccctaccagtacttctggcaatagattccggactgaggagagaatatagagttggaaactctccttatacccattatgaagaagtcgcttggctccatattctaacccatctacacttcatgtaagcaagttgattgttacttcaaatggggaagaaaagcacaagcccggaaggagaacaaaaggctggcctgccgcccacgctgaatgccctagggccctcacagcttaatgcgaactttacttccgtggttaagagcgtcgcgctagcctaagacttcaaggggagtgagtgaccgtgcccaagcaaagaaagtgaagttttgtctcgcgcgcgtgctcactacattggagaaggacctgtga

SEQ ID NO: 6998 - DNA, 828 bp, Homo sapiens
actctctgcgcgtaaggatgtgtacaaatgtatacaaccccatagaaagcagtttttgtttaaaaaagttcttgctttatcgctaaggcttgggtcaatggcataacactagttcatcaagcctcgacctccaaggtcaaagtgatcctcccactcagccttctcaagaagctgggtccacaggtgcaccctgacatgctgggctaattttttgttttttttgtaccaacagggtttcaccatattgcacaggatggtttcgaacttctgaacccaagcaatccaccctccttggcatcccaaagtgttgggattacagaggtgagccacctcacccagcatgtatactttggataacagttctttaccagatgtgtgttttgcaaatatattctcccagtttgtggcttgtatttttattctattgacattgtctttaacagaacagacatttttaattttaaagaagtccatcttataaattattttcttcatgaattatgccttgatgtagtatccaaaaagtcaccacctacccaagatcaactaggttttctcttatgttaatttctaagagttttatagttttgcattgtacacttaggtctgtgattcatttgtagttaatacttatgaagggcatgagatctgtgtctggatctatctttttgcatgtggatatccagttcttccagcaccatttgttgaaaatactatcttttcttcattatattgcctttactctgttgccaaagatgagttgactatatttatgtgggtctgtttggggctctttattttgttttgattggtctacttgtccattct

SEQ ID NO: 6999 - DNA, 716 bp, Homo sapiens
  misc_feature (1)...(716): n = A,T,C or G
ataaaaattattgggcaatgtgaaaatcagtaaaaaatataaaaatacaaataggaagataaataattgaacaataatatattaacagtatgatataccaccaattttatccatccattttaaaaaatatagtatatttgaacntgatttgtacaatatgaaataaaccaaatagtccacagagtgatcagttccaaagcctcctatagagtcagccctcccaatatttatcatatatgtatgtatgtttgcttggatcatgataaggtaccaatttggcatttttggaagccgagcttgaatgtcacataaaacgtctctctgatttggactgggttcacaagctaagtgcctgagaggccaaaagagaaacatagggtgagcagtagagcaagccggaatggtcagcccgtgtcgccagctctaatatcccagtgcaattattttgtggacatccactccttgcctgcacaggagatagggctataagtgtatgttattttttaattacaagggggtagaaaaaataatgatgatgggctggaaggtgccattgcattgttattttttcctctcccttcgtttgctgattatgtgagccgggctcctttgctagccgatgataagcagaatttccatgttctctgcataattaatccatctctgcctctcttcatgccaactcgcccgttatcgccggcacaagccttaaatcc

SEQ ID NO: 7000 - DNA, 964 bp, Homo sapiens
  misc_feature (1)...(964): n = A,T,C or G
ccactaatacaactatcggaatttctcacccaccaacgattatntccaccaccaccancccacgtctcacactcttttcacaccaccccccatattatatattagccggttctatattcagatgaacaccgagcgtacgtgtgatctaacagatgttagttatggattatcttaagtccatgcccaagtccctccgtgttccaacggccacaccatctcttttgcctgtgtgcccacaccacattcccaatatgacactatcaaactctgcctcgcccttcctgcgcgctcccacgctctatctgtgtacagatcccccttatatgtcttactatttcccccccganagtttgtttatttactatacaggtccaaattcctcatatcttgtaattttttacttcaaaaccacactcgttacttatccttcaccgtgcctcctcccgtcacacatttctctcaatttcgtttaaactataaacacacacacggaatcacgcgattagtttttacatttaactatccacaacgtttcccaatcgcatgatgcacgccttctgaccgttatttaccccctaacccaattttttcacagcatttggccgttagaatcaactgtctcccacatccccaagacacacgtttctacaggtcaaaccccagcgcttgttttcctgaacctaaaataaaagttgtaataagccaatccatcatattaataggttcagcaacagtttaaaaacagggagacaaagccaaggtgagcttttattagttttctttctgctcattgtttatgaaaatattgttaagttgttatcagtataaaatcacgtattataagatagtatttgcaagtctcgtgttaacctcaaaccacaaaacttacaataaatacaaaaaaaataaaaagtgatgcgaaagctcttcttttctgctttttcttaccttaacttcgccggga

SEQ ID NO: 7001 - DNA, 340 bp, Homo sapiens
caaaaaattttaaagtcgccatttatctacgacaccaggagccttctatactacacttcagatggggaccatcacgggacattggattgcggatttgatatgtcgtctagtgaattatgtcaactcaacactgcgacattagctataatgccctttagctggctatagaacaccacacagtcgtaataaaaaacatatgaccaccagtggaataaatataggtgtaattaagtaaggataacccgatagcagggcactctggtgcgttaatcttcctcctctctggggagcaattcggatgcatcccaaacccaaactatggtggtcggacacaatgcat

SEQ ID NO: 7002 - DNA, 1162 bp, Homo sapiens
  misc_feature (1)...(1162): n = A,T,C or G
gcctagccttgcaggcgnactcctnacttaatcctactcactcgtcttacagcgttcccgactaagaagagaggagctacgtgtgtccatgtnncttccttctcaacttcagagagactcgacgcagganctctagctaggccgccaggatgaacaagaccttcgcagggagagtaatctccagagtagtgaaaaatagagaagattcagtatttacctatcctcactgcgtatatctatatattaatactatttttttatattatagagagtcgtaggttntattaccagtccgcattatgtttgccacttatacagctttctttatatacctctcctccagcgattacacttcttttgtaaggtgatccgataagtctatccgcgacttatcatgtcctctgttatttatttgcagagtattattnttctgtttgctcaggtatcgtctctgttctctctgctatttattattgtcgttttattttccatccgtcatttgctcacccctgtttatgttttcttttccgcgctcttcctctgattatttttccatttatattttttctgccgactcttatttcccgaagttttcatattcttaatattcctccctacttcttatctgttgtttgtttatgattacgctcgtttatctgcggttattggttcgcctattattctcgcgtgttgcgcgcctcgattttatcgattatattatttttttggatgtgcgcctcgccgctattttccgctgtattatcattactatctcgcgcccgctcctccaatatttttgatgtttatnttaaaactccgttattcagcttgcatatagtatctggatgttgtcactcgtatactgtctgtgttttactatcgctttatatcgcatttgttgttttattatttggagattagcatctgatgacgctgctgcctgctatttttatatttatttagctctccggtgttgtcgtatattgattgattgttttcttattcgcttgtgcgttcctatcgctgcttgtgctcattgtatattttatgttatagccgttgtgcgatctacgcgttatcccatttgccgatatgtatattagtattttatatttatcttagaacatgaactctgtttttgtttcgttgctttgatcgtttg

SEQ ID NO: 7003 - DNA, 907 bp, Homo sapiens
  misc_feature (1)...(907): n = A,T,C or G
cccccccgcccgaggtcctcataagaaagaaaagctgagttcttccccattacagaagttcccacccctgccacgcacagagaataatcttcccgccgcgacccttcggggaaaatatgaagagagttaaccttcccctcgtggaccccccatcacaccccagaaaaggacgcgggacaccccgccccgggtccaaaaaaccctcagttccgccgaggtaacccttgagtgccccggaaatccggagttctccccaacgaagggaatttcttgacccttaggtgtccacgtgaaacacaggtttcccaaagtttcaaaacccattcctcacggtttcacccagaggggtatcaccaaaaagctgaaggaaatgtctccagatggtaataagcctgccaggctttaaccttcccttatcagggaggccaacccagaggccaaggggccaccccctccccatgtccttatggtgaggccctgcccaggattctggggtccagatggaagataagngtcttctcaggtcctccctgtgcagatgtggttaacctcgcacctcccgagcacccgccccaggcctatggcgttcccatagtctttcaggagccgatgtgggccccaacacctgtgatctatgtggaaaatcctcaggtacccggatggcagccctggaacatgaatggtcatgttccatatatgtatcntgctttgcctccggcagccccaggccccctgacacagtgggccctctctactgactgatccaggtcttgaagacatttagaatctggatcctgattcatcagaaagactgaaacacagcacagtctgtgtgtgttagtgaatgactccttcctctcctcacctggtgcaatgagaataaatgtaaataaaaacggatcggccg

SEQ ID NO: 7004 - DNA, 893 bp, Homo sapiens
acctctcccctaacacaaaaagaatgagtgcgcccccatctttatggggacaccaaatcgcggagggggggctttttcttttccccgtttaaacaaaaacagggtcacttctgtgccaaactcccttttttccaaaactcttgcgcaatgtgatttgggaacataggttgttacttttcaccattatgcaacacaggaaaaacccctcggcgagacaaaaataatgttgaaagcaacccctttgttttactcccaaagagggttttttttttttccaaataaccccccacatttttattaaccgaatttttcccgcctgtaaaaacgctggataaatttttcaaaataacagggcaaccccagtcaatgttaaagaataaaaccgggaggcttttctttacatttctgaaattaattcccttttaagaatgtaccttatccccatataaatagacatgtaatattccattccatactgactttctttttcaaagattgtcagggaaaatttttagtttttcatagtatggtttgtaattctctggaagacagaccaattctctccatttatatattgttttaagttcccactgcagctgcagtggctaactgatcatggtagtttcctggtcccagtgacttcctaattgtatcaatcacagtatggcacaggtaagagagattggataagtctaggataatcacaggggagagagaattaaaatactgtggaagagtggcagtgaatttgtcttggataatctgcaaaggagaaagaatcgagtgtaaaaaaatgttattagtccaatcatgttgtacaccttaatatacactgtttttgtcaattatacctcaataaagctggaaaataaaaaataaaacaggatcggccg

SEQ ID NO: 7005 - DNA, 737 bp, Homo sapiens
  misc_feature (1)...(737): n = A,T,C or G
acagttagtcaggatcatgaataaaccctcattaaagggaaagcggccacaaaagctccacaatttaggncaaaaagaacaatttttttttatgcttatcaagaacatctattaagaagtaaaaattttagccacatcaaacataatgcaaataattattcccagatttcaaccaatttgttaaatggcacactggcaggaattaaggaattcatcctgattcttctgttggttcttttcactttaggggtttcctttctggaataagagtacaatcttttttttttcctgccttgaggaactttagcagatttcagaagataaatgctctttaaattcaacgtggcacaaaaggttactgggaagaaaaaacacgtttgccaatttggacttccaccaaatgttataattggtatcagaagatgtgcaagaatggactcattttgtagtagaatttagatgtgactcattttagtcatggaaccaattttatagtgtataagctagatataggtaaaaataaaagagcaaaaggaaatattcttctgtagcattgcagaacccatacatggacattcccttgactcttttcctgtggttacagcagacatctttgccatgcagatagagttgtttccttttgcagacaaatgggtttcctgatatcactttgccaggaagtcaattttcctcaccagccataggttttgtttcaatttttgttcttgtttactagc

SEQ ID NO: 7006 - DNA, 1814 bp, Homo sapiens
  misc_feature (1)...(1814): n = A,T,C or G
cgcggtgtgcgaccacagagttatctctccacgccagatannatnnntcttatattgnangcgcgccacagtcgcgcatgagagctagttatgcgngngcacgaccacacccgcgccgagtaaaacattgttccccgctgtggtgncgacgaacacnacaccagagatagattgtctttaatgacgagttatccatacaacgcgaacgacgccgcacggtatatatcaactgccaacggtgtcgcggagttcgggancacacagtacacgatcctaagatcgcgcttatctgtttatatacacccacgccgatgctntatgtccgccaactctgatctagcgacatagaccgacgatcaagtttatatacgcctccgcgcccgtgataattccgcacatatataatgtgactatccgctcaagtatgatctcgcgtcggcgncacataagattcatcagagcagaacataacgatgaggtgaagttagagttcancgcagtgcgcagagatcgttgcgcaggtgtacgcagctacacagacatacgccgggcgaggtgcgtgcgcgagtgcagtatcctgcacccatagtgtgacgcagcgagnacngatgcanaangcagcgcgtcagcagatgtaanctacancgangagcngctcacncgcgaaactacatgcaccacaancgacgtgancgtgagtacnacgtacagttgctgaggctgcangtgatcacagcaatctaaatcantgtagngagntagtgcacanacgacaacngncacatatangagagaaagagtcactagatagatnattgcatacactcncaactgcacagacatcgatangatgcgcgacacggcacacgagagagtaaatgttaggnatantnattcgtacacgancacgcatgtgaccgnacgacactgtaagtgtntaaaatcgcancgtgaacanacagatgtatantngtaccgtagtagcagtatatgtagatgtgacagagcgcacgcacgacaacgcactgagtngtgtcgagaancacattctcntatagtggcgcgcgtgcgtgagcntccgtcacactgagaccncncgtagcctaccgcgctataccagcagatatataatagaaatacgctatactaatctacgtaagaaggcggagtgagccgtccacgagatacactacgtataacgcacgcgggttgtggcactgcgatagacgatcgttatacgtngnctgtgtntgaccacacacttaatcgatcaagtcgancntcacgcacatacangtagttatggtgntatcagacagcatcgcgagaatatcacgagcacgatncgaaacnanagangtatcagaagacgaatgcaggggtacacgcaangtgtgangatacgacgtagtgagaacaantgataacttgcactgagantagtgttctacagagactganatatacacacaaacgaatgtatcagcacatcgatccacatcgagatacgtagtactatgtacgcacgacggaggtcggacatgcataactacaggtaatcgatgtaagcgcacgactgagctanaagatactatggtcggnccgagcactactcacacaacacaatantgcacgagcgaccacacattatcgcatatatgttagcaactcatgcgcaaagcaccacacacactatataccgatgttgttgaccttcgnacccactactccatgcacttgtgtcaccgatgcagatagtttgtatcgcctacactaatgtatccatcgcatgttgtgtcacaccgcacacatcg

SEQ ID NO: 7007 - DNA, 1300 bp, Homo sapiens
  misc_feature (1)...(1300): n = A,T,C or G
gcgcggtgctgatgcggcgtatagccagtgagaagggagaggttctcttttgttgccgcagcaggcccatttcagcaagaaccaaccgagcgcagtgcgcgggcttagtgacacgaacaggagtatattcttatcgcggcgggtgagatctacttaatcattcacaccggatacagaggcagaccgggagttaacatgcaccagacacatttaacatttatagtcaccagaccagggcatgtgccccctcacatggtgggactaggtagtgcgcgcgacggaggcggcgtgcaagaagaagatctatgagcaaagagatgcgaacgacagtgagcttggtagcgggttactagcgtgcttggaacaaggtcttacgccttgaagatggaggtacagggatcgtgagtgatcgcgcgtatagagataggagaagacggggaggaagcccgggcagagcgggagcgtaggttgacggggagggtaacgagacgtgaagaggccgcttgatgaacaggtcggccatgattcgcggactagcgggtgtggggaggagagctcgagcgtagcgtggagactcngcacagaagataatgagcncgagtaatgtcgctcgcgaggagacaggcagcagctgtgtaggcaggagccggaactatggtgagcgaatcaggataagagacaggccgatagaagggcgacncgncgtgtaatctgaggtataccatagatacgtacatgggagagggatgtatgatagcgggtcgaaagacactaacggcgcagtgcgaggatgagagagcgtccgcagcgggtagcnacggcgcagtgagcggcgcaggtgtgatggngngatgtcggccgagcgcgggtcgcagagggagcanggtgtacatacaggcgccgtctcgtctcacatcagcgatgatatcataacaccgccgactcgcgcaggagggcggcaggcagtcgccgcatagcgataagtagagtgagaaggcgcgagagtaagctgcgtagctcgagactctgtggcagtgccaggagactaggncagcgacgcgtcgccgacgncgaatcgccggcgctagaacatgatgtatcggcgtgcgagcaggtgcagactgcgacgggactgacacgcgcgcaagcanagtaatacggagtgttggctgagagctgtgtgtggacagacagagagtggaggtaaatggnagtggagatgggagtcggcgacganggtagagcggtgaatggagtgaggatgcgaacggagagagtcggacgtcacggcagagtgcgt

SEQ ID NO: 7008 - DNA, 1885 bp, Homo sapiens
  misc_feature (1)...(1885): n = A,T,C or G
tagtcttctattnatagtatgtcgtgtcaggagngtaatgngtagangagcgcacgcgcagcgcgcaganatctgtactactgagacgatactatcagcngagtacgcattcagagcncgtagcgacngagtacagtngcanctntactgcgatnntgagactnctgtatgtcgncgnatcgtcacagtcatatacaatntcgttagtagtcgactgtngtaattctgtatgcgtcatgctgcagcagcgatgcgcaagccnagcgcgtacntntcgaatgagtgatngctgggncntcacagtattcgcgagncgctgccgcatcaacacgagtatgttcncatatgacttcagtgtgcgcagtcgtgnatgtacacgtagtactatgtctggtcataatgttacgcgccnctcgatgtgcggtgtgcggcgactnatatacttgtaggtnaggatatgtgtcatgcagcatctaatatgtaagcatcagcaagttcgctgcagttgcatccatgcgtatgcntancgagacgtcatatcagacgagagagcgtgcggcgcaatgactagagacactgcagatagnatagcggtaaatagtattagcgtctcgcatcgatcgtgcgagagagatcgatagagtggtgagtagagaggcatgtatgtctgagcagcgagacgatagcngattnantactcgcgacantncgagcgncagcgcgagtgtgagtaggcgcgagncatgagtcacgcgtgcgagcgagagagtacgngcgtatgagcaagacgttangaaangagcaggatgctatagactgacgtcagtgcgcatatcgcgtgnacgnatgacagcacgcgacagtatcaggtatagtatgtctgacatttatattatatctgaatncgacggaccgagacggagactgtgagtggtagtagcgtgtccgcgcgcgacagcgacatgtaaggtctctgactagagcggcgagtatgcgcgcgcgcagccgtatgcntgtgtgttcacgagcgtagantgaccgagcgctgcagagatactatatgaatcgctgtacatcatcaacacgtcgtatcatcggtgagtaatatagtcagcgacgtgcgtncgagtcgatgagatgctgagtcgtccagngagctgcgagcaagcgcgagcggaagatataaagtgtcacagtaatgagacgtgtactataatatcacgcagtatatctatanacgagcagaggatgcgacgacgtagcagcgcgcacgaatgtcaatctagcgcgatcgtgtcagcgtatgtntatataagagagtatgcgcgcccatatctagcgcatantgcagntatagtatagtatagcacangacgtgtatataccgcgacgacgtaatatatcatacgagtgagacatatctactgcgcgacgcagatacagacctctcgcagtcatgagtgtatcgcgagtacgcgcgatgtgcgtagagcgaggtaagcncggagagtntagcatataatcacgacgctagtgtntagcgcgtgtgcntgtgtgtatgcatcgcgctatctcacgtacgcncgacagacgataatgagctgtgctctactcacgcgcanacgagtngcgcgtgtgactgtatcgcatntgttatacgctccaatactacgcgtaagcgctcgccagctagttcgaagtagtagtcgacgagagagngtncggagagtgatgaagctagcgtgcgactcgcactgatntcaancagaatatcgtcgatatgtcggagccgtggcgcaatacatacgacagagtctggcgcgagtcgtctagcagttagcggtattgcgagagtagtggcgacgtgtagagaggagatacgcgg

SEQ ID NO: 7009 - DNA, 1440 bp, Homo sapiens
  misc_feature (1)...(1440): n = A,T,C or G
gggttgtggacgtaatngtgtgnnntcaacaaccaccgccaccacacaagggtgcataggagaagacacaaccgctngagagaattatcccggtgtgtatagttgtgtgtgcaacaatcggaggcaactctatccacggcgtgcttacattctattgagatcccgcctgtgtatctctcatacacataagtgcacccnacacacgagcacacgtgtcctatatatcacgagaggnagtatagntgaaanacgattatctgcgcgctgtatattatgtctcccgctgatgattcatatgctcacgcgacgcaacgcncatatntatacataagtataagtccatnactctggacgtatctctgcgcgtctcanacttttttaaccacagattattgcgcgtctatangaagccanacctatcattatggagagagatacaacccaaccaccgtgtttgtttgttctnaggaggtcgttgtcaggcgaacactcacgcacacggatgccacctctatcttcagagtactaccccgccgctacgtccgcttatatatcaaccgcagagttatcctcctcccgattgactatcaaaaacaccatcgaatttgatagagtgtgcttcgctatttattctcaagatgatatctcgagcgcaactacacttaataatattgcgcccacttctctcggcgcgcgcctgtcatattatctaaagcataatccagcaataagccacattataaaatcaggtactcaattcatcgctcgctgtgttantctcctccaggcagttacccctctcctacctctcctaaccgtagagtgtaataatctgtactacttcctcctcatatcctataacgccgcgtcgtcggtgtagttcacgattctattcccgactttgcagncgcgagtcgatcgggtgcttcatgcacattatgtcatccatcgaagacaattctcgtttttctcagctgtatagttccacacactaatcgcacacgtgtaacacaatcctctcgactctaaaccttcntacgtacgttcgtgtattggtcgtctgacaattngcatataactcacagggagtgtatctcgaacgaagcgactacgcgcacacccacacagtaccgttacctgtgtccattatgtgttctgtccgcgtacttcgagtattatactattattatcttaatttcttanatatattgcatacatgaatgatctcntatatatatatgttcatcttctntgaatagtgatgtcaatgnctcnctcgtcgtgctatccntgcgtaactgactaatcacataatcttntatncgcaacanaacactcacaagtatgagatgctatattactanagttccaancagnctgcttactctgtcaatcacacacacatgcaccgatttctccattaactcgtnatatatatcg

SEQ ID NO: 7010 - DNA, 952 bp, Homo sapiens
  misc_feature (1)...(952): n = A,T,C or G
cagctgagcaaattgcaactgatcatgggcttagagcaagaagagactgaggccaaactctgcaagacatataagataccatctgttttatctccaatcaatcctttgccaccttaagctcgttgatattttcatcgcgtgaacttttcatttgggcatcttggtagatattgttcctttgcgcagcaccatgttccatggaaagtcaatagtgtcttctcagtatngcttgctgtgaccttcccataactgggcctttctggtaccattctagcaagtggacatttaaaggctatctttatcgcctgcctccccaaccctagaccctaacaaccacaaatgtgagtcttaagctatcctattcctgcaagacctctttaaggatatggnnactaaccctaagactaatttggaaaaaccgtattattgcacccattctccttcttgtccctgcatgtcccccatatacttgggcgcttccctatcttgtagttcacggtaggattccaccccccctaacctatttcgcgactntgagggtctaacctcccgcccattatcgcaatgcgtcatttcataaagatacacaaatcaccaattgacaaaattgttacaaggccctcctacaactgattataacttttggaacaagccccctgattctctcttttgtttccaattgcttaacatggatgatagcttatatgatccaagatctatttatacttatggctcatcatgcaccttgggcctcgaacagaatttgtgtaaagtgacaactcagaagaatttatattcgcgtatccccacgtataaagtggactacgtctttcgtgtcttatttattcgttacttgcatccaacgatttgccttgcgccgtacgcgtgtaagtgaatagtatgaacaccttagatatgttcatttcatagatttccagattaaccgcgtctt

SEQ ID NO: 7011 - DNA, 771 bp, Homo sapiens
taggttaattgttgtctgtaggtcctccctgtagaccatggagcgacctctcttcttttcttgtcacaccgttcatgttttagatctttgggtagaggttcgcttccattacgtatgagctaggtcttgtatctgctccttgacatgtttctcccagataagtgccatagtcacctattccaggataatgcctcgtattttataactctggacagtctttgtggcattttaaaaaatcagaaatataagccccctattcaaatgtgtgtatctgtgcgtttacttatcacatattaggccaataaatggttatgatagtctctggacatctctcgctcactgtgttctctcacgcgtttgtccatgatagtgtgttttccagctgtactgccagttatttagtgcccatctctccaattatcccaggtaatgagcttggtcagtcatgttattctttcttcatgcattgtacacgtttgtgaaagcagaaatgaacgggagtagcagcgctttctatttgtgcacttgtgctccttataagtatcaccgtattggtggcctgtataattaaattgcaggtatgagtgtttcctccagcttggcagtatatgccatgaggagcaaggcagtagctgctgtagtggccaggcgcctcaggtctcgagcacgtgcgttgctctttcctgtagcctcatcgccctagcgatggctcacgcagtcaattccgtgtcagttgcacaggagagtataaggaccctggcgggattccct

SEQ ID NO: 7012 - DNA, 866 bp, Homo sapiens
tcttaacacaaaaatttttttcacaccacgagcctatactcccaccagagaaccggaaattctatttttacccccccagcctaacaatcttttaggaaagaggaattgcgtttttctcccccccccactcaggccccctcaaccccataaacttttgtttctgccccacacccccccgaacggccccacttgggacaaagaaaatttggttttcgctcccccctcccccaaagagctccattttgaaaaaaaagaaatttggttttttgttaccaacgtggcccccttttaccaccccaacggggaggcaggggggcggcctcatacatgataagtgggggaagagttaaggcttttccccggggaaaagaacacctgtctccttaagtggcccctttctgccccacacccatggggagtgagaaaatcccctgtaaggggctttggtgcccgtggagggaagaaccagtttctctccctgtttttggctgaagtagcgtggggttgccaaaagtcttctgtttgcggaggctgtacctttggccctttggcaagagagcagtctttggttaggatttccaggttgctggcttctttatctccatttctgggatatatcgcgccaaataaaacaaaatgaaacaaaaaccagggaacacacagtcatatagttcttttaaagcactacatggccaaagtttccagccagtgtgctttcttcttttcgtatttcagagtctccttatgtttattttgtacacaatatcctaggttttactaaatgggaagaataagaagaagtatgtctactatctttctattctaacaatattttgttattatataataaagtccgatgcgggccg

SEQ ID NO: 7013 - DNA, 684 bp, Homo sapiens
  misc_feature (1)...(684): n = A,T,C or G
ttgaggccaacgagaccgatttttttttttgtggtgaatatgggggttttattgagtggtgcaggtggctctcagcaggatggatggggagctggaacggggacggagtggaaggatgatcttcccttggagttcagcagtcccgtggcagaactcctctccaactgtccccagctggactcctctagatattcagatgctccttctctgccatgccgttcttcagttctttggctcttctgctcatctcctcatggacccagggattcggggtttatatgggtacaggatgtggggtgtggcgggccaagatgcaacatttgggcacgaaaacaggaatgcctgttcccatttggggcctcgggtttccaggcttgagggtggggcttttggcaggtaaataaatcaaacaaaataaataactttccagtatttccccgtctcctgttcatatcaggaagattacctgggtctatgagtttgagaccagcttgggcaacatagtgagacctctgtctctacaaaaataaaaatattagctgggagtggtgatgtgtgcctgtagtcccaagtacttaagaggcagaggtgggaggatcacttgagcctgggaggtcgaggctgcaatgaactgtggtcatgccattgcattctacncatgggtgacagagtgggatcctgaac

SEQ ID NO: 7014 - DNA, 799 bp, Homo sapiens
  misc_feature (1)...(799): n = A,T,C or G
aatagttgncatacgcccnnaancctccaagacatcactagaaaatgacagccaaggatgggatcagaataattttgcttggagccaactacataatatgaacaaatgaccaagagaaaagcaaaactattaaatctcagttccaattgcttcatagggaagaatggtgtttgaactttaaaagaatatgatggtgaagaaataagaatgcctgaagatctataaagagcccctcgaaaatacggaagcatnnaacggaaacctgtgcctacaacacgnggaaggggngangagaaagctaacttcttttgagtagaaaaacattccaggaatatggaacagtgagtgcagaggccctatggcaggactgcaactgacaatcttgctctgccaccaggctggagtgcagtggcgagatctcggctcactgcaacctctgcctcctgggttcaagcgattcccctgcctcagcctcccaagtagctgggactacaggtgcgcaccaccatacccagtcaattttttatattttaatagagaagatgtttcaccatgttggccaagatagtctcgatctcctgatctcatgatccgctcaccttggcctcccaaagtgctatgattaccaggcgtgagccacagcaccccagctactattggctttataagtgaaataagtgcctttgagcattcctatgggcaatcccactgcatgccacccatatgccatttttggattatctccagctcttttcttacattccctggctctggacaaacggcagccttctttcttgaa

SEQ ID NO: 7015 - DNA, 1018 bp, Homo sapiens
acgacagaacgaaaacaacagaacagcgcacacccgcagcgaacgcgagccgagatctatcggggaaacaacgcgggcaaaactttcaccggaaaaaacaaaacaaggcagcgaccccccgggggcgaagacaaacaacaggaaaggaagacgaaccgcaaagacacgagcggaaaaacccagccgaaccgaacgaaacgcaaaagacgcaaaaacagggaagagccagaccaccaagagacagacaggcagacgccccaacgagcaaacgatgattaagaggaagccgcacgagaagaaaggggcggaagaaagagccggcggagcgggagaaaccggccggcggcacaccaaccaccacaaagacccacaccgcggcgcagaacaaaccacacacaaaacagggaggaaggagaagcgtggcaccgacggagagaaagggacgaaagaagcgcgccaaaaaccggccgcaacccgcccccgagaaacggagagaccgccccccgcccaagaagacccaaaaaaaaaccacccccccagaaaacaggacagaaaagagcgaagagcagcgaacagaaccaagaggagaagagaggcgcgagacgccgcgaagaaacgcaaaaacacccgagaccgcgcagcgagaaccgaaaaaaaaagacccgacgcggcgcgcaccacaacccaataaacgagcgcccccgccccagcgcaaacgaaaacgagaggagccgccgcgggcggcacgaagaaagccacgagaccgccgcaagaagaaaaaaggaaagcgccgaaaccgggcaaggcaagcgcgacggaagcccaggggccgacccgccggagaagacggaggagacagaccacggcgcggaaagaacgcgaagaacagagcgcaaaacgcgcggacgaagacacaggagaaaaagggagagacggagcgacgccgcaacgcccaagcggagagcacaaaaggagggaagacgacgcgagagccaagagaaggccaacgcccaccgat

SEQ ID NO: 7016 - DNA, 876 bp, Homo sapiens
attttttaaattccccggtttaacaaactttactcttacagaatagcattaggccccacagcaagagcactaatgtccaacccatacgccgagaagatgctgctggggataggcgaatacacaacactagcgtaccacaggagacgagacatactcgacaagtcacacagcgaccaaaacacttctatatttttaaccaaagtgagggtaatcccatgacagctccgaaagttctagatatccccaatctcattataccgctccccactggctaccccaaagctatctggatttacaagcgtaaaaccctagcctctcaattccacattgtcaattattagtttacattaagttcacattcaagaattcttcagtggcgtgattgctacaacgcatgcccacacataatgcaatttctaggattagctccaagatattctcttctacattccctggcatctggtcaaacgcgctgcctttcattccttgaacatgcctttcaatggttctcctttattttttggctcacgttattcttgctgtgtaaaatgtcttcatgcttccccaccatctaaaaaaccaaacaaacgaaaacaaaaacaaaaaccttaactgtgctgatcatctatagccctatttctccaatgctctattttgtttaattgtcacaccattaaacaaaaaaaccactagagcatttttctgcaatgttttcgagccttcagcagattataccttgtactatacctgttaatgtgcacgttttctctctcccattggatggttaaattcattacagacagggataatgtcttaaataatctctgtattcttcacagtatcaaatttaatgcttgatatggatatgagacccaa

SEQ ID NO: 7017 - DNA, 1552 bp, Homo sapiens
  misc_feature (1)...(1552): n = A,T,C or G
cggaatgcgacgcgctgcacacgactcnacgctctacgcaatcgacgatgctactataagcgtcacgtnatcgtctacagtcgctgcgacgaaanctagtcacgacgtacgacgtcaanagtcatgtctacgctcgcgagacgcgcgtcgcgcgacggagacactgagcgactgnacgtgctacaatcgcgagtngattacaatgantntgacgcgacgtgatcagtcgtcatgacgcgtagtgactgcgtgtcacacttctctcagacgtagagcatcactaggcgcgtgngtcngataggtgatactattagtgnagcgtgtctctctcgatcatngctcanacacgcatatactaactacggcagatgtcanccgccgcgcanantgnctgtaganaaacacacatcggtaacatcgtangtacgatatgcaccactacanctgcgntcgctctagctctcgtctgagcaacactatccgtcgttccggtgtgcatactgtcagatctgacagtcacattgacntcgacgcactcgtcacgatctggaccgcacagtagtcatcgactcgtaacgctatgcgtacatcgtcgccactactaagcgctaaacgacactctctagacatagctatcagcgaacgacccctagtccacctacaccattcatcgtacaacgcggcgtcgccacagtctacgcgatgcggtagcgaaagaatgggtcgtaaacctgataacgaacaggtccgtccgaatagacgcggctcgatagagtcaccatacgtgaatagaatatcatgggtcaaggcgaggcgcggatgtgcacaccgcggcgccacgaaaactatacaatcaacagatatcttcgtcaccatctcgcacgacatggcgtgctgtatgcgcaggaaatcatgtngagtcattatctgctgatacgagctcgcgtggagagtcgtactagaacaactatcgcgcacaagtcgacgtgacgcgcgagtntnacacatcgggaggctacgagggataccgcatagtaggcgatgcgcatacaatatcacgcgcacacaaacatcgcgnctactggtgacagggacagttggcaccagcaatcggctgtagcacgatgcgaacaaatcgtcatacatatgcgcgagacttcaattagacgacgcgccgcgagagagagcggtacggaatacgacatcactacaactcactatgagctctgacaggcacttagatccatttcctgacgcaatggtcataccattatcgcactgtgtcgcggcacgatacacgaagcaaaaacagaatgtaatatcgcgtcgcggccgcagtcgcgatcatcgacgtactattcgccgtcgtgggcgcgcagcacgaacgacgacaatcaataatgtcgcggatccgaccggtcacgagcgcgaccgagagcgggactcgcggcaacgaggatcaaatagccatgcccgcgctggcgacgatagcagaagaaccataaccgcacaacaacgtagatgcgtggatcgcgttattccgcccgccccg

SEQ ID NO: 7018 - DNA, 1316 bp, Homo sapiens
  misc_feature (1)...(1316): n = A,T,C or G
atggtngccgacagcanagtgtatatagtntgtctcacttgtgatcgatgcagtgctctcgtacgaagcttggtgtacacgttacgacacaatgggagagtggtagtaagtggatgtgatccaacgtgtgctacctctatactatcagcgaattgcggagagtaggtgtgatagcaggtcaacgatagtatgtgatgcgggcggcgtggtgggtggtaatgagagacnagncantggtgagtgagatttcataagcgctatatggcacgacatcagtgcacaatggatgactctattatgtagtattaaaggaagcggctacgacgagagaggtagtaaggtatgacgatgtggcggagcacacttatgcatacaggtgtacgataacgtgagagtgatgtgatgctngagtcgaggtgaggtaggagaaagcaggacaccgatngtggtggatagggcgtgttgtaactaagattatacacaatacggatagtagtcggtaggttgatatgagcaggtggccagtggatcgcgtgtgagtatacgaatccaatagtgcttgacgatgtagtgataagtgcgtgcagtcaatagcatgccancagaacagaagactgggttagcggatgagagcggtcgggcatgtattactacgtacagaaatataatggaaattggttatttgagaaggagtgcacgtcgggtgacctatcgtatctatgtatcgcgtaataggcgacacgcgcgagtagctgatcacnacatgaatgtggcaactgtagaagatagataataacactgaggacagagcgacgtcgtcggatngcggcgtagtgatctgggttaaggaagagctcaattgggagcgaggcttgcgtgtgagcgtgtgtatcggcgtaaatgtattagttgaagtgatcaatagtgagttgcgttatagcggcggagtagtctatatcatcgagctcgtagtttgcctgtagtgcgttagatggtagtgtgatcatctcgggatatgtgantgggagataggatcatgagatagataagatgatatctgatactcgcctcgaagagcgtaacttgtatatgatgtggtatgagatggtattgatgaacattagtnggtgacnaatataagatatgcggtgcgaggagaatgtgtcattgcgttgtagctggatatcgtagtatctcgtaagtatatatctggtcgcgtcggtgcatcagcgacgcatgtgagtagtggagcacatatctagatcantagtggtgacagatgcggaggaggggaggatatgtagtactctccacgc

SEQ ID NO: 7019 - DNA, 1390 bp, Homo sapiens
  misc_feature (1)...(1390): n = A,T,C or G
attgtcgctgacacccantagctcactctcacgcagggcagtgtgtgctgtccgacatcgcgtgtctctagtatcgtgtcgtgatagtgtatatgtgtactngtgatgagangcgctatctatgtagttgctaatatgttggagatactntatatatacccccttcgtagagcgtaccgaggcataatttcgagtagactatgtggggtcgtgtgttcgatgatggatacagctgatgaactagacgatgctatgatccctaagtctacgacgactgctcgcggagcaacgtgagataattagtgaacactatcatatagaagcacggtgacaacactcgaagagtgtcagggtaaggagtgtggagangagattagtgtagcatctgacgtgtgacntaatcgttcgcgttggnatgtaacagtaagaatgggatggtagcgaggtgcaaatcgctgagtctgtcgcgcgtcagtagagctcagcgcggtgtagtagtgcacatggctaggtgtagcactgtagcgtagcaagaagatcggatagacaacangngcgcaaggcgatgctgcgacatgtgatgccgcactcacacgtcgtaattcattcgcgctgtgtccggacgtgncgncaatgatattagtgaantaacgccgttccccccgtcaccttcactgctatcactatatagcgcaggcgacagcggaagacgtggcgtgtctcgcattcctaacaacatatataacatactaaggtaaactagtacgtgcagagcaaggtgtatgaatacttgtcgcagatttgaaccgcgancgcagtgatagtataagattgtgggcgcacgcaatacaactggaaacagcggttatattagccactagtagaagtgggacggtaggaaccgtagcgtggtgcgggtatatatgttgtaggatagcggatgttgaggcagtataatgtcatcgaccactacgctgtgtgtcaatctcgtgcgattgagtgtggtaatatattgcgtcgaggtgagtatgagacagtgaataatagcaataatataatattcgcatattgctgctaccgtatcatagatggagagcagcatgaacgtaacatatctatcgatgaggggatcctcgacatacttcgagccattcattcttttggtttgcgagggaccggtccgttgtcatagtggtagaccgaatagttatcaactcaaggctttgtattaatgttctagtgtcggtggatatcggttttggtgtggtcgtggttcattaataccttaaaatatatagtaggagtgcatcagggagtgatggcatttgtatatctagttattttgtacgttatatgtgtggaaaggatgattaataagtagaactttcgt

SEQ ID NO: 7020 - DNA, 1420 bp, Homo sapiens; identical to SEQ ID NO: 6367
  misc_feature (1)...(1420): n = A,T,C or G

SEQ ID NO: 7021 - DNA, 2266 bp, Homo sapiens
  misc_feature (1)...(2266): n = A,T,C or G
gagatgggctctgccgctgcgtcgctgcactactatcaccaccctatcgctgnctactgactcctcctcgtactgtgccctcagtgcatatcatacccacacacagactcgatagctggccgcgccgctcgtcgtgcaccgatnctacatcncgcgactaatctctgctcttcagacttacatgtncatgtctgtctcgatataccacatcatagctatcaatatatcatatcagcagtantgtcgtattactacgcctatgctagtcgtccaccatcntcaacgcagtataatggcacgtatgtgtattctagctgtctgatcnagcgcacgatctacggtgctggtcattgnatcgatgtgcgtctcgctctctcctaattgtggagtgatncgttgttgagtagtgtagnagtcggncgtcgtacantgcagacgacgatgagtacgntgatatgtacntgctatgngccgcagactcacagnaagangagcgctgagacgcgtagaccgaacgatgcgacttgcaggtgctcgtgtctatacgcgtactggcatcgacaantgacnantcagcgatnctagcgtctcggctgcaccacaccgacactancanatatctagcatcgatatgnacgatctgtaatagtgcngacagtccagtcagctgactcaggacacgtatagcgacagagagccgtagancancagntacactgacgatctgagtgntcgtcatcgcgcatctcgcanactacgtcccgtctactgncagtatctgntatgatgtcgtcatcacgtcatccgcantcagtancatagacacagacacgtnacaganganacgacgaatgcggtacagtcatgcatagatgaaaactagcgtcgtcgtggncatcagtgcagtgacgtncntcgctcgncgtcacngccatgaatcgaccganctnacgtgcgncatctgatgcgctgtgtcaacctgcatgtntagtaccgcgtcgtgcagtngatcganacgatcgtctcgctancgcgtgacgtagatgccgactcgatagtgaacntcactgcttagnagagagtacgacgntcgtgtggcagcganaganagnacncatagcgacgcgctagcngtgctcgtcngacgacgacgntatcncngttcatcacagcgtagatgcagcagagtcagtactcagcagctatcagcacancctnactncatnctactgaccgattgctaagtgagctcgancacanacctaagtgcatgatgtnacgtcatcgntgcantacgtctcgcgtcctacgcgcagtatgatgacntgactgagcgacnacccgagccgctgacagcagcngncagnctgtgatcgtgncgcantcagcngnctgatatcggtatacagcgtagatccgcgacntgccgttctgatcngcntcnagtcgtcagacagcagagtactnaccatcncgcgatacactgaagcgatcttcangtcntgtacgaatcntactgangtngtncgntnccgntacagtgaactacntangcanctgatnagttccntgcagcngtcntcngtagntcntcgacgtcgtntnnattgtcgcaatgangtangtcagcgannatgnagntacnccnnacgantnacngnnacgactacnntgnacgtactgatnagnagntagtgnatnacnatcactgaagnntgcgcntaagtangncattgnacngataatantcatcgtcgtcntgagactatcagcaacgncgtcganccgnagcatgnacgtatgantgctgtacnatnagattacgtgtcnatggtgcaantctagtacgcatactnactcgtaacnncgcgacntacatacagcgacgatcacgngacagnactgnatgtaacgtcgntgnntagcnantgntgncatactgtagtatgatgntaagtgagctgtcgtctcgatgantaagtagtcagcatnggnatgaccaggacgannacagnatcttgccagtgctactggtaagcangcagctgctttcgtgtagcaganntgggcngtcngcagnnganacgtagctatgtacatgatcagcanntacgacgacancatgcgncggtcgacnggtaatantanntctgataggtnatgacgtcgagnctgcncgagactgtgatctgcagcgcagcntgcantgntcgtcgagtntcagcagcgactaacatgatgatgaccngcagcagtcatcnacatc

SEQ ID NO: 7022 - DNA, 1886 bp, Homo sapiens
  misc_feature (1)...(1886): n = A,T,C or G
cgctcgcgcngancgagantccgcacgatgctgatgatagcnantcggagctagcgtgcagtatcactcgcatanagcgatcgtcgcgctancaccgtccctatcactctgtgatgtggagnactcgnggtcntntcgagtatgtctcgagcggntatgtgantggatctctgactcggtgatntgtatgatgcgcgcgctacactatgtctncnanatgnactgatcnangacgtgtncgcgcgtgtggagcgccgcatagcatcgcgcgagagtacatgtgcgaggcgagntgcgtcgtgagtcgaactcgtgacttgctcggttcctgacatcacggaacagcagcgctagtaagatcgacatgcgactatcatctgtgcgttcgcatacacacgctcacactctctctatatataatnatgtgagtatatcagcantacnatctcagcgtgcgcgancgcccgactataaaagtcagcgcgancaggtgcgcnantcatatccgncgtggtgacagnatcgatcacgcgtacactatcacgacgagcgtgtgatacttcaccgtctagcgtaacagcatgcatagcgtcactcatcgcgagcntgactatgcgcgctacatcngtacgtcacgcacgacacgtccgagacgttcgcgtcgtcncgtaactagctcgcgcagcgtgancttactancnaagactagatgtgatatactagtggatgcgagcggtcgncgagataacgcgtagcggtcgggtgacggtcgcgcgtantatgngngcggcgctctgtccagatcactatcatactacgagtcgacgtcatncgcgcagcaccgatgntcacgnancgatcgcatgcngcgtgtaatactccgagcatagtcgggcataactcnccatcagtgcgcggtgagtcatggcgagaggagtcgagatagcacgggtgagatgntgcggcgtacagntactgcacatgacacaatacacatcaatnantgtacactgctgcagcattagantatcgatgatacggaatcgngagtgggtgtgtgatcgntcgtgtcaactatcagtccgtgcggcttatgcgcgcagcgaccgtngcatcgtacgtgctcggaacgaatacacactatatacacggatcaactancggacatcgacgctcganantagtcatcantcgncggagtacgagangtgcatgcgctagcagcagcgcggctggacacaacctcgtcgatctagtataatcgatgtatagaggatcgcttccgcatcgtcgacgtcacactntngataggctcatctcagtgcatcatcgcacgatatacggctgtatgcgtgttaactatgtgctgtgcgcgccaccacgcgatgcnacgcactgagtgacagcgatacnaacatcacacantgctaagctgcctacacgctcnttgtcnattcgctgctcantgtngncgtagcgcgacgtctccatactaccatcgctcggtggtgtggacgctaanatctcgancngngtagattcnatgtatgtatactctctctgcgccgtccgtcgccgctcgcgcagntcataaccgagtactccagcgcacgcgtctggatgctcgatcaatantgtgcgcacacgtcatacatattcacacgtgcggcagtcgctcggntaatcncgatgtgcgggcgcggctccgcggcngcctatggtcactccacgcgtcagacatacttctcgactctctccggcactccgctccgccacacatagagatgtcgtctcgctaacagtacatgccgtacggctatccgtctgtcgatacgtatcagtagcgtcggtatctgtgaatacttcccgactcttcatccgcacgc

SEQ ID NO: 7023 - DNA, 409 bp, Homo sapiens
ctcagggatcctgtgctgcggatacattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaaaaaaaaaaaa

SEQ ID NO: 7024 - DNA, 1378 bp, Homo sapiens
  misc_feature (1)...(1378): n = A,T,C or G
ctctcgctcgcggccgtcgcttgcgtatgtctcttgcctgcgtctgttcatgtcgctccgtcgatctgtcgctcagtgtgtgacgctcgctgtcctcgtgccttcgngcggcgatgtcgtngttcgctctgttgctctggcgcggctgtgcgcggccgtgttcgggtgtcgcgtcgaatgtgtcgtcgtgcgcgctgcgtgtctgtcgtcttgcttttcgctccttctgcgctcgttgcttctctgttgtcgctgtgcgactgtcgtcgtcggagtgggngcgttgcgtggcttggcggtctcgtgccgcttcttctacatgtgtggtgcgcgcgtgtgcgtccgtccgtgtcgcttgtccgctcgcggttggctacgtctcttcgttattgtctgttatgctctgctctcacttccgttggctcctccgtcgtcggcgggtccctctgtctgcgcctggtctcacccgngccgtcgtgtagttgngtntgcgtcttcttatgtgttctgttgtgtgtgtctttctctcttgtcgccgctcctcatccaccctcgtctncgccgccttctctcgctggccgttgctcgctttgctctgcgccgcgcgcttctcctgtctcggcgttgttttcgctgcgtcgcgtccgtgcgcgcctgatgtcgctccactttagttctcgcgtgctattccctcgtgtcctcgcttgngccggcgcccggtgtcgtgtaccctcgctgtatctctctctccgctgcttncgtctggcttacccgtttcggcgtgtgctgcgggcgctcggtgtgcccccttgcggtgcgtctacgtttgcggctcgcctgttcctccgcgcctgtgctcgcctctcctggttgcctgcgtcggacgtgcgcgctgcgggtggcttgccgttgttgntcgcgttttcgtggtctttgggtgttgtcgccgcgcgactcttgtgtgcgtgcgcgccgccttgtgatagagcaccgtgatctgcctctcggtctcgtctctttgtgcggtccctccttctcgttgctcgtggcgtttggcgctgtgctgggcctcttcgtgtttgctctccccttgttcttctccttccctgcttgcgnccctctgcgtcgttctcgttctctcttttcgggttcgttctctgctttgcttgttctcttcttcttctttcttggtgctctgggttctgctatgccgctcgcgcccgaagaggtcgtctgtcgtggtgccgcgtgcgtgggcgatgtgtttagtggtctctncgctggtcctaaccgtcgtgtggtagtgtttgcgctcctaagctccgttccttcttctgcctcgcgtctctgcgtcttctctgtccggcttcttcgtgtc

SEQ ID NO: 7025 - DNA, 1038 bp, Homo sapiens
  misc_feature (1)...(1038): n = A,T,C or G
tgggtggnagtcgcgcgccggtcgggnggctgggctggtgcagcggggccccgtcgggggagaagctgcgccgaactcatgnagcgtcgtgcactcggggagcgggagcggcccctatggcggtctgaccgaacacggataagacgggcgccgctggcgcgggngtgtcacggtgacgggagcgtggggcggctgtgagggtgggtggctcgagggggctgggacgtancgcacggccgtcgccccgcaggatgcgcggcctcgtaagcgggggggagcactggagaccgggcgtggggcggngcgtcagggctgtgcggggtancgcgtgagacgtnnngcctggggccgtgactgggggtgtacgtgggaggatggacgtcacgcgggggccgggccgacgagggnacgcgcgagcacgcagcctaaaccgcgctctaatgcggccggggtgctaggacgccggcggccaggcaggcgcgagggtactccaggggttgagggaggcacggngggcgggggcggggggggaggggcgccgggggcggcggggggcggtaggggatgatgagtgacgggcggggcgaacgcgttggtcagtgctagggcaaggattaggaagtggagttggggcttgaccctaggaacctcgggttggnatctccaccgccccgcttgggtgtcctaccatnncctcccctcacacacccgaacccaaaaaaaccaacaaaaatttttttgtacacatactgctacaccttcaccaacnccctttttcaactccctctaacgcctcctcaccaccatacccnncccgacccacnacccaacgcactactcatacctcaccgtttctactctacatncctcnnnctttcccttnncccttcgccnccttttcctttnnncacccctnnnccctanacttaatnnccttcctnantnatacnnnnnnnnntnnnntnnncttaaannnnnnnnnnnnnnnncnnnacttctnnnnnnnnnctnnnnanncttttnnnnnnttcccatatt

SEQ ID NO: 7026 - DNA, 2144 bp, Homo sapiens
  misc_feature (1)...(2144): n = A,T,C or G
cactcgtacgagctgatcagtcctgctactntctcntgnctcgactatcacctacngactncgtcgtnanctacngtcgtatcngcnntcgcnngcnnctgcagtcngaactgccnagnntatcaatcgccaactagctacgnnagtanacnanacaacngtccgacctgcagctgctcgtnngtctgtgtcagacatgcantgatacttctactactcatctgtccgtnatacgacgtcaaacgacgagcatgctgcacncganctangcagngctgcctncagctatacgatcattnnccngatgcatcgagtangtctgntnnacntacgtctnctagctactnactgacganactgacatcagtactgttcnngnactacgaanagttaantangatnagtaacnctgatcagacatcgnntncgncagtcatntgnctagcnactgcaggctgctatgangtgnatttcagctgctacgctagtnctgcagatgcngacgcnagtacgtactctgcccganacgtcactgcantntnancgatntanatnctatcatncanctaatntgtagacatcactancttangcgtactagagnatgatgtcatcagcagtagtgntcncantanntngctaagcganctgctacagtgcagtcgncatgtganacagctgtgcgcntagctgcatntaatntngacgtacgaactcaatcnagcgtcgttgatttgcctcgatncagacgagctnctacactgntcagcatactgctcgacngtcacagctgctgtcagcactgcngactgcactantgactgatcgcntngcagctaancacagcagacacgcatcggcngacgcgantatccctgtcccgtcacgcactgcgcctgccanctcaganctgataatgatttgctacgtgtcgccataccttgcacatcgtactactcancgtctactcacaccatcgactgatacgacgtantatagcntacatctagtagaacgtcngtacacctaccatacgagcagntcgcagctgntacgnagacgagcgcgctacgacnncagatactactctattnanntntcgactatnggacgancgactactagtacacagcgcatcacgacatgantcgagtaatcgancgtangtnanatgcntatagacagctctcattagtcntgctcgtacgcgtcgtatatcgcactcacacgcagtagcatcttagagtcacacacatgcacacagtcgagtatgcgcacatacacatcncatcatctactcacacttntgacatgtgntcgagagcgttcacanttgatntagagcgcatagcgagcgtacgatcagcatcactagctagcgccacacgtantngcacaactcatgncnctgacatcgctgagntctattctcgtgaacaatgattcgcactgcagcacaatgcatagcatcgcagcagcaccagcggacgacgtctatagcgctacacgtcancagcacttacgcgaacatatanggaggcgcgatcgtgcgcgntgtcgatgcaggctangtgatntcagtgcttccaaatgagagagatgactatagtgagcgtacgtcacagagaccgacgtcatatagagaccatatatgcagacagcaaccgtgatcnactcgcgcgctgcagttcgacntgagacatatccgcaccgcgcgatcgcactgcttcgagacattgantcgcgcgaacgcgatcgcacgagctcatcgtgaagntggacatgatagtatcggaaacncctgtaggnagtgcctttgtgatacgctanatcggacnactgtccagataagacgtgtcatgtgtaatgttgagntgtatgcgatcgattagacatacagcaagatgatgtcgcgcacncangcctctatacagtatacatacgttatctaatacggtgtagcgcgacgagcgtacgtaatatacagtaagatgaccatctataagatagacgtnctcactgcgtcgcgcgcatcagacacttgtatatgagtgaatcgtcgagtccagcgagacatagtctcgttcgtgtcgcagcatcgaccgcgcacacatccacatactataatatgtatatgacttcgc

SEQ ID NO: 7027 - DNA, 1449 bp, Homo sapiens
  misc_feature (1)...(1449): n = A,T,C or G
gtattagtagttgatcacgcatcaggtcaggacgtgtgtcgagttatcccgacagccgcgttacgacccaccacacacgccaccgcgcacactacagtactcgtccgacctatactcccaaatactgccaccgtcgggagtcgcgtgcnggtggtaacagctcgtcaagcgatctatatctgtcagactgtgcgtctcagacctatcgatataatactcgagtcgtgatacttactacaccgctgtcgcaatgttgattactgctcactcgtcctcgcgaatcacatatactcgaacatagcgatcacacatagcacaccgcgaatagtatgtactagattgtcctcagacgaaactgaacattcagnatactattaatatcagcatagtttataagataggaaatagttctcgtcgcgtaatttgtgtgctgcgtattgcagaatccatactctatctctntcgttaacccgcataccgtcacagtcgtatctgagtcgacgtgtttaaggacacatactacatcacgtctcacaatagagattgacgaagatgtatagaccttagaccatcangcagctggcnctgcctatgagtaggactgatagcaagcactgcccattgaatctatatcatgaatgaggcctgtatgacgacgtgcgagtgcgtctctagtagggcatagtcacgtcgctgagcgcgcgagacgtacatcatcctcgtatccagtgttacgccgacgatgcacgcgacgcgagcgtggctgataacgctcgatctcacgctcatgagcgacacgtatcacgtagctaccgcagacgctactactgactctgcaccgattgtctggtatgtactatcgatacactcttgtaatcctcgcacctcacacgctacgatcgtgcgcgcgctcgtcagtcgcctctcgtgtacgacactgcgcgaacgcctctcgcgntaatgactgggcagcgctcgtcgaactatcttatcaggaancgagatgtagaatattaacacggtaggtacgacgatgactcgacctcgatagacaatacncgccagttcgcctctgagcgtctctatttcgatcgccgcgtgcgctagagaacacgacatcgctaagactcctctcttcagaaggcgtatatagataatcataggttgggaggtataaccagtactccgcgagctacaggattattaaaacatgaaacgagtgaatccagactagtcgcgtatgagactacctcgccactcgtccaattatcgaggctgtcttaatcgtgtctcgctgtcactggaaggtcgtcgttcgacgcgctaacgccgcaggaggagctcctgtacttgtggaacgagacgtatgcttacacactatataacgcatgtggtggccgagtcgcgcgcgccgacgcgatgcgccacaatcatgaagatacgacaagt

SEQ ID NO: 7028 - DNA, 1362 bp, Homo sapiens
  misc_feature (1)...(1362): n = A,T,C or G
agagttctctcctcaccacatccatgatcgtcttactactcttagcgacccgcacccaccacactctcccgcgcgcctgccccgtctccgtcgcgttcctccgcgcttgccataacgccccgcccgccgcctcttctcttatacgcccgagctatcgtgcccttacactaaagtcgtaacgaataagtcgcggacggattaatcacgtgtcacgatgatcggtatgtcatacgatcgctgtgctcacagattaacaaaagtaaattgaccgacgcctgaaactgagtgcttgtgcgctagccctacatcgtagctagacgtgtcaataagaatcaacaagtaaagagtaaaccgatttagtgtaacgccaggatctgagagtcgtatatagcgaagccagatgaacaatatccctcccacgcgcgccacaattaaccctcctaacttcaggctaagcaccgagatgatatagagactttcgtctctggagtgcgcttgtccgtactcgcgtcgcgcggaactctgcgcgcacaccctatcacagcacatcgtattcactctcgcccgtaaagatcagaatcataacgtactttgtaaatgacaccagagaatatttaaatgcgatcgtaatcaaagcacaccgtacacactcacatactaagtaccgccactcgccgagtatatatgatgatcaacgacgcacgaatgagcaagagagtactccacggcgaccgctacgggattgtgacatggatagcgcgacgatcacgatcagcacagccgttatgcagatcactaattttcgactcgtccccttaccacctcgacctacggctcgaatgcgtgagttcacttactgctgaatatatcaagtcccatttgcctccgcatacgtgcttacttgtatgcaatgtgatacactatggctctgctagccttcacaatagaatacgtgcacctacggccacctggagctgtatagcgtcgtggacataactcagacgcgacgcgngagtatgtggcaatatatcggtntagtagattaaatactctaacgtgagtcgcgatatngcatgactctgtactctcgatgcgctgagcgtacctatgtgactcnctaatagacgtctgtcgaccgcggcgtntgtaagatatagagatacgattgttgctgcgcgacactacgctgctagcggcggcacaacccacgtacacgcgactgacctcttgcaccangtgtcgcctgtcgttgtctttgactctgcttagctccgtctgctcatatcactcgcgacagagtagtggcgtgtcgagcgcattcgccacacctctcttggntctgataagntctgatacgctatg

SEQ ID NO: 7029 - DNA, 852 bp, Homo sapiens
  misc_feature (1)...(852): n = A,T,C or G
cacccacgccgcccaccacagccgcgccatgccaccccctagcccacctccgccgtctcgaacaaaccaccttggaacggcacaacctacccccacaccgccaccccaccctaattcccccgacgctcgttaacccacaaacccacagcctaatccatctcacttccacacaataccaacgcccaccacacgccacccaataatacaccgcacgcacgcacccccaccacccccacaagcggacacgaggctaacaaccgaacaccaatgtcgcaggacccttgccacctcgcgcgggacaggaaagtcaccctcacaaaccagagctcgggtctcgagaaaaaaacacataccaagttaccccttgcatcagaccgataacacaagtcctacgaacggtatttaagcgaaaagaaataaaaacatcagacgaagggagtgaaagaaacgaaaggcacgaaaaaggataaaaagaagcacaacagagaaagggagaangagggggcccccccccactattggggagaaagagaaatgcacccccctcgaggaaggaaaaaaactccccccccccgaactacccacggcccgcggggaaggaggggggggtataaaaataccccccccaaaaaaaaaggggcgggagaagaactcccccctgggcgaccagaagacgcaaaannaaaaannnnntnctgtggtctctttttttttttttttttttgagagttattttccatttatttcatttacacatctaaataacttgcagaacatcaacgaagcacgaggcaggaagaggacgtggggtcccccgcaagccagtccatctccgtgtcgtctggggacgcc

SEQ ID NO: 7030 - DNA, 473 bp, Homo sapiens
ccgagacggcggggggcacagattttataaacaaccacgtccggccaccgggcgaggctgcatgctgcgcgcctcgtccatccatccgtgatgattacaaaagctgaccacggcccagaggcgggggtggctcgagttcagacgcatgttatccggagggagcgtgtaactagcgcatggcgaaggtgaacatcggcgcggggcgaatacgagagaccaaatatgcgcgggaaaaaggacatcattcaatcttcgcgccacctctgtcctactccgagtcgttgttcttcttcttccagactcgtccatccccttccccaacgcgaataaacatccgaccataccgccgtgaatattacctggtcctttcccataatgcccggtcccgcagcaaatacgccccttgttctcccaagtgtgcccccacgcacacctattccccggcattaacgcggtagagggagaacaacact

SEQ ID NO: 7031 - DNA, 1906 bp, Homo sapiens
  misc_feature (1)...(1906): n = A,T,C or G
gagctggatgctacagctgctctcgactctgatcatatctctagtcancacttgcctatcgactctacngtacatacttctcantcccctagctcatgtgtcacgctagcgcagcagctgacnctgagactgatacgagatngcgatgcgtacgcgcgcagtgaatatanagacanacacgctctacgcgcatacnccngcnacgtgtctgtctgatgtgagntatctcttcactactcgtccttctgatcagtgcattagtnactcttgcatatatcagtagtgcgcgcacgtgctgttgcatgantctacatcggtaagtcgactgcaatcgtataagtcggtgcagtcactcacgctgtaatgttgtnagacaatcgacacgtcggtaccgagcctgacatgacgcacatcgtcacggtgcgagttgactactgaatacatctttatagntatgtagctctacgcgaatgttgaacgtacaggcgtcagatagtagcagagtgatggagcgtggtnaatagtacaacgactgtcaacgcggtcngcagctagatcacgtcacacacacagtgctataacacgacacacacagacagtcgagagtgnagtagatatgactggaatgagcagcgctgtagagtgacgtngtacgctgccaactggcgtgcggcgtgctcgttgtatacgaggatgagacagatgtgtgagctcgcatgtntatcgccgcgctgccaactatgcttcgatatgagcagagtagtagttgatagtagatatgtantagttctccatgatatnggctatcccgtctctgtgatctgtagtgtctgcacacacagatccagtattcatatatntactgatacgagcgaacgcaatagactncgcgtatagagagcngatatcgacgacgctgcacgtagtcgttgtcattgatggtgntcacgtgatctattctganaacagtgcgacgacgatngcgtactgcgtagtcgcgacgctcacatcacatacgatgtagtatcgatcgcgcgtcgcgtccngcctatgtgtatgtgagantgcatcgctataattggacacgagacantatacatcagagtntgtancgatgagtnctatgaatcgtgatctcgctgagtatgtgcgctgatatgcgtcacacgctgcntgtgcgctgagtcgtgactggcgacccgncgcgacgtcatngactgacgatgattctgtttcgtacacgcnaccgctgatnatgatgtctgcgcatgcgcgcgtgagacgacagtctgntcatcactaagtcacgaatagntgatcataggccgacntcactgangncagcgtatgatagccgagcatagcgtcgatatgcatctcttcgctctccagctctcgccgttccaccncactactgactatatatatgttcgctcgtacagtagcgctagtctgtacttcactatagcatngtactatcacgagcgtatgtacgctgancgcagntgcgtgagatgctcttacgcgtgtgtacgatagtgatctagacgtctatgacgcgaaaaacagcagacgagacatttatgtcacatcgatgctcgctgccgagaaccagagagagagagatcatcatcatcctatcgtcatacagtcatnagaatgacatgcgcgtgtcntgttctnctttgcgngnctccgagtagagcaccagagcgaggcatctgncntagtgtgtctagcggtatacatatcttacgtacgtctcatcgcagagatgtctnataatctacngttcgttgccgtcgtntccgtgtagatatcgagcagagttgcgtntcgcgcggcgagntntctacccgtactgatgattntactgagtcactanattatgctcatatncgtcgct

SEQ ID NO: 7032 - DNA, 828 bp, Homo sapiens
atacaaacttcccatccatcttaaatcacaaaagttaacgctgggacttgtccaacagcagtatcaacccacaacacacgcaaaacactaggtcgcttgcagggacgacgctgcccttcatttttacgtgacgccctgtatccacagacaccagtcaataaacacaaggcggcgagcggaaatcacattagtagcaggggtgaagtgatgacatctaattaaaaagcgcgctgttcccacctaacgatatatatgtggctaaataatgtaatttattgataaatgggacgaaaggagaggggggtgaaggggaggaatgattaagtttgtcgtgggtgtttttttttattaaaagtttatcatgggtttagaggttaaattcatgttttacagtttgttttgaggaattccggtataataaaccttcattctccaatttggtgaccttcttgaggatataggagtttcttgttgagctctttttatcctttgttttaaaaaattattttggaaggttgttggctcacaggggaaataatgtggtattttctatacaagataattttcctaattttacattttacatatctgggttcatgcccgtgaataaagtccccccctttatttgtttgtttaaggcaagacattggggtcattccccacaagaagtatttgatctgatgaaatcaggaaggtgcgtctggtgtcaaagggaagtgtgtcatctccagggagggagtaaaacttcttggccggagtgagaaagaatatcatgtttcacgtggtgattggtcttgttggctgagctgttggtgggggtgttgggat

SEQ ID NO: 7033 - DNA, 1401 bp, Homo sapiens
  misc_feature (1)...(1401): n = A,T,C or G
ttgagtgtggggaggatcagagatgatctttatgtaacttacttctgtagacaacctatatactcacaccagaccccgtaattgcaacgagtctctatcatctcaacactattcttgcccgagtccgtttgatatgtgctacgtgctctctcgtgttgatagttgcagatccctgaccgtaagccactaatttcacgtgcgtcagtgaggaagatcaatcacgacgttggtacacacggaaattatgtccagacctatacgcgatnagagttggaggcgtacatgtgtatactcatagaatnattaattagattcataagtagagaacagtaaaaataatcaggaggccatttatatcagagtcggatatagatgactattcatactcgttataaaatcacccattatgtatataagcgtatatcctgtcttcgagagagctcactatgatgagaattacgctactggaatcgatgattagtaggactctcatgcatcctcgcgacccgactagatgagagatgatgagtttatcgcacgccagcacacggcgttgagtgcgcagtgtgtcatacatgaagccacgacttgctaccttgtggagctatgagacaaattcagatgtcaagaacacgaaatcaggttgtcgtcaccaccggctaacatccatataacagcaagatctcagcacagtagccaacntgaacagtgcgagtcgccacttagtcatacattataacactctggacacagacgtaatgaaacacgacggcgcactgtgcacaactttagatatagtaggacgtagtcaaacacnacgatgagataacacgcgattactcgtcttttattgaatacgtacgatgccagacgcatcggggtntcccccagactctgtcactctcatactctaaatttataatagtccgctagggtgggattagtgcgtgacatactagcttgcatcacggcactgttgttactgcactcatgtggtagtgtgggaccgttaggtcgaaccatacaacacgtatgtagacgatacatacgtcagaagctataagatgtatgaacacatgtatatataaattagtatatagagtagatacactgatagtagtgtgtctaaatatagcatctgtgtnagtacgctagtgctgagagcgatanaggccgcgccagccgtacggcacatntcacactcagtttctntatatctgtccctatagagagtagataagtggtgtntatgcgcgtactggctcctgcggagtcgcgctagacgtgcatggtcgcatctgtancgcgatacgtcaccgcagatatcgcctcgtgagagcgatggagctgcgcatgctagccagcgctataccgcagacgaataaatatgatagcgctatg

SEQ ID NO: 7034 - DNA, 683 bp, Homo sapiens
  misc_feature (1)...(683): n = A,T,C or G
aaaagaactaaaaaagaaacgactatgttaagtaaccaaaggggcagggagaaccagnaaagtacatgagaaagtaaggagaaaggaagaatgaggaaacgaacagagggggcagaggacagaaggccgaggcccagggaggagagggnccgaggggccaaggcaagccagcacccgccacgacccagaggccggccgcgcccccccccctacaggtccacccccaagcccccagcccccacacacaccgccagcgaaataagaggcccacagccgccccgcgcccgacgcccccaccttagaggcccgggcccccgactctctccaccccacgtccatgtncaaacacgaggacgaaaaaaaaannaaacaagaggagcagtagctcgcatagagagttacgagcaagaacataaacaacgcgaacttaagcaagccacagcgcggggcccaaagagccccaagcccccgacagccccggagggcggcgccagcgaaaagagcaccaacgccaggcaagcgcgagagaggnccagcgaagancacaagacccacggaacacacgcaagataacaaaaggcgccgcgaaaggccacaggagagccgcgagacncagagggcacgaggagcgggccaggcggcgcggncaagagcggggagctgcacgacctcacccgcgacag

SEQ ID NO: 7035 - DNA, 1646 bp, Homo sapiens
  misc_feature (1)...(1646): n = A,T,C or G
catgtctagtacgctagtatctcacagctatgatatctnctatgcatatagtattggangtgcctctagccattnataatcacgcatcgatagcatcaacacgtgtctacattttgtgacgatcactcgtagagatatcaatatacgcgccaggcacacagcgctcttcagtcggtatcacagtgctcctgctagcgntcgctatgcgtagantctatcatcgatgcagtacaacgtcagaggcgtatcctaacaatacgttatatatgtatgcccgncttatatctatagtaatgtatgattcagatgcagagtctgcacattctgctataatttatatagtacataataaccctacgcagtatatatatactacgatgcncgcatgctgcgtagtgctgtcatcacacaacaccacgtagtgtatactatctatatgatgtatnagantcgangaatatgtcatcttcacgcacgacgatcatcgtagtcacgtagggcaatattatactcgatcgcctgacgcgtacacgtatctcgcgatgttttgtcctggctagacggcgcagcataatgtaaactgatatactagatatggctggacagtacgttcatntcgaccagtatcagatagagaagtcacatgcatattagacgatatgnattgttgatanactatactatgactgctattgatacatatctgattactatctgacgagtcgatcctatactaccattacattgcagagatctagatacgcgtacatagcgcgcgacgagcgtgctntgtaacggcgtgcaagtancgatcgacgctacaantattggagcttctatgtatgcgctgctgtccatatcgcgtcataatgagctacgtacacattgactagtagcaggtaggacgttcgtctaataattgtagcatacttcangagacacatcacgcantgagcaganagcagtagtgaaaaaggagatgcatgatatctactcgcacggacgacaaagcgtgcgcgacgagcgtagtcagtaaagatatggaacgccatcgtccgctgagatatacananatgtgcactcatcgagcttctatatatctcgtatcactcaatatataagtatatgcactgctctantacgctagatgcgtctagaccaactaatagaantcgctacaatacantcctcatggcgtgcacgantggagangcacagaatattgtctgtcacgaccatattctcagtctcgatcaatatgctcgatcgagatcgtcgacgctcgatagccgaagtgttgtacgtacgtatagtagtntctcttactctgntcgtcgagcctanctcgcgcgagagatatcatttgtatgatagtaatatttacgtacgtgtacgataagacgntctcacgctctgagcgacactccgctcntctcagcttcgtcaacatcatgctatatanctgatgacgtcgctatcgttcgagactcgcgatacccgcgctaactatctctctttactcncgcgtgtgtcatcgcnagagacgaatcagtgaccctcgcactcccgtatacgctaacgtagngatcgagcgcgntgcgacggtgccactcacgatcacaagataatatatattcaaccattac

SEQ ID NO: 7036 - DNA, 1639 bp, Homo sapiens
  misc_feature (1)...(1639): n = A,T,C or G
atatcgctatgacatcgatancctgctacagatgtaagtacangtatgcgatgcgtntagtttgaaccgcctactctcagcttagcgcacgacgcacacgcggcgcaacaccgccacatgcgccgccnctaccgcatcatgtcgaagtgcgtatgtacccacgagcgcangacagtctcttgcgtgcttatatgtcggcntacatcncgtcgtcatcctatctacaacatccagcgcacaagctctcgccgcagctctgtacgcataaggtaccatcagattactgccatcgcacgctatgtagctgtgttgtgtggtttacacgctacctcgttcccgccatcgtatgcgatcccntgtatagtatcgtcgacagcgctctgcatctgcgtcacaccgtggtgtcgtcacgagctagttgtacagtctctctcgtaccaccgctatcttgcttacatccgcgtacttcgcgccatcactagtgcacgccantgagtctagactacactatcaanatgtgtgtttctattgatatagtttcaacgactctctgttagtgtgtgttggacgctngcttccacacctcgcgctagctgcttctgagttctttgctactagtactatggcgcgcggcgacgacgcagtctcatatccgactgtagaacagcgtttatcaccggtgatggctgcgtgacaagtataagagcacgtcacatacgccgttagttcgtcatgattcgactacacactccgggagacaacatcgtacacgaatgtcatcaatagtcgatcgtcgagtatcttagtttttatagatcgtaagtcttaccaagcgtacgcgatccggcgagtagtgacatctccgtcttcctcatntctaacgatgtacggcgagctatacaggacggacgtgtganacataaagcagtagagtaggaccgacgcgcnctcaagattaaacntctctcgtcgtcacatacaccgcacctcatacatcttctcncccacacgcgcagtctgatgcgatctgcgatgcacggacggcgnctcgccagaanagagactgcatgacccgctgaccgagcgtcgcgagcgacactgagcgctcanacacgattatcggtacgcagagagcgctcgactgatgcactatgtgctccgacatcagatcgagcagttctagtagtacctgagtcccgcgagcgtagttcagtgcagcgacggcacaagcggctctacggtaagatatccaaacgacgaggatgcgagcgtgctcaggcacngatntntcgtgcgctcatatatatagttgatgtctatcatatgtacgtgcgtgcgcgacgacatgtgacgagnangctgtgcancacatagcgtgtnaccactcataaagtgtcagttatcgacacggcactcgcgatggatgtgacgttagcgagttgttgcgatgtacgcgcatcataccttatcactgcggcgaccatcagacgccgntnacgagaccgatcgctgcacgaccnagacaantactcaattagcatctgtgcgcgagtatggngagtgttatcgcgcgctngcgagccgcgtgcgcgtgtgcgctcgccgcncgtctctcgccgtgacntcttcgcgcgtctcg

SEQ ID NO: 7037 - DNA, 1421 bp, Homo sapiens
  misc_feature (1)...(1421): n = A,T,C or G
tgttttcacatcctggtacctgttgacaagctgcttaccgctcgctactccttcctatcgccacgcaacccgggccgaacaancgacgccaccaactccatccaggagcaccaccgaacagtttccggtctgatatacgcgcctactgagtaggaggttatctccagtaattcactacaactgattggtcttgaatactagataaccacacataaaatgtaaccatgtctttcaacttactgctttacccacgtgatagtcgcattacattcgcattaacgccactcagttaattgcgaagcgatagcggctggtggtcctcgattcacaatatggtactattattgatcatcattgcagcattcttgatcgcacgacgcagccgtcctccgcattaatcgttcctagtctgtcactcaactctccacgattatccgccgtccactccgccggatcatatgtatctagaagtgcatgcacctagagccatgcctatgcatgtacaccgcgtgctgatgttatcgttatccattgtcgcagcggcgcactacagacatgtatgtcattcgactagacacaccacccactataccanctctacagatactgtacagaggcttgatgcttgatctgacgcccgccggtacaacatggtacgcgtgactcgtgcttagatgangctcgctactacttgcatgtcgatcttcacacctgcgcgcgcntacaccatcaatagtatattccgcagtgatcagagctacaaaccanacgagtcaatatcatcacgcgccgtcgtccttcacgcacacaattggcgaacgacaatccatgacagtctgcacgttctacgtctctcccgcgcttatgcattactacgcgatagnatctcgtcatgtcattgatctgtcacacgcggttatattgtccgtttcctcgcgcactagtgagcggatgtcacacagatagtgaatgaatcagctgccgtacgccgtcgagcagtgccgcgctactgtcagtagacgacctacgantagtgcacgcgaccgtgacactgtggcgctggctcgcttcccacatagtgactgatacgacactgctgcgcctcgcacacctcggcacatgtgtcggtccgccctcagtgcttctattattcgagttacttgtcacataatgcttcgcgtatgttacgtagatatccgcagcaacgcgctatctcgtgtcgacgcagccacctncaagtacactggacacgtatcgttataacgccatatctcctctgtcgacatctagctcgctcccgtctgcagatgctgttgtgatctantactatgtatttggtattatacgcacattatcttatctaccgatgctctctgtctgaccgcctacctccctcgtagaacagtagatactaccttact

SEQ ID NO: 7038 - DNA, 883 bp, Homo sapiens
  misc_feature (1)...(883): n = A,T,C or G
ctcgccacacccccttcctcctctctcctcttcctctcctccgcctatcctnccctgccactctcgacggcctacctcctggtcctcctaccccgcccttcngcgccacctcccctcccccttctcactcttctcccgcctgacgcctccctcccgcttctccccccccccatactctcgcccctttctctcctccctacacgcttctcaccctccctacccttccgaccttcccaacgccccccccccccctcccccaccgacccgctccccaccactctccggtcacttagtgtnttgggtggttgccggccgctcgtgcggcggcccacgactcctccccttgcggcgcgaggcacaccaccgcctccccccgacgccccggcaccgccacgactaccgcccccccgcccggcccacccccccccccccgcaccccccaaacccccgcccgccacaacgaccccccgactacggcggttttcacccagcgccgtaccttatcccaaatatgtagaatttctctttttattttcactgttttagtttatttgggctgccataacaaagtaccccagactagatgtgtttgacaacagaaatttattttctcacaattctgtaggctggaagtctccccgcgtcaatgtgttgatatggttggtttttttctgaggtttctccccttggcttattgatggccgtcttcgccctgtgtcttcacaagttcatccctctgtaaccgtttatgtcgtaatcaatcttctcttatttctttcaaattgaatactttactaccatggtagttgtctctgtaacatgtgcacacatccttgcacactcagaatgatctgcctgggggaaagagtactgagtatgcctg

SEQ ID NO: 7039 - DNA, 881 bp, Homo sapiens
  misc_feature (1)...(881): n = A,T,C or G
ctagaatcgattgaaaggggcctcccttcggcccaacaacagtctgacatcatgcattcattttttaaggcattatcagaaaatttcttcattattatctgactacgatctagaatcaaatccatggagtaagcgtccttctgtctcattcactgccacattccaggcttttggaactggccctgacaagaagcaagaggggagctagaatgacaaatgggttccacatanatcgtaatgttgtcaaggccttccggaanaacccttagagttagcatttgagaatctttgcagagtgaataatccactttgtttttcccttttcccaaataccaccacaanattccactcaaggcattttccctttcatctctctttcagtgttttaagttgggtatctatctcttatttcataaatntgcagattatgtgaagatgaattatatagatattttattcagatgatggactcaagatcttatccagaaaaacctacatctcacaataggcagtagaccatttataacacaattgaattaagtcactttaatatcataggtgatattcatcaaaggatgctacaataaacacaatccaatgcattcttatccatattttataatatatttaaataattaagtggatatttaataattgggaatgggctcatgttataaaaaacaattcttaaaagtcaggattaaatttaagaaaattcaaagatacatttcctctataaggagactgagataaaaatcactattactgggaactagaagtttaatttttcacagacattacttggttgtgctgagatttgtgggttgtcaaaacaaagatgctgcctgcagacacatgagaataaatgcgtatgcggcaag

SEQ ID NO: 7040 - DNA, 1083 bp, Homo sapiens
  misc_feature (1)...(1083): n = A,T,C or G
cggggcggggtaccgcatatctatcttgtcgcatgtcgtgcgtcactactacctcgtactcactactttactaacactagaatttctgcttctcttctgctcacgagattgctcatcgtctgctctccggttatattcttactcttaccgggtacatctgtgtcgggttcttggtacttataccgataactcgtgactcatggcaaatactctcttgaaactatcctctcgcattacgcctgccaacatatgtacgcctatattactatggccacaggatcattcttttattccgtgtctctcggctgtactaatctttaatctttcgtacgagttcagagatatcggaactcgtggatgcgtccggctgtatgggttaattgggagctttatgaatatatatagaggttgctggcgtaccattttaccgggacgcgccgtgccgtctcactcgggtttttgattcgatatcacggctaattgtttaccaccttctgtattgtactcatattgttcgcggcacgtatatccttactgtctctttctatctcttcctagtctcagactcgtgatctctgtttatcactaccggtaaccaaaaaattctttctcctcgcgactcgctaaatacaaactgtttcatacttatcggtctttgcgaagtatattcaggggcgctccaatacataccgttgttgttgtgatgtgctctctccttcctacaattctatctcgtaatcaccctgccgatgatgttgtcgatttcggtgtttcgtacacttctttagtactatggttttatctcggtaatggcattgtgctcctagtgttcctccgccccatcggtgtcccctcgcaccaaacagtatcaattatcgcagaatagggacagtctctttacccgcaacgggtggggaaagccgttctcaaagtgtttgcgggtacaagcgtgggcccatataccgcgaacattcaaacataaagatggattgggtttgtcgttcgtaattttctacgtgtntgtctccccnggagtgcggggtttgggtggaaccaaaatgggtggggaattcgtcaacggaa

SEQ ID NO: 7041 - DNA, 881 bp, Homo sapiens
  misc_feature (1)...(881): n = A,T,C or G
caagaagggccagagaattttttttttttattgaaggggtttctcagcaggactaagagaagtttaacagtggaacagctgttgtcggtccttttcctctcgggaaaaaatttcctgatttgcagtgatttcccttctgaggcctttaacagcanaaccgaaacaaattaggtgtgatcaggaatgagaaacttcctgtttatgagagtttaataataatcttgcaattagcgtttgacatcctggaaactcctactgctgagcttatccacacacacagaattttcaaacccaatgtggccaacacccccacagacacctggagaattcaactgctcctagaaaaagtggattggaattattttattcctttgcaaactttttgttgatctctaacctattggggtccaagcatgaaatggctctgttgtattcaacttctgacacttgccctccttaaattggtcaggaagccccttttgtgacgtcttggataaattttaaaactttttgttacagttgcttattttaagtcatgccaggtcagcaatcccattactgggtatatacccaaaggattataaatcatgctgctataaagacacatgcacacatatgtttactgcggcactattcacaaaaaaaaaccaaacaccgcatgttctccctcacaggtgggaattgaacatcacacaccggggcctgttgtggggtgggggaaggggggagggatagcattaggagatatacctaatgttaaatgacgagttactgggtgcagcacaccaacgtggcacatgtatgcatatgtaactaacctgcacgttgtgcacatgtacccgataactcaaagaataataataaaatagtatccagtcagg

SEQ ID NO: 7042 - DNA, 851 bp, Homo sapiens
  misc_feature (1)...(851): n = A,T,C or G
ctatagtaaacttaccacagtgcaaaaagatctggtgttaattacaaaaagtatgtatttctctaaatagcgtatccgaagggagtactggagatcattccaaaggatggtaacaacacaaaaatacttcccggtctgacagtggctggttcttccacactagagaaatctgtatttattcgttggctctttgtcatctcccgttggggggccatgattgtgtgataagcccaaagtgcaacttccaaatttatttcacagtagtacaggttataagtcatccattctcacattttgagtaaacggaacaatcctattagtaatgtatatgcatcttaggtttaacttaaaaagtctccctcttgatttaanacacccttcttaaattgtactgttctctggaatgataataaaattggaaaatttccactcaacatcccattttatcaatccactcaggaacaccctgatagagtgatcagttacatggaacttactgcttgcacaaccttctgccaccaaggctcacaatgaagcaaaaacgtgaaaagctcaatataaatgaaaaatattttatatgatactgtatgcatacttaccaagaatgtttatatgttttgtaataataatttgtagaatatacaaataagtttgtgtctggagtcaatagtcaaaagtgtgcttggagagcaaatagcaagttattctggcagtgaaatagggcaatggactacaaaaggtataacttcaaatgtatcttttccaactgcttttgtctttgttttgttttgtgtaccttcaaaaaattagtctgctctttcctgtggaagcagcactagtagttaattaaa

SEQ ID NO: 7043 - DNA, 673 bp, Homo sapiens
  misc_feature (1)...(673): n = A,T,C or G
aacttacactttcatatggnaggcagatctttgtcaaatgactactccgatgtctacgagtacgaatttcaataaagatttgaaggcaagcctgagagtgctatcaatctgaagagaactatggcaacctccaagaagagatggtctcatcaataaattctggacaaataaagagggataactaaaatttatcaccaagaagttctcccgatgcaaggcatccagttccatgctaaaagcataccgaacttggaaggactttagataagctttcaaggttctaaacttcaacctggtgtggtttgcagtttctctgttgctaggtacagctcttgctggctacagtccattctgcataatgctctcttggattttcttaacatgtggagagacaggttgataatcctgactgaatttcccaaagttactgatttgtgctgtttcgggatacatgaaagttctgattgagacttacaagaccttgggcaaacaaagatggctgactattagagggaggaaattttgatgcagctgcctgtgtagatacccacatacttccctttctatgcattatataaccggatgtcatgccccattccagtcttgtggacttttcataaccagtctttttatgtgttgtgtgtaaaatttgaaataaagcatgatcagcagg

SEQ ID NO: 7044 - DNA, 544 bp, Homo sapiens
acactaggcacagaacaaagagcaaatgaaacaggaactgtggaataacactgtgttcccaaagaaaacataactgccatagatcacagaatgaaagccccagagcacgcagcagagaagtccagcaacaggagtcaacatttacagaaaaccctgtaggaagactgtggcactaccaactgatcaacatgttacagaactcattttatactgcagccaggctgaggagggcccatcacctgcacataaatatttggacagtggcgacaacttgaagacagctagctgcagagtgatattccagaataagagttttgaagctccagatgactagctgacctgggtattaatgctggatatagcaacgtccttctatgtccttctaaattttcttcatgagtagtgataagttatgctgagaaaaattcttgaacctacagttatacaacattgttcttgccgcctttcaaaaatggacaatgtctcccatatggaatatctactgatgatcttgcaagaaggtgaataaaaagggatcggcaag

SEQ ID NO: 7045 - DNA, 1745 bp, Homo sapiens
  misc_feature (1)...(1745): n = A,T,C or G
gcacgagacagagctacagacagaacggcacagagccacaaggacacagaaaggagacggcgcagagcgngccggcgcgnggcgcccctgccgcgaggggccngaccnangcacgcgcgcggccgcgcctttccgcgcagggcgcgcaaaaacaaggngaggacgggaccganngngccggcgcccgagagagagacgcnacgcggaagacggagccgcagagggcgacganacaacaccgaagccagcaaggcggagggcgcgaacgagagcgcgagaancgcaaacgagaggaacgagcngacggagaggaggacgcagaagacaggganccgcaccacggcggaccanagacacgaggcaggacagagagaagaaacaaangcacgccacggacgcgagacagcacaaagcccgacggnaggaagaagaacgcgaaggacgagggagaacagagcgacggagaccaagcgacgcgcgcgcgtctcggtcgggcgccgccgccgcgcggcggagacgcgcgagacaaggcgacgcgacgccgacgcacgcgaacaccgaggaacgagaggcacgcggcacgcagcacccacgccaggcaagagatgcgcagaacggacgcgcgcgcatgcatgagaaggcgaaacagcgacaagcgagaggaacgagagcgaccgcacgcagaaagacgacgccacgagacgcgcacgcacagcacatgtgacgagcgangagcgcggcgacaccgagcgcgncgcagcacgcgctgangccaggcacacgcagcacgcagangacaccaactccancatatccnggagacaagacgaacagcacagagctcaacgccgacgaagagcgcgcagcgtcgagcgacgcggcgactgngcagacgacacgaagaccgacaacgctcgagcgcnagcacacgcgaccaccacgcctacgcgnagcagcgcacgcacagctcagcgcagaagcgcacgcgaccgagcgcgcggcaacgcacgcgcggnacggtagatatcagcagtacgcngcagtgtgcgcgtancacngagagcgtgcagcancgcgagagacgccgncgcgcacgtgacacngacacgacacagagatacncagacngacagagaagncgaagnagcggcaaacgtcacggcgacagagaganacgcagtagnccgcacgagcgccgatccagagcagcgagngcacgagcgtcgacacggagacgcagtgacaggagaccgacacgagcacacgaccgcgcacgcgagnatacagaacagcanagcacaaacgcgcagagagaagcacacagcgcagcacaggngagagacaccacgcacagataagagangcgagcggaagagtagtgcgaagcgccgcacngcgcccgagcaccccgnggcgcggagacgacaacaaganaggangagtagngagagagcagcgcgagaggaacgcgacgcgaagacgagcacgcagagagcanagggatcacgcgccggacgagacaacgtcagagagatgcgatccagacggctacgagagagcacacacnagcagactacgcacacgagcagcaggcgggacacagcgngngccnacacaacgagagacggcatgaccgactgaacgagagactnacgatatacacacacagagtacctggcgaagagcnaatgcgcagcgcacacataaatgcagcgacgcagacacgaccacacanacggacggag

SEQ ID NO: 7046 - DNA, 466 bp, Homo sapiens
  misc_feature (1)...(466): n = A,T,C or G
ccttgttgatactagaccctagttgaagagattaccgacaagtcatcagaacaacctgtgggcagtgtaatgaagcctggcagttatcacaactaccaccgctttaaaatattaagtatgatacacagtagcatcaatttttaaaatgtggtcctggtattcctggcagatcctgagatctttctaggaagccaatgaggtcttcttactcctctgtgtgatgaatatggaaggcactcacactggtcacagtggtcatctcaaggaaaagtacttgtgcatctgagttgcaagctaaactagcagctcttctcctggaatgcattnnttttttttttttttttttttttacagaaaagaatgaacaagtgtcagaaaagaatgtttattcagacttggatattttaaagacattttatcaaaaataaactaagtgagcctgccacttcaaagaaaaaaaaaaaaa

SEQ ID NO: 7047 - DNA, 1114 bp, Homo sapiens
  misc_feature (1)...(1114): n = A,T,C or G
aacnnccagatcggtagngatgantanaaaccgggncnnnnnctnnnngnaanngnggaacnnacgacgcccccggnggnggggggggggggngggggggnnnnntttttnngggggaggaggggaaaaagccttnttactaaaaaaaagagagacgcaccgcacgaaaggagggggggggaagaaccagagaagaaggagagcggaaccggacggcgacggacggccgcggcggaggcgcagccctcctctcacaagaaggacgaagcggcggagacaccgagagcgaacagacgcaccaccgcgcgcggagcaggagagggnggggggagcagccttnccccnttgggggggggggganaaaangnnaagncgagagagagcnagacgggaggaaacagaaaaacagccccaccaacgaagggggcggggggggagagaagcccccacacacaaaacaaaaaacaccgaagcgcaggcggaaccggacagagaaagcagccggggcgaaccaagagagcgaggggcacaagggcgcggagcccggacggccagagaangggaggacgcggaggggcgaaggaggacacgccgcagcaggacacgggacgcgcagagacgacgcgaacgcaagcaagaagccccaaacacgagcggcgcgcgaagaacagaaaccgcagcgcccacaccgccaacaaccccaccacaggcgaacaaaccacgcggaggagggagcgcgacgggacgagggaagaacgaaggccgaacgacgaggcaagcggcgacaggagcgccaaccgagcccaaaggaaccacaaaccggggagcacaacaggagcaccgcaccgcagcaaccggggccccacaacgcacccgccgagagggagagacgcggagcggcggcccaggcctcgacggcgagcgggcgcgcgcgcgcgcgagccggcggagacggcggaacggcgacgggccagccagcgcacccggcccgcagcagaccacgcagcgccgcgggagcaaccacacccggccccgcacaggagaagagagaggcccgaggaacacaagagagagcagggcagcgccgaggagcgagagggaagagcgcaaagaa

SEQ ID NO: 7048 - DNA, 1364 bp, Homo sapiens
  misc_feature (1)...(1364): n = A,T,C or G
cgggaggccgagcgcgagggcgaggagacagaggagacgacggaagagggcgggcctcngggagaaggaccggggggggaggggcttttggggggggggaaacccgccacgaggcagagggccaccgccaacggagacgagagcacctcgccagcgcaagcgagagcacagcgagcccggcgcgaaggacagaaggaagaaaagagcgganagacccgcgcaaagacgcacgaacaaggaaaacaggcaaacgcggagccaaagacccagggagcggagcgacaagaggagcagaaggcgcccagggaaggccaaaaagcgagcaacaagagcgcgaaacaccgggagcagcgacagtcttttttcaacagcggacagcacgcgacacacagacagacacgccccaccaaaagggcgaaagaggcgcggaggacagagacaacgcagggaacaaacacgaacgacagagaagcagacagacagacagcagngccagcagaacgacgaacgcacggcgccgaaagcgcacaccaacagaacacgacgacgcgacacaccaacgacgacacgcggagacataacagagagcgccagaagaggaagggcccccgcaccgcagcggagagagcgagcgacgncgagagcaccccgaacaacagcccggaccgcacgcgacgcacagcaaagacgcggacaaacgcgccgaacaacaccgccgaccgcaaagcggagcacaccgcgcgcccgaccagcaccaagaaaggcgacccgcgcgcagccggagcagaagcgcgccagaacagaacaccgccacgagacanaacacgacacataacgacaacgggaggagacgacaacacaaacacacgacgcgcagagacacgccaggcagcaacacagagaccgagagacagcgacgcatcggcgaccgngacaggagcgcgcgagcgcagagcggcgacacgagcacgacgccgcaaagaccgacacagcggcgcgcacggagcagacagnctcgcagcgaatcagangagagangagacggcgatgcgcgcgcgcgcgcgtcgtacnagccaggngcacgacgacgacgagtcgagcgngcgtcgccgagagagcgacgcgcagcgcgacaccgcccgcaagacacacgagcatcgcgagacagcanancgcngagacgacgcacagagatagcagcacgcgacgacgagagagtcacacgaccagccacgagagcgaaagcancgacgcanccgcgcggacgagcgtccggacatgcacgacgcgcgaagcgcnagaggagtgagagcgcggcgagcaccaanatgaaacaacaacagcacgcaccgcacaccgacagc

SEQ ID NO: 7049 - DNA, 623 bp, Homo sapiens
cctaggtgggacacaactttgatcgtaaaggaattcatctcaaacagtgaaaccagaatcccaagaaagatgtgggagggattttccgagaaaacctccccacgttccgaagacagagacctgtcacacagggccaaggaaaaatcatggagctgggagcaggaggcctggaaatgcaattataaccttttgcctcccctgcacctgaggcttgctacaggccaagtccatctagctatgtgcatagacactccagagtggaactctcacccaccaggaggttgcctcgggagataacagtccatcgacgatccaaaggatgtccgtgacgaaactctctcccacctggagagttttcagctgctttacaacctagtcctgcccatgaaggtgccagcagtcaccagttttaccaccgcctggtagataaagcaccaagttagcgcacagaccccccaaacccgctcgcttcctccctgtgtgccgttcatgttaggcccccttcaaaaagcacttgccttctgctccaaaagtcaagccttaaggcaggaagcctgtacttcttcccctaagctagcttgggaataaaaagtgactctctttatattggaaaaaaaaaaaaa

SEQ ID NO: 7050 - DNA, 907 bp, Homo sapiens
  misc_feature (1)...(907): n = A,T,C or G
ccaggaattccacaaaaatacaaatattaccagtccccccctaataaaaagggtttcatttaacggttttggtgaaaattaaaaaccaaaaaaattttccaatttcatagtctacaaagctggggaacattttttctccagaataaccaaaaccggtaaatttttttccaattactgctttatttgacaaattaaagtttacattntaggccaaaataaaaaattgtactaatgcacacacatagagttaggtaggaaanaaataaccnaattactctttctaaggcctgagatcatagacacacaagcccctccgaatcttgtacaaagtgataaatgattttgtntgattcatttgtcatttccatgatggggatggtggcactggatcttcatttcttagagttgtggagtcatatcagatccaccatccttcagacaccttcagttctaatccagtcttaatttttgacccttccttggcacaacaccaagcctggtgaaatctacctctccacccagcatgcagtggctacgcctttgccaattagccaggtgaaaaaagatattcaatcatgctgacttgtttcatgttaaactcaggaccacaaacctccagtatgctcatggagatgcctggaataataaacttctctgatgaattctctcaaaggctctgctaaatagttggcaccttcttctccctcgtctaatccccaatccttcctgctccgtcttccctgttagcgtatgacctggcttcttactacaccgaaaaaattctaacagtctgaagaaaacatacacaaaccaccaccaacccatttacccatgtgacaataacattcccatcttctgtgccccctcttttcataagagagaaatgaaataaatcagtatcgcaaag

SEQ ID NO: 7051 - DNA, 942 bp, Homo sapiens
  misc_feature (1)...(942): n = A,T,C or G
ggggggagaccaacagaantcacacccgcnnnacgaagcttttcggccaacaaacccccaaaattgacttggttttgctcctgggatctctgaccccggccaaagccagggattcgaccgggggttttaagtcccccctccctaagggcccacgcaggcacgggcgtaaagagcgcctagttatcaactctatcttgagaggcctctctctaataccccacgcgcccggggttttcattgtcccttcctttggaaacaacattaatggtaaaaagcaattttttttggggggggacactcaataaggggaaaaaccacaggcgaggaaaacgaagtactttttcttcccttttccaaaggaaggagctaaaaacaaatttactctaccccgaacctctcaagcccgaaggaaacaaccatgagtcttgataaataacgacgcgatcttaaaaaaaagaaaatattaccctcccccactatattggtcaacacaaacctctctcaaaaattaatacacaaccctccttccccgatggggtctgaaaacccctttacaacaaggattctattgatgggtacaacgccataattgaggggaggactctcttttctcggagaaaaaagaggaagggatcccactctccgaggagcgcggggagtgtaacttaccacagacgaataactcgaaaagtaaaaagtgcttaatcttatcttgagagccccacccaaggcgaaaagaaacgaaataaatatatattcttttcctaaagtagataaaatctccaccatcttcaccgtccctggagatatgtaccaccaacaggggtaaaagagatgtgacaatactccttataatccactgtgcacgtaggtcggtttgtagaactagtgcgtcgattcgaaagaagatcgccaacactctctcttatcaagagattatcg

SEQ ID NO: 7052 - DNA, 820 bp, Homo sapiens
gaccacagcaacggtacaggaaggaaaaaattaaaagaggaccttgataccgcgagaattccttcacaatagccgagtgttcatcaaaatggatatgtcagcatgtgaatccttaacattggacaattacttcagcgagtcgaaaaaccttagtttaaaaaccgaccaatcacacttgaggaaaagagatggggacaacacttggggaatgtgtcttaacagggcgcacacacagatctagctgtgtttacactcgacttccaaatataatatgttttcgtcggcaatgcaatgcacaatgagcacgggtgatgaagcaccgtttcgtatgaagactttcaaatgccaaagcccaggtggtctcggaaggcatgatagagaatgtgcttcaactcttccagagttatcctttgcatgtcaaactgtggagataaagagtagtgagatggtcagaagcatgtggagatgggaagttggctcgggccatgacaggccagacccacagctgctctgcagaaacttgtctcagcgtttcaggatatcaggagaggatgatatctccttgcctgttgaagtcacaagcttagaccaatcaactgagagccaaagtgatagaagtatgaaagtccaaggagaagcttcaaagccattgtgttttctgccatttccctttctcttctttcacataacatttacacaaaagaggggctgctgcttcattctaggttctggaatgacctaggaattcaacctgagtagatcctcaaccatcccacaaaggacgcgggatctgagtgagaaataaatgtcgataaggccg

SEQ ID NO: 7053 - DNA, 832 bp, Homo sapiens
taagagatgaagctcctgggagagtacggctgcatcaatcgggttcagtctgcatttttcccctgcggggccagggagattaaaagtttggctcaggaggatttccccacagcacagcacagcagctgtggcagatcatggccagactgcctctttaggccagacctaaacccatctctactcactgcatggggcctccctataggaatttcaacaactccctagagctaggggtttatgaagggaactctgatttcccagggacagagccccttgggggaggagcagccatggtctctgcagatcagcagacttagtctttccccctgctggctctgaggaatctgggcagtcctgaccagtggcattccccaccagcacagcacacccctcctgtcatggagcagccagagtgcttcattaagtgggtccctgatccagtgcctcctgactgggtaagacccccaaaaggggtctccagacactttatacaggagcattcccactggcatcaggttggtgccccttggggatagagctcccggaggaaggggcaagcagccacatttactattctgcagcctccaacggtgacacctgcaggtgtgggagggaccaaggtaaatagggtcttgagtggacccccagcaaactgcagcagctctacagaagagggagtgactgttaaaagagaaacaaacagaaagtaacaacaacagcatcaacaaaaaagtccccgtgaaaccccattcaaagtcaacatcctcaaagattaaggctagataaattcacaaaaatcagaaaaaatcaacaataaatgccgatcagaccg

SEQ ID NO: 7054 - DNA, 828 bp, Homo sapiens
  misc_feature (1)...(828): n = A,T,C or G
aatatagtcagagttagtcaacattctacaagcctttttttacaattatatgaaacttccagtgggttagggtgattctaaatattctttagtcatatgctagtaattcatttttaaatagaatgaagaggtctaatttttgtatttgtgcaatattgtatacatatttatatacaatccaaaggatacagtcatccaaatatatagagattgcatgtttttatagtactgcaaagaataacagtgttagtttataaattcaaactcattttcttatataggtgagaacaagccaaaaccatattttttccaatggttatgattaccttatgacaattaaccctctacaatattattattatttgggcagtgggattttgaagaaaataacaaaagacagaaaaatagaaaatattcaacaacaaagcaggaaattatgttcgaccagattgaatactcaaattgtggttaaactgatggcctgcctgatattctacactgattactccctccccagggagatattataaacaaggatttactgtcaaaatattttttatttgtctgaaaactaatttgccaagcctggagatacagaggtttggtgcagatgggaaaagcaacctgttcctctgccttgaaggaatcagctgtagagagaacggcagcaagtggaatggaaatgtcacttcagccccgaagcttcgtaaatatcaggaaagaagacagtaccaatctcccagcccacagctcacaaagccactctctcttccagcaggtattaaacattaatgaccatttatataataaggggcgagaanggatcgg

SEQ ID NO: 7055 - DNA, 827 bp, Homo sapiens
  misc_feature (1)...(827): n = A,T,C or G
atggattgatttccgcactcccacagttcttgaagtataagcgggttaggcaggacaaggtctcacaattcaccaggtcccaagggtctcaatgttcagggcccctattagttgctgtaaattcccggcctgaaggcatggatcccgccactacgagtgccccacaggtgtgcggagccacaacaggagaggaggagcctcaaaagcatgatcaggtttcacccagcagcagcaaagaactccccagtgtcttccagttatgagctgcattgatgtggacttcattgtctcaaaggcttcgaagctcaagccaaatatgtcaatatttgtatgtaagaaactaattatgtaataggtaatgtcctgaaactattctatgcccttcaggagatccagtttaattcaaggtgatctttcaccccctgtacaggagtgtaaactcaaatgtgctttagtccccaattgtgagaaccggtgattggtatgttcaacaaatttgtgtatacagagaaatggataaatcgctgctatataagggaaactaccttaggaaagaatgtctactgaatgtttattttatttttttttaaaaactatagagtgaggggttgccccaaagaatatatattggtcattgttacggggggtatttacagtcagcaacttttcgctgaatttgatagattttatgtttggccagatcctcatgctcacatttgatttctgaagttcctccaacaaacacttcaataaaaattaaatggaacaaactccctcttttttgatttactggtacatataaaaaaaatntaaattcagatgggccg

SEQ ID NO: 7056 - DNA, 1483 bp, Homo sapiens
  misc_feature (1)...(1483): n = A,T,C or G
agctaccgttgattagttctgtttatgtatggtgacgtgatgtcgggtattgtctggtcttggtacttattagatgggtgtgtacggcttgtagttgggtgatatcgtcctgattgtagtgtgtcctagagtgggatctgtgttctggncctgttggcgtgaatggttgtcatgtggtggtgtcgtgtgtcgagtggggaggaagtgggctggtggtggtgtggtgagatggagtagtggttgtgacaatagacgtgggcgggtgggaggagtgaggagagggaggcggggaggcggcagggtcgtccggtgcggcttttacgctgcgtgttgggctcgtcgatgcatttcattgagctttcggttgcgtgacggtgcatcttctgcgtgtcagcgcaggcgcttcttgtcttctctcgctgcggttgttgttgggcggttcggcgcggtgtgtggtgtttgggtgcgcagcgcgcgcgcgcgtgtgtggtggtcttggggcaggtcgtatatgctgagtgtgcgcttgttgtaggctgtggctgtgtgggtttgtattgcggtaggacgtgtagagtatggtgctgtgggctagcgcggagatgcggtgcgtgtcgcggcggtnggagtngggtgttgattgtctgtggtgcggttgagtgcggcgcgagcgagtgtagaggacaannacanacatgcgaggtagnatcntngtgtgttgtggtgagtgaggtgcgagttgagtgaggtctggtcgtgctcgttgcggcgaagagggtgtggtgtagtgctgtgtgtganagtgtctgatgcgtggtgggatgtcgcagaggagtgttggtgtntntttggnagtnagtagagagnaaaagtgtattatagtgtgatatggtggtgcgcgtgtctctctcncagacgtgggtacgtgagagcttctggactcgnggtatacgacattgactgctcttcacatgtcngtgtctatgtgtacttcncnttcgttacgantgtctatcacatctntgtgcgtatgttgtgtctgctgtntntgtggtgacgatggcgtgtggcggtcgcgtcgntcgntgcggctcgtntgtcgcgtgtcgcnagtgntcactgatgggcagacgatctgtgtgtgtctgaggagagagtcgcgctncntacgaccanancgagatanccatacatatgctatanagtanagagcgagantatagagatgatagagatacacattacanatacagctagtagagatanatgtagtagagatatatagaggttgagatagacacactatatatcaaaacanatnanatanagantntcncnnaggtntccgcntgttgcgcaagcccctctctcttnttcttctntntcttctcttctctctcctccttctctctctctctctatcccntaccctcnccctcncctccttctcctcntnttcnnnccncnctccccccctcccttc

SEQ ID NO: 7057 - DNA, 830 bp, Homo sapiens
cacatcagggcatttatgtcattagtaagaccatcggtcattaattacctgggctgcaagcacaggcatgattctatcatacatgcaggtgccgctggggccacactggcttttggagagatgcagagtccgttcggcgcagaaaatgaacatggctctcactcagggctctatcttccctctaatgatactcttctccctgtctcttcatttgcttagcatcatttttttttttcattatgttccatgtatactgtaggcagctttaaatctttcccagaacaaaggaggatatgaataaaaaggggtggtgaaggtactgggggtccatcaggcacactgctggacattctgaggaacagtggcactgcccgcatcacaaaattgctggaaccagacgacaacccagctcctgctgaaagcctcctcgcctccccacctatgtttgcaaagggctcattcctggatttaaagaacacaaacaaacagtcttatcacatagttaactagtacatttttctcctgttcacaaaaggtggcttttatttatggaatatgcaaattttagtcaatgccctgaggagtgttcagaaattcgagatacattaaatgatttataagtgacagcacccatattggaagagacataagcaagggcacctttatagtataactcagttaccagtaagccaaatttctgccaccactaaaacacaagcctaactcctttgtgtcaattcatatcataaaagacccttaatggaaccaagactcttttctccttttccaaattcattgtctatttattaataaaaagccgatgcagaccg

SEQ ID NO: 7058 - DNA, 853 bp, Homo sapiens
  misc_feature (1)...(853): n = A,T,C or G
acaattatccttaaacggttaaagaagttttactttaccagattcctatcttgtttttacctcccttgttgtttcagcataggctgaactacctttgagagaactttatagtttaaaccaaaaatataaccagccctttccccaaagcacccctccttcttgcctggggactagattccttttgtaggactaccattagctacaagattagacattatggtttaagagtcatgcanctgcaggcttcaagattttcttcaaatatctcagtgcttgagatattttccagaccctgcaatgcccggatcagctggcaccacccagatggataaactggctaatctgatcttgtggctcccacccaggaagtgactcagcacaagaagacagcttcaactccctatgatttcatttccgtcctgaccaatcagcactcccgggtcactggcttcccccaacccaccaatttatccttaaagattctgctcctggctgggcgtggtgactcgcacctgtaatcccagcacttttggaggttgaggtgggtggatcacccgaggtcaggagttcgagaccagcctgaccaacatagtgaaaccccgtctctattaaaaatacaaaattagccgggcgtggtggcacatgcctgtaatctcagctacttggtaggctgaggcaggagaatcacttgaacccaggaggcagaggttgcagtgagccaagacagcgccactgcactccagcctgggtgacagagcaagactctgaaaaaaaaacacaaacaaaaaaaaactctgctccccaaatgcttggggagactgatttgagtaataataaaaccagaatgcgcccg

SEQ ID NO: 7059 - DNA, 1385 bp, Homo sapiens
  misc_feature (1)...(1385): n = A,T,C or G
tccgcgggatgatatatgcaggtatgcggcggataagtcagtgaagaggagcctagacggggacaccactctgtttaatttttccaccgctcacaacacagaaagaagcccacatcccgtgcgtagagaatagtggaagggttttgacttccttccactgatcgctccgagaagaaaccgcgcagagagagggacgccgggagccatacatcagtgcgacgtgcgacgttattatggctagcgtttcgttgatcggtattttactctaaacatacgcatagagtgatgactcgcgtgttactccccccggtgtgtggacagggtatttatgcgtaatacgcttagataggtcactagccaggacagacggtgttaatgtgacacggcgtgggggaggggcgcgcgacgcggttaggatggagtcaggcctggagagatggagaggttcacatcgcgcgtcgactcatgatgcgtgcgtggaccgcacgaatcatntaaggtcagacggcatcgacgacagaccgtcgtagatgatgtaagcacttcgattactcgatcgattctatccattgtggacgcggccacctcgccgtgatcgcgcgcgcgcgctcactatacatgtgcctacgtaggcttacgccatagcttgtattatacagcaccgagcgcgatcacaacacccccacctattttgttcgcggatatatgcggntgttgtcccgtcgcgacattagtctctacgacggaaatagcgcgccggcgccacgctatcaaccacatgcaaacagcaccggtaaatatanatacaatatatacgcctccactcgctccgcattatcagagcctgacgcgtttaacatcgcgcccgcgacgagctgatcagacggatcctccgccaggtantttatattagcgactgcgcattcacactcaccgcgcctatatttgtatgggaccatatcgcatgtagtcgacccatatagactcgtgtgtacatcagcatctttcagtgaccggccacggggatactatntcacgagcacgcagcagaagagtgtctcacagctgatatatatccgccatatctacatctacgattctccatcacgcatgtgatagattaatgcatagatcgccccgccaccgacaattgatcgcacnatatatgatatcgccgatagacataatagaaagagcgcggagtcacccgacagaagcacgtagtatgctgatgtaggctagtgagtatatggaatatgatgnacgtaccgccaccgattaccatatgcgcacagagtctacctattcaatccatccacgcgagtatattcagaatacgcanatacgagancacctcgcgatgactcacgagcgtagntgcgcgg

SEQ ID NO: 7060 - DNA, 1508 bp, Homo sapiens
  misc_feature (1)...(1508): n = A,T,C or G
catatgagtanactatctgtctgcgngngcgactactgctgtctcatacagtatactatgtctgtcgtctaacatgatcagtacgnanncactcatgctgtggtgtntgctaacatcgatactcgtnacngttcagatcgtgcgcgcactactatctctcgntngantctcacacncgantcgtcatgcagngaagcgacgagtcgggcgtnttntgtggcaggtgacttagtcgatngatctatntttctaganagtctttgtgtggagatcgtatagtaatagnaattactagtatgtcttacnaacatcatagggagtcatatctatanccgtgatggatatgttgctgtgataactcgtattgagtgagtgactcgcactggtgcgcacagtgtgcgttcggctctcacgcgncgcgttctctctcgtgtagtacacacatctacgtctcattactaacactgcatcctcatatattagantcaactatcaacattgaactctntgtcgctatcgatcttatngnatcttctcgtacctgtgattcaatanaacttcacttctgctatcgcacacgangncagctcggcgcgcgctcgagcggagacacggaagagtggcgtagtgagatagtgaaacagtagaacgtaatacataatatagtatatattaatganantcgtatagtcttgtctattcatgcgacaggcgcgagtcacgacagacacattcaccagcgcacgngcgctaattgatgataccatacngaggacgcgcagtaagtatatanacctactgcgcctgaggttgttgtcctgcggttgtgtatgtggcgggacgtgtttggnggtgttgcgcatcgtgtggtctggtgtanggcgcgtctgtgcctgctttaagacgaagcagtngctaccgtgccacattaatcgtagtattcatggggctattaatcatgtntgcttccgggngacattatcttatataacgtgtcgagtagtggctgtatgggactgagnnncgtctcgccnngcttatcctcattccaccgtcaacggacgtnnactccttgtgactgaatgtatattgtttaatgtacatagtatttgttctatacttaccttttttgcgtctggnactagtcgctttctctactactttccctcctcatnnctctctcncttctcttcgtctcttacatagacactaccgtgaaataatatatctctttcacaatatttgtctctcaccgtgacataagtttcatattgtttctctctctctctttccattatccttcagatattccccgtagcgacttagactttcaactnnanctctcaccatnagnaccttctcctatccctccaatgtgctaccagttctcctgttttcctcctctcccaaaattctcttnnnccctctncatctccttcctttatcttnttcccnccttntctttcttctttcttctttttctttcttttttctacttttctctctct

SEQ ID NO: 7061 - DNA, 1223 bp, Homo sapiens
  misc_feature (1)...(1223): n = A,T,C or G
cacccacctttanctaccgctactatgtcanntgacactacacactatcacactctctgtcaggttaatattctcaccgtctatngccagctcagtgtattttgattggttgctactcgagtacatgaactagcctcctcctcnccttcctcccgcttgccccttctgggcgatgngcgttgcatgcccgacgcgtagtgcacgcgagggcaccacctctgtganggctctcnccatatatangcctctgttcatcacatgttacatgtnacatcttanntacactctntgacactgtacgctcatatctcgcgtgttttcagttgcggtgtcagtgcgaggtcggngcaaaccatcatattcctatctgtnnacatcatctctactactcccctgctaaccccactgtactactatatctctgtcatcatagccctagnnnaagcaagtagatctcacacaaacaaacagacctgnacactcggccacggtaataggctatttgtttgagagacgataggatacacatgcactcaagttgactgccaccaacatacnacagagtcgacggacgacgcagaaacgcgtgagcgtggcgtggaccggaacgcctggggctggtgtgcgtgnangggtagcgctgtgtggtatgcctgatgtcgatgtngccccttgtnaccctattgacaattcagcacgcgggatacataatggttactntcgtncctcgcctctatnatccactcctttcnttccttgcctctctnnnnccgactatcagcgtcgcgtataaacctcatctctcaatcatatccatcccttactcatagactgacctatacattattnnccctcaccttaatccttcctctctnnnctcacttcatcccactccttnnnctctccctttctcttctccttcccttccctcttnttctcccctactcctctnntcttctcttcaactttattccccctactccctttttttatttaaatatttactttttttacntacttccctctatctcactntccctccctctcccttccnncctctcccctccacccctnccnnccnnccccaccnnnnacctnntctccctcaaanctnntccatcncacaaaaanccttncccnccgccccnncccaaactcctnnnnccnccctcncnnnctcctccttcctcccccctcccctcccctcccctncccccttctcc

SEQ ID NO: 7062 - DNA, 819 bp, Homo sapiens
  misc_feature (1)...(819): n = A,T,C or G
cttgcgatctggctttattttctttcangagggtatattcaatggtttgtattaagtaagcgcattataaacaaataaattaagttaatgtgctcttattattatatgtaacctgggcattgatatcccgtatgccacagacccggcaggtaaccgcctgcccgacccggagctgcacccggacggcaccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatattgcagagccgctggtccaaagccgttatcttaacgacccgctgggcccgaaggtggcaaaacgggtgtggcgacgttaacgggacctgacgggcttgaatgtttctgtcccgaaaccggaagggacctggttcggttgggacggtgaccgtctgaccctatacaaaagacagacccggattcataaatttattggccggggagcttccgccatttataagggtgaaaccccactggtgagctggcaaaacgcattgcccagtctggcggatacccttaacattcggcggggaagacgggggtggatggtgttccccctgggctggtcggatgcttacggggtgaaaaaaaattcttgttacccggtgaggagggaaagcccataggggcggcagtttggcttgggtggggggagagaaatagtggggagttttgtctcag

SEQ ID NO: 7063 - DNA, 738 bp, Homo sapiens
caggttgccccattcatcgtattctgcgcaccattctgttgccccttccgtgctgacaagcgccagcggcaggccgcgatggtctgagtggtacaggtggatttttcgcgccggagtgtacaccgggtccatctggttttgcatctgatacaccgtaaggccgcacgatgccagccagcggcggatttcctcactcacccggtcagccaggatttcactttccagccggttgagcatctgcaccagcaccggcgggaacaccatactgccaccgtcttcaccgccaaactgttaaacggcatccaccaggctgctgaactgccttttcccccagctcaccatcggcggcctcaaccatgattagtgacatgaagctgcccgcccgattaaacgcccgcatgcaaattctgttattcgggcccgctgaacgccgtatatagtgaggcccacttcctccttataatttcttccacccacatataaaagaacgtaacgatccctccgcgatccgttatatcccctgagccaatcactaaaataaatagcagcatagatagaccgctacacgagcttattgtgcttatgagactaggacaaccagaaatatacacaaataccaaagatagacgataatatacgaaaaatacactcactcgatacacctatctcatcacaaagcttcgagttccgccaagttcgtcaatatctgcccccccaattagatatattcccccccct

SEQ ID NO: 7064 - DNA, 1838 bp, Homo sapiens
  misc_feature (1)...(1838): n = A,T,C or G
cttatcgtcactcgtggtgtcgtagagtattgacaacgtgtggttaaatagtgcgtccgnagagcgctgggtgttatgtggtataactggatatgtcttgaagcgaggagtcgaggntattagtggagtggcgagtgtgtagtgagttgtggtnagtcgagtgagtgtggagtgagtaagtggctgtctgtgttgcgtctttgtggtgtggtatagagactatatagatatgtgtgtacgaggagagcggtgatgatagtnggtggatgtgtcgtctcattattatggtgatcgatgtggtagatgtgaggttatgaggtgtgtgatacgtcggcggggcagagtgtcaagtcgtggtgtaggtgtttagtttgtnatgcgatccatatgtgtcgctgtggatatatgtggtgtatagattgttgtgttgagntttgatcttatgtatcnctggtggagtggtgtgtatattgtgctatcggatctatnactgtgacttatagtagtgtgtgattggtgtcatgtatgagggttgtaggtgttatctatgtacgaggagtggtggatggtgatgctgcgagatgtaatgtatatcaatagattattgatctactggtgggggtgaggtgggagttctgggttatgtatgtgtaggatagttgtatagagtgatgtgagagacgtgtatagtaggcgtggtgngtgtacacggagatatgaataaatgtgatgaggcttctgctagtgagtgagatatgttgcggtggagtatgtgagtatgcagatgaatgtatgttctgtggagtcgagcgtgaggatggtgagtggttgtatctatatttatatatcgggttaacgagtgtttgtggatgcagcatacgcatcgaactgctgaggtagtgtaacatgcgttggtatctgtngtataatattaaggatgtatgtcgcaatggttnttgangcgagcgtgcgcgttgagcgacaggatgtgatgtggtgcgtgtcatgtatgttatgtgtattgctgcgtaactaagtatagatggtattcgttgtatntatgtggtgtgcagagtcgctccatgcgcctctctgcttgnggcgaatagaagaggagcanaatgntacatattgnagccggcgcgtgcgtgatntacttgtttcggttgagtgttgnaggtggntagcactgtgtgatganatatatatatactgcgacagggtatttgtcggntgtctaggcgtctgagctntagagctgnttatagtagcgacngtgatgacatatagtgcagttcgctgatgntnaactgatagcagtagggcggatatggagcgcggtacngangagtggataggggagtcactagcgtactcttggcgctgcgtngctacattattttcattcttcagaggatctatagtcctggctggctgagtgacatatgatgtanganagaaggtgtntataggaatgattggtgncagttgntcgcnctctncacgcacgtctgtgctcccacagaagagaggtatgtacgataanggcagngacgtagggtngngtgtggttgttatnatacagactattgtacggtagttatcanctgtgctcgtcngggtcgcttnctctgtgtgttttgtgntggtgacnatcnatantaaaccacgagagacttatgngtatcngnttgtctgatggttctatcggcctngctatgtncngaggccgttgcctctctctntctcnctcttctctgtccgnttgnctcgctgctgaatcgtgagttctgatatntgtattaagtgtacgtgagtcgacatggagtgctgttgcg

SEQ ID NO: 7065 - DNA, 1087 bp, Homo sapiens
  misc_feature (1)...(1087): n = A,T,C or G
cccctgcgtttcttgctcgctttccctgttcttcttttctctccgcctgtcctgttgttttcgcgccgtctttcttctggtccgttcggtcagcttggtcttgccgttctgtgttgtttttgtctgttcgcgtcgttgttgcccttgcgcctcggctgctgcgtttctccgcggtctgcgcctacctccgtctgggtgtcgtgcgcgggttcgttcccggcttcttcgctgcgttgcggcttcatgctgtccgtgcctggtgcttgtcccggtcggtgttcgtctctttctgcgttcggtctctcttggttggttgccgttctgcctgttttttttttctcgtttgtgggttggtgcggcgctttcttctccggtgtggtttgtgtctctccggctctgctcctctgtgtggctgcgggtcggtctctctttctgggtcctccttgtgttctctctggccgtctttgtccttgggttgggtgcgcggggtgtctctgcgtctcttctcttgtggcgcggctcggtctctctgtggtcttcgtgggggcgtgcgtttgctcggctctggcggggtgttttcgccgttgtcttcctgctccggttgttctnttgttcgggtttgtgctggtcgttgctccctgtttcttcgtgtttgctctttgcgtgtgggtgtgtgcgtggcctgtcggttgtgtgttcttatgccggtgtgcgtgtcgtcgtcgtgggctgtgttcctctcttgtcctcttcggtgcggtgggctcgggtctcgtctcttttgtttttgtgtctctccctttcctggctcggcgccgcgtgctgttcttctttctcgtgcgttctcttccgtcctctcttgtttgccctccgcgttcgtgtcttggctccgcttgtccggttcgtcccgctccttcgttcccggtcctggttgtctcctcttgtgttcggccctcgttcgcgtgcgtggtttcgcgctgtcaaagtctcttctcctttgtttcccgcgccggaagngcttcttttctgctgctttgtggcttgttctgtctgctctgctctttgtggtgtttcggtgtggtgtcgc

SEQ ID NO: 7066 - DNA, 1502 bp, Homo sapiens
  misc_feature (1)...(1502): n = A,T,C or G
ccataaacatgaatacaagataatacaatcagattagatagcgtgaaacatacacantntatagaagtagagttagcgtnatagcacgcggccgctcagtctcgntactncatagcacatgcatggaacacaatacacgctgcgacattcttgnttggcatctctatattgcacgatacagaacgcacaaatacatatcagacatatggaggtaacatactacgacatacaacttacttgcgccgnggtatgaacatacaatatatgaggacgctaatgcacgtatattgtgataacgtaagtctcgtgaaatagatgcagtggtgcaaaccgggtgttgaaacgacaggctagaaagcgcttacaataataaagtacatacataataaatcacaaataaatatgatagaacacanctgttcagatgagtatagtcacagtcttatgtnaagcgngatagacagcatagcagcggaccgagcgattagaaacaatataacgatcccatccagatacatttgcgattcaacatagaacaatcctagcatatcagctccacaagtattaaaatgattgaacgcctccgcgttaattaaatacacaccgcaaacatcaagagatcacagataccagtcctcgtgcttcaagagaggcgctagtgtgcgccgacagatagctctgagcgttattactatctaanatgtaaacagtagatgatgaatngctcatcatgttagttgagtactcaagtgcacttcattcacacacgctgacatctctccgtagcgtagcatattgtgtatatatgtatnatacaggcaagcgacatgcacgaattactagtatcagacagtaacaagcagagagaggttgcaananaatatgttggtgtgantaatactctgtaattggggacgtccaantcacaacgacgctcagcttctaagatatagtngaggcgagagatacgattaacagagagaaagcgcacagtcctcatctagtcnagagggcacgcgatnactcgatacaccgagccaaagtnagangacacagtgagatattatgatgagatatgttatcactatagtggtgacncgantaatagtgcagtggagatngcacacagaaggacaagcgtagcagagggagataactacatgtacgatggcaccacaccactataggagcatatatcgcctagtatagagaacgaatagactatgtcacacagacatatcgcataaacgacgaacgaacacgacaccgtgtggtgagtgaatgattgtatatttgatatctaagtctcacgccccccgcccaaaaaaaatagagaacacgcaatcgcgaacgaaatggatgagagagtgagagaatgaaaaggagtaaataaatgaacaataaagcgctgtgcgnacgacgggtgacgcagaacataatcacaactacacaaatctatctatgatcgatgtaggtgattgcagctaagtgccaacgacaca

SEQ ID NO: 7067 - DNA, 1065 bp, Homo sapiens
cttacgtatggcgggaatgatataataaaaggaggtggagggggggttagtgaagagaagggaaaggatataagttaataaaaggggtagagggatcatataaggagttagaagcatggaagctgatgacgatgaggctaatatagtagagcgaggggggtaaatagttattatgggaatgagtagttgtgcatagctaaaaaagatcgtacaagagaggttctatagtgtgacgagaagatatatgacattataccgagtattaggagtagaaaatggatagcttataattgggaggtggtgattcttttctcggctgtcaaaaaggtatagatagtggaaaataaagattagggagcatagaggaagtgtgatgtaggggggagactgtgtaaaaaattagaatcgacgtagggagggttgggtaaaaaaatgaggtggtgagcagagatggatgataggtggatgggggggaatggaaatacgtgggcttgagaggttatgagcgttatttatgtgggtggtatgagatgtgtaatgacgagatcgagaagagtataacgttgaatatataggagaaaatgggggaaatagaaaatgaagagaagaaaattataaggaatatttgctgatagggagggtaaatggtgggggggcggaaggtggttttctttttatgagaatgggtatgagggttgagtggatgccccccgcgcgtaagagagaagatattgttaatgtaaagtgaaatgttagaaaaatataatgtgtgtgaggatagatagaatgaagattgagaagatctgagagagaacaaggtggggtgagatggcaagggtatagagattggcgaatttaggtcaaagagaagagaggggacaaagggttttttttttttgtttgaggcacccacatacccccgagggagaaaaaggagtaaagataaaagaagaatggactcgctgtgtaaactggtagtatggtaaatcaggaaatgagagagtcgtatctctctataaaatttttttggtttggtgtataaaagataagatagattgtttgggt

SEQ ID NO: 7068 - DNA, 946 bp, Homo sapiens
ggtgtagagcgcggacgatatataaacgaatgttatacgcgggttggacaaaagtatctggcactctctgatattacgtactcattttcagccaaagactcaattacgatgtttgcttatagactggcacccgacactcgcgcagtcgaatagatcgaagggataccaaaaagcagggataagaatccggttgtgtcttctgtcttctcttgcttgtgcgtgttgggtgtgtgtgggtcggtcctttggcgctgcttcttgtccctcttcttgctcttggttttcgtcgggtgttttgtgtgttgtttctcctcgtctgtcgctgcgtcgtgctcgtctgtctggtgttttcgcgtcctcgtcggtgtttctgctctggcgcgttgtttgtggtggtgcgttcgctggcctctctcttgtgctcgttctgtgtggtcgtgttgggtggtggttcttctgggcgttgtgtgttgttgtgtggtttgcgtgctcggtcgtcctgttgtggtgcgcgcccgctttgtggtttgtggcggcctgttttttctggtcttgtgtgcggctgcgttctgcccgcgctgcgcgtctggctcccgtgttggctggggggttgctctgctggctcccctgctggtgggttctgcctctctctgttgtttcttcttgggccttcctttgggccgtctgtcgcctcgcgcggttctccccctctctccttttggttctccgctctgttcctcgtttctctcggtctctttcttcttcgccccctcgttctggctgtgcgtgtttgtgttgtcctgtcttccctcgctctgggtgtgggtcgttgtctgccttgttctccgcgctttttgtctgtttcttggtgctcataaataaagcctgttgcggccaaatttttttttgttcttctctcgtatccatctgtcatactgtgtttgcg

SEQ ID NO: 7069 - DNA, 961 bp, Homo sapiens
  misc_feature (1)...(961): n = A,T,C or G
taattaaatatattaanaaatgttaaaaaaggtaaaagaaaaattaaagcttttnaaacaaaaaaatatttgaataaaacctaagatgaaaggggttttaggtggtttgattgtatggaaagttttgatctttgggtaagagtacacccctaaaaaaacaacaaaaagtgaaaagacactcggacccagcggaaccgaagttaattcgcgcgggcgccccggggggccgcaagggcgtccaacaaactagggagggggggtggcggagcgcgccgcacgcccatctccggtccgcgtcggccaccgcggcagtcgagatggaatagagggaggacagaagttagaggaaagataagtaattaagagtaggagccgagtagtgagggcgcaacgccccccagaccccgacaccgaagcccccaaaaccagaccgcgcaaacgaagagacaaccccagctaatatctcttcttattcccaccctacccacacccaagcgcaccacgcacccggcggcacgcgtgacggtcgcaacgcagtagctgcgcgcgcatatcggccataagacgccttctagcgcggaggaccgctcgcacgcccagcagcgggacccacacgcggaacgacgctgacgcgcgacgctggcacaccccagctccacgcacatcgcccgctctgccccacacaattcggtgaaacggagcagtggcctatctcgatgcctaggatcggccgtggcagaaacgcggaagaggcgtgacatcgccaacccgcccgtagccattcacaagtgactggtgccgtgagtagcgagcggccacagacatcagcgatgataggaaacggcataaccgccacaaccatagtagaaatggaatcacacaagcgcgacgatcatgacccagtctccacagcgtcggggtgtgcgccagccgagtgccgggctcgccctcttatattaca

SEQ ID NO: 7070 - DNA, 1457 bp, Homo sapiens
  misc_feature (1)...(1457): n = A,T,C or G
cgtacggtctcgagatcgttctgctaggngggtgtcggcgatgagtgcgtggttcgatcgtatgngtaacattcgtcttgaggatctagggggagtagcggtgctatcgtgcggtgtgtagtggaatactcctgctaatgtantaactctagtggatacgtggngnaaagacaaacaggcggatgctaactatgangtaccaccatctgcttgttgtgtngcgctgcactctttactgaccatgcttagtgactctgccgctagcgctgtngggcggccatcgtagcctgaggtggctctggagtgtactatgattagcttgtggagcctgtaanaagagaacatgaaaatgcaagattactatggtggaaggtcgttgcgtcccatttgntatcattgtacttgtaatagcgtggactggctcacacagaacaacagaaagcgaacaataggagcacgcggataaggtagagatgggtggaangaatataggcataatactagaaacgttcatacattacctggctgaggcggcgcgacacgcaggggagcggcgggtgataggaggctnatctctggtgtgggctggaggcagacgagcatacgctnnaccgagncaaatgagnnggngtgaccgattagtagtctgtacgagtcattccatgnaccatccgacactgtggggcgcaggacgcgcgggcttcgtggtgcgctgtccgagagtgcactcaggagaccatatgctattgtcgtattgctttcctgtttgtctatgtcaaacacgtctnagtngcaacatcgcgacacanagcgtagantcgcatgcgccgcggcgtctctgtgacgcagctcagatgnatattgtgacagctgtcntgtcgtgctacatgtttannntaaatgatatnaaccgtccatccgttgtttntntttatnatctcgtaacaaagaaactgtggctctggcatagcctctcgtannagcctgtnctcctcgattgaatattcanatctggcatctcgatctgctagagagagagtcggtacactagactgtctcaatactctacntctatgtgtttgacaatgtacacatcgngtatatcacacgtgactacgtcaccaagaaaatntnacacaccttagttacatatacatacagcttantccgctttgctatctcgttcacgntatgtcttgnananantnacanananatatacatanananatatacatagananatagacagacacagatatagatatataaatatacacaganacatagacatatntngagatagnnccacttgtgattgacngttgcncagaaaactattgtatctttnatattccatacatctattataaaannnnantnnnnntanctnncnttttntnnntcntttnnnnnnnnnnnncnttttnnnccctttnnnnnnnnnnnnnnntttt

SEQ ID NO: 7071 - DNA, 764 bp, Homo sapiens
aagcaggcagtataaggggtataatgttgggaaaacacattatttatttatattactaggtcagataatgtcacgttattttgtgtgaggaggtgaatctgtggctaaataaagtaaagagagtaaaaaacaagtatggggaccatatattaatacagctcttgctccttctctaaaagattattctcgtagacttatttattaacaaggattaggagtgtaaaaaaaacgcaatgggtcaacgtttaaataaagacacttattttggaacaaaaaaaaggggaaaaaaaaacactgttaaacataataggccggggtatatgtatttgaaataaaagagttatagggtgttttttcttttttacaacccctaagagtgggaagacttttgaaaaagctcccccttctttttagggggcgtgaggaaggttttttttttataaaacaaagggggttgtccccacccctgaaaagaaaattggagaattcacctcaaaatgttggttttgggaaaaaattgaacgggaaagggggaatgttttctcggggggtttaattccaaattcctcccctccgggggggggggcacaggaaagggtttcccccctggggtttttggtttttttttttgttggatgagggaagtgaatctttttttaaaaaaggtgttatggaaaaaaaaaaagttatggacataaaaaatttggcccagggggggcccttaaaaaatgttatccccaaagtaaataaaatgttttcccccc

SEQ ID NO: 7072 - DNA, 1120 bp, Homo sapiens
  misc_feature (1)...(1120): n = A,T,C or G
gatttagaggacacggccatatgcattggatcgtatagcgagtgccggcgcgtgaagtctacgagtacgaaccgagttaagcgagaggagtaaaacggtcgaattgagggggtatggagagaggaggcgagtcgactgggcactgaggcggtattcgatcgacagcgatacgacatcgtgtaggagggccaactatacagataaactgcagaaatatagcggtagtgcgcatcaacacgtaagagtgtcaagatcggggcggtgatgacggcgttccgcagagtgaaaacgtaggatgtggatgtaccggagccaagacagacatcgcgcactcgacatgtgagggcgcgatatagcaagtgggtcatgtgttctcactgatgtcatttatactcacgatcatgagggtgttggatgaaggggtacgctggcgggggacagagcgcagaaacatacaaaggcagtaaggcgtgaaaggaaacagaacatgtgcgcgtaggagagtgcggtgacggtcgcgtgcactggcattcaaagtgagagggcgcaggagactaatgcgggaatacgtccagtatatggtgacaatactgtgaaacgtaatagaatatagccttagatgtgcatgtatgcgagaaaaatgtgaaagcggcgacaagccagggtgtgtgctctgaatagagaggaatatggaacgacaccgggaaatagcgatcggtgatgttttttgtatggcgaacacgaatgtaattttacaggcccccccccccgtagcggtgagacgtgatatggatagacgaaggacacgcagatgaacacaccaaaaataacagggatcagatcaaaatccgcggaggaggtctgcaacgcagcaaaaccacgcgcgaaacgtctacgacggcagaaaaaaagtcgagtgaggggaggtggaatatgatttttgttgcgcccccccccccccccaatgggaggttggcgcggcggtattgtgtacgtatacaataagtaggacgtgtagagatgaggaacaaaccgtcgaggcgctctggctgtgactaacaagggttcttctctcttggctactgaaccgccaganacngcagagttagtagaatgatga

SEQ ID NO: 7073 - DNA, 1510 bp, Homo sapiens
  misc_feature (1)...(1510): n = A,T,C or G
cgcacgactcagtcgtccgagtgtcacanacgtatacgtggaacagagtagacgcagatctgacgacagtgctagatagtatgataaatgcacgcatagngcagtaagtgntagcagaccagtcaccgtantgcacatagatgtntgagtangnatcgacactacacacttacattatnacacagtctagcgcgtagatcgcgagtagtagtgagtacgcacgncacgtatatngcgcaacgctcgatnagttatcgcacgcgcgantgctagacacanactatatcgtgagtgtagtagtcagagcgtaccncgcgcgtgagttgtagaaagtcgcggacactcatgaatagcacagacgcgtgctgacgatcnacggatggaagctggagaggacgctggatagaatgatcnagcgcgctcgattagngtcataaacaccactaaatntgcantctcatagtagatgagccggcantgagagatactagcgttagcgtgatntcatgactagcacagcaancactcgtctgcatagtatagtagcgtaccatatcagntatatacgacgaggactcgtcagtcaccggcgaacttctacctcagagtacactatataagtagttgattatgtgctctcgcatggatatagataatatatggcgcacatgaatgagaaggattctttcagcggtcgatctgtacacaacgagtaagtggaggtagatccgcaggggcggcttcgataggtacgagggctcaatatatgagagaggggtgtcggacacgatctaaatgtttgatatggttgtggcggcgaagaatatatatggcggcataggtggtgggcggcgaataaggcatacangccacacgcgagggagactggatacagcaacaaagcgctgcaaccgtgatcatgcgcgtgnttcgctgntgagggggtgatagactctacatcgtcgcacggatgtattttactacctcgcacgcacgatgtaagattcacgagtctggcacatagcactacgtgtcgcggaggaaagctacggcaggtcaagagaaaagcagcctcttccgcnagcatgttcagagctctcgtctatattgtcgcgagtctcaatatagaaggctatcctatctggcactactagagctacgtgcatnttgcgcgcaccgtgcggtgcgggccacactcatattaaatatatttgttttgacctccgcgctataggtgagtaacttgagagagtagttgtacatcgcccgctatntaatatcaacgcataatagccgcaatcaacacagtaaggaaatatgtgaagtcgaatatgtcagctacgagtactgagacgcggacagcggttcggcagccattcctaatcaacaatcanatnacaantctctgttnatngcngcngtcgaacccntttgcgctnggtggtgtgttctctgtcgtgctggtaccgtgtcgcgacgctgctcgtgatcngtggcgtgggattgcggt

SEQ ID NO: 7074 - DNA, 1964 bp, Homo sapiens
  misc_feature (1)...(1964): n = A,T,C or G
ccacgctcgcgcgctgtactgtaatgcgcgatcgngacccgcgctatgatgtaatggtaggtgtgcgcgatgtgtacactcactngctacgttacacacctatanagacgcagtgagtgatatactgataatctctagctcgcgactagtgtacgtgtacgngccagacgacgtcgtcgtggtgtcgcgacttccgaatctgctacgantgtcatngctacatatctgntngatacatgtgtgagagacggtgctatcgcantacttcaccgcgctntgantggctaagtantactncantttgctcggcgcgtcgtacgtncncgancgtgncngcgttgtgtagttagtaacgcangntgttatnagttcggcnagcncngcacgntcgcagtgtctcagcaactatctgtgctantttgngntggacgctagcgtctnancgtgctgcgntgtgtgacgaggcgctgctgtggtgtgctatctactgctggtgangtctgctattatataattacntagatgaacgacgnncgcgctcgctgctgactgtacgtgtttctgcgatgcgctgcangcgtctgtcagctcgcggctgcctccagcngtnaccgcctgctnntcnctnanttatctacnnaaagctatcgacngaatcgatacgatcatcaancacgactgtacgtcagncngtgcatatntncanattcgtcgcncngcncgatgcagctgtcgtctatctaagtanctatnatgatgtntcgaacgtactcagancgcgtncctgtncgngtacatcgtgtnctntngtatcatganctcgtngcganatgtcgcgantggactcacactgtacngcngntcantctcgntggcncgcaggacgncgncactgatcgactnatnatggnagctngngatggcgtcgtcgtcactanattgcanctcacaaagactagtgcgacgcgaccatgcgataggacacgcgatgcgtncgngantagtgtactacngacgncgtcnacgntagcagtcgtcngtactgtctcgnctntgtacngntgnncgatntancacgcgtatncntaacgcgcgtcgncgactgacatcgactaatatgtatgtcgattcatcatgnantctacgcgtcgtagtctctgtatcgtgagtngctgcgctggncgtactacagacatgtgcatagtagttcnttagccgctcangtcggctgatagtatatctgtctctgatcgtcatnntgcncgancgtgtgcgccgagccantatctgctgcgcaccgtatctacnttagagtaatatcacnagtgagcgcgtcgctgacgctatcnagacgacgtgatacatactcgtatcattcgcgatgaggtttagcctctctatggtgtacatgcactctcactctttccagacgcgagtancactgcagacanatangatcagagtcatataccatatccgacgcgcgcgagtcgagagtaatanacgacaccacgcagananggaggtgcaagcgcgtgcgctcggcgaaatgactcaccgcgtacatncgtcactttanaaacccgngtcgcgcttctatacngcggacgcgctggcgactcacgcgcggcgactgcgctcgcgtatcnctcgtcgtgctccgtgtatcagtgtcgtatcgcatctgagagcctgaacgcggagtatcgtactcagatgcggcggtgtcgatcgncgctncgcgcatgatntngatactcgtatggccgtagtgcgttcgtgtatgcngntcgtcgcggcgtcggattatgacagcacgcgncgagagagcggatctacggcgcgtcgtgctgantcacgtacgcagtcacttgntgtggcgtagaataatcaggcagatcgcattagagtataatcggttgatcgtgcggactttagaatttgagtacctgcgcgtgggagac

SEQ ID NO: 7075 - DNA, 1234 bp, Homo sapiens
  misc_feature (1)...(1234): n = A,T,C or G
tgtatggttggccacaccagagggtgtgtcgagggaaaaaatttattcctgactatcggcgccaattacagctgaaccgctcgcgccagcactgctactaacacgccagagtcctcttgcggggttaaacccactccttactcaaggaaccgggctggtcacaacggcaaacgaacaaatcgctcgtagggcggaaggaacatagatcaggtaccacttttggcatactacttacctataaccggtgatgcaggatcaatggccaacatngaggagacaaccatgggaataacactgggggacanctacacacagtagaagaccgacgataccttgaacagcattgcgactcgtgggatgcatctggtctccgcctaggaacttcttagagacacgtacgtctattgccatcaccagagcactaggatagaggatagaggcgaggcggtttctacttgggcgggggcgagaacgcccaatatgaaaggacccacacctcgcgtgtctttgcgtgcgcgacaaccagccatccatacacctccaacggcatgaaccctgtgcagtaaatggctgatactgatcagcccccagtcaacgctatgaggggtggcgtatcctcaccactgtgggggtctcgataaatatacaacggactcgcggtcgcggccacgatgcaaacaaaggtggcgcacggggagaacgaactacactagtaggatagtccatgtggatgcacgaagcgatcgccagcaaacagacagcacaacacgaatgaatcgggggtgngtcgacagagacagtaacaagcagacgcaggggaaagacacgaagccataatacaaaacgtcacaacacacaagagtgtaggggagaggaagtacagagagaattgataacaaacacacaacacattggggagggtgaagggtggtgacacatgcagctggggcacatacacatatcggcaagactacaatcgtgtggtgtaactaaaaangtgatatcaactgggtggtgatggaactgggtggtggagcgaatacacacaatgggtataacaagtggggagacgggtgagaccacccaccacacaccacacatgtctatgtgggcgaccaccacaccacaccttgacatgtccagtgtggggcggaaacaaagtggaggtgaaactggaaactaggtgtgggaggagaatataggtggaatagggagagagaagtgaggaatggag

SEQ ID NO: 7076 - DNA, 1642 bp, Homo sapiens
  misc_feature (1)...(1642): n = A,T,C or G
gtacacttgactcgcgactcagatttacaggacgcacaggcaatctctgagcgtcggatatagtacgtagtatatttatagtagctgccgcgatatgcgtgactatgtctgatgactcgcgtcatatgtatcactagtgatcgcagagcgtggtgatgccagcgacagtatcactctgtagagacgtgggatacgacgacgagtcacagtctttgcgtttactaatattcgcgtgtatagtctcgatcgatcgtgaaagactgagtgcggnacgagtcacacgacgcagatactactagcgttgtgttgttaccgacgcgtcacaccgcgtcnccacgcagcatntgagtgcgcacatnctgtatatagagangtatggcgcgangcntgcgccgcatgaacatcgtacnagatagcgnacagacagatatatcagtaatcagtgtggagcgacgcagcctcgcggnacattctcacatagatgatcgncataantgagcanctcaatatataaagcacgatatcgccgtgcattgatcacatatactacagcatacacntgcctgagcagtcttcgacgcagtcatacttctcatcatagncntcatatgcagaagagcttgaatgtacacgatcaggcgttcgcgaatataattgcacgtatctcgcgcgtcagattgcgctcagcatcggtcgatgcgtaagctgtctacgcaccagctcgtgtcaatagagtagacaccagcgtctgacgcatgagtcattgtactgtgcgatcggcgcgccaggttaatccactcggtaccgcgcgtgcactcgctatcagcgcgaccgcttcatgatgacgcgacttaatagtagtatctgcgccacgccgctcgcccgcatcgtcgctctacntatagatattacacgccgcgattaagattgtcgatgcagtcgctttgaatatattatgncgacgaactcaaatagtcgaattcccggcacgagtgaatcgttattgtattatataaacgccgctgtgcgcgaggcntatgttagactcactcgagattaatagacggtacacacgcacaagtcgcgcgtgcgtgcccgccaggtagttatgtgcgtagaacgtcgacgccnacgcgcgatattactcagcatagtgacatgctgccgtattntaagtggaggcgactggtgatacgtgtaggcctctccgtagcgtacagacagatggaagtatagtgaaccggcnttttctgcggtcgcctntaaacgagtacgactaagtgcatatagacgagaacgcaacacagcgatcggacgtgtattatatcagcaggagtgcgttctgtcgctgcagttcgcgctgtacgatgagtgcaacacgagacgatatgatatacagtatcgtaatatgtctcacgcgcgcctcctaacgtgttatntntcgtagcgatattcgtcgaccgcgcgtcagcagtctgccgtagtatcgcgtgcctattacgcacgcgataatgtatagtatgagcacgagcgtatcgagcatgccgaatagcttnagtacaganacgacgcgcgaacnagaanacccacaaactatagactcatgttccgatacgcgtagtactngaatnacgtgtgtcag

SEQ ID NO: 7077 - DNA, 1022 bp, Homo sapiens
  misc_feature (1)...(1022): n = A,T,C or G
aagaagcgagnataactaaggnagaaaactacgtgaaatatagatnaatggnnacgagttatggtatagacggagaaaccgtccacagtcctttctgtngctacgctcgttcagntactctctgcggcgagagaaagataccgagtctacggatcgtagtatgcccagtggngctcgctttaangacatcgaggggtctagttngacttgggccacctagaatgagatactgtttgcagtatgaaagagataagttggggaggagttaactatgttatactagagggnccgctacccagctcgacactatgtttgtaanacgggggtattaactggngattatatgaagaagataagttgtggtggggagagatgttagcgtnatgtgaggtgtaagagggagggggagaggatgctgtgggaacgagaaagaggggtgaggatgagataatagaggaggatgtgacctagagactgggggagcggggggagtgtgtcgtgtgttgaggatgggaccttggagcttgggactctgtcgtacgtgaggnaagtgtgtggtgtacttagnacatgttatataatttttatttctcgctnngattcgtatctctggctaacctccttttnncactctntatttaactttatagcaacattcttctatctcaaacagtcctctcgtntctcctttctcttcatttntcttattattttgattattctcttccttttttatnncgncaactcctcacgttntctccctcacctatanaataaaaactnagataatatttaaataagatatatctagttactctactctcgtcaannnnctatattnnacttttncctntttcttcacatttcttnncttnactctattnncattnnttctcctcatttatttcctcttttttaaacatnattnnncctnagttcctnncncaacatctttnnnnnntcctcttntnnctttctctnacttnntctcctnnnnccccttcctccttnnnncctccttt

SEQ ID NO: 7078 - DNA, 816 bp, Homo sapiens
ttccatgtttccaactgaacccatgttcctccactaatacttggattttcttccaccacggccgttcctgagacagcaagaccagttcctcctccttctgttcctcctcagcccacttgacgtgaagacgacgaggatggagaccttgatcgtgccccactcccacctaatgaatagtctgtagattttctcttccttaggactttcttcataacattttcctttctctatcttactttattataaaaatacagtatataacacagatgcaaattatgtgttaattgagtttttatgttatctgtaaggcttccagtcaacagttggccctcaggagctaagttttgggggagtccaaagttgtatgagtatttttcactgtgtaggggatcagtgcccataaacctcaggttatttaagggtctactgtataaagtaaatattggactcataataacaatagcagctataacatctttgtagcacttagccttggtacaggtgccttcaatatgctaactaatttaacttttaacccagccagttttttatgtaaaaaaacgattcatcataattaatatcttatacatgttccattcaattttctaaatttgggctaatatgaaataagggttaatattaccctgatttgatcaacatttcaaaattacttatatttctcttacaaattcattggtattgacatcaaatttattaaccacgttttgggcatgggtaaccacccagtaaaatagtgggactagggaaagaaattgataatatcttattggggggaccttgagaaaaaaaaaaaaa

SEQ ID NO: 7079 - DNA, 1490 bp, Homo sapiens
  misc_feature (1)...(1490): n = A,T,C or G
ctctgcgatctgtctctctactcatactcggatggtatcgacgtagtcgcgagccgtgtgtacgtctgcgatgaggtgtgtctcgcacgtctgcgttgngtatatatgggtgcgtntgtgtgtatttgagtctctcgtgtgtctctgtggnngctctcttgtcacttgcgncgagctcccgttcgcgtcgatgttatgatagtagtaagtgttgggatcacactagtcgacccagtgcactacgcgatattgnaggtacgcgccattgagggcgtcgactgcgtgccagcgtattatngtgtatgtagggctatctactnntttactgagtccgacgatcttaatctgctgtaggcaagaactcagctcgacctactgacatgcgatcacnacttcttgttactgatattggaanttatctcctcttcctcgcacttcaagtttctattcatatagaagntgctaggtagctacacctgtaagaggctcttctgatgattatacatctctgagaggtatggctcctcgcagtttcccgtctctctatgcggattggcgtaagagnagcgacgtagcatatctgaacagagagagnggaaaangagagagagagagaacggatagcgacgtagagacggtgtggagatcgaggcgtgagtgatgtagtgtgctcggtgagggctggtcggacggagatgacgcgacgaagaggccggaaaaggcagcgctgaggtcgccgtgngaaccgtacttgacacttatgtagaacgaaggaccaggagcaacgctatcgcggcgngagagaatataganaggagtacgtgtntcatcgcgctcttgtccgctctctctctcactcgnnaccgtccggaactcagtgagtgttggtccatcgtctctctngntcatgcattgcgcgtgtgactcgctctcgacgnccacaatactttctcntcnnacaccatgtactcttnnnccgctcctcgtnncccgtagtacncgcatcacgcactttcnnnnncagtatatctctagcaatcgacgtcttccgtattctcctaccctcctcttatnngcacgngctcctgcgttcttccttgtttcacgtcacctttcctcgcctnatactntgtgatnaatgttgatgttgtatcaagaaagaatcttatatangatgatgactagagagtagactgatatgacacgcaagatacacganaacacatatgtatattaaatccctannacccctccacctctcttcatcacacctnnacatatattatatcactatttattntaatataattnataataataatacaacaacataaataatataatacaaaaacatanaacaatannntttcgtatnntctgtnccnngacccttctcttnnntnnnnttntttctttntntnnttttantttttttacttcttcttctttttnnttnctctcttnncntctcttnnnnntncctcttcttt

SEQ ID NO: 7080 - DNA, 817 bp, Homo sapiens
aaaatccgtccgactttacttctaattctcttagtacaacctccgtcggctagacttctctccttcgcaacgacgtaccacatcaaatgtcactggcaagagtcatatcgaacaccatagagtaatgcgtaaacttaaacattattaatcgactcatatcgtggcagccgtctcctacatgagttatctgcccatcgcactttttgtcgcatgaaactctacacatcttggcatggaggtcctgttgagattatagtacggtcatgaaacgactttatacgatatactgaactaaacagtcaggttcagcgtgactaataaaaaggagaatggagtaccgccttccccccctctatctacaaggcaaacgagtcatacaacaaagtgttgatgtgaaaacagaagaatatgcgaccttataatttaggaggaaaaatagatttaaaagtatatcccaatcaaactattgtgaaatgaggggggcgaacaattttattttggggtgacttacgggatgcgaggagtagtacgcccagcgtaaaacaactaaaaaataagggtggggtccaaataagccccccaatggtcaatccaccccccccctctttttattattctgccgtaacgagccaacaagaatatttttttgcgggggctgtcttcttataagaaaagaggaagaagtttattggcggcgcccccccttttttgattggcccatagaacccccctgagtggtgctaaaccaacacgtccttttcccctaaggggggttggtgaaaaaaaaaaaggagcccttttttgggggccgcctcct

SEQ ID NO: 7081 - DNA, 530 bp, Homo sapiens
  misc_feature (1)...(530): n = A,T,C or G
gttccccctgtttttttttgtcccattttttccctcccccccttgccattcaccactttcgacacggtcaaagggtgttcgttttagttttggttccccttattttacttgttaccctccctgtttcttctcagccaccccattgttttttccttccccccacccattttgtttttttcatttgttacccgtcccccattttcccaattccccgtgtttgtttgtccattcctattttccccccccccccgttccgcaatctcttgtttttcatttacggttttgtttaccctccccctcatccccctttcgccattccctccccccctgttctcccaccttcttgttgtctgctgccccgtgtattttgtattaaaatacggtggggggggcggattttgtccacactcctgtcccctcgtgttgcgcctgtttctcgttattgccctcccccgcgctgtcccgttcccgtttgtttgttttgtttgccctccttgcctcccttgcgtttccgctttngtgttgtctgg

SEQ ID NO: 7082 - DNA, 1436 bp, Homo sapiens
  misc_feature (1)...(1436): n = A,T,C or G
tcgacgcgtctgcncgcgacagtactgagcgtttgacagacagnagtaatcgtagctagtcngtcatancagngccgtgtgttgagagcngtntatgtgctgtcgtnctctctctcgtatcncttngtccgtgctcgcgcgtgtgcgatctgccgtctgcgcgctcttgccgcctcgcgctcggcgctgcttgcgtcnttcagatgagtnatgacagtgtctccgtgtcnaccgcacgctctcggtatagtcttctgttctcgtatcgctagctgcgtccgtccgagctgtggtccgacatgcgtcgtccgcttcgtctcctgncgtggtgcgacgtcgcggcgcggntgttgntgatgtgagtgtctcgtgctagtnctgtcgaggattgctngaccgcnccctgcgtncctcttctgttatctggcgtgtggtggccgatcgtcgccgtaccctgcgtgctgtacactttcgtcggccgcgntgcgtgactcgtggtattatttgcttgcgtagtcgtcagtatgatgtggtcggcgctcgtgtcgtgtgtgtgcgcagtcgtgtactcgcgtggtcgtgtctcgctcggttatgcggtccggtctcatctctcctntcgcagcgcttccgactctcagntctcgtcgacgcgatcggcgcgtcgcggtaggggcggctcgccctcagcncgcggcgtcagagctctngtgttcgggtggttcgttctgtcggctagtcgcgtgagtgataatttgagtcgttgcgactgtctcaggcggcgtgtggtattgtgatgtgcgacgcgtactttctctgtcgggctgtgggggcgtacgggcgtgtactcgcggcctcccgcgtgcgggtccaggcacatctgtggtgtgtcttcgttgtgtggggctgtccgcgattgactcgtgtccggtccgctggctgtccgtgattttttcgtctttttctcgcgttcgctcgccgctctccgctccgctcagcaccggcggctcgtgcggcgcgatgcttcgtccgcttcgcctatgtggggtgggtggcctatcgtgtggcgtgctgtgctgttgttgcgttgtcgctcttctgtgtctcctcgcccgcgcggccctccgtcgtctcctcatcatccgccgacgtcgcccgtctcggtcgggcgcggctggcctactctcctgcctcgtgctcggtcgtcccgatgatttgttgtgtcgtaactctggtccgcattggtcgcctcgtcttcgctcctatattattactgctgtaaagctgtgatgttccctgtgcgtgcactggtgtctgattgtcgcgttctgccccgtgtgaaaaagattcccgcccggtttccgccgccgaggcttttttttcctctctttcgttccgctctctattccgtctgtcggatcgtgcttgttgctcgc

SEQ ID NO: 7083 - DNA, 909 bp, Homo sapiens
ttttcgtggtgaatgactaatcgacgatgagcaaatcacacatcagagatgcggtaaactgactaggtaaaggactggaatacacattacaggagaaaaattgtaggtaagaaacaacgtagagttttcttaaattttggaatggatttacgtggacaaccctacggtggctcaacgtgtaaagaccaagtgacagaatcgtaaagatagtgttgaagcgaaaaaaactagctgatactcgggtgagggctgtccgcagttccaacagaacgatatctggtatcgcataggattatgtgagacatcgggtcgtgatgtatagatcctcaggaatgacgtatacaacgaaatagggacaaaagtgtaaaaaattgtaaggttagaactatttctctgaaataattcgaagacagcgttcggtggtaaaaatagcctagggagaccacatcgtcttaagaacatttaacttcaatcgaggatttagaaataatacttctctgtctgcttgcaaaaccttggtctaaaacctacacttacaaaccttcctcttgtttggccctcccaagatactggtattcaaaatttagccaggggtgcacaactccatgctttttaaaaaattttaaatttccccattccccttacacaccaacataatgtgcttggcggcttgtagccttcatgattcttccttaaaacccagcacatgaagaggttgacacggacattttgaatcaaagtaaaaatatacctaacagaagcaattttagagtgctaattttttttctttggggggcattccacctcttacttaactgtatgtcttattatttgtatatctaggataataaaagccgatgcggccggtccacttaacaatctattgtttcgacaaattaaaatgaagcc

SEQ ID NO: 7084 - DNA, 1427 bp, Homo sapiens
  misc_feature (1)...(1427): n = A,T,C or G
gcgacacacacagggcagcggcacccagcacccagaacagaatccacgagnagagaggaaggaggaganggagggcgctagangagggggagagacacagagcaacagaccagaacagatccttcnacaccgcgggcacgacaagacaannangcgcacncncggaagaggatgagccagcgacagacggacgcgaagacagggagggcgcgacgcctccacagnaancganagcgggcgacacgaagagccgcggagccanacatacnaacgacgccgagagcggcgnagcgcgcgncacgacaggccgacancnacacagcacacacnagcaacagacnagaacaggcgggacgaagaccacaacggcagagacaacaanaacaagcgcagcgnagnagagccggaagagcaccaanacgacagccgctgcaacgcagaggcgcgcagcagacggagcgantgagaaacaggcgccgcccgagtcgacgacggacgaccaccggtgagtgcctcttctttgcacagaagagaagagcagcgccggcagacgcagcgagggccgcgaggcgaccaggcgagcaggccgagagncgcagcgagaagacgacgcagcacggagctcgcgcgccacccgcgcgcccgngtaccgacgcgcggaggaagaagacgaagtgagcgaaggcggcgaccgaggaacgcggaggtgcgacccggcggccgccgcgaccgcacagcaccagaacaggggcacgcatcaatcgcgccgcgcgcgccgccgcagataacgatagaacaagcgcgacacgcggagcgcggcggccgtacagcgccatagcgacgcccaaccgcccagccgcgctcgcgagatattgcacgatatcgcatcgaccaccatgaagccgcgaccacgcggacagagcaactgcagcggcacgcgagacgcggccgcgcggacacaccggaagcgccgcgaacgtataggcgacagtaaaccaccacacggcgcgaagcccccgccacccagaggaagaatagcaagccgagacggacgaggagctacaacgagacgcagcgtcgacagaagagccgcctcgcgtagaggacgagatacagaggaccggcgcgccagcccgcaccagagcccgcgagaaggacagcgacgcgcgacgccgccgccgcaggaggagagataaagcgagtcaccgcccgcccgacaaagagacgaccagacagcagggacgacggcaggagcgcccaaaagaagacgccccacgggcggagccgaggggagacgccgtgggctcgagtagaaccagacccgagcgtgaagcaaccgccaagaaccgagacaagaccgaggtgggaagcgagggcagcggatgcgacggaagcaccaacccgacgagcgcatggcggcgccggcc

SEQ ID NO: 7085 - DNA, 1070 bp, Homo sapiens
gggggggaggcaacaaacggggggggacgggggggggaccgggagaatttattaacggtgcatccaccgcgctgcctaattgcagctggaactctcgcctcagcgcgagatgcacgtagacttactctgacaccacacacggtacgtccaagacgtatacagacgggatagatggacatcttaatcccatctacacacaaccggatagcaggatctgtggtaagagaacttatctcgattcctaatgtctccaaagatttatgtggattgtcttgcgtgaagctctttgtatgagaatgcacgtctttcaaccaaaaactacccgctagactgtcactttagatccttggaaacactcagaatccaagttatatgtacttatacacgccccgctttcccgtttgttaaacgaataaaatgtcaatctatccctcctggagcgacttgaccaacacatgtggtatccaggaactgccaccttgccctcggcggcgaggcaagtcactaaacgttggcagtttagagtgctgcgttgttcgccacataacaaaaatccacttggggatgtgcgtgacctcatcggtgcggggggggacatggtggaccaactaggtgggactaaaggggcaaggtgatcggggcccccacggcaatcaccacaggggcgggacaacacacacaacaccggggactggcaggcgagcagggaaggcggcagcgacgcgcacaacgggggacaccggggggggggggggggggcaacaacccgacaacagtgggacggggagaacaggggggacacaccaacatactggggggggcaggggtacaagaatacatcaggaagaaggggggactacatctctacgcttacccaggcggactatgtatcattcgtggactgaccaccccatttctctcctgcggtggcgtgtggggaaaacaccagggccaacacgggacggggggggagtgtgacacacacaaggggcaacgggaacacacatggggtcaacaggggagaacaaaacacggaaaaaacaacccgggctgggggcggacgcacacag

SEQ ID NO: 7086 - DNA, 884 bp, Homo sapiens
ttagtacgaatttacactgaccttcttatcaaaggactgttttcgttatctccactcctactggtaacattataaaagctacatagtcgttccaatcgaaagccacatatttcatctgcgtaagtttatatatttatcgtccctaatcaaatattcaatttcaccaccgtgcaccctgatcatgcacgcatcaactataaatattacctacactgtgtttaagaccgtcatttaaaaaaaaatccaacgatccaatccattatttatccgcagccaaggctaacgcagtttaatggaacaacacaaaatcccggatgttaaccgcggaatgcttaaaagccctaatcaggacgctaaacaaattctgcattcagatacaaacccctttattccaggatgcatagccccaataagagcaatgacccccacgcataactaacctgctgctgcatacatctgtgctctccaatcaataagacctgatgcagaaaacagacaagggcaagagttagggattcagtcaggatggtgggaaaatttgtaaaataaaccttcttggagggccagaaggtttttgcaaaagcttcaggttagagttaatggctgaaggcagcctaatcctctttgagctataacaagggtaactaacataggaatgtagaggagtctatctaaatagcttgtttgctcatgtggtcctaagactgacttttgaccatccacgggtgcatgattgctctctattcaggggttggcaatggtaattaccttctagtggtgtttattgagacttttgtcatttaatgtgggctgaataaatggtcaacggccagcacataatattataataatatcatctctctcaaatatgaatttataatata

SEQ ID NO: 7087 - DNA, 780 bp, Homo sapiens
cctcgcgcagaaacaccacgaaaggaagttttcttacgccacttagggaaatcgattctgtttcataagccatacacaagtctcatgcacactatagggccgcgtgaatgtaacattcgagtttctacacaatataaagtgtatacaccttccgactatacaacacaggagtgaaggcagctcccatgccggaaggacgatccatcacaatcaaatccccataaattcgagagttgtctttgttactacacacatacattagcagtctatgcttaatataatcggggccactatacatgtggatcctaggacataaatgggaaatatctattgagtcgcaatgcaaagtacagagacataaccgtactacttgaaaactactactgtgtgttttttggtatgcgcttgaagcttttcttcccacatatggatatataactgtttttttaaaaacatgctagaaagacttttttttctttgaattacttctgcacctgtgttgcaaatcgattaatcatatatgtctgtttctatctctggactcctttcttgttccattgatgtgtgtatttatccttttttcgacgccacactctcttgatagatgcagctttattttaagatttgaaatcaacaggcttgagtccttaactttgaatggtgtttcaatttttataacattgcattgtcttaatgtacaaatgcaaaaaaaggatatattgccagacataattttggaaagaaaatgtgatatttctcagcatcttgacacttagaaaa

SEQ ID NO: 7088 - DNA, 1611 bp, Homo sapiens
  misc_feature (1)...(1611): n = A,T,C or G
atgcattcaatntagtacgatcgtgagcngcgctgacangaggnagatgaatgcagcanagagagagggcgtacgtgcgctgcantcggagcancagtcgtatcatatcactacgntnacanctacntcgtgcgtcgcgcantacaagcttgtgagcgtggaggtagatatgctngcgtgatngactngtgtcactacatatctatactanagtacttcancatgcctctactcntctnctctnacgacngagncgggtcatctntataatganagttgactatagtacgtcantatnatacatcatacacanatactcantggagcacgtgcatctatcgtgtcatgtgngtgcatagcgnntntcatatgcaacgtactcatnncgactctgtcancncactaactggcgactatcacagtgngatctcgtgacgcgatgtgctgcacgcaagcattcgtcgtagtgattatatcagttatgtgcagccgancacgcgagcgaataacatataacanaagtgngtatgcactagatgcacatctaggacggatganggaggtgtgatgatgacaatatatncatatattattatatgtcttctctctcnctcacgcgangaacagacgcgcagacgcgntgccgcgatctgagcaagcaacgagcataggcgcgtcgcaacacgntgcagnccatatcagtctgaagaccttgcgcgattagagctggttgaggctagtngtcagtctcgactaacacntctctncagcacaacgcgcgctgcgcaaccactagctacgccgacacgattcgctgtgcatatacgagtcgaggttntggtgtgcgaaaatgatccatcacgtctatntcatcgtggtgacttcaagtgcatgtgttgaactgcgacatagatgcaggcaactacatattaattctattattatcggatggtcgtgtacgtgacgacacgtagctaaagttccgataattganatcacatggactaagagggaaacacaggaacacacgtggccacgcgatggacctagtgactaccgtcatacgttatattatgtgatgangacaagttgcaccacaacttacatcactagtcagtatccagtgtgctcatcacttaatatatataccactgttaacactaggtgacaggagggtgacggcgagtgcggcgcgatgcgtcatgtctatacattcgacgacaccacggccgaccgcgcacacacatatacatctaancangattcaatcgcccaccggactacgatgcgcatgtaatcatctgaggtgacaaccgattatactcatatagagatgtagacgtagctagacaccggaccgagccgcacggcgatactaactgatatcgagtgagcctggcgagggtgcgagcnggcgatcagatcacaataacggagatcatgtagtgctgcgctgcagtggactcgactgcagcgtagtgatgcagcatggtcgtgtgcgactaatcacatataaattcacagtacacttcggtgcacagcatgtaactcgcgactacatacatccactaaacgacgacgtgagagtaagaaagttgagacacccatcag

SEQ ID NO: 7089 - DNA, 758 bp, Homo sapiens
aaattttttcataccactcgtctccggttctctgaatatcacacgtcgccccataaagcactaagtaattaagtaattctgcctttgtgatccaatcataacatcttcattttagcttgtacataattacagcaatatctgacacccttttttaaaccctgtagtagtcaatacatacaggcatgccgtaggtgggcacagtaattcagtttagaaaaccaaataaaccatcacataggacctactcaatttctttaaaatcactgagcaagaacagcaacattgaactttcatcctgattttacacaacttctatacagtaccttgacttaaatccaagagcaaaagttaagactctcctcctctatttttggtaaacaactgcatggtaaacttagatgactcttccccctggattttatctgggagtggcctttttacatttttatttaaaagagggcaggtttggcacttttatactgatgtcaccaatgttaatatttcttgggatctcaggaagattcatattctttacagctgatacagcacgggctggagctcctgctaagccagcctcagatttttccagcttattttgtgcatcaatttgtgtaacaatctcattcatatttgtctccaataccattccccccatcaccatttctgcaagaatattgtgaaccttgtctacatggaaaatcaaatccagctcacagacattttcaaaacatttgtactaatgttccacgtacacctag

SEQ ID NO: 7090 - DNA, 846 bp, Homo sapiens
attacacgtagagaatcataaggaaaatgtgtacagaactaaacagaatccaatccggtttaataattggtcggcgaagggagacactttttatttaaatatgtttaacagaggccttaacgccaaatcaaagaaaaagaagctccctaagccagagctttgtgaatcaagacaattctttcacttctgtatttctcaagtatgttcaaggaataacaaaaggaaggtccagtgcatttagaaaaccaagatttttcccgaagcatggccccccaaaaaaaccaccttgagtcagaaaaaatggaaatccacccagtccctggaagttctgaaagggtaaaattcttattggtcaaaaccctttgcccttttttaggtagaaaaacataggttttgtataaagttacaaacctgctatccaccaaagcactcaggactgtggctcgcaaattacgtgatggcttgcagcttcattgccctatgtgttgccttctgtaatgtatttttcctggttacctaataactcacatttatctaaacaccatagcatctctgaggctccgactcatccccttatttggaagatgctagctatctccccacactggtattttaaaatccagcattaattacagtaattccttctactcatccatacaggcacatgcagaaagaagtgaaaagttatttgtttcttttttccttcataaagagcctaaagaaatgtgttaattaactacaaagttagccaagattggatttcatttttttgattttatagatggcctcagtgcaaaaatatccggctaccgagaatagtgaataaataaatacccgatcgggcca

SEQ ID NO: 7091 - DNA, 802 bp, Homo sapiens
ctataagattatgagtggatataatggttgggtaaggtgagtgtatcggtattgttatatatctatgatgagtagcagcggtcgagtgtatggggttgcgattcactaaatagattgacttctctagtcgatgtgtggagggaggcgcttgtcatttaaatatgaaattgtggatgcggtttgttcctttgatgcagatgtcttgttgcgtatgtgggtgtggtttttaagtagagagaataggaggtgggggttataggtttttatggggggtaacaggtggggagaaaatataaaatgtttttttttcatgagaggggatgggtctagtgtgggtaaggtgcgggaagaccaggagaaatgattgttgttttttttactttttgaaagtaggttggggtcgcccccgtctaggattagaggtaaaaaaaaaaaaatggaccattttgtttttttttgttagtgggtggacatgttttggttaaaaatttattacagatacgaatggggagggatttatttgtgtttttttggggagagggtgtatgtaaagggggggttttgttgtttttgttacaaaaaagatttttcaggggggggggaagaggtgtatataaaaaaattataaattccccccccccgtcttttttattggggggatggggattttaattaaaaaaatacaggcccccatcatttgttaaaaggggggggggtttttttttttggggggggattttttttggtgggtgtttttttataagggggagtccccccttaaaggggggctcccttccttttt

SEQ ID NO: 7092 - DNA, 878 bp, Homo sapiens
atttacagatccgcaagcaaccgcaccaccaagtccgcacttctggttaataccagcatctgctatacgtaaggtggatgtacgggcgccgacatcataacttatacggcactcgcctgcctgtagtccggtgagcgcagaacttctcataatcctccaccccctcctccgatcaccaagcgggggaaatccctacgaattttatggccgaagagggctcttcaccagttaatatcgctcccgccgccagagtgttttttacacaccaattctacgccttatgggggcggtaattctttttaattttcccccgctacaggagaaccagagggcttagaagcctgcccttcacgccagtggaaagaagtgaggctcctacaattgacagcaacagaatgcaagtgattgacagtccatgcaaatgaacagttggtcatggccaggcagaattcacagatacctggacaaaatcttatgtggtggcaggatcaggcatgatagcagagttctcatccactatctttaatgttcccatccattacaccatggaatattatgtagccattataaaaggatgagatcatgtccttagaggcatcatgcatggagcaggaggccataatcatcgcctcattaacgcaggtacagaaatccagatgcaatgtattttcacttacaagtgcagagataaacattgtcactgtcagacatggagggcagagcgccagacaccggggcctcctggaggttggaaggaggcagaaggattatcctgtggtatactatgcttataacatgcggtgacgaaataatgtggtcacgccctctcctgtgccgcactaatttctagtatactacataaacccccgatgcgtgcg

SEQ ID NO: 7093 - DNA, 812 bp, Homo sapiens
caggaattatttaagtaggggaaacgaggaagggctactgggaaccttttaatttaccggtgcaacggccgtaagcaaagaacaataatttgtttcccagggattgacttccatactaatggcggggagaggaggcgaacagagtacggatagagtgttacgatgataaaaaagtgcgtgtatatactggtcccaagggaaacaatggtgacgtctggtgaatcaatactttttcgggggggtggtttacccgcctaaagtttggccggtgtgtcgctggcgcaggcgcgggtacgttcatccccgcgtaagcttaggggaagagggatatcatgataggtctcctcttcgacgctgcttttttcgtattagcctagccttttttcgccgcggccccatcagcgtattctattccttcacattatactgtatccccctcccccaccctatttactattattttttcatccccccctcctttccccctttttacggacccatgtgttgctgcgaggtgttttacatgtcttcctatccccccttattaccccattctatccccctttatgcggtgctgtatttcgacccgccattttgatggaccatctaattctgctgattgtccctctcaatccgtctgtgttattgttatcctataccccacaccttccgcctattttacgccattatattaagagacaccgctccccaatcgggttcccgcacatgcgatatatattcgcctctcgctatcaagtcgctattttctctcgtttacctcaaccatttgaatgtagatcaagtcgtgttac

SEQ ID NO: 7094 - DNA, 839 bp, Homo sapiens
atcaatatcgctataacaacttttcacacaaagactaatagattatgatacaaaatgctttttattacacagccccgacggttgggatttctcgagtcaatagaccgaattcaccccgcaggagttgttttctttcccaactataaataacagggtgtatttcagctctcaccaccccctccctcctgggatcaagtaaatccctgcctcagctccctaaaatagggataaaggcacacaccaccaccccgggtcattttttgattttttataaaaaaaaggtttcccaatttgccaagatggtctcatttttttgcctcatatttgccaccccccctcccaaagttatggattacaggcttaagccctgccacatggctgctagttcttaagagggaggtataagacgtatgtatagactaagtgaaaggaaaatatcttgggcccccaaaatctctaagctaaaaggaaaattcaagctggaaaatgttcagagcaaacctgcttcccattctattaaaagtcatccctttgctcactgaggtaaatgcatattctgattggctcctttgtaaaagctaattagaaactcaaaagaacgcaactatttgtctctcacctacttgtgacctggaagacccctccctgcttcaagttctccccacctttttggacaaaaccagtgtacttcttactgtattgattaatgtcttgtgtctccctaaagtgtataaaaccaagttgtgccctgaccaccttgggcacaggtcatcaggacttcctgaggctgtgtcatgggcatgcgtcctcacccttggcaaaataaaccttctcggccg

SEQ ID NO: 7095 - DNA, 1272 bp, Homo sapiens
  misc_feature (1)...(1272): n = A,T,C or G
aacggacctacttagtgttttgctacatatggatatataattataatatatgtctgtatacttatcagnnacataatatgagttaaatatatcagtgtatatagcacatgcgggtataataagaaaacgagatatcaaaatgaagacaaatccgcntctgaatacaatatatatatccgataacacgatatatgagtatactagagcacgatatagnatctatcataggatgggcattatacaagaataaataataganatattatagataacataggtacgatgagcggtttatcaaatacagaaatatatagcggcgatggagataagagatatatgataggagggctgatatatgacgataaatacgangnaatcaaacaacggntgttacatctgngatctacatatatgaacgaataaacacagactatgagaagatctggtgacagtcacataataactaaagagtgctgattggtggacgtagtagagatatctatgagatagcgaggtggaagcgaaaatcaaataagagcacataatgggtgatgtagaggtggatcatatgaggacgagatggcgcgcttcgaagttcgtagaatcgagaatgtgaggtcgcgtgtagctagtttgatatggtcccgatcgggtgaaactggagagagagctgaaaatataaataaaataggaatatatggacatattgtatatagaatatataaaagataactatattgttgagagaagtgaaggaaaagaataatagacaaaatatgaaataagtaaagttataagtcaaacaggaggacgaaacaataaaattatatgacacctaatgctgatatatgacagacaataagataacaagaaaacaagataatacaaagaatgagaacaaaaatattacgaaagacgaaaggctaaacataacaatcatctgagtatattttattgtcagtttttaataaaatatataaaaggatttatatctatgaactatttaattgcactttatataggactatcattagtgagcataggtgaatagggatcatcattctatacataatgtagttagttaaacatgaatatataaacgttacgtcctgttctactattgttcatattttatttagggtgtttatattaccaaaaacaagactccgttctgtgtactctaagaaatatatttntctttttcatctctctattattatctttatacttctttattatacttccatttttnntcttttttcacttcctttt

SEQ ID NO: 7096 - DNA, 916 bp, Homo sapiens
ctaaatattgtttatgaaatcctgaaacagtccgcatctttgtttttcttaccactacctgtcgtataattcaccgtcccgcctccttactctcattcatctaactactttctcgcgaagtggcgttcgacggtaaaattttagacacccctcatgactcgattatgtgcactctataaaaactatcttgatcaagtagtttctgtcagttttattttatttctagtcggttttctatctattaaataggttaataagagggtctacactaaatacttaaataatatttattctcactgatctataaattgcctgtaattatgtgtatgcatataatgaaatcccgttcgcactattcatattctattcactctttcccagtgccaaccctctctgatttttaatagagtcagtcagctatatctattaatttgtttctccccatttatatatgttggtacaaataatattccccgcataacccccggtatatggaactcgacctccaattgcgaatatacaatatgacgtgatgaaattattgttattagaaaaggattgtggaaagtgtgtgcatctattctttaatagggacgtgatttcatatatacttatcccttctttctttttggagggagggtttgattctattaccctcccttgagttcaagtagtggttcgatactttgctacctccacctcatgagttcaggcaattctcttgctttagcctcctgagtagctggtattataatattggtatatggaaataccctcatattttgcaacctttttgtgaatttcttaggattgtaatcataaccgaatcatatcaatattcaaatgaacagcagcatcgcgcgcctgcctccttttcttttattttcatctattacaactcaatttgctcctctgc

SEQ ID NO: 7097 - DNA, 323 bp, Homo sapiens
atatattgattatagctgcgatgggagatagttcgcgcgcttcttctcaaatctttaatccctcccacacggcatcccatatcgtgacatctcttaactaatatcgactcacttcactcactcttgcacagctacctcattctccccttaactttacacatggcacagaaactataacttccttacatcttgccttaccactgcatttcaggtaagaacttatcgaatgaccccggctgcacactaccatactccgtataagacgtcgtggcccatgacaatatatatttattttctcaccctctcacttgacatttataccc

SEQ ID NO: 7098 - DNA, 488 bp, Homo sapiens
ctgtaaagagacgactcctgctccttaagctgtcgcacaaataccctatgctgggacatcacagccacttcacagatggagtctcgctctgtccccaaggctgcaatggcgcgatctcggctcactgcaacttctgcctccagtgttcaactgattctcctatcccagcctcctaagtagctgggattacaggcgcaaaccaccacacccgggtaatttttgtatttttagttttgatggggtttcaccatgatggccaggctggtgtcgaactcctgacctcaggtgatccacctgcctcagccctgcaaagtgctagtattacaggcgtgagccaccgcacccagccatcagtaattttgttttaagagtggttggctatccaggagttggaataacaggtggatttttctttccttctcacatatttgtatattaccataattgttaacaatgatttagttttatgaagagcaaaaaaaaaaaaa

SEQ ID NO: 7099 - DNA, 212 bp, Homo sapiens
aaaatttctgtaaaacatatatagaacaccttgtgaacgaagccacagaaatcaacatgaatgatgaggctttgcagaagctttggccacagatgtacattgagcttgttagggatgcagtcataaaaatccgcaataaaaattcctatatgaagctctgcctacagcacataacagaccaaaaataaaaatggcctttatttacaaacaaa

SEQ ID NO: 7100 - DNA, 1844 bp, Homo sapiens
  misc_feature (1)...(1844): n = A,T,C or G
agtgacgtgcgtatattacgtnaaagtgtcgtngggacgantccgaattcagnatgccgttcnctagatgactgtgactacactncnagctagtcgtcatctatgctctgcngtntgcagcactgcatactcnnncntgcagcacngagtacntacgatgactgtagtancgntgaagtactgtnngcgacgtgtcgtaacatggcagtntgntangatgcntcgtagagtagtcgtnagcactatgacactgntatcacatacnatgaagnantatgcgangtacgcgccgntcnacgagtntangctggtagatactgtnagacnatacgacagatgagttacgtagtatgtgagtagaggtgtacatgagganacgcgtngangacgacntgacgnnaatgtgagttgatgtgtagnatacatcagntacgttattcatgtctggantgtcagctgnagtacntgctggtgcgtatcgtatggtatatgctaccgtcgtcagctgctgcggantgggctgagtgagagtcagganggcacacgtgaacgnagcgagtantagagtcaganggacgcnggngtatcantagtcgcagatggcagtcatgcgtactggnagcgcagaactagcnacgcacngnanngcaacgacgtgtgtgtagcgcgtagatcgatcgaatggtgtagtacnggangctagtcgtctatgtacntatgtgctatatgtcagtggtagantggtagtctagcgtatctgtgngactgtgacnatcattgcgatacggttcgagactagcngngtgcgtagacgtggtatcatactcttgtggatatatgtactatattatagaagatatgtgatgtgcacacacagttacananagaacatatcagtactcatctagtctacgtcacatcatagcgtctccacaagcacatcgtcgaatacaagtcttagatcgctattgnactatcataaatatcgtgtcgctaagtgtgatatgtatctacatattaaattagtggccttgcactcgtgtcncctcactcgagcacacattcgcattacacctctcacagtagcnctatgaatgacatcacttgatatacgtcgcagtcattagacgaantgtcttcatcgtagcgactgtataagtacaagcttatggacagtgagacctatacgaagganttgatatcgaggacgtgagcgcatcgcgcagcactatgngcggactctcttctgccataaacgacgacaatctatgcatgcttgacgagagtagacngacgatctcgttctatgtgacgttgcgatctgtgtacgcgagtacgagctatagatatgtgtcgcatgatatagaactctggagttcgcgactgattcgcctntgtattagtatgacacatacgggtgtgtngagagtgtggcgttagactagcgagatagacaagttgtagtagttatgtgcagctgttattcaatacataccgtataaagnagaataaaacgacggcgatgcggtgagatggctttgggtcagtatgtgggatccggtcctagagtgggaagttggtgggatggtgggagagaaaccgccagcacggaatgtgtgattagggcgtgcgtcgtcgatagaacggaccgctcgcaggtttgtatagcttttgcttgcatagtttatagttggacttcgtgtataatttagtggagaaaatgcatcatcagagcggtgcgggggatactatcttgatnagatgttacgacgtaactgtgtggggcgtcttggtgcaggcatagcggcggatacaaatccaatggccgtggggtaggcgggaga

SEQ ID NO: 7101 - DNA, 728 bp, Homo sapiens
caatcttcgtaggttcgatcatgtttttcatataatctaaacagcctcaatctgctccatttatccatgtcatatattctcgtgccacgtagatactttctggattaacttaatctctgtgtcgcactagaacgactgaatttgcaattaaatatcgaattatggggatattacaagggttgctgtataatttaccaaatgatgctttaatctgtatcagaaaaggagatgtcttgtctacacagaggaatgggcgataatgatttggaaagcgaaaggggcaaaataaaggaaatactagcggtcaagataaatctgaattggtgtggtattaacctcaaatcttcgccaaaaacaggaacgggaatgtgtgccttatcgtcaaaaggagatgtatatgacggggtaacataattaccacggatgattccattttttgacatataggagaggcatcgctatggttgttttttacaagatttcgtggttcacgttcctacgttgtatgctaatcaaaccatcccatgaaatatgcaatacaggtgtatacactccccacccagccgtttcagtactatttagcataaggctgatccttattgtggccgcctccacaactcattttctttatagatgaacatggttacccacagtccatattttacattaaaaaaatcaatttattaatcgatgcgcatatagataatttccaaaaaattggcacatgt

SEQ ID NO: 7102 - DNA, 1366 bp, Homo sapiens
  misc_feature (1)...(1366): n = A,T,C or G
tnannttatnatgnnnnatttaaaattatagaagattaaatagaaaataagatacttgtatttaaaataaaaaatgatatttttttaataaagaataaacactattagcctgcactctagacaaacaccaacgcactcccatgaatccacaaccataaccaaacactctccttggtgctctcncgcacgtcgctcactggcagcgacacagcacctcttgctctcttctcctcctctactcgccacagagaactacattggaaattngtcacaataactcttanacctctactaacatgtgactantaaaatataacatgttatctatcattaataggaaaatagaacgaacaaacacaaaattcactatgaccaacatccggacaggctctaacactattataattatcatacacagcacctcctccactcaccacgacggaccataagctccataatacacgtacagcacctccacaccccccgcccccccccccgccacctccacacatccccaccaaccacactcccacacacagacacaccacgacatggcctagactcatgtgctccntagcagcaacacacacacaagacaacacacactgagtctagcgcgcgcaacaccgacgacacgaatataagacagtatgcgatacagaatacaaactncacaanacagatntagcacagataataaagatacanacaacaaacgacatnatataatctaatatacatgatgacaaacatagcaagatataccacaactatatacgtanaangtaatacacagtacgtactaatatagtatagnancantaanaganactcaaanatcgagagaatataaaataagtacgaataccanaccnatacaccccctcacacgctatcgngacacacncacacacccatccacgacgacccacacgccccccaccacgcgcagctcagcacgagcacactatacacagtatctatcgagcgcacatatacacaatnatcnagctaccgcgcaacgcacgagcacatcagaccgactaacacacgcacgactactcgtnactaccgacanctccacaaaactacactcagctncagcccngcgtccaccatacacagccaatnacacaccnacnanactatctagacgccacnacgatncngaatantcataacnattacgtctctacgaccaccatccnactacatctcnagcgcccgcacacgcacnacgcgtcanacccnacatcnancanacgtcatacgctgacgcacacacaaacgacacncgtacatctacatctgnaggtatactgagtccacgcgcacacatcacacgaaccaacctatacgagcagct

SEQ ID NO: 7103 - DNA, 1561 bp, Homo sapiens
  misc_feature (1)...(1561): n = A,T,C or G
cccacccccccacgggggcgacaccccccacaccctcccccgccccacgccccccgcaccggggcccgacgccgccggtgcgcgcgcaccgccccggaggcgtggatttgcgccgcgggaaggcgacgggattgctagggaatgacactgcgtgcatgtgctgtagaagaacaagagagctgccatgacgtaggcagagaaacaagggatgttgtatagacactctacanacagatcacacagtgagcacggacaaagagaacttgtgtgtacatgtgtgtcactgcgtgtagctggaccaggggacgagagatggatgtgccacagtgtggatgagagtgatgcgtgtgtaggagcgtgtgagtgaccntgtnagagatacacaaagccacgacgtagacatagcaccgcatctcaagagagcaaagtggcaagnagcacaagcacagacagcgtgtacgcatgtagacgaccagtaaagaggggcagtgagaagtagtgtgtgtgaagcagtgtcacgagggacctgtgtgtgcagtcggtgcgacagaggcgtgttgagggtggatagtgagcgtgtacgggcgtgtagagggcgntgtggcgagggtgtgcctggcgaggcgcgagcacgcgccgcgcgcgcgtgcgatgacgcgcgacgccgtgcgcggtcancggagccacgctcgcgcgcgtgtgtgcgtgcgccgcgaggagccgtcgcaagccgagagtgcgacccatcgcgacgctggccggcgngccggcgcgcgcggtagacggggcgcagaccaggcgcgcccctcgcgagcggcgcgcggcccagccgtcgcctcccgtcgtgtgtgtcgtgcgtctggcggtgcacgcgnactacgacaaacgcccagaacacgcccaaccngccacaataacgcctacgccgagcccgctggcgcacgtcgagcgccgcgccgcggcgcgccacgtagcagcgcgagcgacgcacgcacgcggccgccgacgacacgcacgaccacccccaacgagagcccacacgaaagcggntccgacgcaacgcgcaacccncgcgcgcggtccgtccgtcccactacactcacgcgtactttctcgtgtacccgccgcgaccgcacccgacaangcgagcagaaccgcgcagcgccggcacactcacgacacaaccgcacccgccgcaccaccacaccacgctcgaggtacgcgccgaccgcgggcaggccgccgtcgggtagcgcggaacgcagacacgcaccaaaccagcacacgaccgaagagacctgagccagcgcagcgtcgcgcgcccgcgacgaacgagcgccactatcctacgccgagtcacggcaganactcgcactgccccgagctgatccaagcgccgccgcgacaagctctcacacgacgaaatatatcacccacctccgccgccaccccatcgccaccacgccaccacgcgtactacgccgcgatcacccacccacancgcgcgtcctccacgccgccgcagagcacgtgaacagcatanacaaccacacccgccacc

SEQ ID NO: 7104 - DNA, 1805 bp, Homo sapiens
  misc_feature (1)...(1805): n = A,T,C or G
gctggaggaggnattagagatgtgatgatgnggtgaggacaggtgnntgntgcgntgcngtcgatctctaccgtacctgccacaggtcagtcgaccatncagntgnnaaccgtcggacgacagcagtagcacgantacagnatanagcccataaacattatanacacggcaganatctagcgnagtgnatcagaccgntatcgggcagtgacgagatgacgtcgagnanacacgtgtcacgacacgagatccgatatgtagagaatagtgttactncgactgatccagatntcgcgagcatagtcactgcngctctctattgnctacagatcctgtanacgtcattatgtaactcacatgtgccgtntgataacgagatcgcagacagcaacgnagaganatgagagaaacagaacaacaatcaagaatatgacatgncgtactggtagtataagaagcgaagaggagacgcatgagtntagtgagacatagtcagctgtacgggtgagatacgcgcgacgatacnnccgcgcaggtnaccgcgccgcgtccccncgatccgctcacagcatgagttcaagcccgcccgcgccagcatatgcgccggggcgcagcgcgccgttcacatcgccagagtacacagatatgtatacnccgtcgcacgtcgtcacagttggcgcgcccgtgttgcaccactgntttgtatatgtcgcantctcgacagtgataagcnatatgtgacgtaatcaaacacagtctgtaataggagantgtgtctcgccgcggtggacgggtcntggtagtacnacantgcggtgcttaatgcattccaaggcactagacagtagatcagcgaganagcgcancgtcntatgtgaccaacttagactgagtatgctnaggacaagatagaggcaggcgcagcaattataattgangtagtattaggcactgccnagggaatgcgatcgtcgctgttagtgcgcggcgacaatcgacgcgcagtagtagagtactaccgctcgcacgcgggcgcgtgtcacccgagcgcgcgtgctcaccgcggtaagtcactagaacgcgcangcagtacgcgacgcagcgagtattagacatgcatatcacacgcccgtagcagcggatagtcgcatntatcnatcatatagcggcncccgcgcgcgcntagcgtcatgtaagctcaagcggntgcgtctgtgtacgcgatggcgagtgcgcgacaagtggtcgtacaggnggtatgacgtgtnacagatacngtncacatcactaatgtgtccgnctgctactatatgctagacgatcgctgtctgtgggcacgtgtgcgnggtgatcntgtacgcncgactactggttgcgtacacgcgtcactacgcgaccgcgacttaggtcgtattatgtgacagacctacctcggtgagtganatgactgacgtagcacggacacagtgcgatatgtagactcctacggtaaccatgtcgagatacnatatcgtagcacttatgngatagtaganactcacgcgtacatctctctctcgtgacagantagaagcntctcatgttgccaggggcgctactcctngcacgtgcgtgacgatcgagcgntcatggcatatactatctatattgcgccngcgcactctcacacgccagagcccagtagtgatactcgatcnacacatagagatgtctcgcgatacacaagcactacgtacctagcatcgcgatgncttgtagagcgtgcaggtgagtaggacgacacagtgtggagcnatacgtgcctg

SEQ ID NO: 7105 - DNA, 1189 bp, Homo sapiens
  misc_feature (1)...(1189): n = A,T,C or G
ggagatctatacaagtatgtgaacggggtgtagtgatcggtatcgataccacaacccgtgacgtgcgcggacgatctcataccacactcccgtgcttgccattggtcgagggtgtatntgcgcgtattccatcacttcaccctgtgtgtgttgaggcttcgcatgtcgtacgcgatttttacttgcctagtccagtcaatagttagatagcgtttaaacagtaatacgagacagcggagattgcatggagtcgggccgtttggcggaggtggccgtcgacccgcgcgcggcggaaaagtttaattgccacacacattgtcgtgcgatgcatcttctttgcttcgtatacccgccccctgctgatggcctgtttccgtaaagtttggcttttcgccttaccatggatactaacgataggggaatgggaacttgatgccgggtccaaccgactcgaatagtgaaggaggagggaccaatgatagggcgtctggggatgactatggatgcgggagtgtgtaatatgtgggagatgctacgagtataagagacattaatccggcgaatgcgcagatgtatacaattgcgaggctcggcgctattctattgcgggcttcgcgctctacagtaccacactgtcgtccccacgtgttatggactgtaacgacgcgaggggggtgtcgaactaactcgttgagtatgtgtggtttcaggtaaggcattgagtagtgaccgagtagtcagggcgaataatgatagtttatgtagtatcagacagtgcacaacagtggcgataaatcgacagcccttggcacgggtcgtggggaggactgatgtctagtggtatactcgagaaccaggattcactggtggactgcgangcatacctagtgcggtcgtcacgtgaactgcaatcgaccttgtgcctgatgcccctcgtgtatcagtaggtacaggcgtgtgaaccgactgagctagatacgtgtttgccagcacgacacgtgcctagcggaccacgtgcacgcgtgcgctgcgggtcatggtcngactctagtatgtgtcaccaccgtgccaccgcatcncacgtgtgtccgcttggctgtgtaggtgtggcatagatgagaganagagtncgacctccaatgagatcagatcaatagtgggtggcagcccggaaggagcgactgtagtc

SEQ ID NO: 7106 - DNA, 1082 bp, Homo sapiens
  misc_feature (1)...(1082): n = A,T,C or G
ggcccccacgaccccccagcgggaaggcgagaggaaggaagagaacgaagaagagaagaaaaaaaaggggcgcgccttccgggggcaaccggggggggggggtttcgcagaggacaaaccaaccacaagaagacaaacgcggcgcaccgccagcgcccagaaacacaagagaaacgaaaagcgaagcccgcccccccgaaaagaaagaaaacgcggcgcccacgaagagaccacgagagaaaaagagcgcggcaaacagcaccgaagngagaagggaaagaagaacgagggcgccgaagagcagcggccagaagaacggagggcggcgcgacagagcacccccggcggagccgcactttcacagcgaaaaagagaaaaagaccaccgggggggaaacagcgagaagacacccgcccagcggggaagaagcccagggggacgaggcgggaaaggcgacggcgcgcgccaagaccccgcacacggccccacgcagagacaaagaagacccgcggggggaagaggtgaaacagaaacacgagcgagagcggaagcgaagggaaaaaagggcaaacagatagagggcccggggccgcgggacggagaggcgcaagacaaacgcgcgaggcgcaaaggggggtggaaaacaagcggcgagcaagaaaacgacgcggggcggcgcaagaaaaagaaacacacgaaggggcggtggggacgagaggcgcgggccgggcgggggatgaaaaaagaagaaaacgcgacggagagcgcgcgcgcgcgaaaaaaccgacgggagaaccgaacgaggcgacaagacgcgcgcagcgcgcagaccaacgcgggaggcggcgaacgcgcggagggaacgcgaagacaggggagaccagggggacgggagccggaccgacgcggcgccggtcgaacacaacaacaaccgcgagaaccgggcggcgacaaaagcacaccacgcgacgcaagggcgacaacgagaatgaaccgcagcgcgcaaaaggccgagaaacgcaaccagcggacgaaacccgggacaaacggggtgcgcgggacgtcgaagaacgagacgaata

SEQ ID NO: 7107 - DNA, 756 bp, Homo sapiens
  misc_feature (1)...(756): n = A,T,C or G
aaggattaatctttagtacatcatgttaatagtacaaagccaagtactatgattaatcctcaccatagcatttttatatcctccgttcaaggttagttagaaagtcaagtcaatcactttatacatgtaagagtagtgttccaaagtacctaagctagttgtttcatttttaagcaggcagcaaaaaactttcattctggtctttgtgttccagcaaattatacttacaattaacaccatcaatgatatcataaaaaatgctctgcttttaaatttctgaacttcttcaatacaaattaaaatagtactggagtcttttgggaggccaatagctagcagttacattaactggtgtagaggagcctccttatcgataaccaggtccaggttgggtatagccctgaccaaagggaggacggttacgcgcataaggattaggcccacttggaggaggggtcatggtacttccaggaagtgaagtaaaacctggtcttggttgataggccccaggttggcttggagccattccaggttgagaggcaggagccacagtataattagtaggctgagaagtttgggcagtgtaagtttgtgcaggataattgctcgcctggtactgctgtggcggctgagcaggcagttgttgaggctgaccagaaaaggcaggagctggtgcctgggaagttggttgctggccatatccctggaactgctgaggttgttgaggtnccagtctgctgactaatgagcttggct

SEQ ID NO: 7108 - DNA, 892 bp, Homo sapiens
tttaatctttatgtctcaccacagcgaaatcggcctcgttaccacatattcattcatcacttcatctaatgtgcgagtgcgttttctattattactcactaccgggatatcacacaaaatatgacagaaaggttttttcatctattgttgtagttgcataaaggctttccggaaccaatgcttagtcctgtatctttgattccacacgatggtcataggtttttcaacggcctattatgaaaaaattgtttttttttcccttcgtgggggttattaaaacattaatttaaacccttttctttttgacacaatggtacaaattttcatattgggcaattaacactaactggaaaagcccaagttattcacatgattggatttttatccttaaattaaaggtaaatggtaatttcaccaagtgtttccttcccaagtgctataaatgtttaattaatgtagtttcaataagtaacagtgttaaggtcagacaagttgttattatttataaattcaacaataaaacaaaggctctaattcaaaaaataaaacagagactcaaattcctaggatttgtatgtatggtaattgtaacatgaaagtcacaatatgggataatgatcatgtttcctgcttatgttaaagcatcttccataatgttgtaatgtgtcttggggtcacatcctgtttctaatatgttccaatgagaagtgaccttgagcaaattgtttaatctgtgtttcagttattagttcacttacctgttaaatgattataataatatgttcaggtagatttttgaaatttaaatcagaggttgaactaaaacctttacaataaagcccgacgcggccgttttttatttctctgctagtattaatatcctatcttcttt

SEQ ID NO: 7109 - DNA, 837 bp, Homo sapiens
tttgaagatagatgaaatgattggaacggcggagtattgcttgtatcctattctctcttacccttttccaccctcctctataacattaatataatatgccacattctcccatgggggcgcatccctaacatgtacacatagaagcacagaggcgttccagcttaacccgcaatgccagacacactagaacaaaatcccctgacgcgtgcacccttccaaaaaaacacgcacttcccctccacctctgaggtaatagtaggggagcggggagccaatttagaaataatataggtatgggtattttcagacagaagaattcaaatctgtggttttaataacactctacaggaattcctgtccaatgcaaacaaggaatttagaatttcgtcagagtaaatttaataaagagtcccactaataaataataatcagggtggaaattctggagctaaataatgccaattggcatcttaaagcaatgcattagagtcttttaatagcagaatggatcaagcagaatgaattagtgagctgaagacaggctatttgaaagtacccagtcagaggagccaaaagaaataccaataaaaagcaataaagtacacctacagcagctggaaaatagcctcaaaagggcaaatctaacaattactggcctcaaagaggaggtaaagaaagagataggagtagatagtttattccaaggaataataacacagaacttcccaagagaaagatgccaatatccaggtacaagaaggttataacacaccaagcagattaacccaaagaaaagtacctcaaggactttaataattaaactcccaaaggttaaga

SEQ ID NO: 7110 - DNA, 1334 bp, Homo sapiens
  misc_feature (1)...(1334): n = A,T,C or G
tgcggaagagaatggaacgtccgcagcaggtcgcaacagacagcagacgagagagaagaggcgtagtgagtactctacgcaattaaggagtactagacattactagagagtngtacatcgatagaatattcagactcgtgaggccgacggccaggatacagcgtctgtaccggattgctcatcttcactcctcacggtataccctaacatccgcgactactgtctcattggacgatgggcacaatccagcatatacagataaagactcgccgttgtgtcaagccactcgtgagagaacgtatgtagcggcacttatgagagaaggtcacagcgacatagcggaacggaggtttgcatgtgagcgatagtaatgctccatatcgaaaggcagaagagtgatagcatcccagaatctctgaaccactgcgaacaacatcacattagtcacacacatcgatatctacagtcgtatagcgacgacagttctaacacaacgcatgtactagatagtcctacaagataactgatcgtccatctcatgagtcgctcgtgataagcacacggcggtcgcgcgtgactagtncagggctgcgtgcttncacaacacgtagatacagcgtcgaagacaatactaaacgagtatatcggagacatgcgctgtaagaccatagagaagtgcgagagccgatgagactacgagcgccgcatgtttgctcgaggtatcttcggtcgagatcacgtagactgtcccangtcactgatgggcatgcatggacgggggatagacgantgatgccgactacgaccgcgtacacagcgatttacactcagcgcacacatctgacgcgtgcgtagcacatctgaggcacactagagccacggaagtagataacagcgactgaatgacgcacagcgcatactcncaacagtatcagttcggatcaacagcggacactctataatacacgcactnattaatacacagcagacaagaacggaggctaaatcaggaccaanatgcatagcgacgccgtaccagcaggtccacagacgcacgtacacatcacgagagtggtacatgatatgagntatagacgaagaatgtgcgcgcgcgcaggtcgtatantattgtgatggtgatgatgcttctgacgccccgctactgtcctcatccgctccctgtaagactcaggtgtgatagtaatcgctcaatctcgactaccatgacagaaggtaacgcgtctccgatgtagctcagccgctgagaacacantgctcagaangatatcgagggagatgaggtagagaataattgagtgtaacaacacactcat

SEQ ID NO: 7111 - DNA, 1747 bp, Homo sapiens
  misc_feature (1)...(1747): n = A,T,C or G
gagacgcacccagaagaaacccccggagccggggncggggggcggccttgtagtngacgggggcggnggggctccgngggagggaacaggngccacnaggaaaaggccgcaggcaggcgagggacctcttcagaaaacgagcgagcaaaccctctttagcacgcaagcggacagcacacaggcagatgcagcaaanacagcgancagagagccgtaatatcctgcagacggtgcagaacacaccaagcatccggacgacacatacctagagagcgcacagagcgaagagggaaatggactctagtntataagtaggacgacagtagcgaataagaggcgtaccacgtagaccgatgtcacaccgcgcgcgagggtcttttcgtctataataacgcgtccgcgcgagcagcgcgagcagaccgagnacagcacgaagagacgaccggatgatcgccgcgagccgccacgagcagccgatgcggccagcagagatggacatagagacgcacggtctaagacatggagtccacatatgcggctcgtgcgacggacgcggacgcgccagcagcgcggagagagnatagcgcatgtggatcgaataaatgcaggcgagccgcagtatgcgtcacgcacgcacgacaagaagcccggagancacagtcacaccgcgagaacgcagcgcacgatgcatgcagtagcgcaggaagatgagtgnttactcaccacacgcgccactagatagacgcgcgacangacgagtagcgcgacagagacgatgcgcnagngcgtcaagatagagcgtangctccaagatatacagtacaatcgcgatcgcacgagcccgcgacacacgccatcgctacgcaagacacacatcgtaagaatgtacagcagcgagctcgtcacgcgcgcactcgcganactacagcgtgacgagatactgtatantngnantatactgtcgcaggccgncacgncgcgtcgncagacaacacgatatgacngatctagtaaacgagcgagatcacgcgacgcaccccgtcngcncgcgcgctgcgcncactcaaagaactgatantacgatgagtcgcnacgtactggcagccgagcgcngcacagancatntgcgancacngagtactagccgaancacntggtcgagcagtctgatcgcganacgcgagtgtcgatcagtcagcagcantganctnnagtagacngcagcgtgcgagagaattgntgcngcgtagtagacgctaacganagacgatagtgagccggaacgcacanangtacngtcgctacgcagcncacgacgcgcgacggcaacnagcgcngacgtgngatagtnagtgctagctgngccgaccntgcgacngatgtcgcatcgcagncatcggtgaacttattatanctgctcnactaggctganagtagagcagttgatgcaccacgactgatcatctgagcagagcagcgagccgtcacgtcatcgnangtnanacatgatgagatcagtgcagtaactgcganngcngacgacgtgacagaaangnacnacgcatgcttngacagcgcagtactacatccgtgcgagtnntacagcatgacngtatagnacgtgagtagacgngtaagncgacagangagntgtngangtagcacgagcagantcagcatacnagacgagnacgatgacgagcaagatgcacgacgagnacgacgacagcgcaggtcnacgtcgnag

SEQ ID NO: 7112 - DNA, 907 bp, Homo sapiens
cataacatgttttctctcacaaaatatcatcacgcctctacatcataaacatcttacctcacacctcaccgaggagtgatgtgggtatccactctaataattatccacaacaacgctcacgcatcatcacgacctaattttgtttctcttcatacccgtacctgtcacatccatgtggtcgttctacaccgcgaccacgggaaaccccatgaacagcgcggcttcttggtgtaaagtcgtcttttccacaaccaacctggggttgcacagtactgcaaggggcaaacaccaaacaaaaaattttttcccacctgcccacaaacacggaaacccacggccacattcatgtctaaccaatctcactttcaaaaacaccctatatcggagcgacatttccccgcatcttggtgccttctcatttgttggcaaggaccatggatatgatcattatgtttccgcccgagccacctgctttgagaacggtgaagaaataactcactccccaaaagttcgtagaatgtacgaggctggacatgatggatcaaaaggaggtgtaagtgtccctcccccggtttaaattagaggaaagctacgacatgaagagtgtcctgcgcaacctgggcacccctgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggatctgttgtgcggccgagtaacatcattactatactactacttatcgaggtcacta

SEQ ID NO: 7113 - DNA, 1300 bp, Homo sapiens
  misc_feature (1)...(1300): n = A,T,C or G
gtgttatataatcttagagctaatattacgttcaaatatcagacgctcagactaaatatacttacacaagtctctacgaaacaagctacagtaccggcgcattagagaactatctagcgcggggtgtagcatgcgcccgtgtaaccgaaaagacaccccgcaatgggatatatatcatacattagcatctaattaatttcgatatattacctctgatacaaactcgatagatgcatttctattattgactcgattctcatgtgcgtctgtgtatgccccgtgtgagcagtatccgcattttactcaattgtaagaagatatataatgagacgcattcccggagatgtttctgcgacaatcgaaaaagtaaaaactagaaagcccccttcggcgcccgccagtccgcgcagcagaatattgatagagaagagcgtagcacagctatagtatagagatnatggtcaccgtgcggcgcgcgacgcaccatcctcctatttntattatatccttcgtattttcgcgactctccgcacgtcatttttacagtattattgtacgcatacgcagtcgtccgaacgatgtatagccgtgtgtcgctgtcatcgccncgcaccgacgcatctagtgttatacgatgtccctagtcgactcgtatcgcgacaccgtcgcacgatcagcatttnatcgctcctcctagttctcgccatacgattatacgccatattgtgcgagtatgagatagcgatcggtagttagttctcacgacaccgatacgcgctccagtatcgacgtgcatantantagtagtcncgagtatgcgacggtgtgatgtgtatatcagtacgcgagngtatacgtatngagcgtgcgaggcgacgatgagcacggtagtagatgatatatgnagagactcaacagcacgcagagatattcatactcattacagtgatgctgtgtcgcgcatatctcgcgcgcacgatgnagtatctatagtantgatgtataaatacttacccactcgntccgtgatgtatcacttactacgctactcgtcgatcgacattacactcgcttcacggacagagacgctaggctcacgncagctgntcttatgacctggtgcctgtactgctgaagtgcgccgtaatcataatcaactcgccttacgtaacagcgcgatctcgcgtggatgctacagngcangttcgtcgcacattggtagcacgacgagagctgcgtgagtgatcgagcancttatacgtgtcattcgctagacacctgttatcacgcgccgcgacgt

SEQ ID NO: 7114 - DNA, 472 bp, Homo sapiens
aaactacacctggtgcaacccgcgacacgtgccgctcgactatctaatataaaacctaaccccacacgcaggtaccgaaatcatcaccataattaatctcctcactgcgcaggtggtggcgacagcggacgtctacaacgatcaccacgacagatcgctgctagtacgcattgctccgaagttattctgatcgcagggggagtggccagtgttgacaagcttgacatgggtcgccacaaatatcataccgcacaagaacagaaggctcagtaacaaacatctaatcaatactaccccgtggaaaaggaacgtaccactaataaacggaccaacttcgcctaccgcaacggcacacgccgccaactccttcgaccaccacacgaccccaccatatactgaaattacacatcctaacatgtatcgataccttcatactctcacccctcacccacccccaccgcagtataacagt

SEQ ID NO: 7115 - DNA, 816 bp, Homo sapiens
atagaaaacgtttcttatataaagaaaacaaatattgctctgggcggactgtctgtggtggtaaaatttcctttccgcaaaacgcaccaagaggaaaattctccattatacttttttatgaaccccctgggtttttgggacgaggttattgggaatggcttcctagaacaagacacttccccaaagtgtgccttagaaaaaagaaagggggggcgcccccaaccgcgcgatttggtggttataaagattgtagggtgcgcggaaacgttttgcctttgcgagagaatgaataaccttcttctgtataatcactcgaccactaagcggtgagcacgggtgtgtcacaaaaaacaaacttgggtgttttgacgccgcccgcaccatcgcaccgaaatccgataacgctcggttaatgctatatacccacaccccccttcctcaattcccctatttccatgaccccccccccccttctccgctgatttattgccgccaaagaccgccatgcgcgcagagtgaacgacgcctcgcaatccccttatttggcgccctcctccccgccatttgcctgattcagttgtcgtacgcggattagtaaccgaacatacggtaagctgtaattgtccgctaacagatcatcccggtagagatgtaccggttcgccccccgacatcccgcggtgttgccagaatatatatcgcgaggcccacagcgttcagataatctactaatattactttaagcctgagttataacaatattggcatcaatcagcatatcacgatgaagtagccaacccagtaccttcatatttag

SEQ ID NO: 7116 - DNA, 871 bp, Homo sapiens
  misc_feature (1)...(871): n = A,T,C or G
cttaatcaattagagacattagtgtcattcacctgaccagtgtgatgaagacttcggcaaaatcatgcagcattcgcacgcctcattagcaagtaaagtagcggatacacaaggtcattatgaacaaacaagctaccatcatagtaggattcatcaggaattatgatggattctaggtatttattgtccgtcgtagtgagtataatttccgatttatccgtcattagtaatcgttcagtagtgacagtcgaggtcaggtgagtccaggatccagtgcaattcaaccctccatctagaagtgtcaagccgtgccgcaagtaagtatccatccgtctaacggcccacactgagagccccacatgtcttgtttttcattattcgaaacaatcatgagcttctacatcacgatgaagtctacgaagaacaagaaagatcagttgatatgtttttctaaacgatctatgtaatagtagtgttatctagtttgattcgagttcccttcgaccatgatagtgctcgangaataggccgacaaaatcaagtgtcatgcaaaccactagagtggattatttggatacagatatgttgtgcaagtcgatatgcatgcgcaatttgttcaatcagttggtacgagaaataatgctgcgcatattagcactgtacaatgagtgcacaaagtattattacgtggcgcgttatgtgaagtgagcgtagaggcaggcattgcacttccattaacaatgtaatatttctgctcagtgcattattacatatgcgaacaagaatctataatgattagtacgttttgaaaggcagaccaaccctgttagttatatttanggctactaatgancatcnatggtgcaggcat

SEQ ID NO: 7117 - DNA, 925 bp, Homo sapiens
  misc_feature (1)...(925): n = A,T,C or G
ttcattatctacgatctatacgtatactgacacgttccccacaatcgcactcataattaattctccagctgccacttgatctctcaatgcttctacctattcacatactttctcctcactttactgggtgaccccttcctctgctcatatttgatctacccgcatcctgcccgctgtaccacgcattctattcaccctcgcgcatcacatacgaggtcatcctattccacctcttcatcctcttcggcacgtcatctatctttatctctccatcttgccatgccaaattacactaatataattttctccccacccccccattaccataccgtacatctgtagacctcaacaaccacttactatcgctcttcctcgtctcctcaaatccaaacctactgtaactaccccccctctcccacagactcaccaaccggggtccgttcagcaaatgttcctccctcacatcctccccacaccttccccagtaactatacaaattatcacaagcccacacagttttttttttgtcccatagatctcacgcgtagcgtttataattcatcatccgcacaaggctgttgccctgcccgcccatcaaggatggatgctcttttgggaggccagggtgggcggatctccacctccaggacttcagagatcagcctggccgacatggtgaaaccccatctttattaaagatacaaaaaattagcagggcatggtgttgcgcgcctatagttccagctattgaggaggctgaggcaggagaatcgcttgaacccagaaggcggaggttgcagtgagctgagatcgcaccactgcactccagcctggtgacagagcgagactccatctcaaaaaaccaataaatatgatgcggccgcccncctccccttcttacctctccacctcatcgcccctcgtc

SEQ ID NO: 7118 - DNA, 1403 bp, Homo sapiens
  misc_feature (1)...(1403): n = A,T,C or G
atgtatgatgntgacgtccgtacagatcatcacgcgacagactcgtctgctgtcgggcactagaacaataatgaactgcaactaacgacgaagtgtgcgcggggcgggggagataatattgcacataagacgaacactctgctcgtgcgtgcggtagagcaggacaaggtgtgcgaggcataacataataggaactagtgtagatacattagtggtgtgtgtgtcggcggcgatctgcatctcctgtgacatagctgcggtgnctccctctttatncatctcgatcatctcntcncnntcncnctcgcctcgtccaccacacctagagatagtgtagtgtgcctctcaccatctcaatcatgtctatccacacatacactcacattctgccatctgcacctcctcatacgtattgtacagctgaggacgttctctttactatactccgccatcagtgtatatacggagcgacagtacncggtatgctcaatacacaatgtgttcagagtattgtgtgttaatgtggcgcgagctgcgatgcatcctctttcctaactaccactcgctcttgcgtattcatcgtaacagtgtacttacttacagcgcatatggtgtgtaactcgggccgcggaaatgcaaacgccaccgcagcgataatgagtgagcattgaccgcaagctacactcgtngcaacgtgtcgcgtactaatcaataaacagagcctcggacctcacgaggcctactgtctgtcgcgctcgacgatagtgatgtgtcgtcggccgcgtcataaatgagccgtcgaccgtaggacagncacatgtctcgtgggagttcggtatgcggacacccacggaaatcagataacgcagagtgttaaatcctagggcggatccgataatgacctggccatagcataaacgcggtgagatcgatggcgattcacagcgtgtgataagcgtaggacggtaagacacgactactagtatgtcgtacttaatagaagtataccctcgttggattgtgatcatgaacgnaaaccacggaaacaatactggggtgagctgcatattcggattaaacatctctcaatcacgtagcgatcatggcgtactaggttcgtgagctctcttaggtgtgttgtcttatatatgtgtatgccctcgtacacactggtcttccgattgaggtctataggaccacaacgaacgctagggttgagcaacagctgggtgcttatctcgcgccagcctcgctattagcgtagaagatagtggtatgtacgtcatacaaacgtagctagatatcggtgctcggcgcgacctggtaattcgacaccggagaccgaaaagcaacaaggcaagtgggatattgtatagaaaataacgggataggaaggacgcaaa

SEQ ID NO: 7119 - DNA, 1967 bp, Homo sapiens
  misc_feature (1)...(1967): n = A,T,C or G
cgacgncgacatagccgtggcactgacgctctccgcgatgctgctgcntacctgctcgtctgattgctcgatgtctatcatatactagtacgccaacctgcagcatcatcatgtgctgcggcngctgggggtcgcnggcgagaataaaattacatgatcattaatactgtcgtatcgtcactactcnactaggcgtcacgtaatcactncggtactatagcgtcctgnccgtgctacacgacaancctcgcatcatatgctantcgantctacttaatctgtcgtcacacatccatgncattgnacttgcgcatgcattgctcacgtgaccagctntctgttcngcagatatagaanatagaaaactttgggtgnntacgcnaatcacnctgnncncgctcgcgccgancgnctcngtgcagtccacacgnacatgcgcagacgtcgtntactccgtatatgtactattgancataggtntctnctgtacacctcacagcatcgtcgtcagctcatgactntcagtatactcgtcgtgcgcatgtcgnntagtcgacnatcgtagtcgactcgancncagcgnctcntatcatactctccctatctctatcaccanactcntcaatatatctntcgtatacngactatacgctactantagcntcgatactcgctatccgatcntatatntcgttgtacgtcggnggcgtcagtagcanacgacnngncgcgaacatatncncacaacttgtcatgttgngagctncagagcctgctgtaccgcacgcatctcngtngaacatactatcatatcagnaanggcagacgagtgatgatgacncatgagcgctgcgnngctacnctgcntactcnctcaacacgacgtacgtcccttcgcgacatatatactcgtgctaaatcacatgctacgcgncgtagtctctagtcgcgctatgacnattctcagcacatcatgactccatngtgtatatatctactncncagcngacctctcgtacgcacganatantacatatctactgcatatcatagtcgacttatacatatntantanctacactcatggtcttcgtctgtcgtncactatgttgntctcgctcttctgcgtcacgtgctcgtcanccgangtcgtgtacatgagatantcgatatcgctgctcattcaatttgcgattgnttctgnanagagaattcagtcaacgccgtgctgtacactatatattcacgctgtcgtgagtatgcgactgcgagantaactganaagtactgggcagtctgtctactatagatgancgaatatggacgtgtatgcgatgagctcgcgcgagtacatgtcatatacatatcagcatgaatgattcagagacacgactgcnattagtcgtgagcacgagcaatgcgatnccgcantgacgtagcgagcggtgtgagtgtagactagcacctcatttgacagcgtatctagtgatggcgcggtataatgtgcngctgacgctgcgatncacaagacgcaatgcatgctgtnttcatctgactgctgtccgnttctgtctactccgttgaggtacaccgaccgcaaggctgagtaacaactgctaatactacgacccgcatnanagcatctgtnacgacgaagttactactgagcgcgcgtcantatcacatatatattcntgtacaggggcgctcagctatacacanacacantgctgcgcgcacagcatctctgtatgcacacgcagagcganttgtgatagcccagattcatcacgtctaccacgtctccgcgcctactatagttattcntntatgtctgcaagcacgcagaganagctgcgcgatagatcatacagagcagctgtatttgctcattcgcgagcgagcatcctctcggattcatcgtgatatcagctgacagntgagcaggtctgctcaccacagaagac

SEQ ID NO: 7120 - DNA, 853 bp, Homo sapiens
ctgtgtctgtgtccaagtcaagtagcgcactacaaggtgtatctattatcggaatagataatgtctgttggggggggaaaataaaaacaacagttaatgagagtgagaaaatatgaatatgcgggcgtgcgctcaaaaggttgttcttgtcgactggcaaacggggacagtatagtggaatataatatctttttcaaaagcttgtcccggcgaacagaagggatggtagacatatacaagttgtgagactcgcggtctctgtgcggacgactatgtaaagggtcaattacaaaacaactcggatttcgcttcaacacgcataccatataaatacgacataaaagtggcggggcgaagcccttcgtcggtggctacgagacgagacaggaataaaatatgaatgtctgacgccggggatatcgtacagaatgccgcgtggaacaatgaagaataggcggagggcctaaagacaatcgccagcttcaattaccaggccgcaaaccatccccggagtacaacaaatacacgaggtagtagatgcgggttgggctacgtaataaggtgggcaaaggtggagatcggggaaaaaaagtgagatgaggaacaggtggagacacttgacgagcagacgggtataatcgcattcctttatgccgccctgcaatgggaagctagtgacgagtggagagtagacgatataataattctgtaattgcttcagttcgttgccgcggattagcaacgttagtatgtggaatgaggttagccaccacatgcagctagagagacggcttgacgcgctgagtagcccaggaatgagagtgtggaattaatgagcttgaattgcttacta

SEQ ID NO: 7121 - DNA, 1289 bp, Homo sapiens
  misc_feature (1)...(1289): n = A,T,C or G
ctatatatcgtactcctagtctccactacctgagcgtttacaaaaaaacagaaaggtatattagtgggtggggggggaataaagcaaaaaagagtaggaattggcgttcctttatagcggtgggggcttgtataggcgatattgtttgatattcgggttaattggcctgtacgtggcacgataataccccattaccccgccacggccctcgcgcgagcggtgcgttatgatatatctcaagttgcaatcggtaaaaatgtagaatctttcatcgataatattgcagtgctccactttaagtctgtgcaattctcgacctgtgcatctgatctctaatgatcaagatcgtcgatagtgctggtgggggctgctgtgcccttatatagttacgcaagtccgtgagctatgcacactgcggacataattcacagtatgtgaagattgtggcggcgtacgctcagctcgagtgcagttgtgatgaatgccgactaagggggcgcagggtggttagtgttctctacaggactacatacaagatcatggcgcatagtcggcggcaataagagctagtatctggatcagaacatataagttgataagtattggtgcgcactcgtgattgtctgcgctggagntgtnggtgaactagcaaatagtaatgaattgggtgcataagtgcgcgcgagtcgacctgacgcgccgtgataatccgcggaacgaggcaggcgaaagaaccgagtcaatgccaagaggaaaagatagtgcagggagtgtatgtaatagatgtccacacccagagattggttgtgtcaggagatgtatgtngggtaaaggcgggtactggaaacatctatcatgcaatagaggaaaatattttatcagacattagatcttattgtctgccgcatctgttgagatcgnctgtacgtacggggagtggctgtgcttaggctagtagatgcgtgacagtaatgttaggtgatttctntcacatatccgatgcattactcatggatgtactactatatgngaagctatggcagaagtgcggagacccagcatcccacgagtatagccctgacaacagatgaagacaggacgtatattatacagtagaagaggagatatatatgattcaataagatattcactgagtgatngtacagtgaagtattcacgcgatgagagagctgctggtcataacgctgtacgtatatgaggattctgcgggtagtaatacagtgctgcgagataggagcggtgcgaggtagtgattatgtactatcgtg

SEQ ID NO: 7122 - DNA, 1512 bp, Homo sapiens
  misc_feature (1)...(1512): n = A,T,C or G
ctgcgcctgtcgtgcgtggccgccgtgctgatgttactacattcgcgtttagaganacataacatactgtcaatatatcacatggtgtgggggcgcgaatatatattctcaatatttgttatantgaacatcgtcgatctcattggcaacatcggtgtgcggtcagatacgaggtaccgtagaactgttcttcgcttgccgtccgacgaagcgagtcgctattctatttgtctgttcctctgatattaatcctcncccctnacacatcctntctccttcgcctctcgcagagatagaggaggggagaggcgaaccctcgtacgctcattcggcggtgtgatactcgcaatgctacagcgtatgatgtatgtgctggatagctattgtcgatcgtacaatgttaatgtcctctcgttcgtcgacggcttttcatcctacttttcgtactagtgttattgagaaattggataagagggggaccgccgggccctccattggcgttgtgtacgcttatactacgcgggtaaaatacaagaccggtgagggatagtgggggggcctcgcaataagacgttggggcggtattcagtcggatatttggggtatcgtggggtttagtatgtgtgatagtcggtcgagctgataggtcacgccgcgccgccgccgcgaatcatgatagtgtgagaggaatgaaagaatacggatctagaagtccgtgtactcaagatcaagtctgtgcgatgcatatcgttgtcgtccaactacggtaacttcgagtgggacgagggatgttagagcggntgagggtgtctccgatcatccgtncgtcgcggcatcgatactccagcgcgccggctgatgtgatggccgtantctgtgtgtgtgtgtgtatgtatattgaaggtgcgaagtgtcgctcgcacacacgacgcaggtatctgattatgtggcgcgcgatgcgtctggacgctccgcgctcctgcagtgaggtagagngtgngtgagatgtntctcgcgcactcccgtcgcattatggtacatgatgatttcgtatcacgcgggcgcgccgcggcgctagagaaacatgacgtgtggctcgcgctgagcgtggaacgacgcccccgacgccctgcacgtcttgtgccacgtgatatatgtgcgtgtgagagcgctgagcgcggatgtactcanacaattatatacntatgcgcngncgctccggtgtctgcctcgntgacggagtgtnantgtgtgtntcaggtagcgcacgcgcgcgcgcgccgnggtcatacaagcagaganatataganagacagatagagatatacagataganatagacatcgacatacagatagatatatatagagatagatatacagacagacgtatacatagactnagtttcacacggcgatcncgctcatngtcggtgactatgacgatngtttntcgggtgtaattatgtgattgtnaccacgttgagtgccgttctgtcactgtcagtctcac

SEQ ID NO: 7123 - DNA, 939 bp, Homo sapiens
  misc_feature (1)...(939): n = A,T,C or G
tcaataaccactggacgctcgccaatgctcacccggaccgactacgaacaaaccgctggccgggggcgagcaaacatagcttacggaaagtccccgccaccacccaccccgcgccgccaaacgcaatcaggcttctcctgcgcttctccggaccttctccaccttcccaccgccaaataataagccaacctatttncctcccccccaccccataccacgctggctcactcgaccacgtaccgactcgcccgtcggcgcgccgtatagaataccctccgcacaacccacaccatggacgctccggctcaatatctcaaacaaagtaccaccaattcgcgcccccccgccgccccacttatcaccccacagcttccttctcgcccaccacaagggggcacatcgccgctcccaaacgctctctttccttatgcgaaacaacgcggagcagttatgatcccccggcccatataacgttgtacagcgcacccgcgcaccgtcgatctatgcacaacccgagccaccgcaagttagtccccgaccaggtaatacccgcatatcggtgtgaacgaccatcgccctaccccactgccaggcggccacagaccacccaatgcgtaatgccggcaacccacatcaagctctgctgtagacaagtcccgcaccacgcagtatacacatgtcttttcgagacgaactcacagcgcaccccaacacaaaaactacaataagaaactgctaagggttaaaagtgattgtctctggaaaaatgaaatcggggtgggtagagaaaaggcagaggtttgctggttttcactcccaatccagcagcattatttgatttctttttaactatgtatatgtttttctttgattaaaaactaatataaatcaaccccgatccggccgcccgggaaccctgcaactcgccgccgctcgcca

SEQ ID NO: 7124 - DNA, 1698 bp, Homo sapiens
  misc_feature (1)...(1698): n = A,T,C or G
attaaagtgaaaagacaacagagagcgagaagagagaaaagaaacttttattaaaagaagagaagagaggcggtggagtcgtgttttcggcnaggtgcgcactcgaacgcacgcgccctcggggctcgcgctgccacgagacggcgcgcggcgttgcgtgttggcacatacatctcntttactgtagaaatgtgagttatcggttttggtgtcacctttgagtactcttttccgcggataacgtgaccgtgtccgtataatcgtcgaccctttcgcgtctttcaccgggaaccgtacacccgttaccccggtgtattaaccgagtgcgcatcaagtcttgtaagacacgtccgattttttcacccatcccatatcagagacactttatttgtgacattagccaacaacgtatgtagttacacagtcacactgtgtttggtgtttgggtggtggagcagggataattctgtacaattcttatcctcaatcttatgtacacacttgtgcaccgagcgcgacgattccactacgtctgttagaggttgattgttgagncgtgtcacttcatttgttctatgtatgnacttttgcccaagttgtttgcagacacgaacaacnccgtgtgatgttatctacaacatatcatcagtgtgtgtattcggcacagtaatcgtggttgcgcacgagcgtcgcacgtatagtctgcgaggttataggntatgcattgagtttactgtatattacacacgagacgcgtgtgcccaagcactgaacctactcatgttgcggtgtgcgcggttggatacaaatgtacacgattgaggtgaatcattgagaacgtaggttcagcagagaattacgacgagtatgtgtaacgttagtgacaagagttacggacgcgatctttgtgacgccgcatgggtccactgtactaaacataggttgattagtacgagataaatgtaatagtgcagagctgtngcagtatcaacaactaagaacaggcgtgcttgagttgagaaagccattagttggtcgcggtgcaananacaattggagttatttactcacctcgtcacgtctcgcgtgtggcttatctgccgcaccctgtatatgtaatngtncgcgtgtgtntagcgcacgtgttctgttcanacgcgtgcagcgcgcgcagttgatccacgagcgattacagtgaggtagagaggcattattcgcatagtggtctgagcgtattnatccgcggagtgtttgttggtcgtgccgcnccactgcgtaatncnagtgcggcgagtgncgtagtcnaatgttgtgtgcagactgaactgtcctgtggtggtggtacaacgggcgtcgagcaaatgtgtcgacgccgtcggcatactcacactagtcgcagattantacatccacacacactgcgatnatatttgatgttgcggtgtntagtaacgcacgagcgttggatgaatagagcgcgatagagtaatttctctgcctgttgtcgtagccgcgcggtgcggtttcacgcgtctcgcgagacacgcgtcgttataatacactaccattgtcgacagctgngtagttcacgtntgttgtacantgataccacnacgtggtgcgtggtagtgggtacgcgctacggcacgttcgcgcatcanacatctcggtggataatcgtgtctacacaccaacggt

SEQ ID NO: 7125 - DNA, 361 bp, Homo sapiens
  misc_feature (1)...(361): n = A,T,C or G
atatctagtgcgcgcggcttgcctatccgaggcgagcgaacaacaaataaacaaagtggtgcggcgggaaaaataacaattgtcaaagagaggcaattagacactcgggggcgcaaacgaacgtgatattaatgtgataggaaagccgagaaagccgactgcgtgcataactccgcncgtcaggggcgcaccacgcacatccgaaagagagaatagaaatttgtttttatccaaccatgcccaaacaagataacgcaagaataaaaaaccatcatgtcagagtggaaacccatataaattacgaccaaaagaggggcccgctcaccccccacctgacacgatggatgccctgtaggaatta

SEQ ID NO: 7126 - DNA, 1025 bp, Homo sapiens
  misc_feature (1)...(1025): n = A,T,C or G
atattcatactgctccgcgtctactcatcctgtctccgtacggtctcacacttaaggcataactgtaataagcgatgggtggcgcgggagagaatactcgatataatgtaacacatgatatgatcaacaacacgactacctcggcggttacctccacaactatgaaggatcctagcagtctatgcctcgtttattcttcctagccatctcctcggcgcaatacaaacccctcnccaaaccagaaacgcacccctcagcgcccccaccgtctgcactcacaaaatcagagtgtattattagcacctactactacacgaatatatggattgttgtcgtggagacattttctacttaccgctacatataattcaacggtatctactaatatatataggccactggtggggcgcgtcggagaatgcaaagcacgtacatacctctcacccgtgaggaacaatagtagacataaatatcaacggggtgtgaaatctattgaccgcgccaagaagttattttgcgcgagggaccgatatataatacctcactatatcttttaagcagggcggcattgcgaatatattgcagatggagaaggggaagtattcggtcgtggctcgcgtgtgacttaacaaggaggtaatttcaggctatcatgttttcgcgcccatgagcgcttgacgttcaaagccgtttattacgtaaagaaacgaaaatatattgggagtcgagcggcgctccccatacaacagcttaataactcccaccccccgtgaaatgatgttctcagcattataaattgattttcctaactcttctttggaaaccaaagggatacaatgcaagtgacacaatggcttcccttgccttgtgccatgagtaaaagcttcttgagttctcaccagaagccaagaagatgccagtgccatgattcttgtaaagcctgcagaactctgggctcaaataacaccttgtaatcgttccggataattatttgattactattaagcagggtgagtgatgctaga

SEQ ID NO: 7127 - DNA, 956 bp, Homo sapiens
  misc_feature (1)...(956): n = A,T,C or G
attacacggtcactgtgtataaaatatacgaggttcatataaacaacgaacattcaggaggggggggggaatatttaaaatgtgacacaaatggaaaaatatgtaatcagaggcggagataccattggggaaatagcttgcttacatataattgccgacactatgctctcgggaataactcccagctattntgccccctccgccgcacaaagtgtagactaaatatcgctgttaaagttcaaaaccatacccccaccatttgccttagattcccttaacttatctcttagggaggagtataacaacaacgtcaaatttatgcgtgacggacaataatattacacacccaactacagataacaaataatgggttgtgggaaaaattatgcctacgtacataaataggcaaggggataaaagtttgcatagtcgggccgcgggatttaggtgctagtacataaaccggacgaaagaaacgtgtgtgctagttgaaggatgtatgaacgttgcgattatgaggggctgatgtcgggaagcaacggggaaagaggaaaaagcttactaaaaaggaggtgcgcaggtacgtaaaagtcagggtgatacgcgtaagacgccaccaataataaaatgtatagaatcagcgcgctgaccacaatatcaatctacccgtgtacattaactcacaactctgttgaagatttgtaatacacgctactagagccaatcacatgtctaacgctctgtgatttcacgtccaaccactcgcatataataggtgtgtatatcatagtgtagttgaactgagctgtattacgatagacgtcgatacaaggctatatcacgtacgagaacatagatggataggtgacggaccgcttggatcatagggcgcatatgaaacggagggagcaattgcggagtacttaggagttcactgggggtagtgaaggcatgaa

SEQ ID NO: 7128 - DNA, 812 bp, Homo sapiens
  misc_feature (1)...(812): n = A,T,C or G
tcctttgtttctgttggtttttttgtttcnttttgtttttttcatcccttcttccggtggggtgcgaactatttattgtttttgttcactcgccttgttcgttttttgtcctcgcaccgtttgtgtttttttttgcgatctcgggtttctttcttccttttttttgtttttctcatcggtcgcccnttttcctgccctttgtttgttgtttttttgtttccccgtcccgtttgtgttgttccccccccccgtttgttcgcttgtttttccttttgttctcttttccccatgtttttttgtttttgttttttttcctctcttgtccattgttgttgtgtgtgttttgcccttttttttttcttttttctttccttnctcttttgctccctgtttttttttttttttttccctttctgcgtcggtgtttttttgtttttttttttttcctctccttgtttattttttttctgttttttttctttcatccggtttttttttgttttgttttcgtttcccaccctttgttgttgtgccccccccttcgcccctccgttgttggtcccccctctgcttccttttcatctggtttggcgcctttttcccctttccccttgccccacccgtgggtggccggggcccgctcttttttatccccccacgctcgtgccccctgttccccacgtggttttttttttgcccgggtttttcttttttttcccccccattttttcgtcccccccccggtgttgtccccgcttttcgggcgcacccgccgtcgggggtgttaaaaaaataattcttcctccctcccc

SEQ ID NO: 7129 - DNA, 770 bp, Homo sapiens
  misc_feature (1)...(770): n = A,T,C or G
tcttattctcctctcccttgtcccccctctcttctctgcccgcccgtctcatacactaacatttccgggcgcgcgggcgtcaccttccaatcccgacctttgtctgctcacacctgcacattggtccctccatcgtctcctgccacccccaactgcttgtttgtttctctcccccccctcccccatccctctttctctcccctcccctcctcccctaccccctcccgttcccttattcctctcacctgcccccattccccgcctgcccacccctacatattgctagcgccctattaatccccaaacccattcgaaccaaaccgcccactgccacccacagtccatattggccggccgggaggctgcacggcgggcnctttccagggggggaaaacaaaaattttttttcgccacagggcgccttcccttttaatttttaccgcccaaaggtttttgtccaccacattttgaattaaagcggagggatcttttttattaccccccccccacattgggggcccggggtttagccctttatccccgcccttttaagacccaaagggggggaagggccttggttcccaatttcaaaacccccctccccaccatggttaaacccctttgggggggggggggcgggggcccaattttccccattttccggagggttaaggaagaaaaattcttttaatccgggaggaaaaggtttcatttacccaaattcccccccttgccccccccccgggggggaggggaaaaatccctttttt

SEQ ID NO: 7130 - DNA, 822 bp, Homo sapiens
  misc_feature (1)...(822): n = A,T,C or G
aaataataggaaacgatggccacagaacncggagaggcacataaaagagaagaaacaggacgagaggggcgggcgnaatgtaagaggataatgagggggcagaaagacatagggagggccaaaaggactgagaccagaaaagtaagggcgcgaaatgaggatataaagcggtcctcaaaaccatccgaagatcaggtgacgcacacgaaaaggaaagtcggggacaaaacaagagggcacaatagaagacggaggggtaaagatcaataggaaaatataaagaggaagaaagaacgaaaacgggacagataacatacaacaaacacgatgggaaaaggagcacaacggagagcgaccagatattagaaagagaagaatataaaagggggaaagggggaacacgacaaagaggaggcggaataacgagaaaaggcggggcgggaagaaaaaaaggagagagaagagggaaagggggaaaaagatgacgggagaataagaagagagaatgaagacgaacatggggcggggggccncacaaacggggggggaaaaaaagagtttttttgcggggaaaaagacgaccagagaaatgattgaagagaaagagggggtgtttcccaaaaagtttttttaaaaagggggggggtcttttttaaaaaaacccccccggggagggaggggagaaaatattcccccccccccccccgatttttgggggggggggcccccgaaaaaaaaaaaaaaaacttttttaattcccccgggggggggggggaaaccccaacggggttggggggggggaaaaaaaaacgggggggcccc

SEQ ID NO: 7131 - DNA, 1068 bp, Homo sapiens
  misc_feature (1)...(1068): n = A,T,C or G
cgtattggatcccatgtggtaccgcgtattgccccatgttatttatagcaaccccactggcgcgtggggcgagaaaccctccaaattggtcctacccgtgtcacctcctggatttgtggccccccccatattagcggttgtatttcnccaccgcatgttacgatcccccacgcgtgtattcacatcctatgtctccccccttcccccccccgtgaacaaataagtgtgtcccaccccccctgtgtgacaccgtcccccacatgttacctggtgttgcctgtggtgctccgcccacccctgttcatggttcttgtgtccccccccccctcccttttttgagtggggagcacgagaattttttttcccatttccagccggtgcaaaacagttgagatgtgggggccgtacaccccttttattttatttccattatttggcccacccccgatgatgtgagcgaccggctgtgttgccggcccccggctcggggtgtgtgtttgttgccgtccaccgtttcccacccgttatgttttatttatgacatcagccgattggcccccaccggtgtagtgtgggtgcaccacaccgatcggcaccagatatgaccgcccgagattgcgcggtgtatgccggtttcaccgggtgacccacccaccgtgtgccggtcccncccgcttgcgtatcccatcccagcagcatttcccccagttggccagccccgttggtgtatgctgtggtgccccggcgttgtcactgggcgtagcccccccgccagtttgccgtcccccaccctggtgggcggccccccgccgtggtaccggcacaccacaaaccccgcgtggtctgagttgtccgcccgccccgacgcctgccatccggagggaacagagtagagatcgtaccccccgccacaggatgtcgcccccatgtggacaacaagcgatggatgccgcgaccaatgacaatgaagccaagaggtcgaggaggactgaaacaattcaaaccccgtacacggttgcgcgcgatgaagaattaggaagagtcaaggggaagaaaggaagaaggaca

SEQ ID NO: 7132 - DNA, 1329 bp, Homo sapiens
  misc_feature (1)...(1329): n = A,T,C or G
catattacacctgcggtatcancgttcgtcagttgatgagacattgagcgcgcacgngcangtctagttgagagtaacgtganacacgaatatatctantcgtgcgtgtgtggcgcggcgangagattatatagatcatactagttgatactcactatatactatcactcagaatatgtagagatcggagcgagtggtctcactcgcgaacgcgcggagtatactatatgatggcancgacacgagctatagactgatgctttacgatngatgatgtngattgtatatnattatctcgtgcccgctaccctttnncnctccgnccgcgncggcacacgcgaccggcggtcggttctgcaccactctcgctgaatcttttactncgtttcctccgtgcntgtcgcgctgttatccgaactgaaagtgctattgcttgtgcagctctacatacactacagtgagtcaatccgtccattcgccgtgctcgatctcatacacatactgatgatactttgttgtgcggtggccgctgcgggacagcgatnctagccgtatttctgatcatactatctgtctcacacgtgtcagaaattagtaatgtgaggtgggtatacgtgggggcatgaactgatctaacttgcgtttatctatagtaacctttagatcatctaggtatactgccgtaagtatagtataatctcctgacctgagaacgggtctgccgacgcggcgccgattaagagtgtgctgaggctgtttataccgagatagagatcgacgcaagtctctggtggcaggcgaggcggtggcaattgcgcgagaagttatcgatgggactattatagagagattattatcagctgggtattaatgtcggacgtacgatgcgaccacagccggcgactcatggctgttggaggacgggcgcgcgtattatttagcgtgttgcggagtgctacggggtctgccaccgaaagaatagcggtacgctaagatgtcttggacaatcatagtagatcgtatgattattagtatgttgtaatgcggattatggctgctctatcgtgtattcgcgtattacagtggtttagaatgtttgttggtcactatctactgtattccttgcttatctctgtataagctaaggcggggcggggccactgtaacctttccctcattctgtcgcgcatggcatatttacgggcgtcggagacttgattctatgccgccgttcgtcgctacttccattgtgatatcgacatattactacgcatgtgcgctaatttccgtaatatgttatgagctagtaacgtggtgcattgctcatga

SEQ ID NO: 7133 - DNA, 821 bp, Homo sapiens
  misc_feature (1)...(821): n = A,T,C or G
aatgaataataaactgactctcttcttgaaccaccgctcacanaacaatgcaatgatttcacgatcaatgatttctcaaaataaagatttttaataaaaaacaaaataactctnattcctaactattnnggcattggcattaaaaaaaacacattgcacattttgaaccttgtatatatcaaaataaaactttttctccctgcatatcttcacacccaaacaacaaaaatctcattctatggtttactacactccannaattatcatccatataacaccacacatnatngnaaacacctcattcttcttnaaaaactatctctcncacctctttcaaccctaaaattaaaaactctttctccaaaaaaaacttattactaatctacctactacctataccaaattttaaacattccctccactactcaacctccaaatcatctcaaaaaaaacaaaaatccaaataatatcaaaatttcctaacaaaaaaacaaacaaatcccccaccataccctctcattcaccaaattctaaacttaaaaacttctaacctaaaaaccactactacaaaattccataacctctaccaaacctttctaccccttcaaacacaacaatccccacctctacaccttcaaaaatccattcacaacctccactccccttcaacaaccacacaacaaaattcccataccaaaaccaaacaaaccaattaaaccaacctgcctcacccctctcccttatcaaaaacataaattccaaaactcctccctccacttacctccataacccctcgctcctcccaatacaacacaacacct

SEQ ID NO: 7134 - DNA, 1268 bp, Homo sapiens
  misc_feature (1)...(1268): n = A,T,C or G
ggggggagggggggggcgcggcgactgcggngggcggacgccccgcgcgcggggggcacaccaaagccccataaaacagcanagaggcgnantcggcggcgcgagagaagtggaggaagagtgagggtaggagcgtatacaaagtctcgcagtgcggcaccatagtcatgaggagtacactcttncgtgcgtgctcgtcgagccgcagggagcggctacgggctggcgatcccggcgtgctgcgatggtgaggaggcgactgantcgtgggcgcgattgcaggtcgctctacctacacgtcgacactacatatacctctgccttactggtcctaggacgagcgccaccgcgcgacgacgcggtgcctccagacaagtataatcttttcttccgcgatctcctctgtgtctctgtgtttctcagtacttggtcgtcatgttagaggagtgagttaatatagtattggtgtcgtggtgcgccgtgcgattttttcccaagtgcttgtgccgctgtcccgttccccacggccccgggtcgtcggctatgacgacgtcgccgagcggagtgggtngcggctacattaatatacccgtcggcgttttgaacgacccgcgggtgcacgcacgcgcacgccgcgctctaccatcgtctctgctcaccttcctcgcgctgtcgtctnttctctcctccttcctcttttgcggcacgttcgtccgtcctaagagattaggtccacgcgtgagttctcgccagtatccaccgattccgcgtcgcatacgtggccaccgacccttgcatattgctgcgcggtcgttatagcagggtgatgcgccgatagccgaatccgagacgggcggcggtctagcgagtgcgccgcatatgagcgcgttagagacgagcgagactatacaacgccgcccgaatgcccccgacgccgctattgtcatccatgatcancagttctattctncggcttatagcgcgttnttccgcgcgtcttgtattgtccgccacgccggtgtatcttcgacgtcggtgtgcgccgtgccgactgcatatagaatcgtcctccgccgtattcgctgcgcgcgagacgtcatactcgtattatctatgtagcagtcgcgatagtatttccgtgtcatttaccgccgacgcaccgcttacggcttataccggtccgcattacggcatgcgcgcggtgtgacgcggtagtcgccgtcggcctatatagttgtaccgcgggtcgtgttctgccgcgccgcacc

SEQ ID NO: 7135 - DNA, 1216 bp, Homo sapiens
  misc_feature (1)...(1216): n = A,T,C or G
gtttttttctccctgtttcgcccattgttttgtggcccatatattcacagaacttttagtcgggcggggtaaatatataaaccgaaagatggtgttaaacccagtatactgggttgcggcgagattcttgagaccccacagacgttgtgtgtcatgtgtgactcccccgcgccccccttatcatttttttatttccacgtttgttcccggccaccacacgagttgccttatacttcacgtgttcggattttatttttgtcacgtgccgatagatgtcgtctgccaatagaaattatatacgacacgcagacccccgtctgacaacaatgactcgtgtacctttgagtgggtggattggggggcacaccnttgcccgctttgtgttatttatacgctaaattcccacactctgcagctttacgcgcgtattcttaccccctatgtctatatttcagtatcggccagccaatgagatggaagaggcacacacgacactccgtggtcgggccacggtgtggttaanggggctctcaaccacgttacgccgccactcatgttataagtaggccttcaacctatgagagtgtagtgaggacagagataccgacacgcatagttcaataagatgggcccatcaagtgtcgcgcccccaaatttaaggtagctcaccgnaatcatctcgaatttgagttaattaacttcgacaccacgtgtctgtgtgagatgtgacccataggtcgtgtaccgcacatgtctgtaatgttcacttatgagcttacgtttattctcgtcgcgaccttaattatgcatacagtaataacaccaccataccgctcctgcacacaacgataagttgattttgcgcgagtgcaagtggcgttcattgacgttacattatgacgttaattatgcagcagcagattctttatataattcaatatgactgcgagactaccagagtgtttgtccatatagatagtcataagactagactcggtgacagtctcacagacntatnaatacatcatttgatctgtagtgagcgatcctcacataatctagagcagattaatatgacgtacgtataacagccgaggaggtgtagtcgatgagccattatacatgtggaatcagacgaatagtgtattaataggagtaatatgtgacattcgcgcatgagataaggttgggagagtcncngaccgagacggcgcac

SEQ ID NO: 7136 - DNA, 893 bp, Homo sapiens
  misc_feature (1)...(893): n = A,T,C or G
cntcctcttccccatcccaccgtccacctctacccccctccctcttccccctcgacccttcgccgctcccgccccgcagtaatcccgaccacactcctccccccgccgcccagagcgaccccacgtatttccaccacccccgttccccaanacactgttcggcctcagggctttgagcaacctccctccaaccccccaccaatgttccttcccactcccatgggaactcacccacggggggaactccaggcatttttttggccaaaaaggccctctcacacttaaatttgtaccccaagtagggcttttgccccacagttttcgaactaaagccccaggctcttttttattacccccgccacagggaatcttgctttgttgcccagctgaagccaatgggcgaatttgggctcatggaagatttgcctcccggggttacaccattttcttgcctcaccctccggaggaagttgggaatacaggcgcccgcccccacggcccgggttattttgtatttttagtagagacaggggttttacccgtgtttgccaggccggtcttgatctcctgacctggtgatccgcccaactnggcctccnaaagtgntgggattataggtgtgagnnaccntgnnaggnntcccccccccctatattaaccaaaatgagccctcgtttcactttcctgttctaccctaaggaagataaaatatcattccaacttggggtagaggcaggtgccagtacccaagaccntgggntgtgcagcaggggntantgtaaannnaagaccttaaacttcccccccccgcaagagaaagggagcagctntgacgccctctagccccttctcggttagcctngaattctaataaaaacctgatgccgcgcagg

SEQ ID NO: 7137 - DNA, 1326 bp, Homo sapiens
  misc_feature (1)...(1326): n = A,T,C or G
atctcaccctgattcactctctctctccggcgnagcccgtgttcgcgactcctcggtcgcggtgtggtaatcgcgctgttgtctgcgctcttcgtgtgtagtcatatagtcgtcgctggatggcgttgctgtgcgcgtcctgtncgtactctcctcttttcaaccgtggtgggagtgtaacgagtgcggcgagttagcagtcgttagtactcatcgtagtctnntcatactctcgagttggncgcgtttggcgaggatgtaggttggggcgagtgnagactacactgnnctgctttagcgtcgtctgacgaggtgtagggtgtaatgtgtgccttgtgtcgtgtggcgtgttcctcgtcctctttgacttctcatggnggcggtncgctcttgatctcctcgctttatctcgttattgtaatggtggctcggcgcatactttatctgtnaaatgtgttgtggtccgtacgagtacgctgggagcgtgggggccgtgtcatccatctgagggcctcgcatcgcctaggtgtgctacgtgtgtncctgtcggcggagtggatgcagctgcaagagacgcacaacaagngcgagagcttacgacggctacatcanatcgattctggaccactgcttcgttatttctatatctccctcaggcccttncctatctgtngttcgcgcgctatttatntgttcattttcttcactaatctgtcgnccgactttgtnaatactttgagatgatgtcagctgtgtgnacagctgtagcatnttggtntctgtgggtggagctgctgatcttctcctctctctccttcctctgtccgccttnncgtctccgctcctcttgccgcctncctctatcgcttccctnnctcgtactaacttaagattgttatttgattatatcttaggtagtttatntgatgttatgctttggcgcgttcgttgnncgctcttggccgttcgcgctgttgttggtgatgttgacgggggcggcaagcgggtatgggtctggactctctcggnggcgggccttgatcaccggttctcggtcggcctctggcgtcgtcgtgtgccgtggtaccttacgcactcggtctgtgtaggcttcacgaactctcgtcgaggaggaagggttgggagcctgcaggcgtattnnngcgtgctgcgcctctctctcgtcnttcttttctccttttacctccccggcccctcccttgctccctcccgtnncncncttctnnncctcctcttttcttccgtgttcatttctctgcctattaaaattttattttnnttttntggttctctttcctctaagtc

SEQ ID NO: 7138 - DNA, 442 bp, Homo sapiens
  misc_feature (1)...(442): n = A,T,C or G
tggcgcccaaaacaccccccccccctcaacggaaacaaaacaagtccccaatctcacctcccgcacaatccactaacatactttttagtaatgtatgggtaaaagaagaagttttaaaagaaaaacatanataggattgaatgaaaatgaaaatanagnataccccccccctgaggnatacccttaaagaagtgctgagacagccatttatagcccttaactctcaccttagaaaacaggaaagccttcaaataacctaatcacagacttaaatgtaaaacataatataaaantttnaggaaaaatagtagaaaacccccccctccccgggataagtaaagaatttttagacttgacaccaaaagcacaattcataaaagacaaaattaataccccccgccccgcccgcccttntnnnnnnntnnanccccccccccagccc

SEQ ID NO: 7139 - DNA, 555 bp, Homo sapiens
  misc_feature (1)...(555): n = A,T,C or G
tctcctcccccccccctagccccccccccccttcgccgcctctccctcacccaccccagcacccccccccaccgggtgtgcccccccccgccgccaccccctcggaagtgtgcccccaccacccgcctcccactaccttccccctctcacttcccctaatatagtttttgagtgtgatttaaattgaattagttgttaagtaaaatgattggtgtatgatgttggtaattgtagaggtggttgtagggtaaagatagtaattttggaaaggntttatttaggttgggtttaaaagaataagggtaggtaaatttttttgtatgtttgggaaaaaaaagggtaaggtttttttggttttnggatggttgttaaaaagtaagttgggtggagggttaatattaagggttagggaggaatgaaaaatttttttatgttaatggaatngtaaaatggttttttgtgattggtaggaattnaagnaagttatttttagaatagggtagtggggaatgagttggtttggttggggttaaatagggaaaaatnggggtaata

SEQ ID NO: 7140 - DNA, 464 bp, Homo sapiens
  misc_feature (1)...(464): n = A,T,C or G
taatatagactaattcaatgggggatgtagggagagcggacggccgctcggtcgggggggggccgattatgttatctgtcttaaagatatgttacgaagcagatgggttgggagagtagtagacaacgaaagctgtgacacatatntatcctaaaatgagattattattaataatagtgtattccacaaccgggtcgctgtataactccatgctcgtatcgttaactcaccatttgtgtgagggtgatagatgttgtaaatgtgctaataaaggagttgtagtaatatataattgataaagtgttttgttgaaatgagaaaggggaaggagattgtgagagaacgatagtaagatatggacaaagacggggcgcgggggggggagggggaagctggctatgaggtcgatgggttgttaaggagaaccatagtgaataaaaccagaccccaaagcaaaaggtgag

SEQ ID NO: 7141 - DNA, 1180 bp, Homo sapiens
  misc_feature (1)...(1180): n = A,T,C or G
attgatgcgtcacgcaccgcagagagagaggcatgcggtatatnatagatgtatgtgtagataagaatatatgttgtatatagtatgtngaagtaatattatataggatgagagataatagtatagtggaacgtgtgaggatgaagaataaagaagtgaatgtagagtataagtatggaaaataagangagagtgtgagtgtgatanagatattatatagtggatgggaggatagtgaanggagtgatngaatgtgtagatgnggaagagtanaatttagatatgtaaatataagaatgttgattgagagtagggagttagtatntatgaagtttgtgtgtagagtaatagtntatatagagagaaagagagggagtatagaattatgtgtnatgatgaagagtgtaggatagtagaagtaagtagaggaaagaatnnattagtatggattgttgtttagtgaagtaaggatattaataatattatatattaaataatagtatagataaagagggtgtatagtgagataaagaggtggtgattaggatgagattataaatatgggttgagaagagganggtggataattagttatgatggtttgaggaaaagttaagaagagaaatattaaaatttttggatgggaaagaatagtgtgtgtgttgaagagaattaagaaataatattntgtttttgtatggtgagagtaatgagaagggttttaagaaatnaaaaataaaggttaattgggtaaagtgaagagggaggatgtttatattttaaaaaaatagaaaaagttttttttgtggaaaataagggggggggtttatggggtttaaaaaaagnngttaggaaattaaaagatgttaaatanaantattttttaagttagccccccccccccagaattgaaggtgaacacctcttggtaaagggtttttttagtgaaacccttactgagaggtgagggaacacacacattttggccaacagatggagggagggaangggcatctccctttgtgaatttaatannagttgattnattagccagcccccgcccacaaagaaaataaatacagcctctggttacaaaagtataactgctgcttaccaaacaacagaaataaaaggagatgcggccagcccnnnnnnnnnnnntannnnncgcgtacaaagc

SEQ ID NO: 7142 - DNA, 913 bp, Homo sapiens
  misc_feature (1)...(913): n = A,T,C or G
ttgcgaagtggtgaggagtatagtaaattacatgttgttataaataatattaacagcaaacaatttttataatactgaataggaatgagcaggtgttagaaaggaggtatatgcggtgtgtgaggtgggtgataaattattaaatgaaaatagattgagtgttgatgatgatggaatatattaagatagatatgaaaagagcagacgttagaaggtaggtattgataaattcaaaaaaaaagtagatttataaagtataagttaaaggtgaaaagtgtaaaaagagttggttgttttaatattttttataaaggggaatttaatatttgaaaggggagttttaagtttttttttttggggaatttaaagaaaaatacaaggtttgtgaaatattttttttggaggttggtgtttgtaagattaaggattttgaaaatatttttaattgtaaagggaaaggtgggaaggtaaatttggggtagggaaaagttgtggctttaagggtttctttaaggaaagagtgtattttttttgttttcttagggggggggaaatttggttgaaaaaaattatttttttgtgttggggcccaggtttagaaatttccccccaccgattgtttaaagtaattttgaagggataaattgggtttaaataaagaatggtagttaaacattttgggatnttaggcaagtattttttgaccnatctatgaggcgagaaaaggaaatggggctgaagtaattgaggtaaaaatgaagaatgtggaaagtatatttattttgtacaccaacacttgtgcaatgtagtgtaatagaataatggaattaagcaaattgacaaacttttgtttataaaaaataaaggaagatgcggcggcccnccncccnnnttaaaaccccttaagtgaggg

SEQ ID NO: 7143 - DNA, 780 bp, Homo sapiens
ctgtgttaggtggacactaactgtatctttcgtggcatattaatgaggagtagttcaagacacgtgtgacatgcatatcaccagaattagaagctagcttgtgaagctgtggacatggagaaactgataatcaagtgcacgtcgggcgtgggggcgggggtgtgggagagcgagtggttaatgctgtgtacttgcgtgtgaggttggtgggggtgtggagggttttagggggccgcgcagggttcgggtctaggtggagagaatgattatgatgagtcgggggtgggggtgagaggaaggggggaaacaggcgtgtaggagcgtggtgtcgcatgtgggtggtggtagtggttgggttgagagaggaggaagggtcatggggggagtatgaggggggggggggaggggggggaggtgggtggcggtgaggggagggtgggcgttgatctgttccctgcatttggggtttgtttggttgtattggggtggtttgcgcgaaaaataatgatttttagggccagtttatatatttcaccatgattgttaaagtatattgatccataattgggtttaataaagatggtagttaacatgtgggatgtaggcagtacttctcaccatctagagggagaaaggaactgtctgagtaactgggtaaaatgaagatgtggaaccatattactttgtatatcaatattgtgccatgtattgtaatactataatggaatcaagcaaattgacaagcttttgtttacaaaaaataaaggaagatgcgtccag

SEQ ID NO: 7144 - DNA, 806 bp, Homo sapiens
  misc_feature (1)...(806): n = A,T,C or G
acaggcttccatgttattccgcccattggaatttaccgtgagattcctgttttctttccagtttgcggtctggttttatggtaggggttgagagtgttacaaaaattgtttgtattacctcccctatttgaattagattcaattctagttttgaagaatttatgaaatgtggaattcattctaatttcaattggaaaattcgtgtaaatttaccgactttttgtattttggctcaccttatttttttgaaaggtaaaaggaatagagaggtggatttctttgtaaaattagaggatttttttgcagttttggacaatttggaaaaattttgtggaatttatttttaggcaaggaaaaaaatgattaattaaaggttcatgggtaaataccttaaatttaaatctggagtcaacccaagtctctgcctgtctgggttaggggcatggagtctaggacaagaatggggcagcccattgtgcaggggcagtatttttggggatgttcaggaggcgtgggccttcccacagtctttcatttggggacttggcagcattttgccantggcccagagtttggtgtctttgctgcctatttatataacctgttgtgatgaagctttaccctcgatcataaagaggtgtcagttgctaggaaggtattagtcaatgactcatgagaactaggcttacagcctgagtctaatcaactttgtggggaagtcanttcactgtttttccattcccctgtatggaagatatttatactagtgaattattctacatggcatccagaggaagttattaaaa

SEQ ID NO: 7145 - DNA, 546 bp, Homo sapiens
tataggaatttgtgtaagtgagtatagattttttgtggttatgaggaatatttttgaagaagtgattttaggttatgtgtaatatgattttatttgtggggtgtgtagtgaagaaagaagaggtatgttagatatttgagtggggttaataagagatttaattggtttagaggaaattaagaaaaaaatttatactgtaattatttgggtgaatgtagtgtaagtgttaagagattagtggtttggaggatttggtttgggagggattaataagatagggttattaagtttaagtgggtattttattatctattgtttgaaaaaaaggggagaatttttggtttttgtattgtgtaagaaataatttggtagagtggttttaattatggttagggaagaggggaaaattttttatgttttatgctattggttagatgttttttgtgatgggtgaggattgaattaagtaatttgtagaaaagtggaggttggagtggaatgctattggtgtgagtgaatatgggatagttagggtcagaagaggat

SEQ ID NO: 7146 - DNA, 384 bp, Homo sapiens
ataaggtgggtaattctaagatatttgtgagatgtacagaagtgggggtatgtcgtggacgggagtaaggtgagataagtctcttagtaagactatcaataacacgtcaacctattccgcgacgagaatcataagtatcaccagacttgaaagtgttattacctttgtgagtaatgagatgaaataaagacaggaagaagcgatagaatttagaggatagcaggaagagagacaaaagaatattggttcgcacgagtagatataaagtgagcgcgtgatctctcgaggattgtaatggattagggcagacaggaaggagggacaactggaaagagtggtgcgcccgccgggtcgttgtgacgagagtgcaggggagggagtagg

SEQ ID NO: 7147 - DNA, 1016 bp, Homo sapiens
  misc_feature (1)...(1016): n = A,T,C or G
ttatgaattggagatagagcaaggaatggtgaaggtagtttttattaaaggaaaggagtaaatttatgtgaaaaaggaatatgattaggtaggagttttatggggattaaatggggtattggataggtgtgattaagatatttagaatatgtgaaatatatgtttgaaaggtaagagagtttgagtttagattttataatggaagatggaatttaaaagaaagatggagatctgtgatggttattttagtgaagaagtgtgttaaaagaaagttgtgaaattgtttaagctatgtggtttttaatgggataagtttaataagggtgtttagactgtttaaagtaaggaaaggaggattttttattttgagagtgtaggaattttttttgggaaatatagatttagtgaaatttttttgtaggtttattttttaaggggagtgganaaaaagaagatttttgattttttgtattttaatgcaaagtaaaaaatttttgataggagtattttatgagtaaatgcagaggcttatttatttggtttattgttagaaagtgaatgtttttgagtgtggtaatagagtaaggtgtttgataattagtttagtatgtggatttatgttattataaaatgtaagactaatgaggtggtatgccccaccgcatatgatgaattactatagtgagtttgtgatggagaagtaaccctggtagtattcaattaattatgattattttgtaatgtattgttattatgcntgaaatgtgatagtacgaaaagatatanacgaatatatattntgtgttaacntcaaggttattattatgtagaaataaagaaaatagtntttaattgtgananttaatatatttatacatcgttcctaacacaccgatgatgtagaattatatatattgttgtagaatgtatcatatttagatgagtgtgtatatataatttttttttatcattgtaaatagataaataganataangttgtantngngccgtcaagg

SEQ ID NO: 7148 - DNA, 819 bp, Homo sapiens
  misc_feature (1)...(819): n = A,T,C or G
tctgtctctgataaatattggtttatgatattaagtgatgatgtgtaagggggtaattcgacagcgtgacggcgtgtgtggggtatatggggacggggggtggcggtgtgcggcgatgagtagtgggggctgtgaggactgagctgtttagttagagataggagtagattcgacgtaagacagncggtaatcgagtatgaggtcgagaacgggggggccagacagcgacgtaaggaaggagagatgaagaagatgtaccaatcgagagggacgtatagaacacaaggtgggagctccgggcctcgtccgagagcagaggcgcggggaatggcgaggtgcgatgtgtggagggggagaggaaggcgttggggggggggagaagagcggtggggggacgagggaggcggagtcaaggggagtgggcgcctgggcggtagctggcgtggtgaggggggcagggagccatgttgttgagtgtaagtgggcgaatggagatcgtaacactacagacacccacatctccgcccactacgacaacaacaaacaaccagcatgaggtgatataagaaccgcaaaagaaaagtctatagtgttttggatgggaaaccccgtgtattctcattatatgctcctttagcatcgatatctgatggaagacaaacttccgataatctgtgacccacgctataaattagaaaacaactgttttttgtcactattattaaatgttctaatacagagtgaacaaaatgtggaaagatcaatctgtggtgtttaattgttttttctctttagagtaataaatactgtcccgccagg

SEQ ID NO: 7149 - DNA, 1589 bp, Homo sapiens
  misc_feature (1)...(1589): n = A,T,C or G
cggttgagtgaaccacgacgtgtcatcagtagatgacgtcantctcaacatcatatatgacgtgtantttcacgagcgacagacgagcagtgacgnaacacaacgtgggcgcgatggcgcgccgangccgcacgacgtcacacgtgactacagngtcgcagacnggctgctacactnatgcgcggtacatgtaccacgcgtgtgtgttagccanccactacgtctatgcgcacgcgcagcatcgtcgtacatcctaatcgggacgatagcggcgcatcgtcgctatccaagtcattcacantgtgtgtgctaggaagacnagaggagctactcatngcagcgtcngaacncgngtatcgtgnatcnaacgtgaccanncgtaacacggcgagngtgcgaagcatcactacgagtctatgagtaatcaatatataacgatacataccgctatgactatctatcggtgcgatagcgcngatgcgcatacgacgtagacacgactcgagtgtgattctagtagacatagatagacgttactgtgtgtcgctgtgtcagtgaacacactgtgtccgtcgtggcatgcaaatggcgaggtnggagtgtgcngtatgcgacgtcgacacggcaattgtgtnactcaccgcactagncgtatcnacggcctgtagcatgcttgtcgtcancacgcagacgtgncatgcgccgtctatattgtctgatactgcnctanctgtgcgatatcgtctatcacggcgatacatggggtgcgacgctgtgctcgcncatcncattcaactcatccgancactaagtncgcgatgaggcgtnacactctaganggtgtcacgagtatcgcgtgagacgccagtcacgtacgcgtggggggcggatcatattactactctagtcagctgcatacgcgctgagtcgcgcgagtatctncantatacctgtgcacatctgcctatagcgccgacagagacgacctgcgccgngatacgtccgaatatctcgncgcgtngcgcctagtggaatcattgggaagccagcgacgactcacagccgcatgactacgatgcatcncataaatgatagcggctgtctaccaacctggcgacgaacgtggactacttcataatactatgtatcagccagcgtcagcgctcgagtcacgatngctgtctcgcacgtgcagcaacaagaagtcttacgatgccgtatgttatgctcaactgtattgacactttcacgcgcgagaattcagccgctgtccttatttatctccttgtggcactgctgtcatcgtgtgtgtcgtcancgtgnatgtgctatcactttgtcgacgctgctacgacgtgctcgccgtagtgtaccggcactcantcggtcaagagagatgcaactgtctgcgggctctggaagatnatcgactacactctctacatagacacatgtctaccgcgctgcgagccccagtcgcgcacactctaccataacacgaatgcatttctacgacacacgtcgttcggcggccaccacgagcgagctcgcagcgtcgaggacggacgcgcgactgacacacatatcag

SEQ ID NO: 7150 - DNA, 1400 bp, Homo sapiens
  misc_feature (1)...(1400): n = A,T,C or G
ctatacacttagtttattattgttttaattattctttaagcgaagatttcatttatgcttgcaataggcttctctttaatatatacacactacgctcacacgcactctttacgcttatcctctccaacaagtcacatgagagtagcctcgagatcatagagagccacccactacaacgccttgtgttgctcacgtagcaacttaccctctcatggcagtatattcttctnatatctttgctattctcgattgagaggtagggcctacatacgacagcctcgtctagataaatgattgaggtaccagtcatacgcaccgacgccatttgctcatagcaatgggtgagtcttcttaacttttagactatgcctcgacactcgcgccgttgtaatacggttctttgttctccctgttatatatgttatagctaagtatgatgtcgatcatattattcggtgttcatgccctacgcatcttcgatcactgttttcnaantatacttataaacggatatattctgaccacgtgactctacttcgctctttgtccnattcgtattatcttatatcgcgcatggtctgtgatctcattatcatttctggcattgattctacnattatgtactctcgactcagtatgcccgttagttcgcatctccgcactgtagatatcacgatcttctctctcgctatagtatcttcctntgtcagtgttacgtgagtcgctcgctgatctcatcttgctaccgcctgtctgcagtagacgatctanattcgcgcgcattcncacagttgnagttattagcttttattctatcgtcgtatgatatgcgtcttcttcgatgacttctcgccacgntgatagcggttgttcactctattcgtaccntcagagcgctcgatanacgagcggcgcgcgacggcgacgttagcgtatagagagataagcactcattattgtatcggcatgtatatctaattcgcgccgacccgtacgtgnatgcgcntncttccatcatccagagttatattgtcgtctcaggcgcgcatgctgttatgcatatgagagcgcatcactattnttatctgtagtcgattgctcgcgcgcgcgccccgtgcgtataatacctctgtgatatatctttaccagcactattatcatcagcgactatatcgctgtcacgatagtcctgtatattattcngccagtaatctattcatatatatctcancatccaaataatattttatacgaccacacgcatcatcgtataccgaccagtgtttctggcgcgctatttcttatctgtcatttttatttgttggaggtagtggtgcgtgcgtcgtatatataattgttgtacgatattgccgatgctgccgttatataagatatattat

SEQ ID NO: 7151 - DNA, 188 bp, Homo sapiens
  misc_feature (1)...(188): n = A,T,C or G
tgtatgtgaccatcaccaacacacgataggggttcgccggttgtctttatagtccaagcatcaaccccacccaaggtattccggcaagttttggaaaaggtccataacaatccccagatctagggaaaacacaaaagggtctgtaataggtcatatgacaaatccacagcatcagggnaaacgcaaat

SEQ ID NO: 7152 - DNA, 1060 bp, Homo sapiens
  misc_feature (1)...(1060): n = A,T,C or G
gcattggcatngcaaactcgacctccttcgattgacttactactcactacgtctacaagcacctcataggtctcgataggaacgcacccctaccacccatatatgtgacatcttatacatcttattctatgcatagacggaggagaagaattgcnacgtaagtagacatgggatangccgatttctcattagcatataatcatcttagaatactatgcttggctatagaacgtctagtctatattactgagagtctatctantaatatgatatcattctctaaaagaactagggacagtattgatattgtatacgacccgtgttagcatgattctctaatagcaggctactgncgactctagcaatattggtaagagttcgaaatcatgtgtgtatgatagcgcnatatgagattaattaacaataaataccgcccaccacccgccgtattctatcacataattaacattaaccactccccatattatattaatactctatcgcccgcgtacctttcgttatttttcctcttttcccaccccgtcccttattcttatttctgtccttctctactcttttcatttatacaactacgcaccacgttgttatatttcatctcataattccctcgttctcactccttgtattcctctatcaaacacagtttagctatacgaaaatcatcatctaatttacgcccataaccacgattccgactaattgatacgaaagtcgtcttattgtaaccaattacgatgtcgcccgctctatatacatgtataataccgcgccgcaccgacgttgcatgattttaaatgagtccatcgtccgtcgacttatattttatacccataaacgtaggcttcttaattacacctggaatcgatacatctttagtcgatgatattgagtcgcggcctattaattgttcttattacagcatatctcatatattgcttagttcttatatttatttcgccgtgtattctctctagtcagtcgactcagattctttttttatctctagagtcacgcagtaaccgcggtttcggacaccagg

SEQ ID NO: 7153 - DNA, 883 bp, Homo sapiens
ctggtcttaaatcgtagattaaggaatctcctgttttggcctcccacaacactggaattaacaaaatgtcccgcgccacatttgttttaattcataagctaagggggcagaaacacagaatcttagaatttatacttcctagattaatacataaagggaggaagcatttccatacaggaggtgtcaaatgatggataaagaaagaacgatggggttgaccattggcttccactcaagtaaatttgttcaaggccagaatcattcatgaaggctaacaatcattggttgaaattgtgataagatatgagatatttacctaactttcaatgtcactctccaaaagatacttatgaatgacagaagggaaaaggtaacaccgtggaaaaacctgacagacaccacatgaaccaagatcagagctaacatccccagttaacagggacaaatcaacaccgcgtagtgtgatgctctgagaaggcataacatccctgctggtgctatggtgttcctgctaaaaatccctaacttgaatttgatcatgagaaacattatacacactcaactgagggacattttacaaaataactgcttttacttttcaaaataatcaagaccatgaaagacaaaggaaaaacagaagatcattccagcttcaggcagactaaagagatgtgacaaataaatgaaacatgccatcctggaatggattctggaccaggaaaagaacattagtgggacagttggtgaaatctgagtaagattagatgatgctattttatcaaggtcaatttcctgatttcaataattgcactgtggttatgtaagagagtgtccttgtttttaggaaatatactctataaaatattagaagattaaaataaca

SEQ ID NO: 7154 - DNA, 1144 bp, Homo sapiens
  misc_feature (1)...(1144): n = A,T,C or G
ggcaagcggaaagaagaagaaaagaagccgagaaacgagacctagcggaacgacccaccaattaccccgagacagccacgccgacgaccgagagggagcaaaaaaggcaaacgggagaggcaccaagcgcggacgcagacggcgcggaaagagcaagaacctcaaacacaggaccacaacagagatacaccacactatagaccacggaaggcaacaagaacacaggaggcgaagcggcaggagacaacagagacgcacggcgcacgaacgcagagcccagacaataataccccgcgcgcggaaccagtgacgacgcggagaaacagagaacgcacgggacagacagaaagacagcaggcgccacgacgacggcgagagagcggcacgcggagncagagaacaaacaacaagaagaaagcgcccgccggcgaccccgccgaaacgacaggaagaaaaacacaagcacgcggcacaaagagaggaagaaaagagaagcggccgcgcagcccaccacgaaaaaggagccaccgcgaagcgccgcgcgcccgacaactatnacgagagaaaaanaacaaagacgcgacaccgagccaacataacgcccgaacacccggccagcgccacagcagcgcgcgacagaagacaggatcggacaacgagcaaagcgccaccgagcgagcgtaccgagacagcccagcacggcccgcgacaagaanaacgcgaaaaacgacgagagaaaccgcacagacgaaccacgggcgtaccccccagaaccagaaacagaaaaagacacaagataagacagnaaaataaaaacagaaagaagaagaagacaaggagagcgaaggaaataacaagcggcacgggcggctcaccaaagcaagacagctacggccgcggcacaacacaacagcagaataggaaacggcaccacccgccgcagagagacccgcgccaaacgacagacgcaagaggggagcaacgagacggcgcgcaaacgagggacgacgagagcgcgggacgacgcgcgaacgaaaggcaggcgaagcgagagccgagacggaacgacagcaacggagagccccaccaaagccgaaacaacaagccaaaagcacgaacacgcaggccatgaacggcgcacagg

SEQ ID NO: 7155 - DNA, 750 bp, Homo sapiens
agcatccattttaatcaggcgtctaaacctaataaggaccttgacccatgtttcacacataagccacctgaccacatagtccccaggtgatcagttccatagcctcctctatagtcagccctcccaatatttatcacatatgtatgtatgtctgcttggatcatgataaggcaccaatttggcatttttgccaaccgagcttgaatgtcacctgacacgtctctctcatttggactgggttcagaagcaaagtgcctgacaggccaaaagagaaagagagggtgagtagcagagcaagccggaatggtcagcccgtgtcgccagctctaatatcccagtgcaattattttgtggacatccactccttgcctgcacaggagatagggctataagtgtatgttattttttaattacaagggggtagaaaaaatcctcatgatgggctggaaggtgccattgcattgttattttttcctctcccttcgtttgctgattatgtgagccgggctcctttgctagccgatgataagcagaatttccatgttctctgcataattaatccatctctgcctctcttcatgccaactcgcccgttatcgccggcacatgcctgaattgcaaaagaatccgctcttcaattggaacttattgatattcttgtatactcaaccctttcatttaaaggcgtgaattaaaaggacttgaaaattgcaggtatatttagggaaaggaaacttctcccgggtttct

SEQ ID NO: 7156 - DNA, 803 bp, Homo sapiens
  misc_feature (1)...(803): n = A,T,C or G
ataaatgtaaattgatagcccctcgaacttggggaaatacaggagataagaagaatttcagaagaggggcggaaaatggtttaaaaaatttctggcaaattcacagccaggaaagttaataactttgttagaaaagtggtcatcttgataaccaggtatacccaacaagggaataagcctatcattgagacccacatttattgtgacttgaaaaaagacatcccccagtcccaaaggggaatgcgacagaggttcatatttgaactttctggagactgattacataagtcttggagttcgggatggaagcaggttctgcccctgtgaggggttatacatgaccatcaaagtcctacgtcaagctagctttgcacagtggcagtaccgtacccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtagtacatgcctataatcccagctactcgggaggctgaggcaggagaattgcttgaacctgggaggcagaggttgcagtgaggcgagattgtaccacctgcattccangccgtgggcaaca

SEQ ID NO: 7157 - DNA, 831 bp, Homo sapiens
  misc_feature (1)...(831): n = A,T,C or G
ctccacgtcgccccaactctccaaccaacacccacacacaaaaacgagaaanaaacctacaaaaaacaactacncacccccgnncttgaatccncaccacaacacccacatcctaaaacctatatccacccacatcacccacaggagaagagggggctcaacaaaaactctcatcacatactccctatttcactcatccataattccctaactcccccacgtgtaaataactaccatacccctaccacttaccatctacccccattactacaatcataccacaaaacccattcttaccagctgcgggtttatcaccaatacacccaccccacaaaaaaacccatccccacaatccctccctccacctaacatcatctcccaccgaatctacattctaaatctaccctactcctaaacaccgcaaaccaaacaaatcaaacacctcaacctcctataaccctcccacccgtcactcttcccaccctcaaacccacccactttcaaacttttactcccccacctcccacctcaccctcccacctccctcaccaaactccgaaaaaaaaaaaaccacaacctccacatcccttacccaaaaaaatatcctaccctcactcactactcattcaactccacacatacccaaaccacacaccccctccctacacccacaataccacattaccccaacactggacatccaaacaaaacatccaaccacaacccacaaaaacccctaaccccaaacccccatacatacctaatacacaccccacacccctaacacaaaccacacacccactccttccctacccccaactccccaaactt

SEQ ID NO: 7158 - DNA, 623 bp, Homo sapiens
  misc_feature (1)...(623): n = A,T,C or G
agctaattggtcgggagatgttggaaaaccttagtcatgacagccctacgacgcctcgagcacattaaaaactcggggaaactgatgctaatttcggacaacgctttttaattctgacatcgacccctctatactatatatagtcccttcacattctcgattgaccagcgagaaggcaatatttagttcaaacaatttccagcagcgaaccacattgacaacacttcaatgtgcaataacccttgagatacacgtttgtctcgtgattagcgaaagcatatatcgatacgctacttgtatatatgaagacttttcgaaagtcagcggtaaaacactctgagctatagacactagcggaccttttttttgtagtatgcctccgcatcttccgtcacatgttgtttttagatggttaggccgcgccgccatggtgatgacgtactacatcccatcagtggggcgcgattagtaagtgactctatgtgtgacttgatgtacatattgcgcctatnacgcggtccattcgtaatgtatacacgtgatatactggagagatacaagtgttcagaaacgattagagactaggtattatgcgctaagcaaagagatatcgtacccgtaag

SEQ ID NO: 7159 - DNA, 1642 bp, Homo sapiens
  misc_feature (1)...(1642): n = A,T,C or G
acgggagcagcagcgcgccgaagcaaccagtagcacacccgcgaccacccccgagccgagagaacagagaggacgacgaccccccttcanaatnagagagancagcgaacgacgcgcagcagagagaagcgctctcacagcgcgaggcgagggaaggaccggagacggcatccgccgcagagaagancagcgagaaacgcacgaccagacaaagacaagaggtggacgcagaatacgcaaagagtangatagtaccacggcgggtgagacgcagcagcnagagcagacgtagagcaggagangaagaagncgcataactagaagcacacgaagagagccgagagaacaagagagacgcggcgaagacgagagaggtaggagcgcgantcggcgcagccgcagagcagacaagcagctggaggtagaggagccacagagcgccagcaggaaaaacanatcgcgcagctcatttgtgtggagcaggngacgagccacgcccgcgcgcaccagcgcaacacgcgccagacgaggagatagcgccggcagactccgcgtattctgagaattagcagcgcgccggcgccgcagcacncgcacgcgcacgagcaacagagaggcggaagagccgcgcgcgacggcgcgcagatcagagccgagacagcatgagaagaacgcgctaggccacacggtcgtgagcaccggagtaaccgcgcgctagacgtatngcgaggatgngcgaggcagagagagagagagagggaagagctacagagaagagcgcgcccgccacagagacgccgcacactgcgncggaagtagcgcgagaactaagaacaccgcgacgctgcgccgaaccgtgcgtcggagccgcaggcangaanatacgaccagcgacgagccgcacgagagatcacgcgcgacagaagtgacgagccgtggaggaacacgagaagcgaagaaggagggagcgacgagagacagaaggcagagcgcaccgagcaacacaaaggacagtctaggagacgagttagtagatgaggcggagagaccgcgccgggacgtagagagggccgatagagaagatgagataatcccgagcgacgggacgacancagaggtgatagaacgaagagagaagacgagtgaccgccgcgccagcncgccgcagacnctcgtngatataagagtcgcaggaccaagcagcgtccagcanacgaccgcgaaacgcaagaagaagcgcggaggaagaggacgacgccggcgcagagaaggcgcagacaacgagacaggcgaggagaaagcacgatgaggagagctgagagcgcgtacgcacgaggatcagcgcatgagtacagatccgagcacgcgcacacagacatgacattgagacggcgcgagcgcgagagggncgcgtcacncgatatatatgacancgactgacacggacgacnagaccgtaggacagagaggacgcacgncgacagcgtcggacgacaagagaagaagctgcgaggcgcaatagatgcacgacagcgcgagagtccgcgaaagacgcggagagtagagagagagagagtagcacctcagacganaccgagatagaccagaagaaaggagaagccgaaatcaccgccgacatcag

SEQ ID NO: 7160 - DNA, 883 bp, Homo sapiens
  misc_feature (1)...(883): n = A,T,C or G
ttggttcaagctacggaccaacgttagggccacgggttaaaagtattttgtggaacccaacggacccagttcaattcaaaacacttttaaacaagattctttttccagtctcaaggtggcagaaaccattttgaattcaggaattcctcccagtcaaccattacacttacccaaagtatgaagaactccgtttttattgttcaagaagcagattcaaaggaatggcatgcttttctcttcccagggaagttcccacntgcctttcccagcccccttcccaccccacaagtctcccattgccactaatggctcactgttccagcactccaggtctgcctggatcagaagacatagggtatatttcagggtctaaccaaccccacatattctcggagtgaggggtgattgaatgtggatgctgtaattaaacaagacaaacaaaaacacacatctgagaagtgacggggcagtttgggatgggagaacaattcccatcaattcccaatggggaatactggaaccatctcagcctgggttgcaaatagccagaaatgaagaagagggatagggaagatataaacacagaaaaatatatgggagtccacacgaagaactagaatctagggaggtaggtgtttgaacaatttcaaacacagtagttctcccttatccaagggggatacgttccaagaccgccagtggatgcctgaaagcttgaaccatggatagtactaagccctatttatgctgtttttccctgtacatgtatacctttgataaagtgtaatttataaattaggcacagtaagagattaacagcaataactaagagtaaaatagaacaattgtaacaatatactgtaataaaactcgatgcgggcaa

SEQ ID NO: 7161 - DNA, 752 bp, Homo sapiens
ttctgggcggcagagcttgctgcccggcaggatatggcaaggatgttcctgcagtcaggctgttgggccttcgcccgggaggatgcgataaggatgtttccgcagtcaggtggtcaggaaggatgcttctcatggcccgagttcccaaggaatgtttcattctgaccagggtttgcaaaatggctctgcgtccttcatgcttccttcctcagtggtgcccaaacgaacagaaacatgggacaattctgtgcaggtccatggagggagcaggaagcagcattcaatgtcttcagaattgcggtccctcagaactcttgcaccacgtggtggcagcactccagtgtctaggtgtcttctgaggttgtacaggatccagtagaggccactggctgtgctgtcatatcctgagtggcaggcttgggtctctcggctgcttcagcaccagaggttggacagcgcccttgcacttgctcagcaaaaatgcatcactgaagtccaaaatcttgaatgtggccttagccttgaggaagtcatcaacaccccggcaagtgagggtgaggtgctgctccaggatgatggtgtctaaagttgtgcaccaggtcataggccctgcagaagcatctcccctcaggagtgaggtagtacaggaagtccgtgcacaggcagatctgctggtgccattacactaagagggcactgagctccaagatggtggcaatatattcactgggattcctgcagggtgagcctaa

SEQ ID NO: 7162 - DNA, 556 bp, Homo sapiens
  misc_feature (1)...(556): n = A,T,C or G
gatnagaagcgagaagganagaagagttgcgggcccttcggggagcccagaccttgttgctctttgagccatggctgtgacaccctctttggagctctgtggttcctggtgtctccaagcttccaggctccaccatcacattccctggtgcctggaagctgcttgtggtactcctggtccatctacaacctcacagggaacgagcgcctatgcgggcacctgaagctgcctgccctgccacagcgtgcctggttatgtgcagtggcgggaccccaggctcactcactcacacagccgtcactgctccacgcctcgctcgcccttggcaggcgtggaatccagaccggtagcgtaagccaagcgcagcctgccaggccaactgtgtgcaatgagcccagtgggcctcagcaaaactcgggcaaaggtgccaccagccacagagtttctggccagaaaagtgacactccaaggatcctgtgacagtttcacacctaacaagctggaaagtgtgtgcctataactgttcaaaacaggtattaaatttatacttatacac

SEQ ID NO: 7163 - DNA, 876 bp, Homo sapiens
caattaaacaacagatcgaggtttgcctaaaaatataacataaatcaagtgtcttctttttaccaacacttcatgctgggtatccctcaactcaccaacaacaagcgtcaagcaatactaacctggaatttttcctcggcgaagagggctccccctccgaaatagagacaataaagccccttgaaaatcattctcacacccaattatgttgttttccgcatttcacaaacaaaagaaacaactttttgacctagtgcgaggggttcaccccgtgtatcaccaccctatagggcggcaaagggggggcacatcacgcaaggtcaagagtttaagaccagcctgtccaacacgggtgggtcttaaatcagatgtgttactccaaagaaaagcttgaaaaacccaaacgaagacagaatgcaaagaaaccgtggagtgtgcagcaaccacttcaaacagaagacaggctcatggccgaggctcccttccttatccatgtatccatgttaggattagaattcagatgctgttagaattctcaaggaggtgtataataagttatcttgggctggacactgtggttcatgcctgaaatcccaacactttgggaggctgaggcaagaggatcacttgaacccaggagtttgggaccagcctgggcaacatagtgagaccctgtctccacaaaaaatgcaaaagtagtcaagcatggtggtgcacacctgtagtcccagctactcgggaggctgaggtgggagaattgcttgagcctaagagatagaggttgcagtgagctgagacgaagccactgcactcaacctgggcgacagaggagaccttgcctcaaataataataaagttattttgaattaaaataaa

SEQ ID NO: 7164 - DNA, 678 bp, Homo sapiens
ccaaggggaaggagtggccatgtttggagacataggacgggcaagaagtgtgatggaaagctggagtcgggcagtaaaagaacgcaccggggagaactgtgcaactgcagtatcccagaggtcaagtcttcttcaagctcagcccagtgagatctaaaattgggaacttaccagaaactagcagaaaagtatgacaaaaagagaaatatgatccaatgatccaactccagaaaaactcactggatcgaggtgaacacagcctctttaaagctcttgccaatgagctgctggtcactttttgctgcttgtcattcaagcactttgacacggacctgaagctattatcacaagtgcctattccatacttcattcaacttttgggagtctaccaatggtgtacaggaccgaatgtaatcaatatcccaagaagcaaaagagatgcccctagcagaagcatcttgaaggtgtactgtatctatcaccatgaagtctgcattcccattttttttttttttttttttttgggcgggggaagaaaaacggaaagtttttttttttttttaaaaaaaggggtgtcaccgcgagggtttttaaaaacccccaattttggagaaaaataaaaaatgggaacactttttaaaaaaggcggtggaaataatttccccaaaaaaaaaaaaa

SEQ ID NO: 7165 - DNA, 860 bp, Homo sapiens
caagagggtcccaccgcccgcgcagtatcccccagcggcctgtgcaacccagcggggtcccccccgcgtttcttgcgccgagccccactcccgattatatccaaccccccgggtcttccctacccgggcttggacacgggcggcgctctttttttctccccccccccccccgggagaaggggggcctgtgttccaacggagggccccccatcgttgataacctcggggggcgaaaaacacccccccgggaaattggggcaccggcgttccccaaggagtgtttttttttgcgcgcccccccgcggtcttaaaatggggacccccccgctatcccggacaaggcgtcgccaaaaaacgaaatggccccctgcgcccctcccccgggaaactccctggtgcgggggggccacacccctctcaagagctttgcccaaaaggaacggggggcctttttggggggtttctttcaacccctttgcccgggcccccagagttttttcccagggggctttcccaacctttttcaaacttttgggggttcccccaggggggccgggccccaagttttttatattccccaaagccaaaaaaaagcccccccccgaaggatttcccgggggggggggttttctccccccaaagggggcccccccccccttttttttttttttttttttggcctgggaagaaaaccgccaaagttttttttttttttttaagatcatgtttctaactagcaggtatcatgaaaacctcaaattattgaataataatagaattgttaaacacttttaaaaaagtcctgttaagtaatatttccccctaatcacaattaaagacaataaaaatggatgcggccg

SEQ ID NO: 7166 - DNA, 745 bp, Homo sapiens
attatactaaacctcttaagtttttattctgtcacagccttgcatttcattagccatacaatgaggaaacccagttccatagtgttgtcagtaacctccataacttgtaccgaaatgtgatcgaattgatctcaaatatgcgcattggtgtttcggttaacatccacttgtaattgaatcatatggtctttaagattttgagctcgctctcagagtccattatttaggtccgtagcatcaaagcagtacatggttaaaggcacggtgatgttcatggatgcaatttcattcctccgtttctttatggcattgatcttcgtcacaaaatcatcaatgtcatgattttctttcaggaacgcagcgatgttttgctctgccgtgttatccaataagtcaacatactttttgtagacatttaaatatttgcaggggccaacttgatttttctgaaataccttgaaagtttgaatcaaaaaatcagaaacaagtttttcatctgcgttaacagttccagggagcagattatatcctttcagctctgggaacaggacagattccaccttggggatcccattagagttcttaataatttccaggaaagagtcacgtattaattcccagcagccatcaaaagatggattgaagacaataatgggttcactgacttcaagtttgatcatgattagctgaggtatgaaaaacttcatctcttggtagggctccttaaaatcattcccatcctgag

SEQ ID NO: 7167 - DNA, 915 bp, Homo sapiens
  misc_feature (1)...(915): n = A,T,C or G
cacacttctggtatacgccactctcgccccggcctaacacccctanactttttttccaccccccctggcgaatatcaccggtggcacacccccatcatttttggcccaaagggccccctcccctctaaagtctacacaggtgagtgtctctcaccacccagtcctgcatttaagtcgcatggctctttattataccccccggttccagccaaaggaaaccaatttcatggtgggggagccccccaaaagaaaacactgccaaagactccccccaggaaggtgctagacccccatccaagggctgctgagtgaagaattgagaaagaccctttcggtgtagccccacctcccgcaaattaagagcggcataggaaaaagtttttccttttttccaagccaaaaattgcaagggttaaaatttactcccgtgattctttccctcagaagcgcacaccctttcatcantactgataaagtttcaaatatgtttttcaaatctggcattcatggttgctactgcactggaataatggtaacaacaggctgatgagaatcttaagtggcacttactcagtggagtaattggaagcggcaatggttatacaaatgaatgcccctcagagggaagaaggagagatttgccttgaaactgcggctgtaaaaagttagccctcaggtgtggcgaaatcttgtttgagaaccccgatcagaatgccaaatgtgtttgcatgctggatggaagaataccaaaataaaatcattatggatatcaatacacatggatcaaccccaccattaacatgcatccacctgaagcccaaggactgccactccacagcaaaatgatcctagatgataaaagaaagaagtaaagtttaatggtttattcacataaaataaaccgagatcggcaag

SEQ ID NO: 7168 - DNA, 1376 bp, Homo sapiens
  misc_feature (1)...(1376): n = A,T,C or G
ccgcacgattccacnccgagtccgggacgtatcgatcagtggtcgcgctctatnctctgtgtctgccgcggctgtgtngtcaggtatgtgcttatatgcgtcgctagtggagtacgattggcgcgcgacagcgtacgaagcgagccgcgcgagcagagagatgtntcgttgagatatcttactattcatgtatactcgccgcgatcgcttagtcgcgtaaacatacgtttgccagaacgacgtcgccgcgagcttcgttatacagatctcttcgtgtcactgtgcatactgatcattataattacagcgctgcggatttgagtactcacgtattataggcgcaatctaaagccagcgtaacatgttatgtacatgctcagtctgattctgacgtacgcgattcacgcgnagtaggcggaatagacattatagtattgattcgtgttctnagcgcacgctnatatagtgatatgacctgtggcggaatgcgcggtcggatgaggctgcgtggcgagatgtgtgagcagacacggacgtgcgcgtctctgtttgccgcagtgagcacagtagtcgtgtcgacggatcagacgagcacgngnattccgagactgtctaganatcgagctacatatgcgtctctgtgggacggcacggacgntgactctagcaaaancatgtacatgcactacgtgctgttctaacgagagcgacacgtagtgatgtgtacgcagaggaacgagagatcgagcgaacgcctgtggcgagtactcttcgatatcaatgacgccacgctacaatgctcgcatcatatagctaacgttgtntgcgcggatgtaacgatagttnccgatggtcagctgttnatactgccacngcacggaaccatcactgacgagcttgtatcaatgtgagagacttcgtgaccacgacagaaccgccnatctgatatacgggttgcgtacgaatgatcgtcgcactcaggtcaaattcacagcattacttctngntagtgacgcgacngacatttacgtgagcgcgacgtattcgtgcttgctcatctcgcactttcgccgcacgaccagacgctacagtcgantaacgcgaaacataccttgganaagtcctccacagtgcagcgtccgacctagcacctatgtcaccgatgaccgttatccgcggtactccacgctcacacgtctcatagataatatagacgacacacatcgacgacattcgctccgtcgatgagtaatattcgtgtctccacagtgcgtcgcgacacatcagcggactcacttgacacctcgaacgaccaacagactgattcgctatgttcaggcgccatgacgcgtcacgtcataacgcgtccctcgngg

SEQ ID NO: 7169 - DNA, 1097 bp, Homo sapiens
  misc_feature (1)...(1097): n = A,T,C or G
tctaaactataaccacaaagacaaaaaacnaaaggcttatagagtagacaccacgaacgaaggcgtgatgccgtttagaacctggcagatgagaatgacaatgtgtgagctcaagcatgatcttttgatgcacagtacagtgtggagccatagtcaggactacagttagatcggctgccgtgaggcctacaatgaccagagaaataattctgttgttgctctttttctacttgaaagctgtaggggctatgtagatcgctatgcgccagaaacgtaatgagtgatgccaaaaggaaaaaattttttttgtcgcaggatagtcctttagcttaagggagctactgctagcctgtattccctttagttgaggcgttattgtcttggagcgggggccggactggactacgcgcgttactcggttcgagtaagatgtttagcgagcaggtaattaatctgcaatttaatgaggtgtaatccccggctataccccagcacatcgcggtgggtatctggacgctatagatccatgtgaggtttaaaagcctagttataaatgatcagtaaaccgtcgacataagaccaggatctgtttgggagtgtgatgatttagagtcactgatacatgtgacgaagacaggagaagaacttgatagtattaatatacaacgtaaaaaacaatatccactatgaaattaaaatactaaaatgaaggtgttagaacatgtaaaatgcatctaatacgcaattccttgttctattataagagacataaccgacaaactacaccacaatcttgcagagtggagtataaatagctggagagtgtactccacgtcgctcgggtctagagagattagtgtatgaccaagacgtatagactagcgcagaggagagaacgctcagagatgacacgcaggttaacaacagaaaatataaagagacgttacgcaaagcccagttaacaggtttagttgtgaaagtaatatataacaatataatattccaactaactattaaatcgtatagtgaggtaataagtgatgcgataacggcaagataaattngactatttgatgtacggtggacactcgcgtgat

SEQ ID NO: 7170 - DNA, 1602 bp, Homo sapiens
  misc_feature (1)...(1602): n = A,T,C or G
acacaccgcctactccatcatgtgagcgtctntngtgtacatctcactctatcacacgagtagcttgttctatatcgagctcacgtatccagagantntacactatcaccagtacagtaagagcgtctagccatcctatacagcntagagagacgtaactaccaatcgtgcccgcantcgtaattacgcatactcctcaactgatacgtctcccactatcatgcacatagtcatccagtattgctgtatgtactagtcgtgagttcatgtgtgtctctcgtacgtcattcggnccnttcctcttctcgtgtacgtctctctcctgtcntatctatattccatcttcacacttcttacacgcgctcactcgtaatcgttttccatattcgggngacantatcttatngcgcactactatcgcgcgccacactctccagtagacacatctatatanacctcacgatttccacgtctctcggctattactactagngacctacacgtcccatctccactacatcaccctctctgcgagcgctctcttagtgcgtagcacaggcactacactctatcaatcagctggttngcgatagtactacgccagatcaggtcacggctcattagtcgtggttgtggtgagtgcgactcgtggttaagcacgctgcacatanctgcacccagtgaacacataacgaggcgtagaggcatacagtgatcacatactgacgcatgactctcgcgtcgtcggacatctcactctctcttcttgtgtctgtctgctctcgttgcgcngggcgctcgcggtcttcgctcccctcctcctctccctctcgtcctgtgctcccgcgctcatccgcgcaatatctcttannactctcttctccctctcttactagcacccccttcntcctaccacatccccctctgctatcncttcctttcntttatttctcttctnttctctcgcttctcttcatcgacactgtaactnggctctcacgtctgncttagacgtacgantcgaactacatctctccgcgangcgagccatactgcagcgctggcccgcgcgcacctgacgtctgcacctaggcttgtatatgngcgattcccatcatatcactcacacctatcactagcctctcggcgcccacgaccgcgaacacaataaatcaacacaaagngcagcgcgngcctactcgctnctcgtctcgcttctgctagcccgacgtcttcatgccgctccctgtctctgtcntgtcctacgatgcgcttacgcgggagcacgacnaacactcctgcgcctnacacttgctntctatcgtatcnaacttctctcaacactcccatctntnatgnacgccgtgcgctgtancatcaccactcatcgagnncacccatccgcctcatgannnnnnacacagcactngctnnnaccgccnccacgaacagnngtccngtnnnnnnnnnnnnnnnnntnnnnnnncnaaatnannaanaannnnnnnnnnnnnannnnnnnnnnncnnnannannnnnnnnnnnaaacnnnnnnnnnnnnnnncccaaannaaaannnnnnnnnnnnnnnnnnnnaaaatt

SEQ ID NO: 7171 - DNA, 1191 bp, Homo sapiens
  misc_feature (1)...(1191): n = A,T,C or G
acactggttgtgggtaacatgaatccgacaaagtatatcaccggaaagnagcgagcaagaacctccggcgggnggaacacacggagngaacgggaccgggctatagncgagggccacgcgtcggaacgcctcgccctaaccataccgacgccgtgcacagacgcgacttcgcacactgggtgtgtttcatctatttaatgtgaatgaatcttgtgtcggggtgtgaaaccagctactctgctgctcagaagcgcacttcgcatgccccgccattatccttcgtcctgctggtttgattaacctcttgtggtttactgaatgtgaggtgtgaatataggtgttacattgtagtgtgggcatcaccgagcctgtngtgtacatcacgacttaagggtgattacggggacaacacaacacttgctatggtggtgggatataaagacaccgcacccggccggctgctgctccccaacacacccccctcccaccgtgttggcatgcagatcggcgacggccaccggggccctgtgccactcacctccaccattccatgcctatataatcaatggtaatggtgtagcgaaaaggccgggacaggaacgtaacacataacctacaacagacataggggggttatttagtatggtgataaaaaacatccaggggggtggaatagggggggcggacacagaacccacaacacaagtcatgggggcgtgagcaggaggagacccgggaaaaatgcatggcgggggtgggtcggatacataatgagatgccgagcatgggggatttctcaaactagaggggtatggcaaacagatgtgggatctgaggtcgtggtgtgcacaatgctgtcgccgtgggacacacaacgaggaagtcggtgaaaaaattgggcaacacgacccggcgagacacatgcaggcggtgtccaaccactacatacatctggggtgaaccataagtggttgaacgatgcggtaccgggctctgtaggtctacttgctgaccaacaaacactactcgtgtgcgcggaggcgaacggtgactcggtgaggcaaacgacgctgtatgagatttgcgtatgaacaggccacaccaccaccctcggctccagcccatctcttttccacgactctggtccccaccttaactcggtatataggaaaatgaggggtggggaataaa

SEQ ID NO: 7172 - DNA, 800 bp, Homo sapiens
  misc_feature (1)...(800): n = A,T,C or G
cctgcctcggggaattgcagggcattattaggacatgttttacaagtgagggtttatgggaattttaggcgaaagggggggatatttaagtaaggggagtctcccgcttataatgaacaccattttttgaataatttcaggggggtgggctatccaaaaccgcctcgctctcggactgttgtagggttttggggtctttggtaagcctcaaggttcagtttaaaatgccgcgtaatcgcagtttcttgggggaacagctcagtcaccctcatgggtaggcggatttcttttccgcctccatgagcgccgacgtccgaatgctcgtgagcagggggcagctttagctcctactcaaacatanaaggcccgaccgagaggacatcgcacatattatcatctttctatcacattatagtctgaggtacccgcagaatatgagttttcgtcatatgcagcgatatgattattatgtagtcagtcgtcaaaatttgcagtctcaggaaaccttgtcaagttggttgtattacccagtaagtattcccatattctatccagggtgaggctcgtccattaatgtctgggattcaaagttaagccgggagctctacaggagatggagtcactgtaatcggtgagattgcgggctatgttccatcgcctcaagtaagagacaatcagggttgtaaggattgcagaaggcgagaatatgtcaatatcaggggtatggcaggaatccagtgttttcttcttagatacaaccagagatcagctgtgggtattgggcattggaaatcacatcc

SEQ ID NO: 7173 - DNA, 125 bp, Homo sapiens
tttcggtgttatagttggtttctccgggtggacccagcacaaagtcttcgtataggtatactgggtggtttatatggggggttgtgcccccagcccagtttttagtgtatcgtccttctcgatat

SEQ ID NO: 7174 - DNA, 777 bp, Homo sapiens
  misc_feature (1)...(777): n = A,T,C or G
gttccgagcccagccaatcagtaagcaaggatcatacattaccctcaataaaggaagcgtccgaatagtaagaccctaagttcacagaggcagaaatttttttttgaaggtggatatgtccatattagtcagcatatgcatctagagagagtttcccatgattaaatcaagagatgcaaancagtcaggcgtgtcatgccatttacatcattattccaaatggtgctcattctagtcagctgtgacatatgcaatgagaaacatctgtccccttccctctcaggtgtccatggtggcctaggttcatgatgacagccacctttagcattagatacacaaaagcctgctctatatatgccccttcgacttagacatatttctcaaaaagaagtgcaataaacttttattctttcttaattagatggagtggctattgcctaaatcatcatccaaggtccaagtctggttttatacctagaaaaggaaaaaatgttattatcagttaatgactttggcaagaaattccgttaacagctacagttagggagagttcttttggaatctaactgtatttaatgtttataagtatagatacataaaaggtgtcctcattggaggaggggggtggatgaagccgtcaatgatcctttgaagccttatctcctcctcttgccaaggccccaggggaaggagtcttcaacgatgggtctatctagctcttgcgtgtagccttggatctcactgctatttaggcaaacatctgtctgtcacaccaag

SEQ ID NO: 7175 - DNA, 1294 bp, Homo sapiens
  misc_feature (1)...(1294): n = A,T,C or G
cgttgtgatgcattccgtatctcccgctcatctatggatggtcgttgatctgcggtgtcttgaagtcgtactactattcaggtaccccaccgactatgtctcacgttacacaattcgtcttcttcactgccttctcttctctcacacaccacgtgctcacgtatcgctacccgtctcatacctgtaccgtgtcatactactctccatagcgggcgaaacccgatcgcatcacatagactcgtgcgtcccgcgtagcgtgcttacttccttctaccaataggtgtgtaggttagtaaatagatatattactgaatatggatgatattgtagttcttattgtgcgagtcaccaacgtcccggtccgcgtatacacatgtcgtgcaacttcgtggaggtggcgcgccaggataccagctacgacggccttatcgacaaccggcacttgtctcctgtcacagcagtcgcatacaacactgtatcatagatagtggtagtcgttgttcatcaatgctaaacacaacatggggcgctgtcacgctgggtgggtagtcatacttacaacatagtgtgctgcacccactcaggtcgcgtgtgtggcatgctccagtctgtanctatncgggatccacatgggaccccatcggggcgtgccaacacgcacacgatacgtcgagctggaattgctgccggcgggtaggccaacaacagcgcataccaaccgcgaacggcaacggncgatgtgtacaatcacggtgttcgtcgtgtgtcggccaactaaactcgaatgtgttgacatatataaaaataatggagaggacattcgtgtgtcctccttgtacttactcccataactgctacgcgaacggtggttgcggcggagcaaccatgggtacggggtggtgtgacggctcgaacaaaccgtaccatgtgccgcgtgggcggaaaccagtacacatggccagacactaatacacggagggcaactcacacacccggaccatgggcacgcaacccacggtcaaagatggtggacacaccggggggcaacagattacatgacagccggggtacactcagaacatatacaatggtacttgtggggcatgacggtggcgcgtgggcgtaccaacttcggtacgcggcgtggtccccctnggttaacgtgtgtgcaactgcacgtgggtcacacatgcgcagggatgcttgtagtcagtcacacgaacaccggagttcgggtgtgagaaacgaattggggtacatctatccatacacgaaggggtgacacaattcaaac

SEQ ID NO: 7176 - DNA, 461 bp, Homo sapiens
  misc_feature (1)...(461): n = A,T,C or G
agaaagaaaacctgggttcacacaagcactgttggtttagagcatacaggggggcgcntatatgtgtcgctactcggcgccnctggggggggtgtagnntatagaatntgtgggggggggaggtggggcggtgggngtatatanataanntntnntcncccnnctttctncnctnacnccacatgntgcanaggcgcgcagcggntggagacccgaggcgtcgccttttcgcgagagtgggcgggaaaggaggagaggactttccaggagaggagagtgtcaggagggtttgtgcaaaaatgggaggggggggggttgggaaggggtctgatggggggggtctataaaacccaaaagagggggggggggggtggtnncncccanattccttccttcacccttctgaggggggggggtacggccgcgggagggagggagggggggttggggccttgttgaga

SEQ ID NO: 7177 - DNA, 1460 bp, Homo sapiens
  misc_feature (1)...(1460): n = A,T,C or G
ggccgagagacggagggccacacagaagcgcgccgcggtgcgtgacgccaacgagagggttctgttcngacgatgtacaaccacaagncaaactaggtgtgaggagtgaaggaggcatcacaggaggaagcactactatgtngcccactcacctnggncgccgctcgctcggtctacccactncatgggggggctggagggaggcgtagagatactgtaaatacgttcgtctcccctctgctacctcacgcaccgttaganaggcgccgacattccacacgcaggcgtctctgtcgcgaaaatggcgtncacacgagtaagcgactctccacgagaggaagcgttgtaaacgcttgttcgcagaagacgcactgcttcacgcatcttgaaactctctcccgtacggcatcctctctctactcacacggaggagggaggggtccacaaccacttcgtggacggcaacgagttcgctggttcagcacgccactgttantgaggggtggtcttggtgctctcggcaccgctcagacacgatgagcgggttggaagacactgggcgtagagagggtggcggtggggagcgtcgantggaanatccgatcgcatgtgtcgtgcaggctttgtgcgtagccccgcgccgagtggagaggtcctacgatagggcccgccatgccctgtgctccnagcggaggcgtncatctaccggagcggcctcgcgcgcggtactgacgcagcgcggcgctgtggaccccgtcgcgtcgattaggggctaccggtcgtagcgagctcgcgcgcgagagacgaggagatacgccgcaacgtagagcgagacgaggagtcagatgctccctgcagggggatggccncacacgacgtgcgcgtcatcatcgcgcaagctggcgccntgcgcggcgcacggtcnacccgtgccatcagccgcagagaggagcggagcaccgnncgnccgacggcgcgcacgacgncncgtcaggncgactgacgagtagagcagagcgtgtacgcgcgtacagcggagtgtcgagcggcggcgcctctccgcaccggtagcgctgagtcgcngcatgctntacagtgcgggctgtcacgacgccgactgtgagtaggcgantgatgtgagtaggtctgcgcacagagacgcgtctaagcgacactgtctcgtctacaccacgcggcgtcgatgtgngtgtcgccgagcgcagcgacggccgtcgcgagcgnccagcgctgcgaggtggtcgcgcagcgcgcgcagctcgattgcgctgcagacgcaggagcgtgacgcatggcctctcacgcagagcgtacacagacgctcgcgccgcagagcggtgngcgcgcagcgccatncgtgcncgcggcctatctgcgtgatccgtcgtccatgcctgacgganacgcacggggtacgcntccagnctcgaagtagcagcggc

SEQ ID NO: 7178 - DNA, 1182 bp, Homo sapiens
  misc_feature (1)...(1182): n = A,T,C or G
gtttgtttatttattattattggatanagaaacacacaccactctatcttctccccgtcgtgatggggcgcaggcggcgttatgggtgggcaggagtagagctgctagggggaaattaaattggagatcttactaggattaccgtgtgggacatagttatagtagtttgatataggactaagagtgaaggtcgatctaagtgatgatgtgagggtgccgtcgcatgcgctcaccgattagcgatacagcgtcacagatttcgcgtcattagccgttatccgtccgcaggtatgagctgtcttgtaacgcataccacgtccccagttaacgcaacagctcagatatgtctccaatcactactcgactctttttcaacgtcccacccgtttgtttctcccaccttatgagtcgcttgacacgtctgtcaacagtttggacgtacttgccgagtatcaccgctagcacgcgcactacaggctaggtatacatcctcatttgtttttcacgtccccagtttcaaccacccaccctgtctgtcccacctcacgtttttgtcaccctcactgttccacgcacactatagtatataacccacactaaattgttttcccacacatcaaccacccaaactcggccgttcatattgcaattgaccttgtaaattagagacgggcacacctagaacacgtgacgccctaatttccctttcggacccttcccgctaactccgcaatctagaaaatcagtaatctgttcgaatcacaacctttgttaagcgtttcgtcctgccgattggttttaccaccacgtgtatgcctgcccacgctgttagactcgctcgtcccaattttccacccgccccacctccccctccggtgaccactgttatcatgactttactttacctggtagaaagctcaacaaaaatatatacttgagattaaaggtcacaattcgcggataaagggccatttttgcaccaggtacccatagccaaactgtcccgacaggttacatggttttaaccaccctgggcggcgaggaaatagttcactttctacacgtcttccatcactcaacaccggtgtgtatgccattgactacgtcttctctttctgacccgctcccagtcgtctgttcgttgatgccgtacaacccagtggttagagttacactatcctt

SEQ ID NO: 7179 - DNA, 1449 bp, Homo sapiens
  misc_feature (1)...(1449): n = A,T,C or G
tgtccgtcgctgtcgcgctagcagctcacccaganggagaggaggccggcgcgcagagtgcctacgtgcggggngcgacatgagaggggtgtgcgtgcactctcaaggacgagagatgctacactcctagtgagagctcagttggtgtattagtgcgctctacataacgacgatgactcgagccaacatattttcgataatatctcacgcattcgtcctgtcataccagtccgggtccctcatcattgtctcggtgtcaacctgtgatgctttgctctcagaaacatgtgggctgatantcatgtgcccttagaacgccggcgatccgccaaacgaggatatcgcactcgccgagcctgcacgccgtggggtgtcagacgtggtggtgagatgtgcgcataccnggacgtgatacgcgagtccaccgggtcgcgccggttggagaccacgaggaccntcagngcgcgagccgctgcagacgaacacaagcgggacggcgagcggggcctctacacgacacacangccttctctgtagctgtggtcactgcgtgcgaacaacactgcggtacgttacgcccaaattatatacgacagtgtaggttgtgcgcgcataaacccacgacacacgtgggtgttgacgaacactcacagcacacaccagntgaccggtaggtgtccacggtaggtaaaacacatagataagaatgtctgtngtgcaccggttgccgctgcagggcactcggctcggcgccgctctcacataactgggtgggggagaacacgaacaactacaacaacatacgtnggagatggtgtgngacacggccacgcctagngcgctcgtgcagtgcacagaacatcgtatgcaaacagtgcgtcgcctcanccttcgtggtgggcgctagcggctgtgcacgtaacatcactcactcccnctccgtcgttcatgtngcgtcgcgctgtcggacatatccagacctggtgcactcacataaaaganacganatcaactggtggtgtgtgcagtcgcgacacaccnaggtactaacgacacgtcngngcgtcgaacggtcgggggtcgctatgtagcgtcgcgatcctcactgctcgctctntcttnctntctcggcggctggcgtctagtgacatccgttgtgttacatatcataacacnaccntcatcctgtacgctcatcgcatagttatgtgtgtctggtgacatgcagtgcctcgccacctacgtcgtccatccacacgtcgcgtcgacgagtggtgtggagtcgcggcggtgtacacccacactcgcacgntggtgacaacatcgcgcactacgacgatctacgcgtcttcgacactatcgtgttcgcacacagcacagactacgcagcacgaaaagacagacactacgtgttgcatcatacgtctctgctagtctcttgcaccctct

SEQ ID NO: 7180 - DNA, 505 bp, Homo sapiens
cccgccagtgacacccatatccccccacacgccgggcccaccccaagcagacttcactgattaaatatacattccctcatccccccccgctcggccctctctctcattcccagagggccccaacatatttctccaccacccccaagcccaaggtaccaagacttccccccagcccgttccccgggcaccgatttttgaacaccccaccatttcgctaggcccaaggggttcttccctttaatcacccccttttgaaacgccaggccggccggccttaccacaaccatgagttttacccaaccttgttcaccaatgggaaacccccattttcatgagaaacaaacaatttaactgggggtgggggcacggtcttttggcccccaacttcttcagaagttttagggtggaggcattgtttcaccccaagaagaagaaaggttccagttaacccaaaattttccccctgccatccaagcttggccgacaaaataagaccccgttctcc

SEQ ID NO: 7181 - DNA, 772 bp, Homo sapiens
aagtagcactgtgatcatggtagccaggcctgcaggtttgggagtgacagatgtggacctacattcagggtctgccacctcctacctaaaactatgaacagatgttcaaagttctcaatttgctaatccgaaaagtgatgatgatcatacttacctcaaagggtaatcccagcatgaaatgaggtaaaagttataaaatacttcttacagtccttagcacctgctaagtgctccaatatagcatctattgacctatcatgatggtctgtaaatagaagggaggattgattgtttttcagaactctctcaaactattatacatacctaatgtgttttcaacatagagcaacttgtgctagttcttttatcaattggaaacaatatatttattctatcttccggcgatgccttctttcttttccttattttaataaccggctgtccatcatccatcttcattataaatcagctataccaccttatcatcataaggttgcatctcataagcttacaccttcgtttaaattctcaaatggtgatcaccctatcttgtttacatcctcgttgtcaaatctatattttttttttttccctcccactattatccgttcatcttcagagctgagtctagaacacacctcgccgtatatggataccaatcccgcgtcccctgtctctttccaaagactcgattgcacggtactgatgatcgcaccatcgtgagttgtattactttgatcaagtagttacaagccactatgtggcacggtct

SEQ ID NO: 7182 - DNA, 877 bp, Homo sapiens
aggttcttttttctccccgttccgcctcgtactacgcgtctatcctccccgcttgatatcgctacgattcacctatccctgtcactccctcccccccgctttctctcctttgttatccctcccccccccgaatcaatcgaccagaaaatatccccacccccttcccccccatcatctttcccccccccctttcctcaccgtggccattttagtaatataccgtgccctccccaatgtcccctttttcccccaccctttccccccttccctttttccgtattgtttgcccccccccctcccctattttttctttccctccttgtttttttcccccatttcacacaccctacccccttctcttctctcccgtgtccaggtggcctttttacttcattccctccccccccccagttctcccattcccattccatctatctactactctctcccctgtttaactccatccatatgttagtttctcgcacccagctgtcaccaacagtataaatccccgcggtaccattatatcccagtcaaaatttccaggggtggcctataaagcccgcattactttaaaactcacaaagatattttcccaggtcacgctgatacattaaaagcccctgcagtaccatatttgatgtttctttcgtgtagttctgctgttacattaagccaagccaataaccagagacaaagagtacaaattacacagttcattagaggaagtagttttattcttgcatgtatttattatgtttcatcttgttcctaaaattagatcaatccagtttataaaagatgggtattttggcatcaaaataaataaataatgggtagcgacaggccccccctcttcccctccatttatcccccc

SEQ ID NO: 7183 - DNA, 763 bp, Homo sapiens
  misc_feature (1)...(763): n = A,T,C or G
atacgaatagattggtatatttacaacattattataataaagacagcactcgaacagtcgacataccaataaagaatgnatacataatcttgacatacttaaataaagtcctaatttatcataaaaaaaaccccccccctcacacccaaaacattaacccacagataaagccaacttttgaacttccatccatcaacgaatatacaatacacccactcgtccctctcatgcattataaccataaaaacatactagtacatagacaaccctaaagcccgcttcacgtcccctggctgcatctcgttctacccgctgcagacggacgttatacagccatctctcctctgatatctaccgtccgagactcaacgcagttccaaccaacatgcagggttttattccccacaacctcagcacaccctcttgtatcctgcccattataaaccagtccgtcgccatttgtctgccaattcgccccaggttcctcgttttggcacacttttctttcagagccggcctttgaacaatgcagtaatctcacagatcccacagagtctttccggacatgcataacgtttttacagaggcagatgctttccacgtagacaatgatcactttctttattcctagtatcccaaggagaagggcacatacacagataggtacacatgttcctggtccgttacacaacaccaactgtgtgacacagggcaaatcacttaacttctaacttctagcacagttcctggtgtcagtcagcac

SEQ ID NO: 7184 - DNA, 127 bp, Homo sapiens
  misc_feature (1)...(127): n = A,T,C or G
gccgtgtgaatacgagaagaaaaaggagaaaaaaagnnggctatgtggacgaccagtgaacttccccggtacacttggctgactcccggacgagtaaataactacaatattgtacggctgggagggg

SEQ ID NO: 7185 - DNA, 1427 bp, Homo sapiens
  misc_feature (1)...(1427): n = A,T,C or G
ttattcgtattgatgctattaatgattgtttgcagagcgcgcgggggaggaggagggggggcctagattagtnagaacngagggaggggcgagacgccttaaagcgaggngcaaaacacgaacgggcaccgcgaagaaggagagagcgcacacaaaggtagcaagaggtctttagaacaggaatgtggcacatacactgctctctcaatatagcctgtacaattagaaatcacgggagacggacgctacagacttcaacgcgagctcctcgtaatntatatctatgctaaacagcacccaggtcacgactgcggagaatggatgtcagagtcaccaactacactagctccctcntttttttttatttagacacgagcaagtcattccatatgcagtatttattctaagccggattcttctcttaagtatagttgggagcgcgcctacagagcagttcaaatacatgtattctccgattcgacgggccggaatcgtgcatcagcctcacagcgtgtgggcgacgttagtggnttgcgcgtagtgccgcgagcgccgcgcgatgtagggcgaattctgtatatgtactttatattatagcggcggtcgtcttgccgcgcgcgcgatgttattctcgacgcagatcgnacgacgcgacacactgacgatgattcnatccgctgtcgtttttatgtactgacgctcacctattatgtgcccgaccgtagttgccgngcggagggcagtcgaactccgtgtccgataaatcgattaatataatgatgagataaggcgggcgaacagacgcgcactgtgggattcctataatataccaacgatgatcgcgacatcagattaaatttcatatatattatttatagtccttcaccgagcgcggcgtgtagtgtacgctgatatatgataccgcaacacgccccgcgccgctcccgtattgatatataatgttgtataatcgtacggtggtcgcgcgtgagtgtagtgtgtatagcagaacgatagtaagctgtacgttgaagtgtaatatgtatattactaagacgcacgattattntgtacgtagacagaacgaagtatatagtggagcgaatatacgcgcgatatgctcatcgcgacgtgncncgaacgttgtaatgcacgcatgatcgcgcgagtcacgcggtcgcgcgtacaaataatgtgagtatatatcnataggncggtaagcgcgtagacaaccatcatacagacacgtcgagctatgagtgataatctatatataagcgtatggataataagaaatatcacanctatcacgtcgagctcgccgatatggnctacgatanatatcataatatcgtcgtgcagctatgacgcgagtcacatgtcatcgttgagtgatgagtgtgctagtaggcttgcgcgctgcgaag

SEQ ID NO: 7186 - DNA, 882 bp, Homo sapiens
ccgccatgttttccccactcccaccccctctctacgttcccagcatctgctgccaacatccctttattctcccccccctttaccccccacacaatccaccccccttcttattcgtctcccccgccctttaaaaaagcctataacaaaaaaggtaaaccccacacccccgagagatacacaaggcttaatatacccccctgcgtcaccctccagtacacctcacgctagcaacgtgcctaaccacacccaattagccatcccatataacccgccccttttgacttaagagcccactcccctataaggaccaacctcaaccatcccattttccatggcaccaccatttgcaaccccccacatttgtatccttccgcgtcggttaataagcaccccatctccccattcatcccccttttcacctttaaccttgcactagaatttccccccagatccaatttcttcccacttccacctacaacctggcgcccacattaattcacaatgaatatagtctgggttcctgttctaaccacccccaatctaatttccataaccagttaggggatctccctaaaatgcacagctgattattgcttttccccgttgaaaagaatttcgacttcctctgggatcagctcttccactcatcaagataggatggggtttcctcccacaataacggaacgggttctatcacactccattgtaatgaattacctgtctgttcttcccaaagaaacaaaagctccttcctttgttcaattagtagatattcactgacaccttcctatgcataatgcacggagctgttaatcaaatggtaaataaaacaagatgcggcaagatgctctttccctttttccctctcagcgctttcccccc

SEQ ID NO: 7187 - DNA, 1158 bp, Homo sapiens
  misc_feature (1)...(1158): n = A,T,C or G
gaagtgataatgaaatataaaaatatatcgcacatccgcgcggaagacaagacacgccttagctggggataacactgctctccgaattcttgcaccgggtgacaaacacaattgaagcataattataaccatccatcgtagcatacttagaatttcttgtcacagttggtagaaccctgtgccgacatgagtgcacgtggacatgctgaccaacacaagaatagtagatgccagcgtgctcaccgatgctcaaccactattctgatgcacgtgcttacgccgtaaacatgantgccagacaaccatagagcatgatttatttttatactacttacaccgacgccaatctagaaangagcatatagtgggcgacggccttctattctttcttaaatgtaaccgtcgccaggcggtatcactcgtatatctaatagatcctatatccgccagcgcgctgggctgtccctgactcgaatcaggagcgattgcttagctaaacaccatttgcgtgtgagcgcaaccgttaagctggtaggatttattcgccccgtatatccacacgcgtgtttccatgcgttaccccctcgcccgcgcttatcattcgtgtatattgtttgcgcgcacaatttccgaggctatacccggcacgaccaagacataagagtcaccatatattctcatccgcccggttgtcccttccattggtgatatattcggcgagcgcggcacgcatgaagcgtattatattaaatatcgatgccgcgacctataactcggtgtatagagaccgcccgcgccgcgcgccccagtaaatgattttcgtatggtcggatagcatctagacgagtgtcgttacttcacgccggcttagttaataatatacctacgacttgatccgtaattacgataggtgggacgggatccgcatacaggcggacctggcgtcgtaattgatgggaaccacgtatcgcgttgtcggtattattccattgacgatctaagcgctagcgcgccatgcccggtcactgactataaaatatatgctancgcgtcagagtaccataccgccgtctccgcatagccgagatcttgaataatgtacgttctgctacgatcgacgtaacgctcataagatactcgcgtagcatccacgcgcat

SEQ ID NO: 7188 - DNA, 850 bp, Homo sapiens
aaagctttttttaaatttcaaaaggcattctttgcccttaggaatggaacccaagggtctttttccttaggcatgtgggacccctcataaacccttccctgtaaagttaggaaaaacaagccgtttatccccccccgtgggccaaaggggaaaaaaaacccataaatttaaccccggtgtccaggtttcaaataagattttaaaatgttattttattaatcaaatgaaaatactttcctttaaaaaaaaaaaattaaatttctttgaggtataaaatgtatatttcaatttaaaattccaaagacccaattagatatattttttttgtcctaaaatattttgaatgattgcacaattcttttcattttaaattttgtcaaattcaagtatcccctgtcttcaggttaagtgttgcccatatggcacaatgaagctcatcataccacagagatctacttggggtctaattttcatcattataatccaaaattttccttcaaagacaaaaagacaaaccagttgataaagccttctataagattattattactgattatttaaattcctttgactgggtcaaataaatattctgtagacaaaattcctctcatatcaaagtgagataatttttgaattgtgctccaaaaagtcatttttaaattataaatttgtacttattaattgacacatttaacaaaaattcattcagtgctatacagcaaccattatgccaagactgaaacatttccttcccccacaaatcaaccactatattgtaaatagtcatgagagtttcaacactagctccccaaaaggctattcatcaccaaaataaagagggatcgcaaag

SEQ ID NO: 7189 - DNA, 778 bp, Homo sapiens; identical to SEQ ID NO: 4168
  misc_feature (1)...(778): n = A,T,C or G

SEQ ID NO: 7190 - DNA, 1012 bp, Homo sapiens
ccccactctaaatgggaagaccgccggcctgaagctctttgtcacaagggttttctcagctgaagatcgcggcgtactttcttatattaaaccaccagtgtccctggtgctggtgataagacgcaaagtaacaccacggttctgagttggggacttgtgaaagggttcttatcagggaaatggacctcccttgtgggaaagaaggggagggagacatgagcctcccgggcactctttccactatagtgtgggcggagagttgtcaccagtatctctcgtgaaggagaagatagtcggactctgaaatcactgaggacccctgtgcacccgatggttatggtgggtgcaatgacgattgtaaacggcggtgtgcacctggcgcatacaaacagttcttccggttgctctcgacggtttgtttcatacaccccctgaagtgggtatacttggcgcacaagagaattgtcgctaatgctgtgtccctttgtgggttacacctctgaagtgtgtttattctttttcttgtgggcccacaatatgactttagggttgtttgtatagtgtgtggagcggcagggggcgtaaaccactggcgcggtagtcacgcttgtggtagacaaagtaggaacagtgtctctgcctgcacgatgtttcacctcctggcgagagtattgccaccgatatgaaccctgtgatagatctactacgttattccgtgcgctgggccgccgagtaagatttcttgtctccgcccagaggtgtggttcgtcggtcccatgtgtgtcgaccctgccttttttcgacggagatcggagcttctgccacctgtggcgatagggtgggatgtgatgatacgtacgttctcgccaccggagagcaggcgggagtgttgtgtacggccgccaccgtcggggattcaccgtggagcgctttgcgggtacttgtcgggcgttcacgatacagggaggtgtgagagtggtagcggtttctcctaaaatactagatacagaga

SEQ ID NO: 7191 - DNA, 318 bp, Homo sapiens
ctttactgacacgtgacgacccgttatcaaacatgacatgggtcgagtaatactactcctatatggactcctccaaagatgacaatgactatccaagggacagatttgcaaactgcacagagccatctcaccttttgcctaagggagattagatctccacgatgacctgtgagttagatgtcactaaaggagccatcagcttcccttgtactggagtactgaaactgttaactaggaacactcacattctgagaatcctagtttctaaaataaaattcacacagaagaaaaaaaaataatcggactagctggcctaat

SEQ ID NO: 7192 - DNA, 828 bp, Homo sapiens
  misc_feature (1)...(828): n = A,T,C or G
atcacgacttaattattttattaaaaaaatatagggaggctcatgttggcccagaacgaatagaacgcagagcactattaccggacaagggttggttgaatgtccgactcacggagagctgaagacatagtgtcccgcncattatcaccctctctcacttattaatgttccggaatgtgaagacttttcatggtctccctatcaagtgatttatttatgttcaatgggaaaataagctcagcctcctttccaaatggtgccagaggagcatttcccaatccaagagaaatcattcctcccatatttatggagggactctcatccatggacttatatggacaacccccaagagaaccatgttaaaggcccaatggtcctccagaaatgcccagaacggtggcagggagatcatgtcactgcagcttgggagatacctaggagtagtttgggtgtttcaaggaccaaagaagggaagaaaggagacatttggatacatccataaactcttacgagtgcttactgtgatgaatagcactatctctgctgtcaggctgcctaggttgaagcctggttttgccactccgtgactgcatggtcttgggcaagttacttaacttcgctgtgcctcagtcccttgtgtaaatgaaggagatgctggtacatgcctcataaggtagatgtgaaacacccactgggacatagtaaactccagcagatgtttgttagctgctattattattattactattactttctaccaatttttatttttaaaatcacttatttatatatttttgttggtaacagtcattgngtttaataccacta

SEQ ID NO: 7193 - DNA, 910 bp, Homo sapiens
  misc_feature (1)...(910): n = A,T,C or G
agacccgctctcatgtgctcacacagcacctnatgtgtaaggaatatcaacaaaatgctactgtcaccgggtgtccacccacggaagtagggtgtcgatccctgtagtgtaaaaaatcagcctaaatacatatatgagtcagcggttcacaggcctcttcaatataacctaacccggacttatactccaaaaattgcctacgccttcacactaactagatacttctggcaaataacctatctcgcgattgaaatcaaggaccttcattccaatctagccagaggtctatcaccattcctcgcgctcttccaaactgataggcgttcccctggttaagctttctctaactacacattcaaaaatctacctgcttgcatgagtcaaacctttagctttacactgataacccaactaccaagggaatgaggctttaattttctctcataggaaagataaaatgtgaaccttatgggaaggcacttctttagaaagccccccttttttaagttttctagcggataagaaatatcctatagatgtttaactgacttacccacactaataaaaatcttcttttgagaaattcacttaaaagaatagaattagctttctttcaagttggtaaatagtcttcttgcaaagagtacttttgtcaatgtaagagaattttagaattcatggtgaaaaataatctataataaaaggattcatggtgaaagatatctataataaaagacatggtggtgatagtgaggagctacaagaaaaagttcagtatgactagagtcctcaaagctcaaatgctgagacaggagagaggcaaggacaactgtgcgcaagattaaaccacaaataaaaaggatgcggccgtcgtaatcttcttattggcaccactctccgaccatcccac

SEQ ID NO: 7194 - DNA, 216 bp, Homo sapiens
accaccctacattttattcctcacccacgcgcataatcgacgtcgggaattggcgcggttcttttgccccaacacgcgcgcctgcccgtttaaatctgccaccctcctcaggggtttcgaccccaccccgtttgcagcttagcccgcgagttctcttctcatttccccccgcctccaaatgcctcgccctcccgtcgtgtgaaatactcgcaacgt

SEQ ID NO: 7195 - DNA, 851 bp, Homo sapiens
tttcgcgtaaatacatttaccccatgcaaagacccgcttcaataaacgtaacgtttaagaggacgcaacctattcggcaacgcaaaggaacgatgaccccgtcgaggccatcatcaccacaccttttgggacatagtaagagttcttctctgctttatccccccccttcatgtagttaaatatcagtttgcctcctactccaccctggttctcccccgaatttcactatctgggaattcccacagtacttggcttcacaaggccagggcttgagcgaaaagtgtctcccttacctctctgatatgcaggtttaccattccctccagtgttttccaggtggggggtggcatttctacccattccgtccatatatgtagacataccctagagtctgtctcatccatccctctctttcaaacagtcatagatactcttcaagattttatctccaacattcctcaaattagccccttccttctgatctccacccccagctcaggcacttacattctcccactttgaacccgaaaccctcctaattggttactttgccttcaccattaccattctccaattcccttccactctgcagccagattggcctttaccacccaactctatgttatatttctgattaaaattcctcactacctataattgtttacagaataaagaacaaaagttgccttagtggggctggcagtagagcacagacactaagaatatgaagactggagcccaattctcttttggggtttaagtttcaagctcatcgcatgtgacttttggaaaattccttaatatcagtgtgacttagttacattctgtatgtaataaagagagatccgccg

SEQ ID NO: 7196 - DNA, 1544 bp, Homo sapiens
  misc_feature (1)...(1544): n = A,T,C or G
gatatcctctcctattactagcgtaagtatcgcgcgccgccgccgattcggcccgcggagagcgcacaccctctcccggttccccacccggtttattatgtatattatctncaccgagcatttataatctcccgctgccccgctaccgtctaaatantaatataatgacggccggttccgcgcgtcgtataggcatcgcaggtatatcttatatttgactgttggacgggaggatacagtagaccgtgtggggttctaatgagtagacgacgcatggtgctgagtttgaataatcgtgattatattcgagttgcgtcgtcgagccaagangatacatgcanactgattgattaactgtatgttggtaaactggtctcgtagcaatatgctctttgcatgccatgatcacacacattggtgattttatacgcatcgcgccgatcgacgactacccggatatgtntagtacgcacgcagctcgtagtcctcatcgtcaggcgggttaatgacacgcttagagncatttggctcaagatgagtacgaggagtacacancntgtcgacgctagtagagtactaataacctaccgggtcggtgtgctcatcagtgtagacancgctcngcgcccgttaggtgaagtcatcacctgtgtgtgattcgcgccaccacttgtcaccagcgcattgaccgacgcggtggagtctgggttcagcgcatacctccgatgntcgcaccgacgtcgcgcaacacgttgtatgccactataaggtgaggcccgtcaactcatctgccctacccacctcggtgacccgcgtggacattgttatgatatgataccgactccttccgcagtctattcgtgcgccatacatatggtatccacacctctgcgtgctatgtgtagtaatcgcctcgtacgcatactcgattcataatggtgagcagcagaagacgccgccacacagcgtgatgagttagtgacagtaggacattgcacgcagtcgtatgctgctgctcctacactcagtagggtgtactagccgtcgtgcctgtggtgtccacacgaaggtgacaccgtgtgtgcgtactacgtatccgccagacgatgagtccgtggatgcgatgatatagcagcgcatcgcatctcgcttacaccgcacgtatggttcgacacaccggcgtgtgcagatcttgtctcgcacacgcaagtacctcagtactcgngctcgcagtaacatacgcacgcgatgtcgtccactatcatactcaccagttagttagtctncagctatatctcgcactggcgcaccagcgtctntacgatacgatacggtagtagctcggatgctctctcgtcaccacacgctgtctctaactcttgtgtagtgtatacgtgcacctagctgtatgtctagaccacacgggacacgtgtgtgtggtcataccacacgtaatancagctaatactgtgtagcntcgcgaggctcgatatgagaanttgcgctcancgtcctcgcacgcacttgcgacgactatatcgtat

SEQ ID NO: 7197 - DNA, 1187 bp, Homo sapiens
  misc_feature (1)...(1187): n = A,T,C or G
gttccattgctggtcccctctttttcttttccgcctttcttacgctttctcacccttttttccctcctctgctttccaccctcctccattctcttctccctctgctctgggtttggccccctgtactcttctgtctcttgtcgccccttgctccaccccattgttccttctcccccccactcctactcattttgcatccctgcccccttcggacgctgcatgctggtagtacattggccccatcctcttcgcccctcttcccctctcttcccctgggcatgggtgatgataggggtctttccaccatttacttgtgtgtgttatctacctcttccctgtctctctctctctcccttcctgtgcctgcgtccccaccaccacgcctaccctcttgtgcctccctctttgtactcctgtacactctcccggcactcctacaacccctctgcctggatctcctgtcattcatctcctctttcctcgttctcctctcttctctcttgccctctccccgtggctccgtgcgcacttctcactatctctggcgcgccatgcttgtggtcttcctcncttgttcccctcccttctgtctcggtagtgtccttctcctactgtgtctccctcacactgtcctttctcatctccttgttgcatttgtgtctcatctcactatctctctttctctgctctctccgtctgcttgtgtccgcattctgttagtcgttcttattctacattctcctcttcggttcgcgtatcttcttatctttttgtttctttcttcccctctcaccgcctccacctaacattcctttcgtctcctcttccccatgctggcgtctccctctttcttcttgctgtgcttcctcttcctttctcctcctttcttcttttctcttacgcatttcctcctcgtcccccgtcccgtattctctctcactgccacgtgcctcttctccttctttttactcgtctctctcctcgtctgtcactacagtcacgccgctggtgctctatttccgttgtgtggtttggtgccttacacacccgcgtctgtgtgtgtgttgctttctttgctctcttattagtttcttttccgtgtctctctcttctcttctctctctcctctgctcttagtgtggtgttctataccccatacctttttctcgcttcaacctcgtgcttcg

SEQ ID NO: 7198 - DNA, 1200 bp, Homo sapiens
  misc_feature (1)...(1200): n = A,T,C or G
tccgcgcttatccccatttaccgtgtatgtcatacagacccagaggacctaagttgtgcacnaatccgtaaaaccttccnagggatacagcagtatgacaggaggcgcccgcgaggacagcgcccgaaaaatattatgccgaacagtattattacacaggatcagcctcaatacaatgacacgcttgactcgatcgcatccacgtgtgattataaaagctactgggtcgttaaaaggttgaccgaaacctagagcagccacagcggggtctcgagcgcaccccaaaagacacacaatactctcgcacgtattgtggtaagcgtgggagcgccgcgagtgcgcttgttttttcgttcgatattgacaccgccctcgacgtgcgcagattaaccacattatatagtccgcgcgtgagtgtcggccgctctgttgggcgcccgctgcggtcgctgattaaatagatatgtatgatgcagctcggtgtctagttactgcaactatttccgagacagactagcgaagacgaccggcctgctccatctatcatatttttccgtgaagttagcgtcgaccgaaatgcatgacacacgagtatataccagtgtgtccccaccctctcatccccctcatatttatcatatcaccaacgacatggtgttcgccgtattgcgagctctgagcgtcggacgctaacagagaaacggactatactatacancgtaatagatggacatacgagcacaatctaaataccgttatgtgaccgcgatactgcgcgcgacgacgtccatctatcaagtgtcggccgagatatctaactaaccgggtagctctcgcttatatgacgggtgatcgccgcatagagacggttaggatcaancacacaagttcgtgacgtgaatctcctaagctacactatgcatcgagccgnattatatactcagatctgctagtgactgagtcgatgataatacagtgttgcaacgagattactcgcataagtcgacgnancaccagagaaggaagtataatgtctccgccagactctgaatcatatctgacgtgtagtataatggacgtggatgtactgtggatgtatacgaccccttgtctggatacgcttgatcatatatacaacatataaatagtcaacacgagtagcgatcgaaagtacgtagcgacggantagatggagagtcg

SEQ ID NO: 7199 - DNA, 1310 bp, Homo sapiens
  misc_feature (1)...(1310): n = A,T,C or G
cgactacgcccatccctttcctcatcacttgcttcacccccagcccacacccaccgaggagcaaccggggcgccgcgcacggcgcgttttttttttttttggtgctgcgactggaccaacggaggccgcacgaacgtcgcatgttgctaactctacaccatccgcgtatttagatactcaagcctggtgcggcgtgaatcctcgctcgtgtactgccctgcggtgtcgtatactatggctagagagcatctcaggtacctgaggactatcaacccccatccacccgaatgatattcttagcgatacgagcgcacatcgcgacgcccgggtatagtacccaccggcctcgagttttctcccacccgtacgagactcacacactcctcgtacttagcgccgcgctccggctagcgctagctatgtgatagtagtcacgacgcggtggtctgagtggataatcaatatatctttacgagcagcgcatgtttatccacatcaatagagccagctccgtccatacgcagtacacccgataagatgataatagtacacactgtcggcgatcagttggcgtccggaagcgtagctacgacgaatgagcgcgcgacgagcactgtccatcttcattctactagtaatctcgaacgaacggactaagcgagtggacatgtagatagaacaagcagcgccacacctcaaccagagctgaccacacggcaatgagtgagtagttgttgtgtgacgctctgcgcaagtantgctagacggagagattcgttacgcgacacngcgccaatcagttcgaccgtgccacttacacatagacactctacacatctgcaatacctcatagagcacacttactccgtaaacagaatgttaatcatcgtcacgtgctncgcccgcgtccctcacgccgctcgcaatacgagtcgcaccgcgacatcgtaccgatcatcacatcaacaatcgcgggagcggcaacgcaggacgcagatcacgcggcgaacacgcagacattcgctcactatcgcgtgattgcgacgccgcgctangcgacgcactactcgtacgtacaccgcatcacgtggcgtcctcctcagtctgacttactgtcactcgataatacgaccggtgcgtcaagagcgtacacggacgcacacatcacacggatagaagccagagcgcgtgaggcgtcacactcaccacacntgtgcgctnctagaggaacgcgcagtgactacacgcgagtgtactcgnctcacgagaacgtaacgctcgagtgagagatacgtgatcggtcactcatg

SEQ ID NO: 7200 - DNA, 212 bp, Homo sapiens
tgaaggataaaattgtaatatcatgagttataagaggaaacgcaaacacatgctatcatccagtgaagctcaattcaatcatctacagtgttcatgcatcaaatcctctgagaagatagtgctctacttgcaaggctgaggtgagaggatcatttgaacccaggaacttgaggctgccatgagctttgatcatgcctttggcttcagccaag

SEQ ID NO: 7201 - DNA, 355 bp, Homo sapiens
tcttactctagtactatatacagcggcgagaaagacaacgcgagaaagaatttgaccaaaaaatatttataagagaaaggggagaaatacaagaggagacatacgaaacaattatgtgcaaaagaagtatacacggcgagtcgctacccgataatgccgtagtgcactaaaaatatagctacaaattcccgtaaactttgttaatggactagaacgacagtgcacatactgccctctaggaggacgacaaccaacaaggagaggggtcaacctttgcccacaaagaaactaattaatacgcgagaacccgaagttaaccggactcagggttgttaaccaaaaaaccaccaaacgc

SEQ ID NO: 7202 - DNA, 927 bp, Homo sapiens
cggccacgctgccgcgcaccagagacaagacgaacagcaaacagcctcatcgacacgcgactcgcaccacgccgcaaccgcccaacctacaggcaccggaacccatatacaccctctagtaggcaaacaaaacgcagtcggcgcacaacacgaaaaaacatacgcagagcgaccaatcgcagagaactacgaggtctgaacgtaggccgcactccacagcccccacatactccactgtcgacagtggaagaccgacgcccgacacccactaccacacagacacactcacggattattacccaagaaaaaacgcaaacagctccgtaacgacagctacccacacccgccacgacgcttgagcgtgagacaatcccgtactaaaaaaagccataactcacccccccactttcaagcgacgccctatagaatcttcccaacacataacccacacgaaaagaccaacccagtgacgtcggtaaacaacacgaccaccgaatcaagtcgcgcaactaaaatatgccgaagtaccaaatagtagctcacaactattagaagaaaagccaaaacacatcaccacctatcctacagcgactccacgacaatgactgcacctggacaacgcgagtggcagtggaaaaaagcgtgaaaaccgcgcgcctagtcttggccccttactcggaactcaacaccatgcaggcctttaccccagcctaagaagaagctaacactgcaatcaaggcggcaggatttccgctccctcgctttccctctcttttgactacatattttatttcagcccaagtggtcaattatttattcggaggggaggtgggagaaagtcaggagaactcagcccttgggaataatagaatcaaagaagatgcgtccagcctctttgcctccttccccgaatacgcccggtgtgaa

SEQ ID NO: 7203 - DNA, 517 bp, Homo sapiens
cgccaacttacaccccaaatatcccacatacccaccaacctacttcaggctccgttgtgccgtatctaaccacagtcttatatccctactccctcacgacaacatcattccacttacccgataattaattaagaccatcacaacgcctatcaacaaaagactaaaggatcgccatcatataccgtccatcatatagaacagcggatttatgccggatatacccccccgcctgcgtaactcgcgaaatgttaggctaatatctatgcgtcgagcaacggtagtcataagatcatcgctaataagggaatcctctagaaaatccatctaaagtgagcttcaatacaacatacaaacagggaagacacaaagcagcttgtggttaaagcgttatttaagatctaaaataaaaaacctcccacatatatttttaggatcccaatggaagatatcaaagggtggtaaacccaaatatttaattggctatagagccctaatcccagcaatatagtaaagacac

SEQ ID NO: 7204 - DNA, 469 bp, Homo sapiens
ttttatgtttcttttgaatttttaatttgaaatatacattttatacatcaaagagattcaatattctttttctaaagtaaagtattttcatttcattaattaaataacattttagaattcttatttgaaacctggacatcatgttttatattttatgctttcttttttcccatctgtacctacagtgtgtgactaaacatgcattcattatcacataacttataccagggaaaggtcataatgaaggtgtctcagcattgccgtatggttaaattgaccccattgtcattccatgctcataagtgtccaataaattgccatatttagaaatatgtagagaaagagtactcaattgtgttggcatcttcacagctgctctacttctttttggcagattcactgcctcttcgccaagtcacaatgagacagattcaagagcatataatggtataatatcttcattatctag

SEQ ID NO: 7205 - DNA, 1252 bp, Homo sapiens
  misc_feature (1)...(1252): n = A,T,C or G
attggtttgttgagcacttaaccaacataaactaatcatagaagatgataagacgccccgcgctttaagcgtgcnaacgcaccgctgtattaaacatttcccactcggctgcctagcgagcgctgcctactgttcacgtgaattcacgtgtataagatctaaggtcggaatgtttatagattattgtcgagaattgcgtcgcatcgtattgtcatgcgctcggaggcacgcgattatatatcttataaataacattgcccagatgtctcaatgaggttaaggagtcttgctgtcttttactctgacctatgatcgagttttacaattacttcccgtcgctatggaagcgtcttgattattataacacgtctccggtgtattgataacgtggaattgctcgggatttcgctgtgaatatcaccacagcatgacctcgagtttataatgtcgtatcaatgcaattcagccgatcctcccccccctccccctacttcctcctcttaatttaaattaacgctgtcgcctcttttaattttatcagttgccgcgcatgccttacgtttaattcgctgcgcttacacccgccccgtctataattataagtcgacccccgtcgaccactaaagcgattacaacattcgcgcgcgccgtcgagtatttccgtgtcgcaccccgagtttatccccacgctccgacgtccttattataccccccccattcccgcggacaggtaccccagtcacctctgcgcgtcactttaatatatctcgcgcatatcttgccccgctgctcctttctatttggtcccacgtcctctctttccatttttccggcagatttatgtgcggcgacgtcacatcatgcgctgcgatttataacttagccgcctccccgaccgatagcctatctctattaacgcgttggcgcctacgtcgcgatctacatctatctttatttgtatagcaaacacatcgccagctcctcccatgattgtcactcagcgtcatgtatccgatgcctatcatgtctcaccatagacagtagcgaacgcacttgatattcgtaattggagtatatcgtccatcgatcctctgataatatctntatagctctctacagaatcaatcatcgacctgtatcactctatatcaaacactcnagatattatagcgtagactactaatctagtgtagtcatctgtctnttagactcgtaacatccgcgccctcgtcgtatgtcagcgcgcccatag

SEQ ID NO: 7206 - DNA, 1718 bp, Homo sapiens
  misc_feature (1)...(1718): n = A,T,C or G
ctgagttgataaattacgtagcagatgtgcagnacgctatagactatgtgcatgtcatatttacatgagcagcaagacatcctacgtcgtgcaggcgactaccagtgatcgcttaggccgagtccagtggaccgttcngctctggtatgtatgagacantatgttgactgtngttgtacgactcaatagccctctgctgtgtgcgtcgttgagcgatcgcttctgtgtgtcactcgctaataatgcatgactgtgtgtcgcatatgtcgctcagtctaatactgtctctctggatgtgtgccgctgcgagtgcgttgcgcttgtatattgcgagctgatcacagatagcgcctgcttcacgcaatacnatacgatctagagacggcagtgtggagntacttatatctagtattagagctggtcggtatcgtgcgttgcaccgactgtctcgacgcgtgatctcaggattgcccttnatatcgtatgcgagcataagtcacgatgcacggtacgtctattcactgtgctagtcgtacctgtgttggctgttgcntctctcatattctggttcgtatcgacaactacatcattgacgagcgtagacacaggacgtgaggcaagcaccctggaattaacgagtagagattcattgggcgagcgatgagtgcatgatacagaatagcgctgtgtgtaggcgaacggacgaaggatgatcattccatgccgctgagttgatgcgctagtggccgcgccgttgatacgttgatgtagccagtgatgtagctacagcacccgctcgcgcgatttgctacacgtcacagagcagagcgcacatgagagctcagatgactcgcgtgcgtacantccgctcgtcgccgtcagattcgcacactgtctacgtgctagcgctcgtgatgtactaattatgtgttgtgctcctacnctcttactatatatcgatcagattccgtactgtcgatcgtgtactgcgtgatgggtcgtcgcacgctcgagcagactgagcgctagcgatcgagncgaggatgtnaagcgtgtgcgacgcagagttntgtcagtgcccagtagtgagtgagcgacgacgatgtgatantgagatacgtgtagtcgtatacgctaaagactctgacgctgctcacgcatnagttgacgctcntgatgacgacacctctgacgtgttgcacactnanatatacagcgttacacatatngtatgagcanagtaggcacgtgtatgtgtctgaggatanaggtagagactacacatgatcgncaagnactatatctgatgtctcgatgagtcnctcgcgctagnatgtctgagantacgagtatgagtgaggtatgtatcgagcngangagagagcgcgacgagtctaaacgctgatccatntagtntgaatgtgcgnantcagagnggagtangnagcgtgtattcttagtgcagctgtaagctngttacgtgcnctagctgcacantgtcgactctgtgacgtgntgtctgagtgaggcgatcttatagtgtgctgactcgtgtagtagtcngnattgtnggagagtngtctcggtgcgagtcncgtgcgcgacanantgncntagagagcgantagtgtgagtggnacgtcnctgcactagcncgtacgtcatcgtagcgtntgtgtganattatcattagtatgtatgctacagagcgctcatcg

SEQ ID NO: 7207 - DNA, 760 bp, Homo sapiens
taccaatcattgcacatttgtaataaaataacgtcattcagatatcttgtctaacacgaaacaacgcacatattattgtaaaaatatggcctgcaatgactacaacaaacaagggaaatgttatctacatacttctactgggaaagaagcgcgttatgcaatggctggccatacaatcaggagaaataaagggttataagagtagaaggggtatatgcatagataacgagaatgttatagataatatacacatcatgatccgctagacaatggcctactatagaaaggccacttcgggtgtgagccaattgcacccagcctaaaagtcattataatttgtcagatatgtatactgttttagagagacagaggctatcttttcattttcaaggactcctgaacaatcatccatgagttcttgaagttgaataacaggaaactgtacttgttcttcaaaccatttggctactgtaagaagctgctggtcacaaaacgcacgtccaataaactgcagtcctattggcaacccttggtttgagagtgcaacagggatactcactgctggcaatcctgccatatttacagcttgtgtaaaaatatcatcctgggcacttcgggttctgttgtcctctttgatgaactccaagtatggtactgcctcactcaaggtggtgggggttagcaagacatctactccagagttaaaagcatttacaaagtcattagcaatgaggcgtctcactttcagtgctttacaaaa

SEQ ID NO: 7208 - DNA, 777 bp, Homo sapiens
  misc_feature (1)...(777): n = A,T,C or G
tggagcgccataggtgtttggtgctacttgttttccgcctgcatgacattctattgatttcgtatcttttttattcttttggggagctcatggccgcggctatatctttctagtacgtgttagataaatattagccgctcgcgcgcgtgtcggctcttgtattgaaatagctgagtgccttttattgtatgtgcgcttgtgaggcgccgatatcgttatattatctcttatcgtcaggccccgcgtttaatatatttaatttctcgcttcacatcgtgtattgctttctctcgttcgcgctgcgcgcatcttttttatgttccgtctactacattgcgcacgttcgccctctttgttttgcttcgttcttttcccgttatcgtcgttttcggagttaatgcggcgattttctcctgtcttctttcctactcttttagtgaatagagagagcgttcttattttaataattattttgacgaaggcagtgtgctgagggttntattcttcccgctcccctcattancgattgttgcgcctccgcttagcttcactgatattattttattatagtctcaccgtgtccctattatttatccgtgatcatcagctgttctatatggcatagtttgacgcagctaataattgcatgtttatccctattctcttttttgcttgctagagtatgttattttcctatttggtgtagtagtatggtaatgggtcggtattcttttgttttaatataccggttggtactacttatattcattcgggaga

SEQ ID NO: 7209 - DNA, 1154 bp, Homo sapiens
  misc_feature (1)...(1154): n = A,T,C or G
ctattctgtgtatagtattatcactcgtattaccttccgaccctggagggtgggattatacgagatacaaccctcgctcactgtataatacctctgcaggaatctttatgctagatggacactcattttgtctctctgtaattggctgaggataggatcatagaataaaagagggcgtggcccctggataaataaaaaaaatacatgggattcgtcgactcgtgaatatagctctcccaaaacgctggggctgctgggggacccattatttatatagagccgccgtgagcgttggggccttttctccgtctttaatggagtggggcgccacattaattcgggcggtttcgcttcaacttggcgtcgctgttggaggctgaccggtcactgcggaggatgcaagtcgacttcttcgctaatcgtacagtccagttcgaagacgctgggcaaattgactcttatgtgctctaaaagaatgactggtgaatcatagcgcgcgccgtgaacggttatggatgatcggtgccagctctaactaccacgtgacgtctggtcagaccgaggccgagtgcgggcgtgtactagtagccgctttcagcggcgatgcatcactgccagacgccgaccacaatatgttctnttctatatgacgtcctcgccgtggcgcgcgcgccagagatgcaatgaagagaccagctatctgtgagcaaatgtgtatgagcggcgtgacgtgtggcgcttagattggttagtggcggggatggtgtgccgacgcctgagtgctgtggatagcatgagcatcgaggtggagtagatgatgcccgctcgcgtcngcgcccggattgtgcaggagttgatattcgcntattcgatcgatacgatctatcgtattgtcgccgcagttactcgataggacggatgcgtncgtagtgagatgtgcgatgtggtaagatgtactcgcctcgcggtacgagactacgacgacgactagcccgagtagcgcgcaggcgcgcgcgaggacgagtagcacggtggtgccgttggatacaggtgatataggtacagtatgaagtcgctcgtacgaattatgtattctacacaagacggtcttatgtgcgattggcacgatctgtgatgagtgtgtaggcagtant

SEQ ID NO: 7210 - DNA, 776 bp, Homo sapiens; identical to SEQ ID NO: 4172

SEQ ID NO: 7211 - DNA, 601 bp, Homo sapiens
aaaaaaagaaaaaaaaaatcttattttttccttggccgccaaaaaggttccaactccacaaagggttttttaaaatcccgtggtgtgggaaaaacattatttttttattttgcaaagatctttttttttttcttgtaatacacccggcgtttaaattaattttattttgcggaattttccgcctctgaaaagaaagaatttggttgatagaagaaacacacgaccagcaattttgctttttttgctgtttaccaagaaccaaagatataagatgttatttattctgcgcccgcttcaccccctttctttttgtggggaggaaactttatttttcttcttctccttaccgaagggataaagtagtgagcgccagacgaatttttttcaccattttcggaggcgtttatatagagaacaaataagggcggtgcctttttgtttttttgagggaagtacgcaggtatattaatatacattgtatgctattacccgacagtaacaacgtttaaatcgatagtacgtgtaccttcgcattgccggtagattatgtaaattgaaatcacacgaacttacacacattgtatacagtagcgcgaggatg

SEQ ID NO: 7212 - DNA, 258 bp, Homo sapiens
  misc_feature (1)...(258): n = A,T,C or G
cacaacgatattgagcataaaacagagganccgtgaaaaaaagagaaggaagangacctgatnctggagacgactgtgcttaaattttttccaccgctgacagacataccttcgcccaagattatttagggaacatcagcactctttttttatggaaatatgggggtggcgggggctctcttaaaaagagaaaaaaaccccccggattctccccccatttttattaaagaaaaatttgggcctccaaaaaaaaaaaaa

SEQ ID NO: 7213 - DNA, 874 bp, Homo sapiens
  misc_feature (1)...(874): n = A,T,C or G
ttttcactggaacagttttgcagcaaaggtctttggtcccggttaaatccgggaggttttgttcctagcctcccctccgaggtaaacaattttatcttcaccttccggggatgtgattaaagggcaccccccaccccaggtcatctttttgttttaaataaaaaaaaggtttcgttaggtccccggctggcttgaaaatcctggcccaaggtgatattatgccttcgccttcaaaaagtgttaagttacaagtgtagcctttgcaccagccatcanccagtttttaaagggacaaaagccatttaaggagagttaggggggcttttcacccaaatgatatttgagcagttagatttagtgggcaaggtcaaagtggctaaaccttacatctaatacataatttaactcaaaatgaatcactggtttaaacatgaaaatgtaaaactattccacttaaagaaaatatctctgatatctaaaaatgggctaagaaatcttagtcctaacattgaaagtatgattcataaaaggaagtattcataaattgggctttataaaaattgaaaatattcaccatataatatacctgtttaggaaaagacaaactacaggttgaaagtaaatatttgcagacaaataatataatatctagaatacataaagaacacttaaatttaacatggataactgagaaaatttgagcaaaatttgttgattttattactgtcataattatggtcatgatagtgtataagtttgcccaggtgttaccactcggggaaatgctataaagtgtaaactacgtctctctatattcattcttacaactgcttgccaatctaaaattaatgcaaaataaatagcgatgcggccg

SEQ ID NO: 7214 - DNA, 776 bp, Homo sapiens
ataagaatggaaattagtttagtcatacaattattcaagtctttttcgtgtccaaaaggtaaaaaagaataaaatattcgacattcaaataagtttgggcttttggttttccaaacacaagtgtatttaaaatacactttgaattttaaaatttcattaggaaatactctaacattgatcagtttttgtccatgtggcaacccttactaaattcacctgtaaataaactctcatgaaacttactttcccattgtatagaattttaaaactgaaccgaatgtatgaacataagccctctttttacaaagctattagacaacaaaacaggactgtgatcctggaactcaaagaagcaaatcaagtgatcagcactctcaccctggcaaccttcttaggaacatttttccagaccgtggcttaggaaggtggaactcatgcagccagctgcagtcttgctgagctgaagaggcagagataacatgcaatcttgctgaagtagttagaatatgtgtggtggtgcatataagagaaagcgggcattaataggaggtatctccagaagagtgcttcaggattctccttggctctttggtaacgactcagctgtgcatgtcaaggacaaagccttacaggtctcacagggaatacttgatgcagccattgggatgatcaaaagtactgggattttgttgtgctggtatatgttggtgtttctcccaaaccagattgagaagatcgtgctgaggactacaagacttctagatgagagctctagg

SEQ ID NO: 7215 - DNA, 744 bp, Homo sapiens
  misc_feature (1)...(744): n = A,T,C or G
cgacctgatttccaatggctgagtggaggattccctgtgccagtaggcattggtgttgttatttctgctngaagaaaatatgaggcaaagagagtggattgcaaacacatcgaaacctctagatttggaggaatacacctcttgtcttgggacttcttatagaaaagctcggcgtgaaaaaatctttattaaatttaaaaaagggagtgggttatacctttttcgtgaaataagaaagggaaattccccccctttgtacctgggcgctttcattgatttaaacttttacctaaatctctgcccctcaaaatccgccctaataaaaaataatttcaccctctattatcccaccacctcttaaaccttttttttaacgtaaaattttttttttcactgccaccccatttttttctttttatagacatccgccgtcgctgcgacaattataccacccccaatgtattctctcctgtattttattttccttttttcccctaatattcacccacccgcccgccatatccgatatctccgtagtgctccctttatattcaaattcgttatcggatatacgcatgcgttcttcatggttgttagtcgttcgcccagcaatccaccataatccgtgtgttgatagcgcgtcgcgagccttctagatgacgtgaattttacgagcccccggctgacccagtgtggtgttcaccttatataaaccgtcatttgttcgtgtttgttccttttgtt

SEQ ID NO: 7216 - DNA, 1281 bp, Homo sapiens
  misc_feature (1)...(1281): n = A,T,C or G
ccgtcagtaactgaagcctttcacgcgtcacatacagcgccgtcggaccgtcaccgaatgtattgagtacgatgcacaggcatatgtacaactttgaacgcgagccaaaccgtctgcgcgccggcagtacaagagagaaagaaccatactaggagaagatagctcggtggtactgataatacgtgagtatttattaacacaatgcgggcggcgcggaggacggaggtaggcgaatgaagaaggtgcggtcataataggacctgagaggtgagaaagagaggtgtgactacgggagagataaagtaagtgataatagccgccacgatgagatctctaatatgaggagcacttcctcgatgcacggcgcgcagcgagtatctgatgactcgctacgaggtggatatcgagcctccgcccagtcctgcggaagaaatagagaaatacacttgagcggtaacggcgagatcgaacatgcgcacgccgccacggacagaattagacgaactttttttattatataccttagggaggcgaagaaggacaaaaacccccgcgtggcacaaccccctcgggccgggtgtttttgtatacgcccgccgacgcgctcgatgcgaattcgagtgagtcgcccatcangcatccggcaaatcaccacaatatataagccccggccccgccccaccccccagagtgcgcgcctgttattgcgtgcgatcaccacaacgccgcctataccgcacaagcgatatccatcgagccgccccgatcattaaccattcatctcccgcccgctataaatgatgcgacgggaaccgacatggcacggctatgattatgtcggcgcccttcccagcgctctccacactatattcccatatggcgcaacgaagcagctgtcgccgtctgcgnacacgtatgtcgcacccctcagacagatgtgactctggtgaaatatccacgctcgcacgtccgtcactgtcccatcangtacagtatatagtagcggagtgtcgctgcgccacctaccgntactgcgagcgcgagcgagtaagcgcgancgttgttatatatagacgacagatgcatcacgaccgtgtggcgacatgcgcattagtatcggatcacntatagagtagagtcatntatcatngtgcgcgcacntgcgtgctgttggctctaaggataacacatagtgcatacctatcgcgatgagttatacgctgcccacagcccagtgtgtatgcgatagacctctanttagcatgtacaatttgtagcacg

SEQ ID NO: 7217 - DNA, 878 bp, Homo sapiens
  misc_feature (1)...(878): n = A,T,C or G
gaacactagagcncnncnccnnnnnnngggnnnnnnnnnnnnnctagcggcaacgactctcttaaactccacggcgacacacggaagagcaaaaggcggggcacaaagggttggcttccnaagacgcttaaggcgccaccaccaaacanggangcccngcncaaagacacaaaccggcctcctgtcaggaaaacatggagaagagacttctcctatgggaaacgcagaaagcaaacacaggctggctatgagacgccgcacccacgggcaataaaacgcggggggggtggtgaaacggggaaggagggggcaaatctcgatgctcaacggagaagagcaggagaaaaagccccacatgcgcgcgaagcgcgtgccggcgcatcggccgcgcgataacgaaagaaagagaaagtggagagaatagacgggtaaacaacaacaagggcgagaaagtagggggatacgagtcagagcgaggagaacgcgacaggaaagcaggagagggcgcagcgcgagacgccaccccgacggtaagacggaaccgggggtagaggaggggaggggagcgcacgccagaccgcggcagccgggaccgcagacaaccgcgagccgcgagcgagagggaggcaaaaaagagaggggcgagcaaatgaacgagatgagagggcgaggagactcggccagggagggggcaatcgagtcgcgcggcggcgggcacagaaagagcggaagacaggacggcgcagataagaacgcgcggagagggggggcacgggagaagacgacgaatcgagaccggagggagcgcggaatgtgagacggtgcggcgacgagtagcgcaccggggggatacgcaacgacgcgggcgagtggagaag

SEQ ID NO: 7218 - DNA, 851 bp, Homo sapiens
  misc_feature (1)...(851): n = A,T,C or G
caggtcttaataggccaaagctgttttacatgctgggttagaagccctcatttgaatctagttctccgtcgccaacccgttggtaaaaagcaggtttaggatctttaaggaccccaggagtcgaggaagagacccaacaggttgggttgaaaagattaaattaaattcagttcaattcttcctattttgtaattaaaaagcaggtctaggatcttgtagcagcccagtgagttcagaagaaagcntagcagtgtggagttaaaagacttcagtttgaatttaggtctaccgctgactatgtctggactttacaggcaaactacttaagtaaagattcaaattccctgtctttaaaaggaagataataataatcacttggacgtcatgctgtaagtcatatgtgagatgatgtgtgtaagtgagacagacggtggctgtcgtcacctgctcaggccactagtgtctgagacagctgtgcaatgctcaccatctaaaagggaattgacagtatgtgccagagaagagtcagagacttctccaaagtgaactctgccctcctagggtgatgggagtctcttgccagcaactgtcagcacttgtggttgaggctcacctctcagcagaaagcctggctacaccagggcattggctatcgtctgtctgtcacccaagagcaagtgcctcaagctattttgagcacaggacgaaaagacccaccccaatgatgactccccgtacagaacagactcaatccagctgtgaaaggtatatgagaaaagctttgtttttagctggttctacagtacgaaaaacgctgcacgagatctaacaataaacccagatgcgggcca

SEQ ID NO: 7219 - DNA, 287 bp, Homo sapiens
aagtaatacaaacactacgacgttgagaaagacaataagtacgtgttggaaaatgaaagatttacctatgcctttgagtattgcatagatgaacgagaagttttaggccaaattgtataaaatgttcatatataactcggagtgtagttttattataaataacattgtcgagggagagaggtttttaattacgggggataaaggaaaatggaatcagaaaggtaagcagtaagatacgggagggtttaatatgtggctcgatgagataaaagtaaccagaaaacaat

SEQ ID NO: 7220 - DNA, 878 bp, Homo sapiens
  misc_feature (1)...(878): n = A,T,C or G
aggtttacaccgggaaattgccctctagggaatacccacgcgatgggtcaggtgattccccaaaaaggaagggccttttgactccacaaccccacaagtcctgaaaaagactcccaagttcctgatttctaatggtaagatcaaagatgggaacactcaggcatcaacgggctccaccttagaatgcatcctaacccattggagtgaatttacccccgaacccttgaaaaaaagcagctttttttntttgcgctatggccctgccccaataatctctatctgatggggaaaaaggccacctaaggatcgaggccatcaagctacaaatggtcttacaaatggaatcccaaatgagctcaactcccaacttctactgaggaaccctgaactgacccactgggcctttgactggcctagagagttccccactggaggacactacaacagcagggccccttcttcacacccatccagcaggaagtagctagagtggtcatcgcccagttcccaacagcagttgaagtgccctgtttagaggggacagtgagaggtgaggccagctggacttcctgggtccagtggggacttggggaactttcctgtcttacaagaagattgtaaaacacaccaatcagcgctctgtaaaacgcacgaatcagtgctctataaaacgcaccaatcggcaggattctaaaagtagccaatcgtggggaggattgaaaaaagggtattctgataggacagaaatggaacatgggagaggacaataagggaataaaagctggtcaccccagccagcagtggcaacccactcaggtccccttccatgctgtggaagctttgtcctttcgctcttcacaataaacctcgatcggccg

SEQ ID NO: 7221 - DNA, 603 bp, Homo sapiens
gcggggtggactggcccgtatgggtgactcatctctagggggttcacacctctaaacttatgaaatgcttctcccatcaggtaagaaccaatgggccaaaactttatgaacttcggataggagtgtggcacccccaaaacccaggtcagcacattggcttgggagaaaacatttggtcctggggtcttttgggccaaaaaaaggtgggccactctgggagacatggtgaagaacatcgggtttttatgtcgtgaagggggcaagttttggcggccggaaatctatattccagatgtggttaatgtccattgtaccccgttttaccgcccgtagagggggaattttcggtggatcgctctgtccgacgtacaagttggggaggggattgtagagagttgggcgacgcgaactgagaggaaggtggtaaccgttgtggcggaaaaaacacagaatatgtgggggtttgtgagcaggagtccctctgcggctgagagagagtcgcctgatcccgctcaggttagcaccgaaactcaggcgcttttcggatgaactacgaagatgtaatccacgcctgtggtcatatgctagtgataggagtggagg

SEQ ID NO: 7222 - DNA, 2157 bp, Homo sapiens
  misc_feature (1)...(2157): n = A,T,C or G
tctactcagtactatcatcatgcgaatatatatgatagaatgacgtcccagacagttcacgatcgcccgcagagttacgactgatntgacgtcgcctacatcaacttaagatnattagatancggcgaacaatagcgcgccgagattagagntcgctatattatcgncgatatcggactgtattactagtatatattactcgccganctaatatatatagtgaatgtacactgtcgcgccanctctgtatcactgtatagtgtgattcgatatcatnctctgatcacggagaatngttgttactatcagacgcgctatgactcagcgcgngatantgtatagcgccagtagtagactggtgttnatactgactntcgtngccngcgagtgatcagcgtactgtgagtgactgcatgagagatgactgaatgacgcgacggnatatgtatatgngaatgatagacatgtcncgatagtatagctacacgactgcgcgntagtatgtctcactatatntagtatgatgagtatatagtgatatactagcatcagagnacagnagagtgttctgattttttgtttttattatnttgtatgattatatcgatcagcgtgatatcgncggtantgnatatagcacgtcatgacgcgattggtgtgactaatgtgcagcggcgcgcgatcgacnctggcgtcattcgtatatatgtatagtctgangatcncgcgcncgancgagcactgagccgacgtgtatatacactacaatgtatgtagaagatcgacaatggagtgcagcaggcaagncacagcgaatttaagatgtagtgatctgcatgtactantgatngtgatgatcagccgcangcagcagataantacagatcgnatacgcntganttatngcgccgaccatctagatgctgcgacggnaangagcgcgcgacgctgtgtgagtagtagntgatgngcatgcagnatatcgatanatgatgctgcgcgcgcgtcggncgttgtcagctgtcacgaccgtcgcgntcatgtnagtatgacatgatngcataatntntatcgcgacgctcacncgntcgacgcgcgacgagtagtcatgtctatatctacagcaganatcatanatganatactactatcgcaccncccggtccntagcagtttgatnatgccnngcggcgctgntatcaatgnattagagcgactgtgatctgcncgtgtgcgctggtcgtagcgtagtagnatcgntntaatcgacggtacgcagagtactcatantcnactagcgttagcntgacgtcgagtagtatatgtgtaggcgcgactgatatgctatacatctgcgagtgtagtaatataacgacacgcgacnangtaacgacgcgacggctgtcgagtatgtaagtggatagagcatatntaaatataattntatagtactatcgcgatcgtgacagcgcgcgtgcgtatgtatctgtatgaagttatgnattagatgatatatcgtattcaacgaacacggacggcacgcgctatcgcgcncaggagatgagtaatcgtcatgagagcatatatagcttggngatctnagcganccacgcacgcatgtatgtgtaagctgtatcagtagtatatgccgcagcgtaatagtttcagtntacacngagttactgacagtcatgacgtgcactgatatntangaacgcngcgttantatcggtgcatagatgatagatagccgaganagtgctagtatatgattatgtgacacagcgctcgcancgaatcagtctatattgcgcgangtnacatatacgcgatanggacgggcgcagcgacgcagcgtagtnatctagtatcgatcggtatagtgagtcaganatgcgcggtatagatgtagntggncgtatgagngtcagttgtgacacatgtgaatcaaataataatnattgcgatagcgcgatcatcagattggtaccgntcgatatgccgcgcgtgtngncaggctgcgtatagtcgcgtggntagntgtagataattagatatatagtacgngtgacgactacggacgcatctctcggattaggatgctatcgacaantcgantatantgancgaatcatgcgantcgctatcgntactcat

SEQ ID NO: 7223 - DNA, 893 bp, Homo sapiens
  misc_feature (1)...(893): n = A,T,C or G
gtcgccaccccgggtgtggttttccgggttatgaaaacacccccacaaccccaccgaaaaaagccaccgtcattctacacgtacattaagatacttaagacgaccgggtataaatatcgcattggtctctagatacggagtgttaagagtcagacgtggtgacacacctatcgtagccgcgaggaggggggcgaataccggagtagacaggaggaacgagtggtaacaaccacgcgcggagaagcgttatcaagtcatcagatattgcgtacgacggagaatgtaatctcgaattgacagggtacgagntcgtgtcggcccgcgatggctaaggaccgtagcatacactactaacgctacagcgcgaagatggaacatctgcagcgtagtatgacatagcttatagtgaatcgacgactggtaaggtagagatgagcgacagcggaatgcggtgaagaataccccagaacattatatcacgagacgactgcagagcaatagtggcgtagtaaacacctagatgatactgcgaagccgagcgcgaccgcgaacaacgactatcaacgtcacaacaccgctgaatggtaatatgcgaaagcgtccgaagccgcgagaaagggacagcgatacgtacaaggctatagtnatggcaacaacctagcgcagtcatctcactcagacgaaggtggcgcgcgcggcgtgttgtttggaattatcacgccaagtacggacgaagttcgcgagcgaccgacatacaggccgcgtgcgacgggacgagccgccgactggccgagtgtcgcataaatagtacaaatatagaaggttagacggacgcgctacgacacgcccacgtgggtatataaccagcagtattcgcatcgaacgataattat

SEQ ID NO: 7224 - DNA, 798 bp, Homo sapiens
ggaaatggcccgaaggaataattatcttaaggtgttcacactctaagcttataaatgcttctccaatcagtaaggaccaatggccaagacctttatcaacttctgataggagtttgcagcccccaaaacccagctcagcacactccctgcagagaaaacatctgcacctgggcttcttggcccagaaaaagttgcgcaactctgtgaacatgctgaagaccaccgagttttatgctttaaatggtgaagtttctggtgcgtgaatgatatctcaaagatgtttagaagtcaattaataagttatcaccgaccgtaaaaggagaaattgcttgtgatcatcttctctaattaccaatttccatgttctctataatatatatgggccacgaattgaaagattgttccaactttttcttgaaaaaccaaagaaaatgcagagtttgtgcagaggtaatatgtcggtaagaagatagattaacatccgctgagtagaaagcaattaagtatatatatcaataatccgaaatgttaatgcaactttgtgtctattatattttaaattccaaacaatgtaaatatgctgtttcttacaatgacaaaagtaaacattttcaaatgggaaaaaaatcaaagggccggctaaggctgcagcagcctgttgagttccacggagtgacttctttctcactcacaattgtgcctccggtgcctggcacagtgttgggcacaagtacatgctcgaataatgataataatgataataagcaataaagataataataaacaatgatcggccag

SEQ ID NO: 7225 - DNA, 838 bp, Homo sapiens
cttgatataacttgcaccgactgatgtagttttatcacgtggagtgaggcaccacccgcatcccaaaactccctctcgaactactccatgataattcacgtcttctcttggcccaactccctgagtaagccttactcatccggtgaaaaggcagaagtggcacattactttatatttgaggcaccaaggccaacatagcaaggcctttttaccctttgatgaagtaaaagcaccccccagaagcccattggatctttcggactccccagccatgaacgacatgatgttcgatgatgagaaccagctacaataaataatcccaatatgccattctcaaatggaaagaaagcagttatttatgtactagaggtacacacctgataaacaattgtgatcagccccccagttgattatttctacatttttaaatttttaataagacatatttttttcctgctcctctcttctttccctgtttctcctgtaaccagctctttctctaaaagtatcagatagtaataagagttccaactgtaattcagaactttagataaggaaattaattactgaagaatctactcaaatgggtcccaccacttcatttcaagctttggaaagaaatactcaaaagactatggagaaactgtgtaagaattttactctaaagattaactgcctaaacttcactgattctggatatcttaaatcaatttttgagataatttagagatttagggataaatcaaatcattttaaagaataatgtgaattacataatacacaaattttgaatatgtaaatgaacattctttctttttgggaaaagttaacgcataaa

SEQ ID NO: 7226 - DNA, 1370 bp, Homo sapiens
  misc_feature (1)...(1370): n = A,T,C or G
caaggtaatagtcatatatcatcgtcagacgtgcccgtaggaggcttaataggaaaccatggaagtgatggtttccttccgtcacaccatatatcatccgccataccttagtaaatagtcaaaactccccatggaagaaaggcgcgagacatgggatacagagagaaatagcacggtgtttgccgccgcccgtactcccgcctctcaggatacgcgtcgtatacgtgtagtagtccgtacggcgtagaataaatcaacgaggattatagaatgaganacactcgaggagttagtcgttggaggattgtatcatagatcacaatcgacagcgtacgtgtgttaaatatacatcgtcgggggagaggaggactgcactcttgcgatctacggtccgatacgagacagtgaagataactcgttcgtcagctcgcgatgcggtcttacgccctcgcacgtatgcaatcgctatccccgcagctatctatataacttacgtccgtatagaacttataacgtgcacgtagtatgcggtcacacagtaattggaggaaggcgcgctatgttgcttaatatatagtngacgggaatcacacatattatattgcgccgcaccacaccacctttccaacgttcgataactagtcggatatcatccgatgcgaaattatatagtgctctcgtctacgcgctccactcacaccgttccaccaagatattcgctattatatttaatagattaggatgacgcaacgtgtatgaccacataagttacaccgtagtcttgatattactgtgtccgccgtcgcacatcgtatgcgtgacgcatcacgccgcggacgtgataattataagntgctcgacacagctcctcacagacctcccntatatattttatcgacctcctactctccactnctcatncactctatattatcagatatattcttcatcctgtattcaagtaccgcgcacgagatgaganatcgtangcngcaacgcgctctcatattgatatagacgaatggatctctctgcgcacacgtccatatatnctagtaagcgatgntatgtgtatatatatatagcgcattagtcgtccagctcatcatcttgcctctgacgctgtacgtattcccnaggcgttaaatatgagatagctgactgatcattccacgcacgncagtccatgtcgacgtagtatagctgctncatcatatcgtacgacagtgctttgantaatcgccgctcgcactcaccatgttagcccccgagtgagcgcgctatcagatcctcacgccgagttnatgtcagtcgatctcagcgagatatacacgacctttctcactctcgattatcgtatgagtatcgcg

SEQ ID NO: 7227 - DNA, 1277 bp, Homo sapiens
  misc_feature (1)...(1277): n = A,T,C or G
ggttacgcggagccgcggatagttagtgtgagcggcgcgccgcgcgcccgagagcgtgggacgcaccgtacttagttctgtggcgatcgtactgcgggtcgagtattttccgctcatttgagagcgtatcgtcggagtcttgatgaggccgaccgcatagtctcaggatgattgggaaagagatacatcaggaccgcattgacgtggcacgcataacattaaaacgatggagcggagtggcgcactatcccgagtgaggcgcagtgtgacgtgtggggcaggggtggagtggcatgcgaagtgcgcgagacgcacaacaaatagtaattttttttttattatattcgcgcccgccgatgaatcagccgcgtaatgaggaggacgccgcgggaggcagatcatatatattcgcgccgcccaatcctcgcgcgtctatctacaggagtccgcgtatcgacgcgggggcgatgcaacgcgctgtatacagaccgcgagagtgtattacgagggtcgcgcacagcgcgcaggtagcgcagggagagagtttagtgttgtggcggggggagcgggacgcgattttggagcgatatgcggcggcccgcgtgtaaggccgtagagaatgctgcgatttgttaaaaccgcggctaaactcgcgggggagcgcgcacgaatggtagcactgatgtatatgagaggccgatagcgcagtattatagggaataatacaccgcgacgccggcgcgcattatccgcgtttataatatattatcgtacaacgccgtctcggtttgaacgcgatattaatagcaacgccgcgcgcgcccgcgcccacggacgagatatacgacgcataggacgcggtagtgcacaacgccgagtgttacgtactgagagacgcgcgcgtttagaagacgcgttgtatgtcgcgtcgctgtgagatagacgccgccgatatactacgatgtgtggacgatgtgacgcgattcagctaggcgcgcgcgcgcgccgcagtatgatacagaagggacgctccggagcgccgatggcagcaanagtatagtcatctgntcgtaacgattagcggcgatatacggagcgagatccggcgagcagtggggatgtatagagtatcacgaagcacgtgacagaatatgctaacgtgcgctgctncgcccgcatatgcgcgttaatgtatgagaagattagggagacacgactagagtatcatgaatgacatccacagggaggtgatatccgagtgaactcgctcgctacct

SEQ ID NO: 7228 - DNA, 765 bp, Homo sapiens
aaacatgtgcagccaggaagacaatttgaaagaatggaaagaatcttaaggcgaaattgttcaaaattaaatgctgatggttgctatacctccaaaccattgtacttcagctgagaacctgcaccatggatctggccagaaatgagaacggctgtaaagtggttcctaggaaacttctcacagccttcctgagactgaagagcatgtgcactgcccattttagagatggttgactatactctatctcttactggagctccttacacaacaggattccacacagggctcagaatcattgcctatcagaagctctaaataaaacattccaacaccaaattaccaaacattcaatggttatccatggagtgcaacttaccacacaagtttagcatcctgcccaaccacattaatgacttgaatttgggagtagcccacttttcttagactttgaactggaaatgtctttaaacttggggtgttaccttggaaatttaggggggtgcgaatacttacttaaagggagtgtggggattgggaagtggattttcttgggaagatgaacaaaatttgtgatcgctttggagttgccatccaatggggagggaaggcccacgacgcacgtgagagggcgccgcgtagagtggcttgaaggggtgtgagacgtgtcggcaaagagtcgtcgcgtggggacgcagtctatgccatttgacactaccagcttcggcgtagggggtgtggatcgggcgctatgcgcagaatatcacg

SEQ ID NO: 7229 - DNA, 1347 bp, Homo sapiens
  misc_feature (1)...(1347): n = A,T,C or G
acacaagacgtacacaacaaacaaataaaagatgaacaaagaaaaagccccttaatatagagaccctgacgtatttagatttttaaaagtacgacaaaacgagacatttaattccacgatactataggcaagatcatcataacgatattttactaataagggggaggagagtgcgcacataaaataaccaacataaataaatcaccctcacagtcccgacgtcatatagtaatctcatttcaagtggagatgtaaaacccgcatcacgatactaacacgtatatcattaccctcttacactcacagtagttaataaatcagtaagaaaaagtataagatacatcacacactcatatttttatacgagggaggggaggatccctcatcgccgcagatgtagtctatataataactataatgaaggataccgcgaataatcttgcatagcacctgtgtaatataatccagatcccctgacagcataaatttttaagataacgtattatcatcatttaataccctgtcaaccctcttatacgattacaacatatcctgcacactctgatatcacaaactacacatagatcacgcgcctcatccacacgtacccatacacagcacatatatatacccgatgtactcacttccacctatatcaacgcctcataagtccgaaccacacacccnccactctcactccacatattgctccgacatacatatttgtactctctatctcccgacacatcgcgcactcagcgcaatgcattatgtatttgatgccgcccccgctatatattacagttacatatatccgatcctactagtatattgctgcatagactcatacagatctcgtacactaccataatatttgtattacgccatatgaccgagtcacatgcnnccatcatagtcacgacttatgatantcatcaccatgcccatttcacctcgtgccagantctatatagcacgatcggnatacgtatacatatatctgtggtatgattatcaccncatngctcgcagtacgtatgaccatgacaatattatagtatagttgcctatagatgcacagcncatgcgactatattaacacagtattcataaacgcganacatagttatattcatcgcctctctgctacctactcatactacgtgataactatatatcacacagcataaacagacactgaancatcacgcagtatccgcgacgagattaacacggatggacagtgaatgcatcgatgtgactcnatgcacctctgattatatccntcgancaagtgatataatacttacttatancactaatagagtagagcgtataagacacaat

SEQ ID NO: 7230 - DNA, 555 bp, Homo sapiens
acaaagtctcgctctgtcacccaggctggagtgcaatggcatgatctcggctcactgcaacctctgcctcctggttcaagcaattctcctgcatcagcctcctgagtagctgggattacaaaaactcacgacctgctcatgtaaacaaaaccttaataacattttgatttcttaaggtttatgttcattgttgcttaagtctcaatagtgaggaagcgcagtaaataatttattagtataaccctcacttgcaataaattattatgaacccccgttcttatagtttaagattggtgcccacgcgacatttctgtaatttaggtcgcccgctctttgatgagtttttgtcgcaatatatttttgattttacgataagggtgtctggcctcagttttaagagggcgccgtttgatgtggtagctcgcggcgtgttttggtttcgacgatagatacgagtgccggccgagatatttttagtttgcgtgttcgcatcccgtgcggtggcagtgtttaatgtgtgtctagtgattccatatgggagtcctacccgcccca

SEQ ID NO: 7231 - DNA, 906 bp, Homo sapiens
  misc_feature (1)...(906): n = A,T,C or G
ttaatagtataattttatatatataagtgagataatgattaataattggagtattgtgttatataagagttaatattttaagaatatgtaggtgaaatcggtgatgggaagggggagagatgggtggtgtgttgtgtttgtggtgatgttggtttgtggttgaggagtgtagtgagagatgttatgtaagtatatgaggaagggagttggagtgtataataagttggtattggtatgaagggaaagaaatgagggtgggaggaaaagagtggttttttggggtaaaggggggttgataaatatagttggagtggatgtatgggtttttgaagaaggggtgttgagttaaaatgggaggggatattttataaaatggatgtttaaattaaatttataaaaaagttgggaaagtggggggatgaaagttatttttatggggtaggaagtgtaatttgaagagggattaaaaagagatttttttatgaaaaaaaattttgtaaaaaaagggggggtaaagaaatatttgtgaggttttggnaaaaaaaagtttttgtttgaaagggggaatgttttttttattttagttaaaatttaaaaagaaattttaaaagattgtgggggttgaaagaaaatttnntttttatttttagtaagaataagtatgtgtggagccaccgcattaaagagatgttgggttgggaattttatgtaaagtatatatgtaattttagtttgtagataagtaaatatgtttatatatgcagtaagaggagtttttgaaaagaaaataaaaaaaaaaggtaggggttttgtttttttttttttgtgtggagctaagagagttaattttttagtgttataagaaaatatgaaaaaaaataagaataaaaaaagggaaattaaaaa

SEQ ID NO: 7232 - DNA, 926 bp, Homo sapiens
  misc_feature (1)...(926): n = A,T,C or G
atctgcttgctgttcttggtgtctgtcggctttggtggttgtttgtgcggtgccgcgtggcggtgtcgtggcgggcgcgggctgcgcccgttgcgggggttctggtgtgttctcgttttgtggggttgttgcgctcgcctcgtgggttggggggcgctggggtcgctccggcgcggtgtggggcgtgcgggggttctgggtgtgcggtggtgccggtcgctgctcgctcggctctgggctctcggctcgcggcgggggagcttgttcctccgcttctccgccccccccccggcctgtcgcgccttgtatctctcgcctgtgcgcgctttcccctggtcccgctgcttgcttcccgggtggtgttggtcgtgggtggggtggtgtggtcggtgtgtcggccggggcgcgtgcggttggcgggtgggggtgtggctggtgttgtggcgtgtgcgcgctgtcttcgctgtccgccgccggccgccgcgcgtgctccttttcgcgtcgggtgcgctttgttcgggtggggggcggttgggcctgtttcggtctcctcgccctgtctcccctcccgtcttgcctggggtcgcccccgcgcgcgcccgggccggcgggccccgtgcgggcgttcgaagaagtctgtttccctctcgcgggcggggttttgttgtggggggattggtcctcgagtcggcgggggcctgcgccccgttgggcttgtgcgggggtgtgtgtctccgcccttcggggtggccttgggcttttgtcgttgttgtgcgctgctggggcgtcgcccttggggcgcttagcgggtggcgcccggctgtgggtgttacccctcaaagcccttaccttcgtagccggccaannntttttttttttttttttctcttcccccaccccnnacacntacnccncctctcttaccc

SEQ ID NO: 7233 - DNA, 865 bp, Homo sapiens
  misc_feature (1)...(865): n = A,T,C or G
gaattaaatgacagaattattcgttgtaaagatgacaagttgaggtccttctattaataagtagtaattgaataaaagacattttttactgttggtaggggggggggtggctcgcatttgattcttcatatcgtgtcgtagagaagatggaaaggaaaacatatatatacgaatgtcgatgaaggagtagagattgtgcggcttagaaaatgaagaagtgaattaaatttaggaagggttgacagataactgacaatcaagtttaatgcgggaaacaggagtatgttacgaaataaagaaagagtaatagggggaaaagagtgaaaagggggggacaaaagagcaaaggataaaaaataaaaatataattttgttatagggtgggggggagaaaaaagaaaagggagaagaggtggtggtttggttgttgagagtctttaggtaatttaaaattaaagaaaatcgaaaaggggtggggttaaggtaaattgaggaaataatgaaaagggtgnaaaaagttctttagaagcaatgtggaaaaaataaagggggggataataagggaatttttttgggaatagagggtttatttaaaggttaaattgttaanggagcaacgcgcttttgaaaaaaaaagttttggaatttaaggtggagtgaattcttttaatttaaccacccgctacagggtaaacacctcgaataatttgggataatttgactaggcaccatttatgattcaccagttattgtgggttggaaatggaagaaagaatntattttggggtgttcccttgtttgcaagaattatttcnttctgaatttatggggcttggtcttcaagttgggatttgccgaagttgat

SEQ ID NO: 7234 - DNA, 1305 bp, Homo sapiens
  misc_feature (1)...(1305): n = A,T,C or G
gtacctatatgatcacactctataactgttcaactcagcgtgnnggtgcgttctgtctcactntccgctcagnagangnacaggagacaggtttgctgnaaggctgagccagagaacgcagactatcattnnctctgtatattgtactatatataaacncnagaacatcaccatctcgcatanaccctgtttcgtccttatcttcttctgtgtgtctatacnccacgctttncgtgtcctagtattttataaaataatatnactgtggtgtggtctgtggcgcgccagtaataatattatatctatcctgcgctcatatctacaatagacgattacntctcacagccgtatcttattttttatgatttatccctgtggttctactaattatttagttttgtcttctctttatattatcactaatcgagatgtatataattaacatataatcacgcaccgcccctcctccacaccgtatagattagaattatcatcatgctatccctactacaccatactctctatattctccctcctcctnacgcagaggaggaggagggtctttacatccgcctaatcaagatttctagatactactatatataatattacaacacctgttatttcacgcccctccacttttgacttactccacaccctcccctctaacaaccatccttgcataccatatttccaccataagtacgcccatccccgcgcacccgatcagcaccacctcatcataaacatgctaacacttataccatacataatttcccccccactcccaccctacacctcctctatacgtattctctcttccccatattttaccagtataatctactctacgctaacactctattaatacgccattatatattcatgatcaccctacccacccccataacccactaatatattagtacaccccccacacacaatacgcaccctctcaccatcgatataagattatttatcacacatccccgtttcccccctctatattcgcgccactcacctcacactttattcaatttacttttctcctttccgcccaatcaactaccccccaccttaataattcgaatataccgccctccctttcacttccaccgaagattattcccatatcccccccatcccaccatccattacaaccctacttttattttccccgccctcctcatccctatctatatactccagagttacttcacatctttccctccgtcgcatacccatatccctctctcttccccatctctaacgctccatactaccattcgtatccttctaatcact

SEQ ID NO: 7235 - DNA, 1319 bp, Homo sapiens
  misc_feature (1)...(1319): n = A,T,C or G
gtcgttgttcctgcttgaaggagagataggagacgggtgaagcccgncacatttaagctgttatgcagcgtgctcgtacgctaactttcacatagcccccacgcacgtctcgacgaaccatattccaattccgacatacccgaaggatggcgccaaaagaccgcggatgcgtgcgcgagagagcgacaaacgggctcgcgagtaggcggcgctgaagaccagaggggatagttagacagtatgtattcgcgcgccagtatagttccgcgagagatgagttcagattaccagagacngcatgacgccggtatgcttcgatgcgtcaagccgcccgctgatccacgatgtgacggtccatgatcagcgtagntaagtggaatgtgtaaggcgcagngaagagtatgcgacagactntgcaccagcngcggagggtggacaagcaaccgtcaccagtgacagcgttacgcgacccgtgcagtgagattacgcccgcgccgcacagcgatgattctgtggtgttagattcaggctcgcgctgctgcacatcatcgcgcgcgtgtggcgagcaccactgctcgcggcaccgcgagcagacgaactagttgatatgacggcggaacggtgcgcgtcacaacacctgatgcgatcttgcaaatcagcgacccgcgagcgtcacaagcacactcatatggtatcacgtgcgtcacgtaccgcccgttccggcggcgcgttgttcttttattcgtttgtgattcgagtagttgtgcgtgcgacaacggtgtgagcgttattgtaggcgttcgcgctatcgcaggagcgcgtcacttggattataatcatcgattcgacgcagtaggaggccggcattgtcggcgctaagcagagagaatccgtagtgcgcgttgccgttcgccgaacttcgccttagataagtgatactgctaatgtatcggcgcgccgcgcttcgatctgtagtgcgcctcgcatagcagtgtatactcacgtcgctcacaccacgacatagcgttcatacatccgcacgcagcgcttatggtgccccgccaccgcccgcagatattcgtcctctccgcgtaccgatagatgtaaagatgaccagactctgcccgcgcccgtcgtcgctgcgcnagattagtcgacactggatgatatcgagagccgtgccgtcgcacaagtgatacgagccgacctagcgatatcgtagatgacaggcgacgagctgtctttnantgattttcggtgctcgcgcgtacgctgatatctacgagcccaactgcaagtcagccactcctgtgtcaggt

SEQ ID NO: 7236 - DNA, 442 bp, Homo sapiens
tttttttttttttttttttttttttttttttttttttttttttttttttttttttttttttttttaatttccaatcttggagacagcttttaatcagtgcgaggcgcagagaagataaaaagagggtgatcggtttcacagggtgagatgctctgtattttttctgtcacgtaacactgggagtgccgcagggtttactgtcttttttaggaagaacgctcagaactaggtagagaacttggggtcggatggtggcgggcggcgcagaccggctgagccggggaggtggttctccaggatggggaccgaggttctgcagcgccccctgctgccggcgagaggcccaccgcccgaggccgagacctccgggatgacccctgcatccccaggatcgcgcgctgctccgcgcgcgcagagtctgcgcctggtcaggctggaccag

SEQ ID NO: 7237 - DNA, 1227 bp, Homo sapiens
  misc_feature (1)...(1227): n = A,T,C or G
aggacggaaatgaacgacgcgagcaggacgacgggcgcgaacccctctatggataacgaacaggcaggggcgctttcagcccggggtgacctcggggagcggaaacaatgagagagaatgcagttcgctacgatgcgatgttcggtgcacgcagtgagctaatgtattacaatatattggttgtagtgccgacgcgcagatcagagcgcaaggacgtaacaactgtgtgttaacctcagaccaccgggattgttcgacaccgatccacacgaccgcgtcaacccgcgggagcatgcacccgcacagaccgcgctagtcgcgggagagggaggaggaacggcgccatcccgcgtgtgtactgtacacaagaanacgagatcaacactcgcgaacactgngtgcaagtagtgaaactgacggcaagagcgaggaggaccggtgagaccacaactggcgagatggtgtgtagcgcgagaacgacgcgcctcggggcgaagaaattagaagcacacggnacgtgacgctagccgctacccacctcttgagaaccgacacgacatgtcaatctagacactgttaaggaagatacatataccctcatgtaccatcccgcattgccatgagtgtagattacgggcatcgtgcggaagagcgacaactgaggtgctgagtcaggcattactacctctccttcgtgcgtggtgtgaccgtaatgcaaagtctcttgctctgtagcgcatggcgacggcggctactcatggatcaatacaccacatgtactctcgccgataagttgacgtatgcactcactttcgtcgcgtggcagacggggacaatcagaggcggactacgtagtgagtacagaacatggctattgagtatggaccacacttatgtgtgacgccattcccgtggagaggtaattacgatgaatatacgacagcatccgctgtcatgaacgcgtagtacgtgcgttaagttgcagacgatcatcaacgctaatgcgaaatcacgcatcttgagactgacgcgtctgcnggcagccgagtacggcggaccgcaactctcacatcgcaagagcgctatgtatctcgatgctctactattacactagtatcggctcgctagaggagatactcgagtgatacgtgagtgtgatttattcttcacatcactgcctgctagatacagaagcgctacacggtctcgtgtgcgtcgatcccgcct

SEQ ID NO: 7238 - DNA, 1084 bp, Homo sapiens
  misc_feature (1)...(1084): n = A,T,C or G
aaaannnnnnnnnnnnnnnnnnnnnnnncccccttccccttnnnnnnnccaannnnnnnntnnanantccnnnnnnnnnnnnannannnntcnttnnnangattatcaaaatattctaccanacccccttacccataanattatatacatatttaataaataatatatnatatttaaattctttatttagtaaaggatcgcagaggtgtacaggaggctaagtggaaagaagaccaagcaagcttgtcactttacaacacatgtagcgcgctctagtggtggtgctgccgccgtcggtcttttgacttctcccgcatccgggcacggctcgcgccgcgcactcgcccaccactcatccgccccacaactaccgcgacacagcaccccccgtcttttttttgaggcgaacaccccagcaagaggtctcattaagagtgttagatatggttaaagtagtattgnacgggagacaaaccgagacagcagacagcacgagaaggattaagtcagtgctatactcggcgatagtgtggatccgtccccagcagctcgccgccgccgccggctgcgccatgccctcgtccggcgtgctcattacacacacgtcacactacgacgggtgtcgtggtgcgcgtctctacactaccaacttgatgcctcctaccggtcctactaccgatcgtccctctattcttctccgatgctgcaccgccgccacggcacagcgcggcgcgcgatttacgtattcgtgcggtgccacactgctggtgtctcgcctcaatcctatagccgtatgcagtatagctcccatgctctgtaccgccagtgctgcgctgcgtatagagatctgttacgcacgaccatgactgcgttcgagatctccatacgcgtatggtcgaaacgcccctcgccacaaagcgctcgcactacaccgtcaccgacgttattaatcgacntcacccgatcnccgcgatctcaactacctatacacantacatnatattatgatacctcaaatgagcacataggagcgatatntgctgcagaccgggcctctacgcctacagcagcgcgngcgtccact

SEQ ID NO: 7239 - DNA, 1050 bp, Homo sapiens
  misc_feature (1)...(1050): n = A,T,C or G
cgggtgaagtgggggaagaacggcggggtggaagaaggagagggggggactttagcgtgggagacgagtgtgctttaattatcgcacgcgggtacaacccccatagcctattagtagtatttgtggaagagataatacattttgacagctaatatagcctgtaggataagtatcggaagccccagtaagtagagtgaagatggtgtttggtagagggcagaaggtccgacaagactgaggagaggggaggctggaatggaagaatccgtggtcgagtaatcacaagaaagagaactgctatagggagaggcgtggactctagcgcatgagaggcgaggataaggaggagtgtttgtagggcggagaggacgaccaggagctcaaggtaacggcaagataaggtgcggatagagaacggacgaccgcggggtataaccgacaccgccgcggggaggaaaagtggcgactgtatgtttgcgcatgggggggggtggggtgggtacaaggagtagtcggaggtgtcccgcgaaatgccttaagtgaaggaacgccgccggccctgccaccgagcgtgcggtaataagagtgtaacgatggtgatggcacggctggaagcgccgccgccctcccacgtagggcgccgtanaatgggcgatgccgcgtgggccatagtcccgccgctattgtagccgcgcgcgaggtcgaacgaggcccggtagtggattaggcaccacgacctagcccgataatacgacgcgatcgcaggcggccaagtagcggtgtagctgagatcggtccggccagtggagagagagcgagatgaatgctacagaattttccggagccgatgaacgtcgtgggtggatatagtcctgtagcggccccaggggcggcggagcgatgcgacgtgtatgatgcagcgtaggatgcgagcaagagtagaaactcatggaagggggaagaatagccagcagagagagacagaataacgaaggtcaccggatgtaangatggctcgatagtagatctacggcgcgctcgataggtgcg

SEQ ID NO: 7240 - DNA, 979 bp, Homo sapiens
  misc_feature (1)...(979): n = A,T,C or G
gcgcggagaagaggggagcgtttagggagggaagagaggggggggctagtagatgaccgcgcgcggaancctccacgggtacaacccangctngngagnggnaaaangagacaagacagtggttcagacggaggaacagaagcccttgctcaagatagaagaaacagcccgcgtgaggggagcgtaaggaagactacgaggagaacacaccaggaagagaaagggccacaacaagactcttgcaacacccggggcgggccgcggcggaggaagaaccgcacggagacgcgcggcgggaaacattccctcacaacgaggggggggaaccacccgggggcacaagctttttttttcgaaagccgaagaaagcggacgggggcgagcggcagcgagcccctctctttagagaaaagaggggaagagagacgaccgtcgaaacgaacacccggacccaaggagcccagacgaggcagcaagagcagcgcgtaccagaagaggccgccgccacgcgacgacaaagcagacgtccgaaacgcgaacgcaaagagagagaaagccgcgcgccgcaaacccaaagagaacgcgcgaagaaatcggcgacggcgccgggacgaaagccccacgagaaaaacaccccgcccaacacgcacgccgcccacgcagtaagacaggacgcgaacgcacccccccaaaaaatgagcagaacacaaccgcccaaaacacgggagcgagcgaggcgaccggccgaacagacacagccaacaaagaggcaaaagaaagagcgccgccgagcaaggagaccggagagtggctcgcaccgccgcagcacacacccgcagaaaacgagacagaagcatcccgcccccgcgacgcgagacaaacagccgccgggaggaacaccaacccaccaacctcacaaagacaggggagaaaaccgtataaatcccaggccaggcgacgcgacacaaacgagagagca

SEQ ID NO: 7241 - DNA, 787 bp, Homo sapiens
aaacggtagaatgtagaggacgggcggcgggtgtgcggagtggtcggtctggggagggctagcggagagtgtcggcgggagatgaagggagggggtcggaacacaaatagaaggaggggggtaaattatgttgcgataggtttggcgatagacgagctgagaagggccggcagtgtcgggcagggcggggtggttgtagggacggggcggattaggggtgggaatcgtatgaagtggtcgagagggggacatggggggtgggtaacggtggtagatccagtgagtacggtggccaaaaaggcccataacagctagaatgaatagtgcagtcagaggtacagtcacaacagtcatgaaattcatctacacgttctctattatgccaccggcagatcagaaggaagaaagatccagcgatcaatttggtggaatacggtagtgcaggtgatggccagccaagcagttactgttgtccaaccccacagttttaccaaccacgcagggcttgtagttaatagccaaagtaacatgtttgtgaacgattcgagacagcgattacaacgcgctggtggaagcctgttgacaaaccttccactttctaatcagaataagtagctgtggtgaatactcagatttgaagaaagaaaaagcagactttagggtggaacaatcatgtcacctcgcgccaagaatggaaaaacaatactgagttaaattaagcaacattccttttccaagtgaaaggacgggtttttctctgccagcaataaaaccatgtatctgccag

SEQ ID NO: 7242 - DNA, 1093 bp, Homo sapiens
  misc_feature (1)...(1093): n = A,T,C or G
agtaacttatatctaggaatatactggatttcttattagcttggacacactcggagagatttatgtgcgttgtttacaataatatgtgcgtgttgtacaatgtatccgagactcatttaaagtatgtcggctccttgtgattgatcgtggatctccctcagacatactacaaccactactgacgcatgtatattgggtgataatataggacggtactagtcagaaggaagagtactggtcggacgagatggaagataatagagagaacatacagacggggtggacgaagctatcgatgtgatgtcacgtacgtgagttatcgctggcgtgactcacgtacgtgctcctgtggtagtccgattgnttgtggtgtgatcgccctgtggcgcggtcatatatgtgcctgtatgcgtgtacaaccttgagtggacttgggatactcctcggtacgtcttgttggccggatcatatttcaacagtgagcatcacccgcgactgtgctagatcttatagctatataaccacacacaaaacgaaaacaggagttaatgtgtggcaagaggtgtaagctgggtatgagcaattttttatcttcattcctgactacggtggccttttggctttgtccagtttgttttgtcgctcttgtccctctgccattcgatttcggtgatctaatatatattacatctttaacaattactctatgatnggctcttgctcgattatttgtgtttggantgtgtcattttgtcatcaatgtggatttcatcaggcaacgacggggagggccgtagcggtagagataacgcagggggcactcggcgggcgtagtattaataacaacggtggtcagtnggcattcattcagttattagtatgtgccatggcgccgctggtcggcagagggttgattttgtaatggactgtggcgtggcggcggtgctatcgttgtactgcatattggagatntacnggtgacgatccaatatatacacttagtnagcaacagacatagccgtacggnggcacagtttttaagnatacagacgcaaaagtgaaaagagagaatnnnncattgnnngagnnacac

SEQ ID NO: 7243 - DNA, 1144 bp, Homo sapiens
  misc_feature (1)...(1144): n = A,T,C or G
ctggtctgcagagttgcttctgctctgtcgatacgacactccactgttatcatcccttgacactggtccacagtctctcagcacatgttgattaatcgtcccgcctacgtacggataccagtcgcgcaaatgtacgcaccgcccgaccgcgctcgccaatctccacagccgattaatccccgcgagtaccatggcgacacgactgcgtacgagtccgtacgtgtatcggcaacgtgctgatgagcaatcgcaaggcaggcgactcgtagagcacacctaggcgtattgtagcgctctctgccattaatatcatacaaccggcacgtgtccgagagaaagagtttcgagcggtagcatgctcctgcgcgctgcgctcagcacgtgacttttgtatgttcacgtctcatgcgagtgcgctgaacgccgtcacggacctgcgtcatcggaccgctcactttcgacgctagcacattccaatcatgcgcccccgctccgtaattantcaccctatcgccctacagattataancgttgatctcttcacgaatgatgtatgtcctcgtccttcgcgtatggttacataaccactgtggcgagacgcggacatgacctaatacactagtcactgccgttcttttatatattcgcccccctccccatctacgcccgttactatacctaccagatcccccttaccccgcccccccctacaaccactatataagaaatcccacccctatgcgccgatctttatatccccccattaccgtctacccccttattatgttcgtgctcctcctctcctcccaatatattattgccagattaccattcctcccattaaacaccagtgcatcacgcgtcactcccgcccagtgacagtgagcagacatccagtatataacttaatttatcccctctgcctattcgtatcaactaatgtgtaattcgcgtgaacgacgcgccatttcgtaccctcgtctaatcctacacgtttttatataccacagcccctacccgctcatccgtgtatcccaccttcttatctactgctcatatcccctccagaatatatccaaattccttgttgaaacacagtgaatctatctcccataagcaaacaacgctaacacaccatattccg

SEQ ID NO: 7244 - DNA, 1264 bp, Homo sapiens
  misc_feature (1)...(1264): n = A,T,C or G
cgagcgctgtgtngtcncgctgcgtccggcgtgcatacatcgctcacactctacgagtcgtgcgcgcgcgaagnctcggacgngtgacactcacacggtcgtgctcggcgcgcgagtgacaatactcgtgtcgaacgcagcgctctgagccgtggctgctgcaccactaaccacgctcagcgtgcgcgctcgagcatntccgacctgcggtctacgtacgatgcatagnggttgagagcagcgacctgatctctacgtgcacgacgatcgctcagcgcgcgtgggtcgcactcanggaggtggcactatgtgtgttctatncgataacttgaagtggagcgcgggtatcatgtacatagcggcgacttggacgacgcgacagcatcgccatgcggtaatgtcggacaagtgccgtgatacaccggacacggcactcgccagaagacctgtcgtctgtacgacacatacttcacgngcagactaccccgcccggccgacggggccacgctagaggcgcccatcgacgcggagagagagtctcgcgtctcgcgccgtccggtgacgcgatgctgccatatctgtgttaccgcacggtcctgcgggcgtgtgtcatccatcgcaacgagccgttccaggtagggatagctccttaccgctcacgtgtggtcaacacctctacacgtgggtgaccctcccaaccgcggacgagcacgtgcgcgagaatccacacatagacaagctccgtgcgaggagggctgtgcggctgaactcttaatgtgagctagtcagctgagcgctacagtggccagctgatcacgccctccacacacatgcgtgcctgccagcgaacaggcacgatggccagcaccctggggcgctccacacgcccgaggagtctccactcacctctcacatatattcaagtgagttccccggccaacaatatcgccacagctgcggtcctgcatgccgcgtcgctcgcttacggcgtgtgtgtcaacaaggcaaacggcagatttgttcgcagcacgcactagctgcatacgtgacgtgctacgctcatcgaaatacttgattacagaaataaagatcgaacgaggcataagatccacggcagggcgcccgcacattacccaataggacacggccagcgctcctcgatagagacgactacgctcctctagacgtggcgatggcaatcatgntaccntgggtnncnnnnnnnnntactgaagtttaggaccatctacctaagaaagacagc

SEQ ID NO: 7245 - DNA, 616 bp, Homo sapiens
agggctcactccccgttcaagaaaaaacaaacgagcgggagggccttccatttgggcccagttcttggactattacccaagaaacccccggcttcccgggcgttcaaatttataaggagtagaccccgccccgctcgaagggggcggactccataatgtggtccctcccaccgtttcccgcctctactatgtggttgataagggggaacggggaactcatcgacctccccttttctatgtgtgcctgtgcccagaacaggatccccccactttatccgcaccactgtgcggtgttccctctgtgtagagagcacgtggcaccccctaatttgcgccccctcccttcccgataatccgccaccctctagcggtgcgcgggaatagtaattagggttgtgtgaaaagtggtagcccctcggcacccaaacgcttgtagggaggttgccggaaccccacacatggccaccgtagtttgcccgaagagggagggagcagacgcggaccagatgggatgtaggcgtgaataggagtgatatatcccaggaggagtagcgagggaccacgtactatagcggtggggagaacacggtatggccgccagtggttcctgtgctcg

SEQ ID NO: 7246 - DNA, 461 bp, Homo sapiens
ggggaccgcaaaatggtgcctgacatgtgattcggccgtttataagtatatttaaaggggccgggattcgtaaaacctaactgggtcgttcgcatcggacttaaaacatggtcaccattctgtactcggagacatgcggtggtaaccctatccgatagtgcccgataaacattgaagttaaaagatcatctgtaggtagaagcccccacttcacggagtaggtatctgagtttacttggtttcgtccaggggatattttcgactgcgaacgcattgtccgacgtcccacgtaatatcgggggaggatttttgactgtacaggagtgaccgcccgttcccccaataataaagggataatttcacgcgccggggaagagaaccacgtgattaagtctcaggccgggtgtttaattattttctatgactggtattcgcagccgcaatattgtgaggatacgttg

SEQ ID NO: 7247 - DNA, 581 bp, Homo sapiens
catgctgcagacgactctcttaattttccaccgctgcagatgttctccatcacatttaactttcaatgtgagtgctgctgtctgaggaagcaaagaaaagaaactctaagatgaatataatttgaatgtgtgaagggagaactcttggaagaagaaaagaacgttcttaactggtatacgttcttacaaggaaaggatctagtacatgacctgtcacacagctggatctcaagaatgtttgtgggggtgctgaaacaggcaaaaatgttgagagtcaagaaagagagaaaggaaagaggtcttaaaatgagccatcatgtacgagcagaatgcattccggggcaaaggggaaaatggaaaagttcagaaatccatctagaagaaataggatccgttggttgaatccatacatgcagaacccacagatatggaaagccaaatgtgtatccaggagtattatctgtatgggccattgaatacatagaacttaatgtgacttaaaacattatattataaattaatttagcatctaaatgtatgttaaattataagcggactcttattttttaaataaacctgga

SEQ ID NO: 7248 - DNA, 780 bp, Homo sapiens; identical to SEQ ID NO: 4073
  misc_feature (1)...(780): n = A,T,C or G

SEQ ID NO: 7249 - DNA, 833 bp, Homo sapiens
  misc_feature (1)...(833): n = A,T,C or G
atgtacatcctcacaacaacacttactgtctccatcagttaaagggctcgtgtggctctgggcatgctctatatccccaaagatcatatctataatttttcatccatatcagaatgttcacacaacccaacaggagctccaaggctgtagtgacacctgccaccatgcacagctaactgatccataaaggaagtgaccgaccagctggggaggtgaacagagatctctgggatactctcgaaaccaacaccacgtcatgtgtacatgctccgatggtcaaaagcgtgagcacttactaatagatcttgctctaccagaaccacatatctcaggaacagcactcattccttctgatacagggaaaaggcacaggctgatcagatgcctgatataatcctaaatgatgaccatgggaccgcanaattgaactcctgtataccttatgacactacaacaaatccattcagtagggcagtcttgacaggaacaaatatcaactcttgacccaatactatcaaaaaaccggggagtggacaaacccggtttatacaaccaagccacccagtgctatgctaaggccttgctgattggtacacaagttaaccaattcacaaaagggaacctcatggcaggcttggccaaaaatatgcttgtatactaaaatttggccgggggtattgttgcattccttgtggaacagggaacaaccccggttcccgcccaaaattgtttaaatgccttagaacgtgagtttgcttttgcaatgactaaccacattgaacccctggggtgagcaaaagaaattcctcgcatgaacatgaaattttttgacc

SEQ ID NO: 7250 - DNA, 808 bp, Homo sapiens
aggatgttgtctcttacacccaggttatttgttaaagtctttggatctatacttaactgatgacctagaagagcgattctcaaaagtgtgagtcctggaccagcagcaacagcatcaccgggaacttgttagaaatgcacattctcaggccactccctagacctactgaatcagaaaccctggggttggagctcagcaattaccctgcaggtaattctgatgcatgctcaagtttgagaaccactggcctagaagaaatgaactactgcaacttatgaggaatcatgagatccagctcacttttgctcaatacctatcaaaagcttgtcccagagtgattatggaggattgcatgcaggatacacacttcattaaatcctctaaaatctaactttgattaattaagtacagggttattgctgatagcctcataactctaccaccattataatggatctatataaaattgcttaatatcagtagcctaaatttaggagcactatagttttaaaaatacttaattggctactttatttaacaatgttttagggatgtcgttcagtatcttttccagtgtttgctacctaagatcccattggggtaaaaatataactcacatttcactgttaggaataggtctgtttgggagcaactaccttctttcatcttacacaatgaaacctggtattaaattatgaatttctcttcatacgagcttgtagaaagctcagctttaatttggcggtcacctttaccaatatatacaccttatgagtgacggtctggattcaaactttttctttgggtt

SEQ ID NO: 7251 - DNA, 1956 bp, Homo sapiens
  misc_feature (1)...(1956): n = A,T,C or G
catctcgncgtcatatccagtactagacgtgctgtccgacntagcgtgatgcgtangcnacaggacaggncgctgngcnnggtctagctactactagacgancaccgtcacnactagngagnnatgacnatcnaagaacaccatcacgntacgtnagtatcgaccaaatcagtagcatcgncgtaggntaacgacnctanccactatctcncagnacgacganctgtggacgcgagagagcgtacgcttcgangcgtagntctgtcatgatcagtcgtgantaggtacatgctgcgtgtgtgatacntgangangacagctacgcgcacagcncacacgacggatggancggtgtcgagccgacaccgctacatgctncgacacgatcaatacgtgcgtcatcatcgagagacananngcgcagcgacgtcgcgactnnanacctgctcgacggtgctagctgcntantcnactactcgtacnanacngactgcntatngntatatacgagnnanactngntcgtactgcacatgataagncatcagtgtgnangcagatgcnggancagcgatnangcgcagacgacgcgagcagtgcttgctgcgtngtccgngtcggacgacncggtcagtgnacaacatacgagtagtccgactgcgctgcgtgcgcacgtgtctataanacnntnaccagctacgctacgcatgcgatattctanagtgntggcggagntacgacacagacgcgcactcagcagcgngactgagcagtcgatcgagagagtataggcgactcagtcgtctacgcaatagcgcnggtcgtgagcgacgagtaganancgggtggcgtgcagacggtagnantnacnaaagtaggagacgcgcagcgcgacgctgagtgcggcgtctcgtgcgnagcgtgtgagagacnacgtgcgtagggcngcgagcgcgatgtgntntggtggcggtgggcggngcgcgcgtgtgcacgcagtaatcgacagtctggtcgagatgtacgagtgggacgatcgtgtgatgacgaggcgtggtgngangggtggcgtgtacagccacntgaacgctgagganagagctcgagacatgagcgccgatgnatgtgatgnagnaagacgatgtgngcgctatgcgtgtaggagaggtcagtgagagangacgcggancgcgagcgcgcatcagtgtntgtgnacagagtgatgatgtagagaaattagatacgagacagcataaatnatataacacacgagacatgacactcagagagagccaacatcgacaacacnagcgactcagctcacnacgacgacaganacacatatcacgatagagacagcattgtacgacacgcntatgtatagnatanatctttatcctcattacatatattatactatantnaacatatcatgtgtnagtancnacncacacccactcacaacacnaagtgatnatatttcgagacacacaccatacatcaccgagagcaccccacgagcagacatcacaacacttaaatatacataacacatattaaatgcaatctactnagactaaacataatactcacaactcacangaaatcatcagtagtgatatagattgtgatgaataatatatgttgtgtgcgatacgganangncgtatgtcgtcctcttcttntngccatattntcctgccttgtnctcttcctcctcctcttgcttccttnnnntcttccttcntttncttctccctccctctctccctcccnncaccgggcgcgctctnanccgcgttcaaaaacctctctctccttttctctgggtttctctttctcttttaanntcttctccctcnnccctcgcncctctgccncacgtccctctattntnattacagtccacccactancattnnnccacnccaacctctcnccatacaacaacacaaca

SEQ ID NO: 7252 - DNA, 798 bp, Homo sapiens
  misc_feature (1)...(798): n = A,T,C or G
tctcttttcctttctcggatgcagaaaaattgctaaccaagaagggttggggttagaagcacaaantaccattcacataagtcagtctataacatgatctgcaaagtttcaagttctgttccacaattttccagtgactctacaagcagcaaaatccataaacaaaaggtttgcactaaaaacataatcaccaataaatatgtgggggggtgaaaaaaaggggggtggaaaaaaaaaaaggaacggagagagaggcgtgaagaaaagaggtaggtgggccgggtggggcccgtttcctttagggggggggtatttaggtcccggggccaggggctctttggactgggacggtgggggatggggaggggtatttgctccctaagggggggtttccgggttttcagaaaagagggggatgaccccgagaaaacacttggggcaaaaggggcaggagaggggaaaacccgaaaagaggcgcgggggttggggtttttccatggggccggccccctagggggataaaaaaaattaacgctcaagtatagggtggggaacacgggcggggttttaatgatccgggtgggtccccggtgaagatcgagtggcccttctcttggccaacatttgctagagcggggaccttgtcgcttttctcgtttgggaaaggtggggtttttctagagggacacgggggggatgaaggggggggggggggggatgtctgaaaggggggcggggtggaaacccccaggaactagttggggggttattggggagtagggatgggggagaccgggg

SEQ ID NO: 7253 - DNA, 799 bp, Homo sapiens
  misc_feature (1)...(799): n = A,T,C or G
tcactgtcaggctgatgtccccggtgttggctgaacagttggggcagcgctatgctttgcatcattgcgccttagcagttgagatggaaaaagacttctctctcctggaccatcaatacaagtcttggcttcccttttaagagaccagctggagtcattcatctactcctaaactaatcagtgttactaatcactaattaaggaggcatgacacattgatttctgtatcaatcactgtgacaaagaggatgaaactgtatcaactgtcttaataaaaataaccaggtgtgtgtgggaatggtaccacccaaaccagagggctcctccccagtggtgggctggatgtttgggaggcaaccatgaggatcacctctcaaattctcattccatgtgttgggtactacatcgtatagcatccccccaaaaatcacatgtctataaatatgatcttatttggaaatagggtctttgtacatataatcaagttaaaatgaggttataatggattaggatgggccctaacccaatgactggtgtccttacaagaagaaggaaattggagacagacacacagagagaatgccatgtgacgatgganggcagagattgagtgatgcatctacaagccaggagcncaaggactgccggcaaccccgaggccaggagagagcacagaatggattctcccttggagctncagactgggaaggatacattttgaatgtttcacatccagtttgggggctaattttggagttggcggaatgacctgtgctacaccggggactggtcctgccag

SEQ ID NO: 7254 - DNA, 822 bp, Homo sapiens
  misc_feature (1)...(822): n = A,T,C or G
ttctaattaccaccgctacagtcctctagttccaccaaagatgaatcacagcaggaccaacctaggggcaggtaagcttcagtcccactatacttgaccggattacccacacaaagtgcagcaagaatcactgtcaatataagatctcctaaagtggctttgctggaacctctcacaaagaatctcagacttaacctccaatagccccttgagccaagccaagagaggcatctgcacttgcagatacctacatggatttggaaaatccctctcttcatgaggcctcagaacaacttgaagttcatgggcctgtcagaaagtggcactctaggccagcgcagtggctcacacctgaaatcccagcagtttgggagactgaggcgggcagatcacttgaggtcaggagtttaagaccagcctggccaacagggtaaaaccctgtctctaccaaaaatccaaaaaanaaaaaaacacaaaaaaaaaaatagctggggtgtggttgcacatgcctgtaatcccaactactcgggaggctgaggtaggagaatcacttgacccaggaggcaaaggttgcagtgaccccagatcacacccctgcaccccaacctgatggcagagggagactcctctcaaaagaaaaaaaaagagaaagaagtggacctttcttaccacaggccagaaccctttaaaggactgttaggcaaggtataagcatccctgtaaggattctattggctttataagatttctcaatcatttgctattttgaaactgcctttcctctaagccttgaaaataccacctctccactgtgccataaaa

SEQ ID NO: 7255 - DNA, 397 bp, Homo sapiens
  misc_feature (1)...(397): n = A,T,C or G
aatggatgctcaggagctggagacacatcttgctggtggcaggggagcgcgttggcaatgaatctgtatggaggattcancattgactcctcctttgttccctgatggagtctcactctattgcccaggctggagtgcaatggcgtgatctcagctcactgcaacctcggcctcccgggttcaagcgattcttcctcctctgcggggggaatagttgggaccacaggtgcgggccaccacacctggctaatttttgtatgtttagtacagacggggtttcaccatattggccaggctggtctcgaacttctgacctcatgatctgcccgcctcagcctctcagagtgctgggatgcacacggcctatgtaccacctcatactgataataaaagcaga

SEQ ID NO: 7256 - DNA, 356 bp, Homo sapiens
gaaagcactgggaatacaatgtgtaacccctaccctccaggagtattatcacagcctaaggggaagacaaacagtcttgatgtatcattacaaaagaaggagaaggtggtgatgaacttctgcccataaccatgtaagaatgtcatctgacctgctgcttcaaggctaagagagtgatagtgcctgtgccttctctgttatggcaatgaaaccatctgctctcttggttcccaggccttgccactggcttccctgttctcctgcttgcagacagcatatcacaggacttctcagattccataatctgtgaaccaatgtccataataaatcctctttcaggtataaaaaaaaaaaaa

SEQ ID NO: 7257 - DNA, 141 bp, Homo sapiens
ctaatgatgccccatcattagggtggggctgccctgtctgttgggcggtgacctcctgctttggtttctgctttttggcagaggctgcttttcctagattactgccaacatctgttcacttgcttctagaataaagcagga

SEQ ID NO: 7258 - DNA, 233 bp, Homo sapiens
  misc_feature (1)...(233): n = A,T,C or G
ccttgccccttcctgttagactttcttgttcttcctgcctggggtattgacaaagggctggagatggatctacaaggacaagaatgaggacaaatgccaacataccaagaatatcagagtggaaagacagaaataacctggcttctgaaggtactgttgaattcctataccaacctatcatctaataagaataaacacctgaagtatttaagccnnanagaaaaaaaaaaaaa

SEQ ID NO: 7259 - DNA, 833 bp, Homo sapiens
  misc_feature (1)...(833): n = A,T,C or G
ttactgcgtgacttttattaaccaccgtacagatgctggaccttgagtattacccaccggatcacactgggagggagcactggatgggtgaaaaaggaacatctcaaccaggagagaaggaactgagtcaagaaagggctgcatctggggaatatgtccctcccagtgatggaacccagggctgctgcagccaagagtctataacagtggagacgccttgagcaaagggggggggcccttgagctgcctgttccccctcctctgacatgatgggtaatctgatggaagcgctgagaggcactgcctanaattaagccctatgtgtaaaccaagcaaggaagaaagaacatgggctatcaaatatagatcatggttcaaatatatgggaaatatctaattctttgacactctggagaacctattctgataatggggttggttttggaaaggaggggatcttcagatataatacagaattgtataagctattggaccatttataaaaggcaaaagattgctagggggaaactggttaaacccaaccacgtggcaatttaagttaaccacatatttctttggttaagggggtgtaatggcaaattttacagaacaaaaaaaagggttggctaaataaggtgtgaaaactaagatgggttgtttatccccagtccctaaaccaagaaggatggagctggccgtagtcaatgtggggggagagattggagggtgttttaccggggagtatccatgggaaatccaggcccccgggggggttttgtgaactgtagcccatgggtttaaaaaactaagaaccagagattgtgagaagaaac

SEQ ID NO: 7260 - DNA, 377 bp, Homo sapiens
cagaaaaagagcccttgttaacttgcagtgttatcctttaggcttccaccccctcttgacagacataaatatagttacaacctctagattgaggaaggaggcgaaaccccgaagaggagctatgatagatgccaaccggtgcccactctgagaaaccctcacaaaacgctgtaactaagaacgaacctatataatggtccacggagccactacaggttttggaggttagaaaagagagaagactttggtagttagtgtaagaagaagaagtcgacagtgcgaggacagtgctgataggcgaggcgagagagaaacgtataagcccgcagcgagtagcagtcatacagagccgtagagatgaggtgtcggagagaagg

SEQ ID NO: 7261 - DNA, 841 bp, Homo sapiens
tctctaaataccaccgctacagtctgggcgccgtggctcatagcctgtaatcccatcactttaggaagtggggggggggcccaacatcaaactgaaacactaagcccctgataccagagatgtgtgttattgatagggagagaaatatagaatatgctgcgcccagtgccttccttgagaaggatagaacaagtctgcttatttcctgtgcaaaatgcttggtacggggggggcgcaatatgttatggggttccttctaataagaactgtgatggatggctgtctacccagtcgctaaggaggtgcggttgcggcttgtgttgcttactctggatttgtagatgaatttctcgtaatctgaggaagtaaggtggggggggccatggtttgtgccctgtggaagcgtggcttggggtgtcggggccctggggtgaccgtgaaggatgtcggaggaagggaggacaagagtccgcgtacaaaggcgcaaggcggggggtgctgccgtacctgagtgagtggtcgcaggagtggtcgagggaccgtagaccgagcgtgtatgtcgtgcgggcgcgggcgcgcgaggacgtgtcaggtgtgacgcggggtaacgtggtattgcgtaacggagggatggatggggatgatagagtggggaatgggcggggagggtcacttgtggaatgctgccggggcgcttagggcaggggggcgaggtcaggaagaggacgcccgatgcgtagtcgggcgtacgtggaactcggacgcatttttggccagagaggagtcggacagcgagttgggtgacagcaagcgagaaggagggtggtgaaggagagaaaag

SEQ ID NO: 7262 - DNA, 1128 bp, Homo sapiens
  misc_feature (1)...(1128): n = A,T,C or G
atgctggctctgcacgtcggtataggagtctatcgcacaccgcgctcgttcgcctcctnccgcgctggcccgtcccactctttctgccgactcgttcgtcacgtccgacacaccgctgatgatctcgtgtggggcgcgggcgagctgtctatgtgtgcagatcgtgacttagtctcttctgttctatcgttcgagagtcagtattgcgtgactggcatatgtttgctccgaggggctccgtggctcatgtcgtcggtcctactgtgatgtangatataagttttctatcttgtggccgtcctactaagctccttctccgtgctatgcgctcgtgtgccggtacgcggtgatcccatccgtgtgctgggggcgtgttcttatctatcgtcccgggctgcgttgactcgcaaatactgtcccgggtatatgctatacggctgcgggctcagaatccggcttctgaggacagaatacgtgttaggtcgtgagtgtgcaattacctactcctttgtcatcgctcttcctcttggcgcggtccttctatgcaatttatgtcggtatttcttccgtcgtgcccgtacttcctatcgagattctgtctacccgtcgctcttcgggtctctccattttgggtccatcgcgctctgctcacccctggtgctctcgctctgtcctgacacgtccatgaccgatcgctgcgggcgtggaggtgctgtacgtagacacgttgttcggctctgtacgcgttgtctcggtcccggtgtctctgtgtcccatatcgctcgatgtcataggtcgcgagcttatggagtcaatgcgcgatgcgtgttctcgtcgcgtcgtgtcattcgtgtcgagatctcttgactcatctccttatcttctctcttcctcggttctctcttttgtcgcgggtgtacatatcttgacaacgagtccttgttgcctcgtgaccgtggtgtatgtcgatcccctgttgggccatatataggatgttgtatgcttggacctcgttggtgtgtgtgttttatggtnaagcctatnctgaaaacctttctggctctgtgtctccccacttgaggnntgtgactcgtctgtcttctgttactatgtttgcgaatagggctc

SEQ ID NO: 7263 - DNA, 1271 bp, Homo sapiens
  misc_feature (1)...(1271): n = A,T,C or G
cgcgcgggtgcgtcggtaacgcgcttcgtgttgtgtctgtagcggcggggacagatgccgactctcctctgcacggtttcgcgtcctcccgcggggcagctgcgacggcgctacgcctacccgccaccgctctgactcggtcgccgtggcttccgtggcggatggttggcgatatcttgtcggtcgcctacactactcgtcagttatgttgtcgcctcgacgcctgtgtacggtgcgcggtctggaggcgctcttatgcatctcgtcgcctcggaccgcgcatggctgctcgcgcgccggcgatattggggtatctccttgtgccgtcgcgtccttagtcacgatatcttaccgtaatcacgctgggggtctgttcctcctgcctcgcgtcgcctctctcgccctttgtctctcctgctgcggccccgtcggctgagtttagctgtattatggccctccacgacgcttcttcgtttatttctctgttgtttgtcaccccttcctgtcgctcttctgtgtgtgctgcgttatattctccacacagtgcgtctctaggggtgtagttgttctcgctctcttgtgagcgtcaccacgtggtcttcgtctactcgcgggttagggtctgctagggctcatgatccgctcggacgctagtctctcgccacgactctgctcatatgctggccgtgngcgtcgtgcgcacgcgggcctgtcgcgattaaaacaatggttctgttgctggttgtcgcgcgcggcggtcgcgtgatgtatattgtcggtcgtactgcttgtacgcgcatgcgcgccattcagcagcggctcacgcggctcctctaggtcgattctcatctgccgcgatgtatcgtcgtctatttgcgagggtcgcctgcntncgtgtctctgctcgtcttcgtcctcacatctactggtccgctcagaggagcagcgtcggctgcagcgcgcgtatctcagtcgctgccacagccacactcgtcgttctagcgagatgatcgagcgatgctcagtgagactctggcgtntctcgatcatcgctgacgcanctcttctgcgctgatgagcgtgttttgctgacgtcncgctgntntctaaagaagtgtctgtggtatgtgtntngtagttatncgctgnntngcncggaangntcgctcttgattgctgggtcgcctcgcttcctgctgtgcgcgctcntnctcatcntcgactcatcacactgtagntntnactcgctgcgtcgtgntctctcgtgtcat

SEQ ID NO: 7264 - DNA, 791 bp, Homo sapiens
ccaggggtacttgggccaacgctcagactacgaagcggattctgtgagtacacgtgggagccatggaacctgcttacgcatccggaagcaagactagagggctgaaacgtaccgccctctgaaggaaccaacgttgttgacagcttgaattcattactagcagccttccagcaccgtgacaagaatacattttcgaagatacagcgcccctgattggggccttccgtactacgtcccaaggagacttatgctgcagacattgttttaccaacgaccgaattctgataacaggaagaaataacgcaggcctctacaacgttatagcactcttggactactctgcgcttacggaggaaatagagcacaataaaattccttttctaaccgggcctgactctgtagctcacggctggagtgcagatggcatgatcttggctcactgcaggctctgctctaccaggttcaagcataggtatgctgcctcagcctcccaaggagctgagcatacagacaggcaccatcatgcccggatagtgttatgactgatagtatagacagagtttcaccattggcgctcgggctggatctgacctcctgacctcaattgatcggggcgtcattgactaatatagtgctatgacttacatgcgctagccccacggctgggtgcaaatgtattatttcagtagagggagtgatgcgagcattccttaaatgttgagcgctacgaaaacctaacatgggaacgtaaggcaggtggagtccatctctttaaaaagaacaaaatgcgg

SEQ ID NO: 7265 - DNA, 638 bp, Homo sapiens
agatggagtttcaccatgttgcccaggctggttttgaactgcagggctcagggccacctgcaccttccatagtgcttgggattataggtatgggcccctgtgcccagccctatgaagaataatgttcaaagtatattaaaagacgtgctttttcaaaatagggatcaccctgtgtcatcctaacagaaacagaataatggtatctggggcaaagtatcaaaattgaggctctactggacaaatgaaagaacctcattcctgggtgactgggatttggcccaagggcataccaggttattaagaagaaaagggggaatacaattgaggggctctactgagggtgtgattgtagccgtttagaagaagataaaatagagcacaaatcccggccgctctcctttattagaagggtaatgtcctgaatcgctcactcacctgaatctgcttggactacggctttacgggtctgcgtgaggcgggtgatccctgacgtgaagggcgtgatatacgaggaagtcactggaagtagggggaaaccccggtgaagcacatgcgagaatgggggtcaaaaaaggtctaggaatcagtaaagggcgaggggctaggcggtatagcttaagccggccgcctctgataga

SEQ ID NO: 7266 - DNA, 1830 bp, Homo sapiens
  misc_feature (1)...(1830): n = A,T,C or G
tctaaccatttangagttcatncttcttcctgcgtactctcgatcatactctactttngctcgctctcntacctccatccgctctcagccgctagtagtcatccgcacctctctcacttnactcctacgcgctgcntcagcctactataccacatcacaatgcagtcccacgacgcaacgacacgtgtggtacagtaagcgatcacacacactatcagctatctctcacgtaatcgcgctcataacgcttctcgcaccatcgtattcnatgcacccgagaccagctgacatcataccgactatgcactagtgtagntagtagtatacacagtagaccgatgtcgatgctcagctgattcagtagaggtgtgntatgtgatagataaccgctgcatctccgtcatcatcantgatcgatcgtctatcgcgaccttctgtgctacgattgattgtgcatcgcctatagtatgctgatataacatgtgtcacgtcatctctatgtagcgtattatatctaagtactatcatattagtctatcattatgactgatatgatcacgcgctgcactatcgaactatccacgcacgtgccacgtggatattgccacacttgactagcctccagcgtctctcatgacgtcgcctcatcatcattcccttcactacaccgttcatgtactcactacnactctatcagcgttatctatggagtgctcgcatctacgcacgagaatatctcaccgctatgtagtacgtgtncgtcgacgcatcctaaatactactctcgtcttcgcgtcncttntctgagtgtactgtgtgcgttgacagtggccgacgccgtctttgcgtaatattacagacaagacagacgaganaccatgatcgattatatactntatgagctcgtatcagtattatagagatatcatacgtcagaggctgcctcggtctgactcagtgtagctatcacgtctcacgtgcactagcgtntcatcatcatctagacatccaacaacagcacctatgtggagccncgctgtgtgtgtagacacncgctatggtcatacacccatcatcgggcgtagtcctactnactgacaaactancatcctgnttatcgctcattgctatgctctcgatcatacacgatcgacaattgctcatgacttgnactcgtgatactgatgttactctcgctgtgagtgcgtacattcacgagctgtgaacagcactgctcgtcactacacaataagcactgtgtgcactagcacaactcaacgcacaatctgtgtatgtatgtgtagatgcacattcgtgtagatatctaantttatntangantttgagcnctgacgagtcangcgcngnatcactgtgcgtgcctgtactgctcgtcgtggtacctcgcgntgtctgtatntcgcacgtaacgcgaccgttccgaancnacatgaagctntaaccgatntatagagctgacancgattcgctancactcactgngccaccgcttgtcgctctcgtattgnctgccntagtngttctcagccgtgtcccgtgttgtagtgnagtctccatcattgtcaccnccgcatcatcgttcgtcacacacatatactctgtgtactacctgcgtgtgcactctgctcacatggatcagtacgtcataatgcgtgataggcgtaangntgcatatacgtctctagatattgacgtgactcgccactcactacttcgagtngtcagctgtattatcacagttagccgnggccnatgtgtgtagatacaacatctgnatggagtgttgtaaactgcactatatntatnact

SEQ ID NO: 7267 - DNA, 1137 bp, Homo sapiens
  misc_feature (1)...(1137): n = A,T,C or G
tttctccccgacaattacctgctaacatacccttttccacatcttggcgcaatcgactctccccttttctgggacgccccccatagtactgaagcttcgggaccctacatgtatacgcatcgcgcttttgatgttcatcttcggaccatacatagacaacgtgaaggtggtaatacccgatcagataaaacactccactgacatgacccatgtacaatgtgacgccgctggacgattcatccagttcacacactacgcgtatgatacattccatctacaccgccctcaacaagcgcctctttactcgacgcccctcctccaccatgcaaatcgcggcctcccctcacagaagaccaccacatcacattcatccacattccacaaccacactgctcttacaattcacttcggacacgcccactccacttaccaccatcaactgcctatcctaattaacactccatctagcgtgactctcaccaaccgtctgacatacccccagcaccttttcctcgctgctatacacgataatagtcctaaatcaatcgacactccactctcgcgcgcgtagaccccccntaacatccttacacatacctcaccacctccaacgtcaccactcctcatcatcttcattatatctaagtactataccactatctactcatcgcgcgccagcaaacatctcatcacgacttattttatatcgcgtctctactaatagaatagcgnccgacgttgttgtacaacccaaccactagcgacccttattgtgtccatctacacaatccacctccacacgacttccatctagccctctcttctacacctactccgcctcgcatcacgacgcactcctatcatatatatatttctctccccgccccattatacaacgtactcacgccgcacaatcatccatgccntctactattacaccnagacgatccacgacattcatataactgtctgtgatctctatcgcactgcacgtgtggcaccgcacacatccctgctgctagtcactctntattcaatcctctcgacagctacagctcacactatcacgtcgcttctcactcaccgctacgttatgacatcatcaccgacggtcctctcatgacatatacaacatct

SEQ ID NO: 7268 - DNA, 743 bp, Homo sapiens; identical to SEQ ID NO: 4086

SEQ ID NO: 7269 - DNA, 708 bp, Homo sapiens
ataacatccctaacgggggactcttgagccgctggcgcaagttccctcccactctgtggaagtacttttgcttccgtaaatctgcgcttttgttgcttcttctttcgttgcttcattcttttgttgctttgtttgttttgttcaattctttgttcgacgtgccaagaacctggacagctctcagccgagacccttcatctggtgacgaatggacgttgagtgagtgctcaagctcagacagctgcctaacaaggttctcgaagtccccgccacacacacaccttttttttttttcctgtatagataaatacgtgagagacaggggactgtgctgtattctccagggcccaggagggctagtgcagagtgccatgcttctttccagtgctaatttgaaaaacctcagtgcaccgtgggtcacctgcacggccaccttaggagtgagtgttgttgtggcacggcctgcactcaggactgggtttatcattcagaacctggcaggctgcctctaaagagagcgtcacctgcttatggggcccatggacgtctttccactgcagctagacaagtccccgatttcaaatgacgattacgcatgttaaaagcttggactgggccggggtggtggctatgcctgtaatctcaccacttggggaggccaaggaggcggatcacctggagaacgaagtcaaaaccacctggcaccag

SEQ ID NO: 7270 - DNA, 1852 bp, Homo sapiens
  misc_feature (1)...(1852): n = A,T,C or G
tgtattatataagtnnnnaantatatggnantaattagtatnnnnttantaggataannnagtggntgaggagtgtnntnggtgangtgcggtntngtagttgtatagattatagagagngaagtggntaagnagngagatgagagagatgnttaanagatgaganatagtgngaagccccgaggnangcgctgaatcngangatgatagtnatagaagtatngtntagtgatcanaccctntattacgtnctgtgagattaatgagagttagtgctatnatagtgataagaggcatagttgagtagtatatatatatcanctaagaatggtcgtnananacagatagttntannatattatagtagcangaatgcagttntcatctacntctnctatcgagcctctcgcgcgngcctcgcagtcacacgcagacgagcncncncttccgaagagcaggacgcngcacgtccctcgtctctccccacaccactcatccgcgcagactaacacggnccgagcgcagagaggactctccagtaactatctcacgacaganatcatacacaacacgacgtatngtctcngcgaacgtcgacancngctctctatcatcgccgtttatgtntcaactncagagatatgatgttacagaacattatatcagtcatcgttgtctgtcattcgttnntacanatcaggagacgccgacgtctgtagcaggtgccggagatagcgcggagagtgtaagaacgagctnatgaatagtcggtggggnaggtgtgaanatgtaantgactctccttcactattattatattactactcttactctcacacctcgatgcgctgttatcgcgcgcnagctcgtgatgcgtagccgcggcagctccagaccngacgagagtgangacacgngtatntctgtatgagtgaatgatcattacgttcnancgacacancgcctcactcaccatcgcctctgtngataagttgtagatcagngagctatacgacgcagtagaagagaatgttgcnattgtgtcgtgatgaaganantaatgatataagatgagtagtgttgaggatagtgagtgaggacnagcgtgtatgtgtgcgcgtgattaaatctagtatnattnaccnttagctccacgtcgcgctgcaccagactgcgcgancacgatcacactcaaggaaagtntnatatatatatngttntanttcgcgagaaagtgcgaagagangnagagacgtaggcagtaanangtatntagagagtntcatagtatgntngctgctgaaaangnagattgagatatcgtncgtggtattcgatgatgcgtaaatgatatgtgtgtatgaagtnactactatgacatngtagatgcagcgcgagagtattngctttccgtctacacgactgctctaaccatcgatcntctcacgctancnatacgtantctcgtctcatagaaactgtcacacatatatcacanaaccacgtcgccgcntcgacatgtcgcacgccatcgcgtgtgatctcacgcagcaccgttcaccgcgcatgcagtgcacatgatagtgcgacgcagcgaccgtgatagagtgcgctctctcgtctacgcggaatctgctgttcactagntctactgtgtatagcactctagcgcgcgcgccctcgtcctctgngcgtgngttactaagtgcaatatgatccgagtctctcgaggccnaccgagagtagtagccggtcatcntntgcacactgtagagaaggacgtnnctgtatggtagtagtggagtacgtagagagaagcatgcagagagacgcacacanagcggatagncac

SEQ ID NO: 7271 - DNA, 1357 bp, Homo sapiens
  misc_feature (1)...(1357): n = A,T,C or G
tgaccagtgtagagcagtataagcangtgtctttttgtgaacntctactatacgtggacaagttctctcgatctctgcgtagnctaccttctctgctcacattactgcgctctattacatcatacatntgacgcgtcattcatctgaatcctgngcgcgtacagtcatatttgatttgtgtcgcggacactggactangaaccangtcagcgctantgattctccatctagttcgactcatgtctagcntacatacgatacgcgcgtcactcagtcaccgcacatcctaaagtgtgagagcacgtagaatcgcgccaccattcacactatgatggtgctcgataccccgacgagttcancctatggagacgcgcgcgcagatgcgtgnacgtgcacatcgtctccctcatcaccacggcgacgtccctgggtgagcatagcatgagtgctgtccaacaaccacgccatgcnctccgcgcctccctagcatactggtgagtgaactcctgctgtcacgacactgcgatagctccactgccggcgacaaggtcgtgtcacgcgtcaatcacggcgatatacgtagcatgcacgtcccagtcactgagagctcggactctcaagaagaacgctgttcgcactccagcacccagcacctcatcagcggatagctgggcagctctcccgtgtctcacaacgctgccactcctccacaaaattcgaagtcgtgttgcacatgatctctcctcttaatttatataattatngtcttcagcgaactatatcccctgtggtggttatcttccccactcgagtcctacccagaagtagcgcggtcagtagatagcgatacatactgaggcaacagaacaagaactaagcaaagccaatgatcacatgcaaagaggaggggtcanggcgtggcccgaggttntcgtgccgtttgaggacaggcgcgcgccgcgnggggcgtggtcccgcgccgtcgggccagttcagccgagtgggtcactccgggtcgccctccgcggcgtggtgtgtgagttctactatagtagacaagatctacgtcatggataaaaggatatgtaggtttgttcgaagactaaggcgcggaccttgctacggatgcaggcgtacgtggaacgtctcaggcggtcacgtgcttcctctgtcctattcttctccccctgccgccggcgcgctcggtgcccccacctgcgcgttccccccgcaccccgcagccgcggatcttgttttgtttctcccatttaaattttatcctttttntctntctnttcaatccacttctctctattaaccactttttttttctctntttttttcattttttttattc

SEQ ID NO: 7272 - DNA, 2020 bp, Homo sapiens
  misc_feature (1)...(2020): n = A,T,C or G
cgtgcgtgncgagctcgagcatgtagcaagtatacanctcgcgtggctctcatgacgtactacccgacagacgacgagataacgccgcgctatgtatatctancgntgcanttcganatagtgcgcgctaacgacgcacagtgatgcatagcagcgagagacgatagcgagtataagaccgacgtacgtactcgtagcgagcatgcagcagctactncgctgcgacatangcntgcgatgctagtctagacatgcatgcgtatatngagtgtctcacatnatacactcagcatcgtgantagatcagcatnagaggtgactcagactgcgagtctggtagagnatcncgtagacgacacactgagattacaaacggcgcgtgcgtatgcgccgcgtcgctagcagcacctcgtgactgantgtcatgatagtccggagccgacgcgatgatgtcgncttctcacgcgcgtagtgagtctgacatgcttcactgatatactacgagantgatcgatcgnanagtnaaagagatatncgcgcgatgcgctcgnacagngcggcgacntacacgtcgcacgtcacgtgcactatgcacncntcagcnacacgcgacggcgtgcacactctgatctatacgatatgctcacgancgcacagcgtagtgcctcgcnngcgatgangcatngaacgtgtgtcggtcgcgntcgacagtgcgcagtngatcagtnctatcgcgagctgngcgtcntgctgcggtgncgcgtngcgngagagctcagtcgncgtcgctggcgtgtgtagcgngagtcttagtacaaacacgcgcgacgctctgagcaantatatcgatcgnagaggnaaacgcgaacgactagatcacgtagctccgcgactcagactagcgcgatcgcgctcgngngtngacngctagcggccagtaccgcgccagacatctactctatgagatatggcgagagcgtancgcacatcttatgatgnagtacacctgtggatcgactcatacgcgatgtaactatagtanangatggctacagtgantgcatcgatcgtctgtgcgtgcngcgcgtccgtcgctggtgcgatacgacactatgcagctgcgcgagactgatatatgagtgaagcgtgantnangtgcgtntncagtatngcctcatgcagatagataacgcgcgatacgtncagatagcggacgaccgactgatgtccagatatcgnatgtctcatgcgaagatcgatggtgtgtacgcgagcagcgctgactgagcgtanggagcatntctatctgtgtgctgatcggagaccatctcacgtntcgacgactatgtatctctacnttagcgtatagctattgatgtcgtgcgtntggttancncngctctatacatcgtagtgacatcggtgagcagagcaacgcacagacncgcgatcgcgcgcacaagtacagtcatcagtcatgctgngcgggatangntgaagatgagacattgagccgtgatacaagtcgatgctcgtatgtacggcgatatgatcantacctttatctgtcacgtaatatctactatcagtcgataagagcanagccatgacgcgncngctcgcgcgtttccgcatactgcgtcatgangaaatctgtccgttcacgtatgagctagtctacaacagcatcagagacgctgcntgccgcgngcagcatgacgagtacatgacgctcgcgcaacggagagtcgcgtccgcacgcatcgtgagtcgtagactaacatgatgtatngtatgctgatagtcacgcatgatagatctgagtagtgatgctatgtatcagagtggatcagtctgatataagcggtattatcgacgagctcatcgtagaacatgataactgagacgagtcacgcgagcgagttntaccgcccgatcacgtaaggcnctcttgtttcgttctctctcngtttatcggactnctgtaaatagagtgagtaagtgatatagtaagtatgaa

SEQ ID NO: 7273 - DNA, 1481 bp, Homo sapiens
  misc_feature (1)...(1481): n = A,T,C or G
gcacgtttcagttgtgatcatgtatataagttcttcacttgctgtagagtgccagtgcgagttacgtatgcggcgcgctatcacgtgacatatctcaccgactcgagcgtctcgatcacgcgaactaccgatacgcgctgggcggcgtattagcgagagcattctggtcatagcacgatacgcgaagcggagccgtacagctgagtacgcgtcgcagtgatgtgatctaccgtgcggcgatcgcgcgctgctcgactcgctcgcactacactcgcagaggagtcantgtcatgcgatggagaggtgattcgtgtgcaggctagcggacgcgatcatctntactgctgcgcgatcgantcntctacncgcctactcaaancgncactagacagtaagagactctgtacgaagcgtcgagcgtaagtcaactactgcgctacgcgtggagcatattatacggcgcgctaggagtacgtgcgacgacggcgtatctccagtatgcggcagcggcacgcaatcgtactcacgacgtagtcttctgccgtgtcgctntgcgagcacgacgtacgcgccacatcgtccgcgcgtctctcccacacattccatattgtancatgtgtacgtcccgctccgcgccttctgattcgtgtgggctataacaacgtcctactatatttccgccagcgccgcgccgcacgtntgtctcttacctgcatcttgtctcangtgttactntctaatgcacgctcgtcctcgcgtagcgctcaccgtgtcgntctgtgatatgtcaggtgttgtcgngngtgataatcagatcatactcgcagacacagcgcacaatgcnatgcacgcggtnatagagtgngnatgtgtcgtaacgcacgtgggcaccgtggccgcgcacgcgagcgtgagataaggagttattgagagagcacgtctagagctgctctgatgcggtcgtaccgcggtagtgtgcggaatnaacttgacgcgtgtactgcggcgtggacagggatagacagcgtctcagcaaagcaaggtgtgcgtgatggaggttcgtgtctaagagtatcatcgtgattctacaacggcggcgcgcacacaggactcgttgagtatctcgccgctccatcttatgtatgtcgntagggccgaagcgaaggatcacttaagcgtgcttacgcacttagtaaccactttagtaattccgttcatgacgttgtccgggcacatgtgcgagaatcgtagtccttaggcagaaaatcgcggcgcgcgccctgtcgcttatcggcggcggagaagtacccgtttgaggcacgcgttgcggctctgtgtcctctctcggcgcttgccagtcgtacttacgacgccaatagaggaccgtgccccccattccgcacttttgaacgacacggtgggtggactagatattacgtcaattaacttgctcgcagaagagctagaagttgcttcagacg

SEQ ID NO: 7274 - DNA, 1383 bp, Homo sapiens
  misc_feature (1)...(1383): n = A,T,C or G
tactctatgctatagctcgatctatctcatactacagctctagctctgatcatcgcctatcttatgctacgaacggccttgcacgtnattatgctatatatacagcatcagctctcgttcaccatactctctacgcatctgaagtaccatctcacacggtctgtacttcactctcctcatcccgtgtacgcctgattgtnatatgcttcgtgtnttcctatatacgaccccgatcgagtgcgtctacgcgctgctacgcgttgatantntcggtacatacgcntnttatcgttcttcgcatcacgtntncgtgtcagcgctgaccagctcacgtccatgcgatgtgttcagcactgtactatatctgntctccgcactgttnatagcatagtacagcatcacgatcacgtgancatctgcagngnagatagacgcacgccagncacagcagcggactctatcagctactgtacttntctgtgtgctgtcgtctacatcaggtttccgtnctcgttctctgctactatgtcgagtgtgacatacttatctaacgatgatacgacgacttcananagcgatgangatcacttgcanatatgcatgtagctactccagtatactctagctatagctactnattcgcatctatgtatgtagtctcgctcgatnacatagtcatgactcctgtcgacggatgtctcgtatatcgtganttgatctcactatgtacctcnanatnctctagtgatgctggtgncantcagtgctctgcgcagnactacgtctgnatntcacgtatatagtagtattgtgttgtactcacatcatcgcatgtgtgatcctaacgtgacatctntcatatgatatttacgnatcagtgtanntatcacgtctctacttggcatgcgaccgcgatcttgcttgtnatgcgcactatctgttntatatgtagtctcgtgtcgctctgtatgcatcgtgatcgntatcgttagcataatttgacgatgctctcnatgtcgttcaagntcaangtcgctccgatccgtttntctagtagtgagagctaatatatgatncataatagtagctcgaatatatcactcgatgctagtctgtgttactcatctgtcgatatattcttgtacaagttctgttntgtaaactagatacaatacatgtgcatgctgttgtcatgcgtaactagagtctcacactaccctcatcacactcatctcgctccacatacaacanacgcattagtgtatagtctctagtatcacgatttaacagcatctagtctcantaaccatctctgagnnactcactcacatcggtatcctacagatcatcgcgtgcctgactctcgataatganagctnatag

SEQ ID NO: 7275 - DNA, 2036 bp, Homo sapiens
  misc_feature (1)...(2036): n = A,T,C or G
attanactcatacacacaatgatatatcctacttcaacgtgcacgagcttcagatagtacgcacggtagacngtgttgtaganaagagactgagcggtcaataactgagtatagatgatgtgctctcgtgaggaacacacattanacantgagtgactgtntctgttntcngnactctactttcgtacatacaacatagtcactctgagctgtcatagcatgatgncatcggctcgtantgacgtagttctcagctactattgtatgttatgngtgcagtctatacgcgnngtgaagacagcgacatagctcgatntanaccanaactaagtatacagaatacatacagtacgtcatactcatatgtatctcagtcgngcacatatcgcgcagncatgatctatgtgtacgntagactatatangtaacnagtatagctagcagggtgtctgtcactganaagagngacgtgctgctcagcganctgtagtcgtctcgcgcgtntnagagtatgtccgatgatgnagacacgtatgtatctcantanngagcatataagattgtagatantatctagatatgtaagtgcgtgcgattntgnggtaacagtatatgatgacngngntgtcatatattatatatctacacattaggantgagtcgtananagtcgcggcagtgcatatgcnactatagactcgtacnggacgntttaaagctcgtgaganagtanacacacgcgangnagtancgantacagtacacagtactctcgcggtacgacacgtgctcaaactgtacantagcngagacgagtacanatgntgatgacgtngtcagnttgtanagctagcgtcactgcataggagatgngancacgatcacaatcatctacactacagcgcacaactgaagcgtntcgcgtgtcatatgcgtgaccgctctgcagcctgggtngtgancggcgagtatccacgcgtcgaggagtgnacaagngatcgtaatgcatcgataagtantgnagactcgacgtaggacggtatngatcatgctacgtcgctctacgngtnagtacgttgncatagccgcaccagagtagtctacactgcgtcgcactgacgcagtgtcagcactcgcgcagngntcgcncntcgcntccgcgacncacgcacgacgatgtacgacacgctcgtgtcatnggtggnagtgtcatgcacgatgatgtgtgtgagtcgtgagatnggtttcgtgtgtgtggtgttgtcgtgatntgctgtgtactcggtgtgtctgnatgatggtaagattgtatagctacgtgacgtcatacgtatcagtaatctgtgtactnatgtcatcagcacttgcatccgctggtctcgcaatggcntngattcgcgtctcnatcagcctcacgtgcttacattgtcgtactacctgngataatacgtttnctactatcantacactctagtatcactatagtagacacacacagcngcgagaaagtcgacgcatactaatagcgtgancctagttatgatgtattgngaggngttcgatggcatccacatagcganacgcgacgagatgcgctcngacagatantcatgagtcttatatgcagtgtgtancgagataagagccgaggagngataggacacgtagtctatattgagantacttcattcactcacacactgatttatgtggtgatacatctgtccatgcatctacatcaggccatcgtaaccacacacgcacacgtcgtatgagctatanacacgacatcactctgtatatgatacatgcantntatgaggtatgtcagctcgtgtgtcggttatgtngncgtagagncattgatnggcgacgtgtggtngcgnacgttaatctggactcctgcgatggtagccagctcgtgataactgatcctgtgtagtgtgagagagagacacgcgtgtgacgcagcatcaatagcgtancagtcgcactgtagaactcnagactatgagagtggtgtatcagaggatgat

SEQ ID NO: 7276 - DNA, 374 bp, Homo sapiens
ccaagcgtgactggctctcttaactaccaccgctacagaaattctgcaaggatgaggaatgcttttcttgagacctcttcagaaatccgaatattttctagatcagtgcttgagattttgcagaccctgcacttgatggatcagctggcaccacccagatcgattaactggctcatctgatcttggagcccccacccaggaactgactcagtgcaagaggacagcttcgactctctatgatttcatccctgaccaatcagcactcctggctcactgactttcccccacccaccaagctgtccttaaaaactctgatccccaaatgctcgggggtggggtggggtactgatttgagtaataataataaatcccga

SEQ ID NO: 7277 - DNA, 183 bp, Homo sapiens; identical to SEQ ID NO: 4089

SEQ ID NO: 7278 - DNA, 772 bp, Homo sapiens
ccatctttcctgtttagcagttataatgctaacacatgctcaaaatacaaaacttgggagatgtaggaaagtagaaagaaggaagaaaagtccgatgccagtgaccagaggtagcagcacacccccaaggaacgaagtggagtctcgctctgtcgcccaggctggagtgcagtggcgcgatctcggctcactgcaagctctgcctcccgggttcacaccattcttctgcctcagcctccggagtagctgggactacaggcgcccgccaccacgcccggctattttgtatttttagtaaagacaggggtttcaccgtgtttgccaagacggtcttgatcttctgaccttgagatccgcccaactcggtctatcaaagtgctgggattacaggcgtgagccaccctgccaggcctcatgtttgcttatcttacccaaaattgagccctcgttttactctccctgttttaccctaaagaagatatatatctttccaccttggggtagaggcaggtccagtacccaaaccctgcgctgggcataagggctactgtaacccagaccttatcttctccctttccaaagccagggacatctttaacgcctttaccccttcttcttacctatattaaattaaacgggagcggcgcttcgttaatgaggttattcatatccccgttactgctcttgcatcggtctttgttgtgaaccgtttaatccttagggtttatcgttttcctattagggttaccagataacttgacaaagcctcaag

SEQ ID NO: 7279 - DNA, 502 bp, Homo sapiens; identical to SEQ ID NO: 4206

SEQ ID NO: 7280 - DNA, 1358 bp, Homo sapiens
  misc_feature (1)...(1358): n = A,T,C or G
actgctgcacgcgcatcctccgtcgtccgcgtgtacgtcttaatactacgctctcaccgtgcgcgtacatatgaaacaacagcacaaacagatgcctcgtctagcacaatgacagtagcggattacgcgtctcacgaatccagctctctgcgtttgctctagtcaacgttcagagatcgtactctagcggcgacgcgtaagttcatatccaccacatagtcatcaagacaactgaaatatcttgtagatcanctgatgatactgcaacacgtggtgtattatagcatctcctatcttataccaatggatagttataagatgcgacttgtattcgacgaatacacgtatacaggtgtgatatgacagtagacgacgcgacgctacacgccgtcatcattaatatcgactatactacacaagctgagtatttctagataatcactgttatcantcttcgcaaacgccccacgactatctgctcgatagagtcgctattcagtgcgttatcgattatnacgtcacatcgagaacgataagcaggcatataattcgcgccggattgtacattagtacttacatgacatccgagactgtatcacacgtcgcaactcaccntcacccgacgatgcgtattgcgcgcgtcgacataatactacgtccacacaaacgacgacatatgaggatagttatacgtgcacgacaagcacgtctctcattagtacagttagagatcggtacacattagactacgtcattgctgactctcctccactaacgctagatctgcgcagacgcgaattcgtntgtctccagtacacactattagatcantgtatgtactctagacagcaaacgtactaattacggctacgcgtgcggcgacagccactatacgtactctcgcatcaacatngcctagcagcgaccatganctgagaaagatgctctcgcgctctcaagtctcaacctatatcgcatatcgaatgattgtctaatctcntgatcgcatcggtcatatcctagtcaatacataacatgtcgtatactatcgtacactcttatcgactacacgcgcgcgctccaacatcgcngcgaattcgtacgtataatatgtattacgtattctgccacgagacatcgtagcgaccctaatataaatgtttggacgatgcacactacgcatcacgcatatcactccatatatgctgcgcaagatcgggcattagagaatatatagagcaggatcgcgccgtctagtgcacttcttcactgctatagcgaatgtnggatcgcccatacgctatccaataacgtcgcgtggataactagtatactgcaatcagcgacatgactcattc

SEQ ID NO: 7281 - DNA, 757 bp, Homo sapiens
  misc_feature (1)...(757): n = A,T,C or G
atagtctgatcctgatcctctgaggcaagggggtctgcaggtccactagagtgcagacctggagttccactccattgatacatacagcctggttactgggtatcttctcctgtgtatttattcgggccaaagtattgggtcctgaatcaccattccaagcaatcataacctaaatatcactcatttcaatttcactaataatgatacattattagttaactaagcctagagcattcattttgaataaggaattcatctactaaaagctctccctaaagcgctgactataggtaacttgtatatactctggacaatagtatttaggataaattatcccacagacagtataaccagaggaagcaacactggagattgggcttgaatccaaacttaattgaagaccttctaagtgctaggtcttttgggtttaagataactaggcaaaagaaaagaaaaggaatggaatgaaaaacaaaacanaatactgttgtcgtcctccataattntaccacatatccatgataataaccaatatggctacaaaaactgagtagcanaatctcagaaattgatcanagtaaatctgatctgtgcttctgtgtggatggggatggttttagacagaatctctcttcacacagtggccagatccagtgctctctcatctttgaaacttggtcccccaatttggtaaaattttaaaagatagaattcaggcaaaattctacttattngaaagaactctgcaagtgaattg

SEQ ID NO: 7282 - DNA, 763 bp, Homo sapiens; identical to SEQ ID NO: 4093

SEQ ID NO: 7283 - DNA, 1174 bp, Homo sapiens
  misc_feature (1)...(1174): n = A,T,C or G
agtcggtgagagagtagaggcgagacggcgagtcaggaagggagaggctcaaagtggagaacagaggacgnaggaggttaaccagggagtaaaccaggatcccaagacgaaggcgtagaagagagcgaaaagagagtactcttcgtcacgctcaccgaagcttacacatcacgttattatatacgatccatctgggcgtgattatggttaacatcgggagacatgtgactaacagacacccgcggagcgacggatacggcaaggcatgccgcgtgctgccagtatacacgatctgcgctccgactaaccggccgactcaatcatagcgaatacgcaaacgagaatccgcccatgaagcgggcagcgctcgaccgtacacgctacgtcggcacggggcggttcaccacgcacagactgcaaacggcccaccccacgatccacttggcgctctaccgccgcgtgtcacacgcacacatcccctcctctgcctccacaccacctatcccgtgtttccctcgcgcccgcccctcctcgttttgaggcgcgctggcagaacaagtggtaagtctatgtaatataaataaaacgaggagtgatagtctcgatctgtggtggcgagntagcggtcgcgcgccgcgtacagctcatagtcgcgccgcgcggcagccaccatcacgttcactgtagtgcgtgggcgaagacacgtgtgcaacgacgcgttactctggcagcattagaccatatagtctacatcagcaagcgtatatgtatgtgagagtcgaatcaactgtatcacatagtatgtagtgtagtgagtggcgaggtgaaagtacgcaacatgtagaaagatcccgtgngcgtcgttgactgtacgacctgttaagtcatcattctgcactgaagagagtattactctgacccccaaccgtccccacacatgagaacgtactgagagtgagttagttgctcacgttccgaacacccgcacgccacgagcatgactccgacngtgccagaaagacacgtacggtgactccgctgagcggcgacggtggtgtggcgagagagagacgcaaaatgttatacanatattatacgatagtggactcgcatagctatgcattcacacgtcttggtgtaaccagataacacaganacgtctggcgcgtacatg

SEQ ID NO: 7284 - DNA, 811 bp, Homo sapiens
  misc_feature (1)...(811): n = A,T,C or G
atgctccttttgtctggaagcttcagctatatgccatctcaaggggcgtggggctgggaacccatataaatccaccacttttangcttanccatcctctccttgatgaagcctatccctgacctctgcccaagactatggaaataatgttagacaaaaagcaaattcaaacgattttcttattcaaattcaaaattggtgagggggggggcaaaacacaactcgcaacatcaaaaaaacatattggcccaaaaacttctaataaaaaaatctacantccaatggtgggtaaagaagttttgcaaagcataaaagaacctctaagatgaggagcttaggggccagccatcataagttgacaacaaccaactgaaaacactcatgggaagctggtcctcttacaaacacagagagaagggcgccaagaactcaaggtgaagcattctatggggggggatcatgaaagccaggggaaagggcaagaaggctcagtaatagggggcgtaacggcgagtgaaggataggatgagggccgagggggaagggttacttgtgggaggggggaggggagaacgtcggtgactagcacagggagctcaggggtggcgagtcggcggaccgggtgggggcaagggggcaatgaaagctagagaaacatagggggaaggagggagaagaagggagggcggtggcggtggaggagggcgagtgatgtgcgggtcgagggtgaagggggatgttcgaagcgggcggttgtggggaggggagagaaagtatagaggtagagggaggaagagagaggagggggagat

SEQ ID NO: 7285 - DNA, 355 bp, Homo sapiens
  misc_feature (1)...(355): n = A,T,C or G
tgttcgcactgctctctactaccaggctacggctgagtctccagaattccatggtggtatctatttagaagcaccttcctgaagcgcccagcccagccggtgtctccctggccctcagagctgtccatttcacagagagcaaaatcaaggctctgagagtggtgccagctgcctaacgacccctcgcccccatttcccctttcccatcccaacaagagccaancctgagccttcaggttttgcacaattttgctcaatttcctgcctgaatggcacagggcctgaccctctgcaggtgctcaggaaatgttcgtggggtcaataaaggacagctaaatctccaaaaaaaaaaaaa

SEQ ID NO: 7286 - DNA, 860 bp, Homo sapiens
  misc_feature (1)...(860): n = A,T,C or G
ccctagctgcaatcactctcttaatctcacacggcatcacattttcacccgatggaagactaattgtgtcatgtattgaggataaaactattaaaatttgggataccacaaataagcaatgtgataatggagatgaaaatacctcacaactcttcagtatcatcacatgaatattaatatttaagagataattcattgaacaaactttatttgtctaaggcaatattatcttttcgctgggaagggaggtgaancatgcttgcaaatgacagccgtattacgcaggaacttctgtcccaatagcacagatcagaggatggttctggtctggaagtcagctaaccttgttttgtatggaagaggcttattttcattaaagagtcacttgtccaaaaatggttcatctccctttctgggatatttgcaaatctgttggttagaacttcggtttacacaatgctctgctgatactgggccagaagttttggggtctgaaattcacaatccttacaacgttctttccacatatgccaaaatgaacctttataaatcgggcaaccatgtcattgggaagtgattctccctctttatttgacaggaaacctgaggtggtgggggtcctgactccccatataccatggaccggggtgaggggggtgttccccctaaggcctgccttttcccattttctaatcctttatggaggggggtaaaaaagaactcattcttagttacacccatttaccactaccaaggggaataaaactttatattccaggggcgtaataccgggttaaaggggtggcctttcccctttacgaaatatcccggcgggcctgcccttaagaagggtatcaaga

SEQ ID NO: 7287 - DNA, 1519 bp, Homo sapiens
  misc_feature (1)...(1519): n = A,T,C or G
tggtagggagagaanaaggagggnnnggaaanngggggggtgtgttgtgggntnangagtgtgtggtgtgggggngaggggggagagggaggctgagagaggaaggaacaagaagggaagaaggaccttcacacagcactcgagcacacgacannaagaaatatctacacgagacagctagacatagcganggacaacgaagttcgagaggcgtgtagttgtaggtgttgtagcgttgtacncnacgcccatccgangcgccgtgggagttgcgggatgagtgtgggtaaattaagtaagaatatagttagatgaataatgatagtgatatgtnattagtgaccacgttatattatctatatctcattgtgtagctggcattaccacgtgcgacgtccgcgctcgctcagctcagtgaggcgcgtctcagcggacgcacatatctttctctttactaccttactcggttctctcaatatcagttcgtggatgtatttcgcncantatctataantngagtacttcaatgcgnaacagtcagcatatggctgttttatttgcgcgccacaacaagggaggtatttgagtgtcgagaattgtgcgatagtataanttcctaagaacgcagtacttctgaggctgcgcgagatagagggtgagagatagtntgagtggagggtagtatagatgttgtacgattgtagtacnggatgttgtatangtgtgtgtggaaagatacgtgaaagtaggtgtgataggttgtggagtagtatgtgcagtaggtgagctaggttgagtgactccngtcgacagtagctgtctcagnagatcgcgctcattgactgtgcgggaatactatagtggtttgatgtatgtggttagatatatatgtgttgtgtcgtctcatgtattgttcctagatctcantgatgaattcacttgcacagatagttatatanatcttatcgtacttagctggtagactatctcgtatagtggtacggantgctgtaggttnnntacagtagagtgtagatgactgacgatagtcgagctgcagcattactatgagtatatacgatggtgttanaacgacagataattctacactatatcagcgtatcacattcacagttgtgtctctcaagagtcacacattcatgtgtgtttctttattggtagctcgctatcgtcttcgcaggttgtgtagtgagtacgcgacagatgtgtaggcgctcgtgagtctgccttcgtcgagtgagtcgtactatgcagtgtgtatgtgtcgtgtgatctcatacacgatatacgcagtgtacagatctctgagagtgtanctgctacgtgtngtantcagtgagttantcanatgaattatagtctcgcatangcgctgtatatcataagtcgtagatggtgacgacgactagtgcagcnttcgtcntgtgtcgcgatgtcgtgactgtggagtattntagatntctcgtcgatgtgtcacagatgataatttantattatt

SEQ ID NO: 7288 - DNA, 774 bp, Homo sapiens
  misc_feature (1)...(774): n = A,T,C or G
tttatgcttcagccagatgtagtaagggcagttggtgagttctggagaccatcgtcctggcaccatcagggctttagacgtggcatgggctttctggcaactcgtctggtgtcctcagctggcaggaggatctgactgtgtgcagggcccttatgcccactgcacacctctgtgttaatatccttcacactaagcacaccattcagctgctgaagtccatgcctgtgagtccaacaaagtaggtgcatgtcagcatccaggagctctacaaggatgggacaacagcagcccagctagttggaacacaggtgtgcaagcatctcagagaccagcggggcatctgactgggttggttgagtggaaggcaatccagaatgtggctactgtagctgctttcttttttctttctttccattatagaagttacaatacttgaaagtggcaattcgcataaattgtaatgttggaagtacacagacttgagattggaagggagtgaagttgctcaaagtcgtttaagttgttgattttatctcctaggacttaaacgttctgtcctcctgcagccatctaaaatcagccagaaaggtttaggatcccatttcctgttcttgcatcggctgtccaagctgctgttcctctctccgcagtaagagggtgtttctctccctgttcaagaggagcaccaacacttgaggtttggattccatcttttcctgccccttccgcaacatttntgctctgcccagaagaacagcctctgtcacaactagg

SEQ ID NO: 7289 - DNA, 628 bp, Homo sapiens
  misc_feature (1)...(628): n = A,T,C or G
ctgcttctggaaaaccagtttctccagccaagcgagaagctgtagtacaatatgtcccaagtggtaacttctgacaaaatttttcaccagttcaagaaaaatgattatgaagaagaagcaactacataatttaaaagatgaggtgatctttggaactgcgtatactgggagtgagggaaaactacaaaagagaatgataaaagccagacattacctggaagactccttcctgggtcctgctcctgcctttttgcgtgttagttgaatatgctgctgaaaccaggcctgccaccatatacctgccaaaatagaccctttaacaatgccttacctccttttacaaacaaaaaaaatgcccctgtgtgaagtcggaagttgaggcccaccccaagatccaatatantagaatagtggggaatgccctgcatatgggaaaccaaaaagaccctggttttggggattcccttaacaaagatcttttttctttacttgcttttcaagaagggtactttatgcagcagtttaacattgccaaacaggggccaaaatggcttatgctgagtcccaatccctgccaatggctttctgggggacacctaaggaccttttccatggaaagaacctgctt

SEQ ID NO: 7290 - DNA, 917 bp, Homo sapiens
  misc_feature (1)...(917): n = A,T,C or G
gagggcctgagacctgagaacctggctgacattcctncaaacgggagtggggacttntaaaacctcttccaatctacccatgggccgcccatagaccatttgggcatgtacttcctcccctctgaaagtccataaaaagcccttgggaacagcccaaaaaaggggctaaagattggagaagcaccaaatagatggactgggtgactcaaatcagcggggggggggagaaggatcctgagaacctcctttnctaaaaagactagaaagcccaacccggggaccctggctgttcaaaaaacggcgcgcacaccctataacaagcgcgctggcgggccgtacggtagagacctacaacgaattgtagtatggacataaactgggcgaggagggcggaaaatatagaccgctgcggggcgggcagatagttcaagggaaggggtgagatggagagagtgaaatgattagggatctagagagagacgagagagcgggcgggtgcgcgagaggatagagagtgcagcgcagggcggtgatacagtgacgatcggggtaacgcgggacagagctcggcgtagggggtcggagggaacgggagatgggaggggagaggagagcgaagtgaatggaggaggtagtgggcattagggaaagtgggatggtgctagaccgcgtgtatgcagcaggtagaaggatgatagaattggcgtgacggagggtggtaaaagttagtgaattgaaaacaaggagtggtgtagagaagagaaggcagaagaaagcgaatggggagaaggaatgatggcaagaggccgacggagaaacgaagaaggagcagaggtacagaaaatggacaggtgatgaaaacaatgagacgggggggggaagagggggtgaaggcggacacgtgaggggggtggtgg

SEQ ID NO: 7291 - DNA, 816 bp, Homo sapiens
tttcccggcacaaccgccctataatgttactgacgccgccttggggatatataaccagggggcgcatccagtgattgttctgggcattataagccaacccctaactaaagggatgccgcacgctgggcttttatcacaacaatgtaacatttacactggagaaactctcttaatgaaccaccgagtcccgtgaaaggcggaatgaataggatacaaatttattcttcctgagcacacaagaccactaggcggcgttacatcggaatgcgcagaccgtgactccaattgcacagggaggatccctggctttgcccaccggacgggcgtgcggtctggacaacgaagggtggcagcctggccctggtcaagaggaccctggccctacactaccacactgttgagaggacggggggtcccaacccctctgatggacaagctgtcagattacatgcctaacttatgcctttgggcctcaccaggagcgacacatcctaagaaggtatcctgcgacgcgagcgccataggcttaaattaggcatctattctgagccttttgcccatagctggggttaggacccccccaaatctacaaagggtggcaggcaagaccaggggccctctacgtgggcagtgtcttacgctttgttttaaagacccgctggctgtggggtgagcacagctcgggcacctaccctgtgaacctggagacccgtgccgaaaatcacacctaaagcctactcttgggtattctgggaccagggagataaatgtttcccaaattattcaactcgggggggaactgcggaattaaaaaaa

SEQ ID NO: 7292 - DNA, 425 bp, Homo sapiens
ctgttatgctccaaccaagggttttggatcaggaagccctgggaattcatctaaagatttatccaaaaccacactggtaaagacagtggttgaagagctagatcaacgtggtaaagttctttcatcaaggattcactccattgaagaagagacatctaaaataaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcacttccattcactgatgactaataaataactatttgtgaa

SEQ ID NO: 7293 - DNA, 412 bp, Homo sapiens
  misc_feature (1)...(412): n = A,T,C or G
atacctggtgcagttgctgatgagaaggggcactcaaaaccaaggagaaactagtgtggtttcccagtgctacactcacctccaccctctctgggagcctctcttggggggctcacctgctcccatggcctggtccctgctcctgtgcctgtgggatccagatccgtccgcaggtcaaacaccagcttcagccatcttctgcaatgcgtgcgtcttgtcaggcctctggactcaagtgtgttttgcagaccagcagtgtcggcatcacctgggagctcgttagaaatgcaaaatttctgcccccatcccagacttcttgaatcagaatctgcagtttaacaagttccccaagtgattcgtgtgcacattaaagtttgagaagcactggtgtaaataantaaaaaaaaaaaaa

SEQ ID NO: 7294 - DNA, 804 bp, Homo sapiens
ctttggagcacctatgctgccctttcaggcacaacgactgagctgggggatgcttccaagttgacttgactgaggccctacgtaaatggtccacgtacactggaaatatgccaggcctgatgatcgtgtcactttcccgggcgctgctcgggcagctgaccacactgcatccttatataatgcgacatgaggtgatcggactatcgccagacacatcatatacgatttcgacactgtgaatggaccgctgtcaggaagaagctccatctacatttactaacagaactgaacctggctgctccaatcctgcgcatttactctgacggggttgcaaaagaaacacaatgcgaacgccattactactatctgatcgcccatctgccctgacgatgtacctgtgactcatacactacgatgaattcatataagacgactgctaatgcacattctgacctatatgcatgctcttacttactgagacctgccacactgtactgcagacatgactggccttgaagtctgctccaccccacatgatcgttatgcatccagagctgacctgacactagtcgaacactaccatttataagggtgcccaccgcctgacatgagacctagcatactctatgacgatgccatcgaacagacgtccaggccttccttatacggcacagatcgaggacacagattggcacttcttcagggctgaaaacgccaaactctctcagccgttggcctgaggggtcacgaccgaggctcgtcattggaggcttggtcacgcactgcaacatgactttatccttt

SEQ ID NO: 7295 - DNA, 2112 bp, Homo sapiens
  misc_feature (1)...(2112): n = A,T,C or G
gctcttatgtgtgcgataagccatagctcctgtacgctgccagagcgtagactgcagctagtatantcgcagtgcactgagtgactgacgtctataatgcgacatactcnggtcatctcncngtcactgtacacgancactatatgccagactggcaccatgccagcacccgtcgacctgtgcacgctgaacgtatcgacgtgtccgaggactcgataactcactgtatctcctctatnatgagaggacagcatcgtntacgcgcgatcatcgtgaggtgacgtagcattcgtacactgcgtggttgtagtgatgtactcgggagagtgtcagtgtncntatgaaagcatcgactagcgacggtgcatcgcataccacagatcgtagtaggtgcacacatactgactgctctattgtgtatcgatagtcgttggcgtacatattgtatgtcgtgcgttacggatatgctnagacgncagtancatatgcacatagcagagacagttcgcacggcgcaccgttactcgctcttcgctgctcatantgtagatagtcgtagattatgcgcttcntagtatgatagaagctaanttcgcgtgngcagtgacgncgtccgctagcatcggctagtgctgcacatcttatanagatgttgctagtaaaactggatcnagcgatcantcgactggagcgctgacaccgtcacagcgctgatcgtcgagtagcgatctacgttgtctgtatcttcgtcgtactatgtcngntncgcntnctgtaggtgcgtctgacgactgacatgcgcgtcccgactgcacgttactnatgtgcgcgactctctcgtgagtagtgagcatntccagtcacatatatcacttacatctgtncgtctaagctcactgatggggcgatgtgtacgcacctcacagccgtgagttcgcatatatgtaanagttagtgntgatgattcctcatgtctgcgcatcgcgagactgcgtcgaatcgtacatactctcacagcgaagctctcacaatctcgtacactactttccgtgcatgcactctagcccgcacataacgcgcacgtcgcccgtcgcatctccactacncgccgntcgcgtctctgatgcgcgtgactgcgcgagaccattatctcanattcgtgtatgactgcgtgattatgaggtagtagatatantgctacnacgcacgcatacnangtgcaactcactacatgtcagtcgtactactctagtcgacttgactgtagtaccgtgacatacgcacantnactgctgacggcgaccaggcntgtgtgaggtaaactcgtgcgncgcacatagagagatgcgtgtgcgtcattgatcactactgtagntacacggtcgatctganagtcgtctgtctcacgctatatncntatgctgcgcgtctggtagcgtctacgcncatactgcagtcgcgntaganatcgtacacgcaactgctaacacgatntcatctacgangtcgacgtgactcnaagcatgatcancagatgatcgnagaaacntcagcaagcngcgncgantcgtacaagtgacgagcagatgacgntcggagctactatgtngacgtcgatcagctangtngcgtcgctgcgaccgnctaantacgattagatcgtagctgatngacganacgtcgcttnnatcagantcagagtgannggnctacgactactgtctanntgtcgatactagttacgtactcgtcctgacgcgagttgtgctnagtagtactgngtngcngacactntatcagctcacgtancgacnacancagacgactggtnagcgtgacacagactgntacagatatcgngtttgtgntaactgtatgcgtcgctactgcgtagcgtacantnatcatcagtgtnatcgtatagnatgtcaaatcactgaacgngtagnatctagtcatncatctgagcntactacactncgngatnatnangtatgacgacttcagtcatcgcagagtcactacgtagnagtagcgcattcaacngtcgtacagtgnatcgnacgtgtcgtngatngtcgacantcagtctcacnntctctagctcacnct

SEQ ID NO: 7296 - DNA, 1337 bp, Homo sapiens
  misc_feature (1)...(1337): n = A,T,C or G
tttttccttcgcgctcggacgtcgatgattacctagttctcgtcttccgacccgctgtctgtccctctctcttagccacctcgacttcttgtctccacttgagacctttacaacttacccgcgtatgtctcctccctgatctttcctacgtcgctgctctgcggtgcgcgctcgtctgccaggccgccatcnagantgtgatctgataacgtacgtcgtcctacagtgactctcattctgcgcttgttcagaactacgtctggtgtgtgccatggtgtcgccgacagaaccgttcatctcacttttcattatctctttatacataataccggctagacgtgccgtcattatttcggctcggacttcgctcgcgtttcatattgtctacccgtgctccagtcctctttgtatttctcctttattcgcttccacgacgctgtagtctcgatgaccgtttattcttcgtcgcggcgcgtcggtcttatttaccatattgcgtcagcccggtgtatctatatcatcatgaagttgaacgaccaattcacgccagttatttggttcagcgacactcgttgcatgctatctattgcgtcgctgattcctgtgagtgagtggattgtttcttgatctcatatactgctcgtacgctgctcgctcatgcntcaatactaacttcataacgcatctgtgctgtgtgtacgcacgagtcccacgttgctcgacaccnatactgttaagcgacgttacggtgctcataccgaattcgtgtgtcttctccgtcctaactagtctgtactctctattacagcattctaacgttccatctctcccaccgataatagaattcgatgatatatattctatattctcatttgtaatatatgtccgctgtgtggtgttctgaaggtgtgatcttcactggtggttcgggttgtctgtttgttagatctaagcgtgctatgtcgtgttgcgccacgtcagccgttgcattccctattgttagttattcgtgtgtgggtttcgtcgagtacgattgttctcgtgtttgcattatcttgttcttaacatttgtctcgggtgtttagggtgccgttcctgtttttcacctccatctcttgagttattgtaatttttcggcgcctccttattccctcgacccccgtatcttcggtcncgttttcctggatcgtactcactgtgctattgtgctatatatacctgatgttaagcccgctccacgcctgtccttgctttatatatgtatcgtttctctttcgactaaagctggatagtgcactgtgcgatctgcgctctcgtactattatatgagtcaatct

SEQ ID NO: 7297 - DNA, 773 bp, Homo sapiens
  misc_feature (1)...(773): n = A,T,C or G
cnaatcctcactatggatgggctcattgaggacattaancatcggggggagggggagaggacataccnccnncaacananggaaanctatnaaaggtgccggcggatctacaacatggaaatgggtcncaagatcaacttcttgatgcaaaagaatcgggcanatccctggcaggggtgctgaggcctgtgggtgggacacccggggggggaccctcatccanttttctctccataaattttctttacacaatcccatttcctattaccattctctncaataaacccccatccnnccccttccctttatgaagggtaattcattatccctcctcactaactcactacactcaatctttccactaccaccacccttatcaatctcactaaacccattaatacctctttcccaaaatctacccataacccattacaaaccttctaccaaaatccacccaaacccccacaacccaataaaccccccctccttccctttttacataatctccccccccttactacctaacaaaactcaccctcacctcacattttcccaaccccacatcctctacacaccccacntttccccctcaaatcctcctcccacccttcctttttacaccctcccttttccctaacccatcccccttcttctctaacaacccaaacccctttactcactcccccccaacttcccactctcccactccacattatccacacatccttccccaccccccccctccacctatacaaatcatttcataaaataat

SEQ ID NO: 7298 - DNA, 973 bp, Homo sapiens
  misc_feature (1)...(973): n = A,T,C or G
ccgtgccaaccctaagaccaaaatttaaaaggtgccccttaccagggggctgagggggaagcaaacaaaatccataaatacaactactggagtgatatcaacacaccggagctctcacaaagcttctctccaacgagcaccgtggacctccctttaaatccaatggactgtccaggtccgatcatatccatcgctgtgaccctaaacaacaatcctccccattggggggggggctaactatcacacggtcatcctaaaaataacataacaagccctctccatacccttctttccccccgttcacaaagcttccacaaccgccaaccaagaaccaacacacaacctagtgctaagccccgtcgcctcttcgacgttgcccgccgtccaccaccccttgtctcccgcgctatcgtactctgccacctatcacccaaatacacgctcgccaagcggcccgcgcactctctcccacgattcacactcccccacctcccctctagacccccgcaatcacacttccggcgcagcactaccacaatagcgtactcagcaccactaagccatgaccgcatacgctattactcgccaacaactcccaatcgtctcgcccccgcgaccntagtcaaacacagacggacncagctacgcgcgcgtatgcacgaccaaacgttgactactcactaagcgacaccctcacgacaacacgcgtaatgcagaatccgcaatagcggtcatcaccaactcgcctaattcagtacactagagcagctaacaccctacactgtccttggttcatggctccgcgagagcgagcctcataagtgcgtaaacatcatgcaacactctccctccaatacgctcctgacagcgatatacaccaccaaacaacgcagtctccgctcaagcacgtccacgcaccagccacgctctccataccaagtgagattatgaattgaattatgattattgagtc

SEQ ID NO: 7299 - DNA, 340 bp, Homo sapiens
  misc_feature (1)...(340): n = A,T,C or G
gaagtgggaagcaggctgggatatggacacnacanaagagcggaagggcgccttattaataccnaaaatcctttccattttgtgtgttcttgaagattctctgagcaatattaaaatcaaaatatcagtgaagcccaagaaactattaacagctcccaggactgtgccctgaagtgagaaggaataatacaaagctgtggggggggaaaaagaggatcaaaaaccctcctcattctgtcatgcctcagtcattataaagttatgagtttgtgaaatctttagctcaaaaacttgattactgttaccattaccttgagttagctttggaaataaatataga

SEQ ID NO: 7300 - DNA, 861 bp, Homo sapiens
  misc_feature (1)...(861): n = A,T,C or G
tgtctaattaccccgctgaggggtgggcatctcctgtgcgcttagagcaacctttnnctcggggggtggggggggntatcnacactctaaatatactnagataaaaaccaacttacatacaaaaacaattaactngggcaaagggagatatttctttgtgcagattctgtgaggggtggggcaaaaatgtgtatgggcaaaaccaancagttccatttacaggggggggggttacntangtgcgacctnaaaaaaaaaacctttaaaaactctcgaaccccttggagaggggcccttctaggtgaaataaagtgtttatagtgaaaacgggcaggaaggggcnaaggagccaggcggggggcggaggggggggcgaaggggtgtggagggnacagggtcccgggggggcgcgttttcctttaaggggagggggattcaaggaggcctcggctcataaggcgggggcggtggggggttgaggggtgcgggaggcgggcttacctctcagtaaaggggggggtaacctggggctccccaaggtggggggactaacgcggcggaagagacttggggcccaaaggggccggaaagaggcgcgggacaccctaaaaagggggcgggggtggcggtgtatggaagaaggcgtcccccgctacgacgaggagatgcaaaaagagccggcgcggggaggaggggggagagacgccggacggggagtgaagagaccgcggggggccacggggaaggggcctcggccggcggtcggtgggacggtgtggggtgagggagggtgcggccggtttttctcgggaggagaggggggcgtttgagaaatacggcgcggaagagtgcgagagggag

SEQ ID NO: 7301 - DNA, 655 bp, Homo sapiens
  misc_feature (1)...(655): n = A,T,C or G
ccccaaaaggggggggggggctcctcctcttctacaatccaaaaaaaatacttttctttnatttcccttccccttcactaccctaatccaacgcacaattaaatctattaactacaacaaaaaaaattctcttaactacttttttcaccccccctaaaaccaaaaacttaaaaaatttnccatcacactttctatccaaattttacaaaatcccactaaaaccatccaactttctaaatatctaaattccctcttaaactataacacccctctttcctacctattttccttttaatacaaattttcttctttatactctttctcctcttactcaactacacttattaccccccccccctcccactcactatttttcctatcattaactatctacaccaactctcacccactcaccatcaacctaatccatccctctatctacctctcttctcttatcatccataccttattattatactctcacattatcaactccctacaaattatctattctccctctcaccatatctcaccacataacctaatctcctaccttccacaaaaactaccttatcatctctcattttctcttatctattacacttcaacaagcacccatcacaccacctacaaccaactatactacacataatat

SEQ ID NO: 7302 - DNA, 797 bp, Homo sapiens
  misc_feature (1)...(797): n = A,T,C or G
actctttgacgttggggagactttncaatgccccnaaacttagtccgggggaggggaanaaactaaaaaatcaancttcgctgaccaacctaaggcagaagtacctgactgggatttcaaaccccaggggggtactggggcccatnacctagaaaggagggaagggggtattccagaatccatagaggttcanctggggggggggagtntcaantttgctttttaaaatactatctcacctttcnctnaaaaacctccctctnaaaaaatcctttccataatcacnggntctccatcatccttccacctaacaaactttaatntttcttcctccacaatcntacaaaacttttttagaaaaaaaacctaaaaatgtttttttttcttccacttaaccacactttnattttcnattttctaggtaataattatctttaaaaccctaaatctttccctaatnaccttantccttcaacctttcccaaacccttattaaaatctaaatttnaatcaacaaaaaaaacaaattccccccctctttttaactttccaccaacaaaataacccaacttaactaaatattccttttcaaatctctaactccacttcnacctaccccaaattaantacacttttaacccaaaacctcttttatctttccaaaaaaaccaaaaacctcttactcacaaataaacctcccacaaacaaatctatccccacctttactcttaaaaataataattccaatactcccactccttccaacaaaacntaaaaataaaattacaaaaatataa

SEQ ID NO: 7303 - DNA, 349 bp, Homo sapiens
aaaattattagtttaaccctcacacatttaattatgccttcattaatctcccgcctcccaccaatcaaacgcatttaccataatcccccatcataacccaaaaaacacttacctctttccatcctccaatagtataaacgaaataaacaaacccctacctgatctaccgtatctctaacaccacatctactacatctctttactaccacctccctacctatatctctttatatacatctatcttcactttcaatcactatcttactaaccaacacaattcgtacaatctctcaccccttcacaccccgccatacataccaattataatctcaattataaataaattaag

SEQ ID NO: 7304 - DNA, 793 bp, Homo sapiens
  misc_feature (1)...(793): n = A,T,C or G
ctctctaattaccccnctcacatggggaaacagggtccttagactctnagcaacttccccaagggggacggggggggaaataaaaaanctnanacaanaccanccancacttacccaccacngggtgatgctgacgttagaggacaaggacatgaagggattctcctgggccatantcccanccttaacctccctaggctacctnattatactgggngtctgggggggggccttctnggtgcgactnacaaacaaaaagtcccacgaagtctttttcaggggcctatttaaaaactgcgttaatgccaaatgctggaagcctccacccttatccatttacatcatcctcggggcgggtttcctgctttctggaattttcttgggtttcgtcaccaccttcatcatgatgccctttgcgtccaagttcttcccaagggacctggaacaaaacttttgggttaagcctgcgtcaacttgcttcacaaggggcctgtgccgttcctgggttttgggcgtgatccccctgaaataaagggtctaaagagaaactcggcccctggaattcttcgtgcgtgggcttataaggggtggggttaggatttttttgtcatagggggggggccattttgcttattaaagaatggggtgcctttgtgggactggggggaacttccaaagagggagggggggcaccgggcccttcctttggaatttgaaaggtgggagaggaaaccgctaaagacagaaggagcaggggagagcggaaacatattgtacccaggttggttttttt

SEQ ID NO: 7305 - DNA, 860 bp, Homo sapiens
  misc_feature (1)...(860): n = A,T,C or G
aatagctgcagctgactgctcttaattataccaccgctgcagggttcatgtccttancaagctactgagtttcatgctacaatnaggggtgaggggggggacanaactataccnctctctttttngccanctccaccctcccgacgaaggccacgggggattgacatcncccacctccgacacccagtgggcgccttgggtggggtggctgctggtccaaatagaggaaacctatgactttatggggggggggtaatanaanaacccctnnaaaaatactaaattccaaacctttncctaatacacncaanncnctcttttcccccctaaccccccctttaaacnccacaaataaaanctttatcccccctcttccctttaataaaaattaattcataaccctccctcactaactccctncacttcatcttccnccttccccaacctntatcacctcacttaaaacccatattacctttatccacaaattccacggataaccccaaaaaaaacatttaaccaaaaacccccccaaaaccccacaacccctaaaaacccccttttcttcccttattccattcaccttcnccccccttacaaaaattacaaatattcacctctcaattcaaaaccttccaaacccctacaaaaatataaaaaaaccaaacttttccccctaaaaacctccttctaccatcttttttttacaaccttatccatttaccaaaaaccntatcacctttattccttncaaaacaactattccttctaatatattcacacttaaattttctcatatttnntaaactccttacattcaaaccntttatataaccaaaaccctcttcaacctctcctta

SEQ ID NO: 7306 - DNA, 741 bp, Homo sapiens
  misc_feature (1)...(741): n = A,T,C or G
ttcacttgttcgtaaacatttacccccaatttattcagagttcacattatcccttntaagaccataacccaccacatctagaacttatcaaacccttttgtgaaaatcttgaccaatggctaagtaaagataacaatcatgnttccaccaattcactgttagactnaaaacggaccaccttgtaaaaaaatatttccatatttattacatccgcgccaaatttttaaagccacaaaactccctatatttctatgggaaagtaacccccacacacaaaaggggataactattccccaccaaagcccctatttttttattttcctcccttttaaaaatcttctcaatattcacccgtccccctttcttttcacaaaaaagttttaaaactattccaattttccggggccaactctcattcctcaattttgcaccctccctctaaaactaaatttttttcccccaattcacccccccctcccaccaaaacaagttcttgcctttatgttcccctcaccccttcctcttttttatgaaataaaaaaaaatatcttcccccaccataccggtttcttaaatctcctaatttctcttcttggctcatcccttctccctccccccccccctatctcctttacaaccgtatccgtctcttccctcctccaaccccaaccctctcctcctcatcacttcactattccccccactccctcttttcttttcttatttttctttccatacatt

SEQ ID NO: 7307 - DNA, 783 bp, Homo sapiens
  misc_feature (1)...(783): n = A,T,C or G
tgccgaagaggctatctgggaagctcatcatccanctcanaggggatgaggggggganacaaaanaatntcanncatnaccccacacttntgcaacanccacntcctgctcctgccattagcatgggtcatccgaggcccagccccaagatccatacaaagggggttcctgctgctggcttctcatctgctctgcttcctaggggggggtctnttnctncntctnaacccacagaatatcnaaatcccaccaaaatntcctnccancaaaaccaacancantnccanccccctcccaantntcctatccccaantatcccccaaaatntccctcaaantntncatcctcatccccacctccaatctcttccttctntaactccaactctaaaaacttctataactctaaacactttnnttcctccaactcttaaaaaaattcctccttcctaacccaccacaaacaccatanntcccactaccacaaacccaaaacctccaattcctataacaattccactccccacccatcttnaatttctccctccttctctaaaaaaaccttttcttaccttnaccanaaccaccccaaattatttatttcccaaacaccctttccacctnntatttacctccttcatcttttcctttccttcttaccccctcattaaaaaacccaaacccccccctccctttaaaaanttaattataaacccccttactaacccattacctcttctccacttcaaaaaccttttattttataaaatcttaatacaattc

SEQ ID NO: 7308 - DNA, 902 bp, Homo sapiens
  misc_feature (1)...(902): n = A,T,C or G
acgggtgcgaggcggataggaanannnnnaaaannnggggagggagaggttaagctgggactggctgctctttaatttaaccacctctgcacnaatcaaagaagtggtggggctttaaaaagttngatgactacccctgggctgggggggggganataatanattctnttncctnngtaccaccaananggganacttggggcggggggatttattcctgttaaccaagattatgtgctgaagtctgcaaagcttgcaaaagctggggggggcaaacatttcaactttctatcctgggggggggggtataaatcaaccaattttttatatataaanttaaaaaaaacntacaccccaactttnaacaattaaaatttcatccttactcttattttaacccttaaattcttttatttaataacaaaaatcttccccatttaaattactaattaaaaaatttttttttctctttccaaaatttttaccccataaccacttctttccctttacttacccctctttaaacaattcttatcaatttttttaataccaaaaaacatccctatttaatctttcttaaaatcaattttttccttaacttcaccaacacccctatctttttttaaacccttaaacacatttttaaatattattttttttttctcacccctacctacccatcttcttatttcctatctttaaattttaaataaacttttaaaatattatcacttatcatattcactctttctttatccttccttctccctaatacaatcactcctatccttccttcaactatctctctcctctttattatactctcatactacattatctctataatatccccaccccccccacatcttctcttcattcattcttatatttatttttttact

SEQ ID NO: 7309 - DNA, 848 bp, Homo sapiens
  misc_feature (1)...(848): n = A,T,C or G
cgtctnttgaagtttgctgggggtccactccggaccctttttgggggtggggggccagcaaanactacanaacancaaanattgcttcctgttccctcctctggaagcttcgtcccagaagggcacccgccaaatgccagctgggactcttctgtatgagccccagtgccaaccccattctctgcatctcaaattcctcttgagggggggggcataaaattctaacaanttttnacataattaatataccaaaaccacaaaaaccctcttaaaaaaacacaaatnnggccaaatntnaaagggggcggccactttaaataacagctcccgaacggacaaaaacggggctctcctcattatgtgcatgggacaccaaatatgaagaaattcaagccttttttaagactgagaacctttttggggcgttatattgcattgggaaaaaaatgtgaacatttaataaggtacattnaaaaaagtgcccaaaaccaacaccttcaagggccatttttagatactaaccataatacattcgaaaatggcgattcccccgttcagcttgaacaccgcggaagaagaaaattcctttttgccttggcttgggagggctcttctgggtcgccggcaaattntccgaaggggtttgaaatttttaaaagaacctggggacgctttaagcacattttatctctgaggggcttatgggcacttttacttcaggagtgtgggatttttgctaataaaaatcctaaactttattgatttattagtctgaaagcgcaaacagctgttggagattggtgttgtggagaaaatgggcgaaaacgttctagtggattttcaggcac

SEQ ID NO: 7310 - DNA, 892 bp, Homo sapiens
  misc_feature (1)...(892): n = A,T,C or G
agggggggagggggggncanananaaaaaggaggaaggaagagtaggctgcaacgactgtcttattttccaccgctacacgcccatccggaatcacacttttcacctgcaaaaactcatcannctggtctggggggatgaaaaaaaatccaaancccatgttgctcttttttaggggggggctgaggaatgttcccttcaactgggatgcatcccgggtgagaagtggtttttctacattggccaatataagttaaaaaagaaaaaggcgtgttcaattcaaggggggggacaaaaaaaatccagccccttaacaaaaacaatcccaagggtaaatgggggggggcttatacagcaaatgcgagcaggtggggactgcgagaggagcaaaactattagaacttcctacacatgaagagcagtcccaagcgtccaggggaagatgaaaaagctgtttgggttgaagacanactttttgtgaaatcagtttccactcattagagtanccttcttgggcgttaaaaaggcgtggtcaacaggctncccagagccttctaagaaagaggagcaggggcccaatcatccagaaacgtgtggacttcttctggtcggatggagaagaattccagggtaaggatggggtaatggccaggctaactaacccttgagaaatagggtgganaaatggagtgggcgtggcttctgagtttttttttagagagtaagaacccaacgtttcagcttggccatatagcaagcggagagacaggtggatggggtgcccttgctcnagggtgcagattgcgtttaaaagggcgctggatgggnaacgtggcttttgttaaggctgggctttgngaatactttnagagaacgcgttagtgatgggtgtt

SEQ ID NO: 7311 - DNA, 734 bp, Homo sapiens
  misc_feature (1)...(734): n = A,T,C or G
atcataaaatcagttgctctttttcctggttgtttaaaagcttctccgaggttattatttacagttcacagaaggacaacccaccattttaagttattcacactagtttgtaaagaacttacaactcataaagttaagtggaggcanattcttccttatctccttctattttctgagtagcctacaacctagagtccatggttttactattacttttgctccactgttataaattaantacacttttctcaagtaggggccaagcgtcctttggtcatgaagagagtgatcttttgccctgtgttttgttctattactctttaagagagtcttaataacacatggtgaaaattcccttttttgtaagaaagaaaaaggtttcacacatttgatttgatacaaaggtttgtcaagttaataactttcctttttctaaaagatctcacatccttatgtgcacaatcctactagtttattttttatggacaaattctattcctaaacaacttccattctttaaaaatgaaatgtttttggaattaattatttattttaaaaaaacttttgacaaaattcaccaaaaatccctggacttttccaaataccatccacccactggacccttactaaaaaattccggaacaaagtttaatccacccaccaaccctttaagccctgaatttaaaaaaaacaaaccctnttcctccctaatagcgagggcatattaaaatttt

SEQ ID NO: 7312 - DNA, 828 bp, Homo sapiens
ccgtcaacctccacaagaaactcaagctgccttcttcagacctcagggggtggggcggtgctataacatacccttctcaatctaccatttcttcccaattcctaaaggctttctatgggatcatctggaattcacagaaagataacaggggagtcaaaaactacagggaaagacacggaagtagaaggaaattcaccaagatcaacgggggggcggcttttcacctgggggggcctgaccattgcagaaaagggatgggagagtgtaatcacctgaacggagccttcagtgggactctaggctaaagtgtctacgggctcgagggggggaaaatcgcaatatattggggggcacatctgataatttccaacgtggcgcctgcctgatcagggaggggtaagtgcgtgcgagatgtgcctatgcgccctgggggggggagacggagaagcaacaggcatgaggttgtgaggggcgggggtcaaaaagggagtgttacgcgggaagggggagggcgcgacgcttgcggccgtggtcggcaccaggggaggggcgtgggcgagagctgtgagcatgactcgtggagggggcgggaccctctgggaggggcgagggcgaggtgccggggggcgcgcgtgaggggcgccaggcgcgaggtaggacagaggggaatgcggagcggggcgggcggtgcggaggcagcgggggtgggggggtagggagggagggaggcttgagtaagagcgggagcgaggggctgatccgggacgaggtcggggggtcggatggaagcggagtctcggaccggggcggacaagaggggagtgaggg

SEQ ID NO: 7313 - DNA, 1085 bp, Homo sapiens
  misc_feature (1)...(1085): n = A,T,C or G
atattccaataaaaaagacggggntggacggggggggggagaggtaaacttcaacgactctctttatataccacctctacacactatggaaataatgttaaacaaaaaccaaattcaaaccattttgggattcgggttcaaaaaaaaataataaaataccanaaacaactcncaacatcaaaaatgcatttgccccacaaacttctaataaaaaaatgtacactccattgttgattcaaaaattttttcaaaacaaaaaataacccttaaaaatcaaatatcctattgggggggggggtcaataatttttacaacatccccaaataaaaaaaacctccttgaaaacctttttccctccttaaaaaaacacataaaaaaattgtggccccaaataaacctcaactcttacatctcttttctattggattttttacttctctataataccaacattcagaatactcataaaaataattcccaatataaatatgattgccttaccacaccctccaatacaaacttataaactaaaacaccctcgcatttctaaaattttaattacttctttacatccaaacaacaacaattacaccaaacctatttttcttgctataaatattgtatttcacaatatacagagttatatatctttaactattacaacccatcagtgaaatgaacccaaacattacttatactgtctcacaacaaaaaataaacatcctcacacacccacaataatttttaatctattaccactaaaatatcctatattcattatactttctaatataaccacgcacgtctaataaatgactagtaaaaacatacctataatatcactcaattcacaacactattatttctctaaaaacacactccatttactagaattaaacatcattatattcacttataaaccgtgacattgcctttccacatcatcactattgtaatttcattatatcattcattgtcaacatccaatcttctctttactatcctacaaaccgtaaccaacacacacttaactatataaagatatataatggtttactaacacaactactaaatactatcagaac

SEQ ID NO: 7314 - DNA, 283 bp, Homo sapiens
  misc_feature (1)...(283): n = A,T,C or G
atactcggtactgtgttatttccaccctaacgggagacctaaaccccaattnnccnncctcattnnncctcaaggccccgggcctcaaccccttcctngggngctttcttccgggggcccggggggccctttccgcgcctccctgggcccggggagccaaactggcctgccagaaccctgctccaaagcccccaaaaacccaaaaancccccggcggtgggcccacctgggcaaaaaaacgggggggggcnacccaagggcggggcctgtaaaaaaaaaaaaa

SEQ ID NO: 7315 - DNA, 274 bp, Homo sapiens
ttttttgcaatttttttttttttttttttttttttttcttttttttattttttcttttttttttttttttttttttttttttttaaagcattgctaaaaactgtttattcttgtgagatttaagcacaaaatcaattatcaacaagaattagtaacaagaggattgcaaactgtattccttttaaaaaacttgctcctccttactttcctttgagttttgattatgttcttctgcaggtatttgtctacacattaccatgggcagcaaatctag

SEQ ID NO: 7316 - DNA, 815 bp, Homo sapiens
caatcaagaagtgggggactttgaaaagttggatgactacccctgggggtgggggggggatgatataaaattctgttgcctgggtaccaccagagggaaagctggggcggagggatttgttcttgttgaccgagattatgtgctgaagtctgcagagctgggaaaagctggagggtgcaaacatttcaacttgctattctgtaggggggggggtaaatcaagcattttttatatctacaagttaaggggagaatagaacccaacgggggagaattaaaggttgatcggtactctggatttaggcctggagttctgttatgtggtagggaaaaatctggcccaagggaatgggtgggtgaaaaggtttttgggatccttaccagactcttggggccgtggggcattctttggcctggagggaccgtggtaagggcgttgtgtgacaattggggggaggacaaatagacgatcttatggaaattgttggaaaacgggggcttcatggactggggaaggggcatgtggcggtgagggcaggaggacggtgggaaaataggggttgttaggaaggctataagcggatgaacgaggtgggggtgtgagagggggtaacgggaggtggggatgggggaactggtgggtgatggctatcctgcgggttccattccgagtagaagagaggtggggactggaggtgaggatggaggacgcaacttatgattttgagagatctggagagttgattgattgaacgctcagggaggctgtttatgaagtgagagtgtaggggtgcgagagagtgtagagagggcagt

SEQ ID NO: 7317 - DNA, 1213 bp, Homo sapiens
  misc_feature (1)...(1213): n = A,T,C or G
cctttgccacgnttatcacacgtactcactcatttaatccatcttcctgacgtgaggcagcaccgggactgaatttgcacacggagggtcactctatcatactagtcctaccatcgatactccagaagcgggcgatccgtccgtgtccgctgtcctctaagacgcgaaccaccctccgccgtttcatcgcacccgcgcgaatcgggcgctccggacccgcgctccgattgggcgctggggcgcgcacggcgcgcgaggccaagcgagcgagtgcgcgacgcgttggtcacacttgcacatttaancatactatcctcacttttcatctctccggcagaccgcctgtacgagtgggtagtataaaacgtacgtctcgatcaagcatccgctcgaccatcgcgcgacctgtcagctaatgtactcgcctgcctacatgccagcaactgctcgtgcgaaatcaccagaataacaagactggtaatgagcacagacgcccatccgaaggagcgctctcactccgcacaagcagacacgcgtataacggtaatcatgagtcgattattaatcactattcgtctactttatcgctctagaactgcctacggccagcgcaagcacttaaaaatngttgtttgagggatgtgttctctaatatatcactgtctaataacatcgttangactacggatgacgatnagatcgctctttctgtgtcatatctacgtataatactttcaccccacaccgtcccactanctcactcaacatatctcnntcttctaatcctcatattatcactcgtcntattttcatatacttactcttttttttcaanattatctgcactcttatctctttactgctctccctacactatcaaattctcncctacttactaattcttactcataatctatatatataaagacncacacacacgccacatcccattaccgcatatacgcgaggacgcatgaatagcgacgcatatctccctacnaccaaancanttctncaccacgtccgcccgccccccacatnngantnaccacagaanccaccgccccacacngaaccgacaacaanaaatntcaacgagagtcgcgagacagcatcgaanaccccannncaacaaaantnnacaaaagcctacncnnncaantanaanacctccaaccnccaccacnacnacacaagaaccccacanccannt

SEQ ID NO: 7318 - DNA, 228 bp, Homo sapiens
ggggggggtgcatgcctggtatcaaagattcagaatatacagaggagtatcaaaaagaaaatggaaaaattgcctataatttcgcctctcagtccgaaactgagtgaagattggggataaataaacattttatttgtaaacaaaacgggatcatactgggcatgctggtaagtgcacttcccatctgcattagtccattttcacgctgccaataaaaactgatgccgg

SEQ ID NO: 7319 - DNA, 904 bp, Homo sapiens
  misc_feature (1)...(904): n = A,T,C or G
gataggcgtgcagcggactgctcttaatttaccaccgctacaccaaagtcccgtgtgggccaaagcgtagagcttccacantnaccggggctagcggacagatcctaagatntcctcactgtcacaagcaaacgtggccaaagctctcgatgccggggctcctgccagaggacagaggaactgcattttaagctgatgggttgcatttttaggatactatgagcaaaatgcgaacangaggccagggtgttgtgggtngaggagtgcatttctgcagaaatgggaatgctccttntggtctggagcttttcctccctaaacacatcatttacttaatttgatcaaaaagagctggttttgggacacgtgattttttttttatggccatcattactaatcttctaccaatgtcgctcttcccacaacaaaaccttgtgggaacggggatttttaaaatggggagcacaaggtgatctacgggaaggctcgagggcacaggcggtcgtcgttaaagcctcgaggggaccacttgattcgccccctcttccctgggaccctgtaaaggggggggangcaagaagcgtattggcataattattatgaaagatatgcgcgacgtgtttcttaagaaggggggataaatgaaagaacgttggagaggaggtgaggggtctgatggcggtgtggggtttgtcgggaggagagtggtgggggggcgagcagggctgataccgccagtgcaacacaggacgacggcgccggcggagtgcgaactttcgggcgagggcgagcggatggtgttgacctacggaaaggtgagggcgagccggatcggtggngcgggggacaggtggccggtatgggngtgagactgaggaagggggcggatggagagaggtggagg

SEQ ID NO: 7320 - DNA, 804 bp, Homo sapiens
  misc_feature (1)...(804): n = A,T,C or G
acacggagcgccttcttttcgtttagagcattggtgtctccaggttaggggcatcctatgtagctgttctgcttgcagctgcccaagtctgcctgggcctcctgcatgaggtcatgagtcttaataaagccactgacccacacatttggaatcgtactgacttttcacaactaacagccaacacattgccaagaagcaattcagtgggtgaggatatcacatcatgccagggaaagagagatggaattcagaaagcctgggatattgcaggtttatcctgacagtaacctctccccaggtcggaagacctctcaggctctgtttctagggaggctgacctgctgacaatgctcctagctggattttgtaagcggtcttgaataaagtcttcctcactgttttaacaagagacaaggtaatgttcattgaacatcttatacaaagaggaaacctggcgcagaagtggacatgcactcggagggaaaatgccaagtgacaatgaaggcagagatcaggtgatgcatctgcaagctgagcaacatcaggaattgccaaaaaccaccaggagctggagaggcctgngacagagcctcccacggagcctgaagggagccagccctgcccacgccttgatcttgacgtccgacctcaagaactatgaaagaacccatttctgttggtgaaggctccccgtgtgtggtcccctgtcctggcagccctaggaacctgacctntggtccctctgcatccctggcatcactctgcctccctctctttttctccagggaatccacacactctaag

SEQ ID NO: 7321 - DNA, 835 bp, Homo sapiens
  misc_feature (1)...(835): n = A,T,C or G
ctctctttaattatccaccgcctgcaggcgagccanctccaattcaaggattttagattntaccttaccttggggcacgggggagnatatnaatcaccantacctatnaatgccgtatatgggcntgattaagtacagtccatccancgtgtcctcccctgctttgtactcaagaagatgttgaggggggaaagtctcccctccgtgttctgggtgagaccccanattcctggggggggcatattanatacgttttgcaacaaaaaaaaaccaatacaacatttttaaaagcttctaaaaaagacataccccctcctcctgaagaatgccttcaggtcctcagcagagccacccaggggttcaaagagcantacattctcaaacaggacttgggcaaggaggagattcaccgagggggtgcaattattatggggaccaaaaaaggaacaactccaagatttctttttttggcaaagaaaaaaggaaaaggctgcggggaaatggctaaccttttacctagcaaatttgagggggcgtaaagaaaaacacggggggtttcttgacccgggtgaaaacactacttcccagttttcactcttagctcccagttctttcttgtggggagcgaaacttgaaaagaaagtttccgctgataccttatcaatttcaacttttggggaatcgcgctaaacagggttctattaaaaaggattttcaccccaaaaattgggaaggtggtaggcttccaaacccaccttgttctaatgccaacagacaagtgcttccgccttctaagagaagggggagcctttagggggtggggaaccattatttt

SEQ ID NO: 7322 - DNA, 804 bp, Homo sapiens
  misc_feature (1)...(804): n = A,T,C or G
ttcccatgagcatgagagaagaagcaatgcgcgctccnncanaggggtaggggccggtacctctaannancaccanatttcancttatgggatgctttgattgctctgtggctgcgtttaggagaaggaggctgcggtcatgcgtcatcactgccagcctcacatctcttgacagttaaagccttaggggggagcaaggggggggggggaataacaaatgaggcaaaagcaagaggtgatgttccaaagcagaggagggctaagtttatatatacaaatgtcaagggtgtatagtgcaaaactaggaccaggtgggggaatctgggggcaaaaacaaaagccttcctttttttttttcaaggcccantcccaagacgcaagaccacttgcgccagcagcgggcatcancaagatagcaaaagcgggacgagagctgcccggaagacatctacctggccagaaaacacctaccctgggcggaagacatgtacccctgaagatagagaaagaggcgctcggggactacggagcagtcatgtgagactgggacacttcctgtttacagagggactataaacccctggcctggcctcactggggggtggccgcctcttaagcgctaggccgcctgggagccaggggtgcggtagaaaaggttgggggtccacaccggcttggattggggggggggcgcactctctggggttgaacaaatacaagccgcctgtagagcggggtatgcgtgggggcgtgagcccccaaagactcctttctattacctctggcgccaaaaggcttatgtgg

SEQ ID NO: 7323 - DNA, 226 bp, Homo sapiens
ctggcctagcttggagacttccatggtttgtgggcagagcaagagcctctgagccgtttctgccagaaacattggacaagagctgagccaatgaaggacttcagaccatctcttagacacccggggcactgtgggcgggtttcctgtgtgtcactccccaactgctgctcccctggccataagccagactctctcatgccaataagcaatggcctcgttggcctca

SEQ ID NO: 7324 - DNA, 147 bp, Homo sapiens
ctggtatcctcctctcaccttcagtgcccggctgcaggaggtaactccctggtgaggaagacctaagtatatggccatagattcataaggagaatggaagagaaaagtgcttttaaaagtgataaatttgagaaaaactttcagatg

SEQ ID NO: 7325 - DNA, 1408 bp, Homo sapiens
  misc_feature (1)...(1408): n = A,T,C or G
gtttcctcgatcctcatctctctcctgtccgtatcacgcaccccccttcncattataacccggccaatgcaccaagcttttattgcatcgtcttctcacagaacaggcagtttgaaacattccctgtatcatcttcttatcaattctacacaacactcttgacaaatagactagctatatatctctccaaaacctagtgtctctaccagactgctcggcagccactcagagtgcgatagccaagtaccatagcgtaccagagcatagcctctgcgcaagtgcaaccgtacacatcatcgctgttcccttgcaacctcctctcgatctcatctctatcaggacactctgaccaacgcatttctcctccccctcgtcagccttaatacgcactctcagagaaacatcgccgccgctcactcgcttcttaccacactatcaccctcgtccatctctcactaaaccataaactaacaccctcgcctctgtcccttggctcttcacccggtcgcgaggctcttagcggtccgcttatcctctttcatcctgacagctctacacaacacgcataccatccgtctcacctagacctactctaccccctcgtactcttctccgcctctgccagtcacacgtctcttcaccctaacttcaacaacctcatgtatttaccggctccttctcatacgaatctctcgtggcttcgcgcccctgaaatcctaccatccccgtgtctacaaaagcctctagcccaactcgcccgtcgtcacaccgtctctataattagccctcgtatcccctcgcatcttaatctcaccacaccgcctccgtgtcccaccctgtcccgcaccagcaacccacaatnctctcgccatcttctattgacgcntacagtatgctccgagtactctcaacacgcgcctcgtcctaactcaacctcaatgccatctattcactgctattctattatnctctctctaccactctcctcctacgctactctactccctatgccactncactccgcnctacgcgctccacacatcatctctctatctctctacagaagacctcagcgctcgttactactataacttcacatcacgcagctgcgcgtactctactccactgcgcgcncgcntnctcacatcatcgctctctattctnantgntgtgttatcacttaacagagntctcgtcacgtataancaatgntctcgtgtcgaatctctgatatcnctgataccactctcgtagctcatgagtctcgaatctngtngcctctaganctcnanaagatcgttctgctctgtcgtgtgcatctactatcagttatcatcgtgactacttcatatatcatccactcgcattgnttatgtcgctacgcagctcacgcacccatcagcacacc

SEQ ID NO: 7326 - DNA, 1380 bp, Homo sapiens
  misc_feature (1)...(1380): n = A,T,C or G
ccggtgcgcgcacgtacacaattcactataaatctgcggacaatacgagtgancgacgtatgtggagagatcaatatcgcgtgcgagagagcgcgantaactgaagantggcgcgtggtatcgagttcgcgtggtgagcatctacactccgatccatatatctttctcgcgcccgaagaagataacggtggcatcagtatatgngagaacagcgcggcggtcagcgcgtgactgtgataggtcagcgaatactgcggccaacgtcctcatcatgagactgcggttgtgtctcggtgaccatgagttgattatattgatagatgaaacgcgcggcgggtcatcactacatgtgatgcacgagacagcggcgaggtggaatatatatccacaatcgtggaccaactcgtagngtgtgtcgtatgaataatgtcactcgcggntggctaatggctgtttgtatgtgggcgggtgagcgcactacgtgggccgccaagaagacacgccaggagaaacgcgggcggtcagacctgttcgggaggcgtcgcttaatcgttgttaactgccataaccacgtactcgtgtaagcatcgtgatgattaggtaacatcagaagaggcacaaataatggagatgtgcagtcgacatgcgtacgcaatgcgcttcttagaataaacaacaactatatatatatgtgatggacgaggtggcgaacgcggtgagagccatatgttgtaactgagagggagaatggcgacgacatgtgagagtggcgctggtgagtatagatatataggatgaagcggttgaatgcgtaatcgagtgtcggtcggaggtggaatatcgaagttgtgagcgaagagtagtggntgataaacatcgataccggagatcgcntcangacatgaagcacgatgatcggtggcacatcggtgcatatttggctggcacaccggacgagtgcgcgggatgagggagcgacacataagatacatatcatgtgcagactgatagaactgagacgtgatgttatcggtgggcggtaatgttagatgtcgattcatgacagcgcggcgtaccgcacgactacactatctatataatcattcatatagttcgggacatagcggtggcgggctctcgcttcncaatatggtcgatgtgagagtgggcgaaacaacaaatagagatacggtacgatcacacgagtcgcggagcgccggcgcgactgaaccagtcgcagagccggtgtcatctccgatctggactgcacatatcggtggcgggtgggaacaaggtaaggacagcgctcgatacggacaaataccgcaacatcaccattgatagccgggtggaagccgcacaagttagancaccgcgcgg

SEQ ID NO: 7327 - DNA, 187 bp, Homo sapiens
gtacgtgtccattacaggcattatattggataggagaaggagaaaactaggtggcaacaaatgggggtcccctcgttgggcagaaactgatcaaaggcattccctgggtttggcatgactggactgagctagcgcacataaagatcatcctttacaatggaaagaaaaagcggactcgaaggcctca

SEQ ID NO: 7328 - DNA, 1027 bp, Homo sapiens; identical to SEQ ID NO: 6268
  misc_feature (1)...(1027): n = A,T,C or G

SEQ ID NO: 7329 - DNA, 1728 bp, Homo sapiens
  misc_feature (1)...(1728): n = A,T,C or G
ccttacaacctgtcacatcgtcaagttctccacacagtatacataatatcacactcactaagtatgcaaacatgtactcccactctccctcgctggntacctaaggtagaggagtagcaatcacactcttatgctccgnctaacagcaaagaacatatacagctatcgatagccctcatgcagcagcacagtcatgtatcactgangagggtatngtctagcgagaangcatctacgcntnaggaccacacaattactcgttgggncacncatagtgttcctacacaactccctcgcnactgcgcttgtgcatcacacctcgtcctctactatactaccactagaagcacctcgagngtagcctactcaatacgcatgtaccaattactagcccacgtgctaccatcgattaaggctcagctatctntgacatactatacaacttactaaactcataaacaagcatcattatctcgacatctcgtacgacaacgacgtctccnccactcacacacgatatcgatgcctaatatnaccctacacactcacctcattcacatcttcgcgtcttatattcactacagccccaccctnctcancactatctctcatatatcgtctgcaccctatctgtcatattcnatcacttcctccttctctcctccatcacccttctcaaccacgctcctaacacctaccgctgcgctgccgtatatactacacatactctcncctcatcacactctataacacacgatcacacanttatctccatcctagcgatctccatanatctcgcgctgtataactaagaatacgtagntcatacacgantnntacgtccatctatacaactcttctcnactaaantatgtgcagcncgncntcactcgacgcatatagcgcacatcaatttctacatctcgccacgtnagtacgagtaccnatctactaactcatattccagctgctatcatacatcactctctcgatatatcnacacacancacaaatatgagtgacacgacncttnctgactnctatgagaatattngtatatcaganctgcacanaccattactncnctntcacagcagactaccagtcatnacatcatacacacntcatgacagtacatctatcaacatatcagctcacgacgatacaacnagctcatcccgactcngatcanacantgagtaagtagtgtaatgntagagtctcntgtacgtatcacacaccagagncaancntnacaanactatcaacacgtctncntccnacactcatcatctagtganagtcttgccgtcagtgctncatatacgantcatctgatacgnagatctcatcntantcatnatacgagtagactcaaatatgagnatcagagcgcaactacgatcacatactaatgnatcactatgacncngatcgtantctgtcncgatgctcacgatctgactgtcagagctctgcgacngtcgtagcntgattagctactancaganagtagtcgtncgactacatcatcgtcgtttgctctctatcaccgatctacaaantancntcctcagacgcatcaccntnactactacatctgantnantcacgttcgattnatgtcatacgatcatctantatcatctcagtactgatatcttcatctcctnatagtgcntctatcgctacagaccgctatgtactactacagnactgtatctacaa

SEQ ID NO: 7330 - DNA, 517 bp, Homo sapiens
  misc_feature (1)...(517): n = A,T,C or G
tggtactttgaagatgtttcctttcccttcgaagagttcaatgtccgtacatagaatgaaaggtgccatcttctccagcatgagacatatccccatgtgatcccttaccacgcagactcctggctgagttaggaagaaagaatagaagtcaatgcattccatttgttttcaaggcacacccaaaaagtatgaacttagatatatcacagagcttccaatttacctgcctgtatttacaaaataagtgtatgatttctcccgaaacattattttttgcaagttacatgccaataaccaccactgaacataagctgatatttttgctgaatgaaggattgtgaattatccttgtagctttctttgacttcattacacatttcaattacttctctaaacactgactgccgccataaaatatctttagttcttttcccctatgaaatgtgctgccaataataatattttactagaaaataatgcaatanattagcatgatcacaacctaaaaaaaaaaaaa

SEQ ID NO: 7331 - DNA, 1061 bp, Homo sapiens
  misc_feature (1)...(1061): n = A,T,C or G
ctccaccgatgtggccactgaggccatttttttttttttcttctcttataaccatatctactatcttgatataaacccctacagcgtacacagttatacacgtgaacaagaatgacctctagccttcacgggagagatatattgtttgtatgaacgaagagggactgtagtaatgaatgggagaaacaagacagcagacaagtgactctgtgaacacacacacataagacaggaacagcacgcgcaccccctcgttgcaccatccactaccgaactacaacacccctaacaaacagacgaacgacactcctgcctcccttaaaagaccaaacacaccccaagagattggtacaatacccacgtcccactccatgccctccctctactcgcccatacctcacacaccacatctcattcctccacgcactcctctccgcttatacctccaccccgtctccgaccttgataatcacctacaccgccacacaccacacatatcacacagcacatcccaatcccctcctaccctcccactcaccactaacaccgcacccactccactcactcactacaagtgctcgcgcnacacattctttctatagttttgataatactactgtctaccaccgccagctccctctcccgtcctccgcctcggccttctgcacccctctacacacgacccaacacgcctcactcacctcctacccaccgcttcacctaccccgcccgcgtccaccaccgtcacacgctacatacctccgatcacatactagtgcaccacctctctccttatccaccacccctatcntcctcttctctcttaccttccccgcgtccctctcgcactaccgacgacgccttcagctctccctcatctcaccgtcactcaaccctcactctcctcgaccacgtccctctcccgtcgagtcatcatcatctcactccgcactcctcctcccctcactacccccatacactatcctctcccgccgnctcacgcgcaactntccgtatcctaccctcgacgacatcgcacaccacccatctctccatcccat

SEQ ID NO: 7332 - DNA, 886 bp, Homo sapiens
  misc_feature (1)...(886): n = A,T,C or G
ttccacagttcgactttgggcaggctgttttatttcccccggtaagctttttgaattgggaggcatggctcattgggtgaggacttgaaggaaagtcaatggctctttggggtaagcaataacaggggggaggttcattaattttttttccttggcggtgatttgacaccccccagatcagaagaaaagtccagggtgaagtggtgctgatctcaatgacctttacagtttgcgaataaactcatggtttaagctagttagaattaatgcttttctgttgcagcagtaggcattatttatcctgattaatccacccgtcttaaatattgcagcatttctaagactcattttattcttgataacctgaaggaatgttctgttgtagaagatagccttccaagattgtaagagattcacatttcattcatagttatataggagcacttctccctcagactctgaacaagccctgtggtccaactgtcattactacagaagaaatgaaacataaaaatggggctcaatttgagtttcatgagcatagcactgagacttgagtgcaagtgtggctttacaagatcacaaattctcctttcaaacagatcatctggtggggtttgttatgcgatgcagactgttgattgtccaccaaatggtcatattctttatttattgcaagaagaaccttgatgttcagttgaaggtgacctttctctagcctcagggggtaaagcataattagtccaagatagccatagtagtcttgccagtgactggtttagacatgggcatgaagaccagtcttggccaatgggaagtgagggaacgtccattgggtgacttctggtataggctttncagagntatagggacgtttccgaaccag

SEQ ID NO: 7333 - DNA, 890 bp, Homo sapiens
ctttattatctccggtacagggaccgataaagatagaggcaccagttgagggcaattatgcagaggatggtccattgggagaaagatttatttcaaagattaaagttttagaaagtggcaaagaggttatcaggaggaaaggtaataaaggaatttttatgagatttggaagtgatgaacaaaatgtaatatagcagaggagggtccagtaatatatgacataaaaatgcttcctgcattttggccattagtatgtttgataagaacctcatagaatgagtccacaagtgggggttgataatagattccagtaattggtgaagagaatgagagacagaaaatgaaggtagttggaatagagtgagagattagagagtgtgtctggattgtacgggaagtcaatatagttagagaagttgtagacatgagagactcagtcatgaaaccaaatgtacaggtggaaaggttgatgttgagcacctcattctctaattttagagaagagctgtacttctgatctttggatgcatatgaaagtatgtctgtaagtattgggcgggaagaccactcttagtagcaacatttctgtaataattaaagacaagattctcactgacagaaacagggtagaagttaaagaaagggtttcagaagattgagaacactttaaaaatccttgttccttgttaaagagaatgttcagagaaagaaaaagcaagggtgaatgttagcaagcatccacccatttctttgagataatgaatggttcatttatttttttaaaaaaagtgtgtgtgtgtgagagagagaaagagagagagagaagataagtgcccaaacaagtggtaggcatcatgaaaataaaatataataaactcagtatgcggcca

SEQ ID NO: 7334 - DNA, 750 bp, Homo sapiens
  misc_feature (1)...(750): n = A,T,C or G
cgcgcggttgagcgcttntgctcggcgccnccgcgggcggggcgcgcgnnacgcgggtgccgtctgcggttgggcgtnctanncgcggcgccgcnnnncgcgcgccaccgcaggcgcccagcgcgctgcgcggnnnctcctcctccctntncctccctctccctnnctcntcccttnnnnnacatccgctctcacccactcccttccccgctcntntggcaaccctcganatnnccgtccaacatncgtttcttcgcgcgccttanttgtcctncggggtgtgtctttncncggcggcgcgttnnttatctcttntccgnctccactcttncctatncttctctcctccactctctctctcctcccgtcgtnnnnctccgtcttctccttctcactntcnactctnntnnnnncttcccnctntctcncaccctaccccacttcnactcaccttnnnnnncacnnntnnnnnccactcctcctcncntncnnnncctctnnncnnnnaaccctcttaacnctntctcacttctcctnnnnntccctctctcttncctnnnnactcananncnttncaactcatctcctnnnnnntnnnctncnccccntnncacacccactnnnncnncnccnncttnnnnnncccctctctnccactcnncnttctnnactnntntcccccctnccccccatctctncctccccnnnnttnntntnnnntcacnntnnncacnttnactcctctttacc

SEQ ID NO: 7335 - DNA, 909 bp, Homo sapiens
tacaagcaatgggaaatcaccgtggaaaccaataattttggccaaaagcctattacagttaattgctacgcaggaaggcttctacccacaagtccggaattaagttcaggtattttcttaattaacaccgttccaaaacagggtctcattcgtcatcccagttggagtcagtgcaatgatcacagttcactgtgacctttaatgtgaacccaagcattcctcatgctcaaccttcttaggagctaggataccagaagcggactaatattaatggagttctaagttatatgctaggcaatgggaaggcctcttatattatcgatacctaatcatactcttctgagaggtatgctagaagagtctttgacaattatacctctcagactatagggctttcttacccatttgccgtgtgatattccatggctgctataagaacacggcgctagaaggctcgctgttctatttatcgttcatgtatactttaaagattttatcaagtgcaggatccgaaataatgagctattttatgatctttgtatcttccactatggtcatgataagtttgacttgcttgtcaccagtaatattttaattaaaaactaagggagccttcctcttattgccccaaattggctggatgtcatctttgtcaatcatctcagtttaaaagaaggtgggcagacctgcctgagggtaagtagcaacctagtcctatttgtagaaactgtttgtaaacaaacactatttatgtctgccttcctagaacggggggcagggtatttatgactcagtatataaaacattttgagggaggaaacttcagccattgctaactaaaaattcaatgtatgtattttttgtgcttattaatgctatcttgaatgtaaataaaaaaagatcggcaag

SEQ ID NO: 7336 - DNA, 701 bp, Homo sapiens
gctcagggagaaggataaccttggcccccaatgggtccagatttgggggggcctcaggatttccccagtcctttgaaatggccatctttctcagtgggaacttgaagagtgaaaaatccagcctggaagaaaagcaaaaacacttcgtgtttccaacagaaggcatagaaaaaacaagaagaagagattttgcctttttatacatctttagaaagaacttctcggccgggaacggtggctcatgcctgtaatcccagcactttgggaggccgaggcgggtggatcacgaggtcaggagattgagaccatcctggctaacatggtgaaaccccatctttattaaaaatacaattaaccgggcgtggtggcgggtgcctgtagtcccagctactcgggaggctgaggcaggagaattgtgtgaactccagaggcagagcttgaagtgagctgagatcgcgccactgcaatccagcctgggcaacagagcgagagtctgtttcaaaaaaaaaaaccaaacaagcaaaaataacttttctaccccaagattggataaatatatgtaaataaaaaggacagttcagtgaaaaatttgaaatgaaaatgtttgaaatcctgaaatgtattgtaattttactcagctcctttagcagttacttatagtttatttgcaaagttctttcaaataaatagggatgcgccag

SEQ ID NO: 7337 - DNA, 892 bp, Homo sapiens
ctagttataatatatgagatacttccttattacttaaggttcccgcgactattgaagtaaggagataacaagttttgagcacgaagccgaaatagatttgtttaataggcgtggcgcttttcaaatcaaatcatacgggacaaacgacggtgtaaaaaataacgagtcggagtaagtcaagaaatttcatacacctttttattatctggaatcaaatcgagggtaccttaaacgaaggatataaaataaaattaatgactggtcataaagataactgtatcgcaagtgaaggaaaacaacaattacgagattgttgagctgaacaatattaggacatgacctatcaaaacttgtggattcagcaaaggtgatgctaagagaaaggtttacaaccttaaacatcaaaaagtctgaaaaagcacaaataggcaatctaaggtcacgcctctagaagctagagtagcaagaacaaaacaaacccaaacccagcaaaagaaataaccaatatcacagcaggactaaatgaaattgaaacaaaagaaatacaaaagataaatgaaacaaaaagcttgttctttgaaaatataaataaaattgatagagcattagcaaggttaaccaagaaaagaagatagaaaatccaaataagctcaattggaaatgaaatgggagatattacaactgatgctacagaaatacaaaagatcattcaaggctactatgagcatctttatgcacataaattagaaaacctagagtagatggataaattcctggaaatacacaaccctcctagactaaatcaggaagaattagaaagcctgaacagaccaataaaaagcgatgcgtcaggtatttttttattttaatcaagattaacgggaggcaaaaa

SEQ ID NO: 7338 - DNA, 849 bp, Homo sapiens
ccaaaccgtttaaaaaggggttaaatctatttttaaactcctgtgaaaaaaaaaagtttttgcacgttcaaccgctggtataaaaaagccccatttggcagaagaaaggggtaagcttttggaaatcagaacggtctcctccaaaatgtttcccactttttgacatttgaacgcgctcccagaaaaagaaaaacgacttctttataaaaggcttgcgctttttgggggatggttaaacgaacatggcaagttcttcaaaaaatttgtgggaggactccctgatatctgtgcccccatacccaagcaaaaagttttacgaaaaaaattaaaaaccctggttttagtttcaggtttgtttttccaacctctataatttttaaaaaatcacttaatttttttaatccattttatccccagggtgatcattttaaaaaaaaaaaagagtatctgaggaacaagaataggggagaagagtgttgccccaggtaatccctaagacttctttaagctttagtatcctattcttattcatccgatgattctgagaaattccacctatgaacgctaaagcacatttagcctgtggcttctcaagcaagtatcatagaaacagaaattataagtagttattatatcaggtgagatctcacataaatagggtacgtgtgttccttataagtgcgttgcagaaatggcaaagtgattttctggtatttcttgagtttatgacagtgttgcatgcaaatgctttatcttccgtaagagatactgtgttcctggtgtactttgtttatgaagagtcttgctcgtatttatatatatttttaaacttcagtaaaaaatatcaac

SEQ ID NO: 7339 - DNA, 922 bp, Homo sapiens
ctcagcctgtcggaatccatgtggttatggagcctctcctccctgccaggtgcaggattcagttccagttgtctgagccaatgatgatgattgttttcctgttaccacagttggccaggaatccaagcataagatgttcagcacagagcactattctgaaaactcttgatagtctcaaggtaatgagcccagaagacgtggtttctattctaggttcatgggagaggtttctccctctccctctgaacatggatgtggatactggtatttcacaccgattgcaacaggaagacaagcagtctgaagacaaagctgatgcccccagagacaaagaaaagaaaaggaactacagggcactgatcatactgcccagccaatcatcctaccagttgatcctggatatagatagagacctgtctgccagttttaaaagctgactaagctttatgatttaaacgaatatatcacaggagaatcagtggaaactgagaagaatatggatttatttgtgaagttaataaccacctttgcatgataccttggtgaatagatctttacaaaatatgttctctgttttgttctgcacaaaattgtcattaggcatggtcttatagatgaggaagaataatcacagatcaactgattactttaaagcagatcactggtgtcattcctgggagcaacctcccatactttgaggttttctctgggctacttcaccatttattattctaagcttcactatagagcaagaaccttcttcgcccgaacggaatgagccctgcctgtttatccctactgcctagaagcgaccaaccatttactgctccaggtggggcgccaaacacgcccactctcgcttgaattggtcctaccccgcatgcgcgagcgttttacagagaataaaacagtctctacaatt

SEQ ID NO: 7340 - DNA, 746 bp, Homo sapiens
tcggatcgcgaaataaaggggtcacttatggaaaacagcacgtgaaaaagtagtgtttttgataatcaagtccaagattgtaaataaactatacacataaagcaaagaggctcaatagcgtaaagtagttagcactagccgagtcagaacaatgttaaatgggggcaacctcataatactccagttaggaactctaaaagtagaccttaggtttttatttccatttacaacattgtgcaaaggtatatccaatgcaactaatataagtgctttgaataatatccattaaaaaagagtcagttccgatagtgtgagctatgaggcaataaatagagcataagcatctcatgtgggtttaaagtcgtgcgcgtctaccaaaaaaggaccagtatggagtcagtgcatagataaaagagtgcaatgatggtggccccagtattaagggtccttaacttccctcgtttaggagcgattgggaactgatagtggggttcattaaaggtctgatttcagagtgcacttatcataataccagatcattttaattgaaaattcttcatatagtaccaagttaaaacgcacacatcctaaaaactggtctggggaagttgccttgactgtaagctctgaggaaggaccaggttatttcttgcttgctcgttaagtcttcgaacaaccacccttgcattccgattatattatatgcgttcaataaaatatgtgtcaaataaaaaaaaaaaaaaaaa

SEQ ID NO: 7341 - DNA, 1569 bp, Homo sapiens
  misc_feature (1)...(1569): n = A,T,C or G
aaaannnaactgnnnnnnnnnnnnnnnntnnnnngagnntaagtttnagttngnnngnnnagntgnttnnnannatatnntattnnnnnnnaanngtagntagtannntattctanagtgtcaaatatcactatgtgtatcgcaagtgtgcgagatgtgacgatatagataacntagataatagaaataaagaaagaggtgaaatagacagacaagatcaataatagttagtgtttagacttggtgtgtgtataattgtgtccgaccgccgcgtgcagaccaccacataccgacatatacaccgaccacgtggaagtggcagggcggcaacaagtgaggatgtcacgcagtactgctgataattgttgacatgtaattaataactaaacgatatatcatctagaagtataagagagagtagaactgaagtatgataagagaaggagagatcagagatatgcactagtagcatcggtgttgtatagtgtgataattatgcttgcctgctgaataatatccctatgtaacgagtaataatatccgagaagtaaaatacgacacggctagcacgagcgcagcgcaggacaagcgcagttgaagaagacattatacaccaccttcacggcaagcagacaggaagcagagaggccagctaaggcgaagcaggatcgcacagagcagaccncagacaaagacgcgaggagtaggagccagtactgcgttacgtgagtacgtggtgttgtcgtgtgtagtagtacgctatacatatcgcgctctgcacgcatatgcgagtncgctagtgcgtgttgacgtcgcatcgcacagacgatagataagagtcgnatcgatattgngtagaggtntagcaattcgagtatcgttgttagtgtntactcagtttaggagtggtgccgatgtngtgagtattattttatagtaataatatggatgaagataganatagacgagatatgtctanacaagactatgttgagtanctgtcgtcttncntcttcgcacatcntcagtagcatagtgtactcatctgtaccagacgcttgcgatgacgatcgntagtgaacgcgtacgtgtcagcagcgngacgccgatcgaggtacgcgtttacaactgacatcagtctgcagtactagaccntcgagatagagatcagctaaccagctcgctgcgcgctcgacgacagatanctcactcacgatggatcacgcactatcgatcggcatagctcgtgaaacgagtnagtgagtgtgtacgtgtggacgagcaanagcgtatgagtacgcgagtctgtagattatatcctctcacatacgnaccgtggcgctnccantcagtctcacgaantctatattactctcctcacactcacgtcgctctgtacgtgtatgtgtgtcatggctgttacgatttagtgngtgatgactatactgagaangtagagatcgtgatctactcatnanacgacgtgacgatagatgtgcatctgtctatacaagttcgatgtagtcatgtaatnattgcgtactactcgtgtgacttcttgctctatcg

SEQ ID NO: 7342 - DNA, 764 bp, Homo sapiens
  misc_feature (1)...(764): n = A,T,C or G
aactatatattgacacaagtctttagtatggaacgaaaaaatcaaattgttgaaactaatactcattgcaataaattaggaacaatcaggacactcgggaagaacaacaaaaacaaataacatcatatataaatacatacaataaacacaaaataaaaacaaacctaataaaatcacacactccgacaaaaaaaaaaacaatcgaatataaataaaattataacaacaaacacgtttgcaacaattccacaacgcacacaccccaacaaccaactgtacccgatctaaacttacctagatggtaagaataaaatgatttaacaataataatcatctcatcacaacaagaacaaacgcccctatcatgcttcgacaaacccccatatcctccagaaaaacacataatcatcgctatgnaaagataaaaaacccctgagcgtatatataacacaatttccagtattaagacaacatcaatcttctcttaacagtatttatagtagtatggcatcttcaactgtaatacccaggcatgatcatttcgcttatgtgacagaatatggcatatatacagggcagaagactccccaaagtgacaatctaactttctctctggtgatggagtctttgaatacctcaggttggaatatcctgaataggcagttggttagtcaggtagcagcctttgaaatttgtcaggtctccacctatccagcaatccagaaaacccagagagactgcttcatccactcttccatttatga

SEQ ID NO: 7343 - DNA, 793 bp, Homo sapiens; identical to SEQ ID NO: 4214
  misc_feature (1)...(793): n = A,T,C or G

SEQ ID NO: 7344 - DNA, 1060 bp, Homo sapiens
  misc_feature (1)...(1060): n = A,T,C or G
attgttttttgattttcgctatgtcgagtcatgaagtnagcgaccgccaggaatatgtctgtcagtcggctacttcttaatatataccacccgcttaccaggtagctctacttctggctagcactcgtctcaacgagaaacgctacacttttgtagtaagactctgagttattggtgagtttgcctctaatacgttggtagtatatgtgcagagatagagcggttgactgtttttttggcttgcgttgttgctgcattatttattagtttggagagagatagggctgttgtngtttgtcggattgggtttgtatgtagtgtgtgtggcgctcgctctgtttattgctatttatgtcgagttttgtgcgtagatatttcgcgcggcgtgtgtctcgattttttcgccgcgatgatttgccgccggtgcctcatttgttttttttttatggtgttccccatatgtatttaattggcgcgtgctatcagcccccgtttttctcgcctgttttctgtcgcgctcgagattggctatgagtgtctcccntgttgatgtgtatgagttgtattctgtcagggtggtgactcgggctgcacgtcgctgttttttattctgtttgtggatcgacggcatgaccgcgttccggtttttagtcgttgtgttgtcttatgtattctcgcgtttcgacatttcgcgcggttgtgctgccgttgtctcattggtcagttgcgtttttggagttgtctttcatctctctttctctctattttcgttgttcgtgtgcccgctctcgtgtttcggagtgcggtagcgtttgtcagggccggtggatatgtgccgctcatcattccgcatctgcgtccgttattcccacgcccccccacctgttcggcgtatcattttatttgtttatgttgacttgtaccgccttttgctcgtatttttgtatctattgttttgtgtgcgtggttgtgtatctactcttttctgcgctggcgcgggaccggtttatttttggttccgtggcgtccttgcgctctgcgccttctgagtgtctccgag

SEQ ID NO: 7345 - DNA, 355 bp, Homo sapiens
tacatgtccttagcaagactctgaggttatggtgcctattgagcgtactacaatgaaggacgaagccagcacagaactgtaccgttctctgtttgaccaactacaccctgccacaaatgacacgggagattgacatcgcccgacctgcgacacccaggagggcgccttggttggtgaggctgctggtgcaaatggagagataccaatgactttataggtgctcgagctacctaccggagagcctcgtggatgagagcgctgaaggtcacgaacctagagcctaatacacgcaagggagctgtccctgacaaccgcggctttaaccgccacaaatcaagagcgatgcgctcgctat

SEQ ID NO: 7346 - DNA, 300 bp, Homo sapiens
tctttaattaataccgctgcagctcttgtccttcctgctgacatagagaagaaggatgtatttgcttgcgccttgggccatgattgtaccatgtaaaatttccctgttcaacacgaagaaaaaagagaatggccttctcttctataacagaatggacatttaacactctaagttattctttggggttggcttcagtataaatgtttataatggcaataatattgaaggggatgaggggtctctctcccacaacttgggctataaagcaaaagatattatatctttcaaataaatcagcga

SEQ ID NO: 7347 - DNA, 925 bp, Homo sapiens
  misc_feature (1)...(925): n = A,T,C or G
agtgaacagattgtcaaggaagacggaaacaaagctacagtaacacacaaattattagaaggcaaccacctaacggtcggggtgcggaacaggatttaaacggtgaattgcactagttacatcacaagacgggccaacacgactcgctcacccgtacatcgctgggacgggacggcatcgacattgagcgatactcagacagtacaacacagtagacgtatacactgacgtgaaaacaggcctgcgccatgtatctccatcgcgcggggtgggattcagacaacgccaacataaactacacaactgaggcacctatcacacggccacctcgatgtgccggagcccaccggttaaaattatctcgaccacttattacaacctagcaccgcgctaccacagtacgtaacgacacacacgaacgagtgactatcctaaatttttattacaccgccccacgccgcgatcacgcgcaaaatatcgaaatccatcgtgagaacgctatcggcgcgacccacccccatgttcccattaaatgagtgccctcccccatccgccagaatatatcgccccactattcggtagtcccgccgatttgttgtgactgtgcttggccaattatttgccctatacgcgccgcccaatatcccagtctctctctccaacccgcccgaacagtctacgccatcgactatagacatatttaatcagccaggcatgccgaatcgcgggatgttaatgatccgatgcgcccgcgacgcaatcgccgcattgaatgcgtcattatatgacgagagaccacgccagcgttccattagacacgtctattcacttatttatcatatccccgcatacgatcacnatagaacgaagtcacatcccataattcatccctatagtcttaatactagtgatgatactgatgatc

SEQ ID NO: 7348 - DNA, 1296 bp, Homo sapiens
  misc_feature (1)...(1296): n = A,T,C or G
tcttataccatatataaagacacactgtacacaatttgttgtatgttcgctaggacgggataatttcccacctgctagaggaccacgggggccccttgtgtatttttcttcactgtactcatttctccagcgacacaaactcggtgcccttgccatacaatgcggacagtcgtgaggaatacaggttcgtgtgcacaacctggctatctcctcatcgttggtggtgggtgctccaacacctcacacatactaggtgacacgccttattaattattctgtgtgtgtatacggcagatatactctggcgccaattggcgtccacaacataacgccacgtgcccaccacnacaacaaccatgtcaacccgtcgctatttgtgcgggcagggcgaaccacacaagaccaggatactacacactccctccacttctattactccgtgtatctcacacaacacctcactccctcgtgcgtacagcgttggtgtatatcctagccaacagtagtcgtgcaatgtgggaggaggataactaaatcaactggtctgcacactcctgtcgggctgggtccctcaacacggataaattggcacataatgagaataatctgttggtcggcctacatctcctgacccctctcacccctcggtcgcgggtgacaacaatatttctatcaactgattatcgtgtctctgtgaagacccacattaacggtctgcctgggtggtgtgtacgccaccccaccgaccacggtgttgacctacaacaaaaactcgtttgtgtcatctcgtgtcttaactttatgtgtttatgctctacttatttactgtgatttgcatgtaggcacctgagttagacactcttatgtagtctttatctgtgctctttctcacacacaccactttctgtgtatgtgtcacttgtctctcaactcttgctcatttctggtgttctatttcgtactgctgtttgactacctntacactgacttgattatcttgtactcccatctgacgttgagtctctctgttgacaccaccactgttgtatatatgacacttgcacgcagttgttgtccgtgtgatatcagattacttcacacnacgactcatagttgtgctacgatatcagtcaatcccagtcaccctcgcagtccacacccgtgctgagttgtatcttctatctcgtcaaatcatacgattccacttgtacctgctgcccaccctcacgcggtgtgcgtggcacacaaccttgtgttaaantacataaatatggtcgtgtgcattatctactatat

SEQ ID NO: 7349 - DNA, 762 bp, Homo sapiens
aatacatataatccctcttaaaagtcagtgtattcaaggatcctagataaggtaacctagacagttctttattttttcgctcttcatcgattagttaagtaacaataagacatcgagctcagattgtcaaagacatcccacaagaacatttctttgtcttcatatccaccccatccccccaatcaccattcccagaaaaaggtaactcccagtaaataccagctgtgagcacatttatacacttcctgcatccccccaagaatgccatctatcccctctcttcttagacaactgccaattagaagaattaaaaattatacctcaaaattctgttccattatgtttccacctttactcaaactctccatgatggccttatttcgaagaatatcctctccactgaggtgttctcttcttttccttgattctaaaacaagtccattcaccaggtaaaagtctgccaaaaagtttcctactctttctgttttatcttcccgaaaaagccatcctgtctgggcacgcgtgaaagaaattgattttgttgataaagttgcagagtaaatatcactgctcattaaaatatccacctcttcttctgtttccatctctgattcctcatgatgtattcgctgataaactttttgttcattgtctaatactacaaaagattcagagggcgccgcatccccattgaaaatgaagcttagatcccctcgttggcacttcatgtcagtaaagactatgagagttggtcacgcctag

SEQ ID NO: 7350 - DNA, 1358 bp, Homo sapiens
  misc_feature (1)...(1358): n = A,T,C or G
gcggggatacgattggagactatggcgtcgaagaccgaggaagaaggaacttagctggaggaaccactttgctggcatcttttcgccgcttagccggaataaagcgcacatccgtaacgtgcccggaaggcgagaatctaatctcgtggctggtgttgccacgcagatggttaacaacaatagggcagaagactggtctggattcacccactgcacatacggagggctgcgtacgtggccatgtctcacctgccagagtagtgcgtgtattaaggagagagactttacaggcgcgaacccacagagcgtgggctgtaagtgcacgtgtgtcgagcagttgtgatacagcatgtcgcgagcgccgcnacgggttgtgagttagcaccgggcggtgcggcagggccaaccgntcgcatacagcgagcagacttatagcgtgaataatgtgagacgtgagcgcggcgntcatgtctgacaggtccagcgcgggtgtagantaactgcgggncatccacgagacgaattagagacgatatgacgacacgcgaatcatntgactacgcaatcaggtgatgggncgctgatgtcgtatgtgtggcgtgagtagcgcacgcgacgcgtgatactagcagacgagatccgtatagctgtacataatatgaacgacgcacgccccacacctccgtaatctacattcgatgtatagattgtgttcagatcggtaatcgtcatataacgtatcgatcgttatgatcgcgccgacgctcancggccgaaccacnagatagaggcgcgcatagtatatgagtagcatacgtgtccgccgccacgcncgcctcatatgtagcgcagcacatccatatattagcacgcgccagnacagtcacatacgagagacatagcgcactgcgtgagtgttgtatgactggcacgcgctgccactctatcacacccactgatattattcgcacccgcattcgcactgcacagcccatcatagatcaccagagatcacctcctgcatccgcttcgccggcgcacaattgcaattaatcgcgtcgccgcacgtggaatatctacgtgataaagatactcccgtaatcctagacgaggacccggcattgatgatggatcgccgaaatgcgcnccgtcgcgcgatacccgacggatacatttcgccgaggagataatataccccgtgtctccacacaccgcatgttcatgagacaccaccgatattagtcaataatgaagagccgcactactccacactcgccaggtagtcggaagcactatacccgtgacatacaaccagtcctcgatgtaactatatcagttctcgagtccatatatacgct

SEQ ID NO: 7351 - DNA, 759 bp, Homo sapiens
cggaatagggggtctaagctaatatcattttataactcctccccttttccttttttgtaccatagccttagactattttctatatgcttgtgggtggcaggcctgattggtcaacacatcagtctgcagctaaagctcaaactccctatatgattgggtgaagcttcaatcacttagtttgcagcagtgactcatttttgcttagcagacagtcccctttgattggttgaagtttcaatcccttagcttgcagctatgactcattttggcttagaggaatgtccccttagggaagtccctgttgacccaggaagtctagctaacttagccacttagtgcctcagtaccccctctcaacaggaaagcccaagtgctgttgagaagttgggcaatgatcattctagctacttcctgctgaactggggcatagaaggggatctacagttgagggttcctcaggaggggagtcttcttcagtgtcgtggtgttagaacaggttggtaggtcagtctaggggtcctcgatagtaggtgctagtggtggtcatttggggctccatttgtagaaccacttacagtttcatggattctattcacttcagagaaatcccggacaggcccccagaaatgagatgagaaggctcttccgatcgaaggtttttctcaattgaagagtttgtggttccacgggcttcaaagaatgaaggcttggaccgcagcagtgagtgttacagctcaatttgaggagcatgcagaccca

SEQ ID NO: 7352 - DNA, 1357 bp, Homo sapiens
  misc_feature (1)...(1357): n = A,T,C or G
gcgcgtgacgatagtgtgtcagagcagggtgngtgggcgagcaagagggagggagggagggcttaggctggcgagacgnactgctgctgtaattattaccaccgctcacagcctattgttggggagaaccgatccagcaaaattgagggagaagaatggggtgaggtattgcggagggcggaggcccctctcccctctaatagaggacgaaagaagacggcgtcgactgacggtacatatttgagcggcggagtgggtttggtcggtgccgcactaaccccgttctttatcccacgggggcgtgtctaaaggggagggcggagtgtaacacccagacagcacggcccaaggttgtgtgtttcgcgaccgggggggagagggcgggccacgacgaggaagactcctcagttatccacattatttgtaggcagagaagtgcgtggaggcgcgcgagagcgcagcgatngcgtagttagcgctgccgcttctatgctcatactagaggcgtagtgagtaggntgtgctttgctcctgtagcgtggtcgccgacacggagcgagtcgcgccggagcgactgcgatacgcgtatggcattcatcgagnggacctgtgatatttgatgagatgtctcgcgcgcgtcgcgactcgactcgntgacgcagtgcgcgtatgagtttgctgctacancacgcgaccgcgcgtattgcgtggcggcattgatgagcacagcagtcactcgcgtacgaacctcgcgaatatattcgcacatgatatgatgatggntgtacgttagcgcgcnagcgcgcagcgcaattctctggtgctcngtcgattatatatcagcgctacgccccactctgatcagancgcgatcctccgacgcggactgtctgntatgtgttggacgatacgccaagtgcccaccntttaatgtgttgcaggccatgtacgctggtcagcgccctagttgcgcggcgcatgcgagtcatcgcctgtcgccgccgcnagagtctgcgtgacggcggcntctacgnataatcgataaggtggtgttacgcgcacactcgcgcatctattgcgtatcggtatgctgtgatgttgcgaatgtgtccgccccgtcggagcattgcggtcacgtatataaacgcagtcctgtgttgatgttgcggcggccgctccgccgcgcgcgcangtgcgctgtgactgcagcgcgacggacgaggatgatcatgaatactccccacgtaatcatgaatacgactatatgacctcgcagatatctcatacgtcgcgagnagtcacaccggcacgtagtatatacactgtagcaagtatgttggagcgcatagtgtacgcg

SEQ ID NO: 7353 - DNA, 767 bp, Homo sapiens
attatcgtcatatattcgaatagccaaatccatctatgtcctaatcataggtttatttttagtactatattttcataaatatttactttggtgctagaatttatttcccggggtatcctacacacaactcagataacattttgttaaaatttttcaatatgttgccccacctcatcatatacagtaatatacagccatagaaaagaagcacttattattttttttcacagttctttcttacaatatctcaatttctggcagttaggacaggagtgagtcaaaatagctttttaaatacctaagatatgaattagctggacgtgatatcacatgcctataatcccagctgctcaggtagctgggactacaggcgcccaccaccacgcctggctaatttttttgtatttttagtggagacggggtttcaccgtgttagccaggatggtcttgatctcctgacctcgtgatctgcctgagaactctctgaggagttagaatgtcctgcctgttctacctttctcattctccagcttctgcacagagtcctgtggcccacaatgtggccaggagaaagccagtccgtagagcctttgcaggagacacagtaggggcccagtgtggcacagtgaaggtgaaacgtccagatcagaagaacctggtggactaccactggcagtcctctggtctctctgtcatcaaatgaaactggcatcagatacaacctttcccatctgcttttttttatgagaaaaacacgtggagcctag

SEQ ID NO: 7354 - DNA, 166 bp, Homo sapiens
cacatgaacaaggcttgagtccagtgtgttttggccattccttgttctttagatcaaagggatctctgcttaggtgaagaatgagaaagggctggattgaacagagaaaaaatgcatctttgcagacaaatttaccaaaggaagaaaaatagtcaataaatagaga

SEQ ID NO: 7355 - DNA, 585 bp, Homo sapiens
gggccaccattggaaacagttaaccatggtgaaagaccctgtggcaatatccccaagcagtcttgcaacatcaccaacagctctaaggaaagattcacacaattagagcagggttatcacagttgccaaaaggaagaagcagtctacgtgtccatcgacagacaaatgaatagaccaaatgtggtatatacatacaacggagtactattcagcctgaagacggaaagaaattctgacacatgcagcaacatggatgaaccctgaggacatgacaccaagggaaactagtcaaaaaggcaaatactgtatgattccatgcatacgaagtacttagagtagataaattcataaagacaaaaaatagagtggtgcttgctagggcctggtcgggggtaggaaattgggagttactgtttaatgcttatagaatattcatttttcaagatggaaaagagttccggaaattggttacacaactacgcaaatgtacttaacaatattgagctgtacacttaaaaaatttaaagatggtaaattttatgttatgttatgtaataccactactaacaatcaaattaaccacga

SEQ ID NO: 7356 - DNA, 633 bp, Homo sapiens
  misc_feature (1)...(633): n = A,T,C or G
ctcactgtcctggtgggagcggacacgggtgagggcggtggtgagccatcgcgagaaccatcagctccggcgccattaagccccccacgcgctatggtaacaaccccccacacccaggaaacccgccggncggctcggatngcgggactggggggcacagaaggtagccatgcgcgggcggagagactagcgacacggcgacgagaggaaggcgtggggggcgaggggcggcggaggggacagcgaggctccttcgactccgttcacgactgaagcgagccctaagaactctgcatgccgacctctgggcgtacctccagctaggggataaaaataactacggaccaccctggacgttacagaccgcggcagaacacaccagaagacggggggcggggacgaaacaagcgaattaataatggctgtcgtgtatacataagtcaaaacgtcaactcgaccgaagaggaaatctgatagtgggtnaacccgagctaccgagaagagagggacggcgaccggaacaataagttaaagtcgtttactattgagtaaccacacacacaaaaatagtccttgtgacacgatgaacgcgcggctgaccgttattcctttttcctttgtnactatannnca

SEQ ID NO: 7357 - DNA, 261 bp, Homo sapiens
atgagtagtcatagcagaagaaacaagcactaagggaacaaaacacgcaaaaaaaagacaagcgaccacaagttaccagcgaaaaaggggaaggggggagtagaacaaaacagcggacaggacgaagcacaagacatagtaatataaacaacatccacaaccagaaacgaaaactaaaagcatacaggacagagaacataaaatagtaagccaggtgagagcgggggcggggcaagttgcaatagactcaggcaaaacgga

SEQ ID NO: 7358 - DNA, 976 bp, Homo sapiens
  misc_feature (1)...(976): n = A,T,C or G
catattccctccgtctacccagaatcgaaagaaaaaaaaaagctagctgcatcgaactctcttattttccaccgctcaggtgtgggcctcctgctcagaaaaacaacaaccaaatctttgaagcctaacctatggctgccgaggaaaattgacttcctggcgaccgagactcaccgaaacccatattgattgcaaatggacacacctctctctagcggccaaacactgatgctgtccccccacgaaatgagcctacgtgcatgtccattgtatgggttcctgcaatagctacagcaataatattctcctttgtgctcttttatttcttacctatatctacgattatgagattataaagtccggctccattactaaaatgagccacatttaaactctactacaaaatgaatccattcttggcaatgttttgatacacattataacattggggtggaacgcacacacgggccaatcgttattttcccttccccgttaacctatatgagccacttttaaattgaaaaggagcttttatctttcttaaaatccttataacaggtgcctcaagagcgcgagacaaaaatccctttcgatccacggattcccgcaagacgggaaaccctccacacggtaatcaagaacccaacgagatccactcagtgattaatatccctatattccccgagcagaagaggcccatcgagtncacaattcgtacgtgatatgccgcgaggcccacctaattcctcgcacaccgtataggttgcggccacaaatctgttatatctctcttaccacacatataataattcggcccacatttctccctataatttaaaagataacactccgtcgcaacccaaccattttgttaaccttagactctgagcatgtagcgtcaaaacacgcttacgtagtaataccaatttcactatcacgccaatacaggagattatatgacatgtcactcaacact

SEQ ID NO: 7359 - DNA, 948 bp, Homo sapiens
atatccccaccccccccctcccaatatgaaaaaaagaaaaagcctaactgcaaagactctcttattctccaccgctacaacacggagatttgatcttgttgcccaggctggaacgcattggagtcatctcagctcactgcaacctccacctcccaggttcaagcaattctccatgtctcagcctcccaagtagctgggattacaggtgcatgccaccatgagcaggtgaaaaaaccgaaacccagtgaggaaactgccctcgctcggataaggtcaaattgactaccatcagtcacagcacccagtcagaaacagctataaagaccaacatccgaggtagctgggagaaaatgtgaagtcttccttatctaaaagtgttttcattatatcgcccataattggactgcacaggagcaatatatagttccctccaaattccaacttccgcgactgaaatcatccttcaaacaccaccctaccgcgattttaggagctaccagatattacacaatagttcctagtctctaaaacataaaatacaagatatattatgcatccatcaataaaagtagtcaaacaattcctactcttctagatggaattatcaacgcaatacctgtatatactaataccctattatcaatatatctaatatacccttaccaccaatattgctgaattcatcccctctaaataaactggtaatataaaatatataatattattcatttgaaccgtcatgatatcttgcccacccgtataatagcccaccactccatattttatttcccacacgccatacttcatcgcctattaatcttgccttatatgagatatatacgcgacaatcagccagcgtactctaagcgatttaactaaagactcgcatattacataattgcctatttattatgagtaattcaaaaattcacatttatcttctacata

SEQ ID NO: 7360 - DNA, 1712 bp, Homo sapiens
  misc_feature (1)...(1712): n = A,T,C or G
gtgatagacggatagtgntcggtggaggtagtagtaacaggatgagangagnaatagagaggtagaggatgcgagcagtgagggagatatgagtnggtgatagagaaatgatgaggatctgtatggatgtgtgagagatgtatatatagagatanganatcggantagagagatgcatcagagtatagatgagagagagatgaggagtatgtatatgnggnataggcgaaaggtatgaanaaaagtgacatgtgagatatatgatgagatgaaggtcgtagatgaaaggatgcggcgaggatatgtagtgtagctganaggaatcgcgatgagtgatacgcgntggggggggagtagaggnaggagagatagcgataggagtgtatgagtatgatgngagggtgangagtagagagagtggtgagaagtagatgtaatggagatcggangagtaagngagagaggaaggaggtatagatatgatcggagcgaagaatgcaaagatgagtangagaaggagaatatantagatagagagagcgtggggagcgtacgtcttgaggagatgggcgtntgntggggtaagntatggtgaatggatagcgtatagtataatcagtagaatgtgaagacaagagaggagcgcgatggagtagaataggcaggtaatgtacgcgagagtggatgacatgaagcggatagaatatacacaataatanagagatgagagggagnggtgaagcgaagagaggaaataatagaaggtgggagtggggaaggagaatatggaatatgagagagagtgggttgagggagatagagtagaaagataaatggtgatagaaggagagaaataaaggaggagatagagagagaggaggaatgaagagaggagataatgagatggagagaggagtacgaggtgagatgacagaaatgagaggagtacgaagagtatagagtgagaagtagtgcgagtggaatacagtgcataagtacagaatatgagtgcgatcttggatatgtaatagaggatacgtagtgatattactagaagagcgagcggatataatatggaggagaagagggtagagagagaatgttgttttgtatagaagagtnataagtgaatattgatagtaaaagagtaggcatgtaccacacccgcagcggatgagggagtatagagagggagagatagaatattgcagagagatcgtgtaagtggagagtaatgaagacaagagcaggagtaactagaatangtgagaagagagagaatgagaatagaaagagagagagagagacgtgaatataatntatagagttaatgagagangtagtgagtaggaagtgatgaataatatagcgataatgatagcgatggcgtaggatatgatgttntaatggaaaatgcgagtgaagggagcagagtatgagagattntgtatatggttgttgagacgggtcgtggctgtaagcacgcctaagtggaggaggagtgaagatgngggctgggatagtaatgtnaagtggtattgtgaatgtagtagaaatgcgagggaagagagatgtgtgtggtgatagagtggaggagaaggaggagaaaaagaagatgagggaagagtgtggaactgaaaagataatattagtnnaatgaggtgttgttgtgggtgggtggngtgggggtgtaggtagaagaatggagtgag

SEQ ID NO: 7361 - DNA, 1304 bp, Homo sapiens
  misc_feature (1)...(1304): n = A,T,C or G
ctctgtatgtgctggcgctntcgttgtgtctctctgtgttgtcgtatgcgtatgctcttcgttgtgncgcgttgtgttcgttgctncgcggctcggcggttgtcgtgcgctgccgcgcgtctcggcgctgtctgtcgcggtttcgtccgcgtgctcgtacnctcgtcgttgtcgcnctatgtgcgcgcctctcggtcgcgttcgcgcgatcgcgggccgtcctcgctctgcgtggcggcgttgttcgattgcgtnggcgcgtcctgctgtcgcgtntcgcgccggccggccgtgctgtgcgcgtagccttcctcgtccttgtcggtgtgctcttggctcgcctcgtggttcgcgcgttgtgtctttctgctgccggcggagtgtgctgctgtcgcgcgctccgtggtgcgcgttccttccgttcgtttgggctgtgtnttgctttgctttcttggttcgtcggtccttcntgtcgcggtgcgcgnggtttgggtcgtcgtggtcctgtgtgccggtgcgggctctctcggcccggcctcctgttcggcggtcttgcctcgtgttctttcgtctcctcggtgtggttggcgcctcctcgtctctcgctgtgcctgcgcgtctgtgtttgtgcgtgtctttcgtggtgtggtcggcgctcggccctgtctgttggtcgtgcgtgtgtctcgtgtcgcggcgcggtgtttctggtgtcgcgcgngcgctcttacgttgttgtgcgtggcggcatgtggcgcgtggttcgcgttctctgtcttgtctcttgtcaggcggggggtggctgtnatcttcgggttgcctcggtcgggtgcgtggcattctgtggttgttgtcgccttctgcctgcgggtgtggtccgcgctgcccggcggccgtgcgtgcgggccgttgtccgtgctttttgggtgcgtgcgttcttctctccttcgctgctgcccgttcctgtgtcttttggtgtcggtcgttcttctctgttctcctttcgctcggcctgttttgcgtgggggtctttcgctgcttccttcttttttgttttctcgctcttgtggcggtgtcttgtctctttgcttgtggtgcgggccccgctttgttttcctcgtttttgctgtctcccttctctctgcgtcttccgccctgtctcttgtccgtgccgttctcgcctttctcccgggctgtcgctggtttttctccctttcagcctccctgctctgtttcccccggagagggtgtcgttttttcgtgcgctcgcgcgctgtcttgcgcgtctgtcgtgtgctgggggg

SEQ ID NO: 7362 - DNA, 1115 bp, Homo sapiens
  misc_feature (1)...(1115): n = A,T,C or G
ctctcagccgaccgcgccgtcccgactcctccanttggcgcgcggacgcgtgcgccgctatcctatacgtcggtacgccatctccctcccggcgcgattctcccgccatgcgcgcggtggttagcgcggagtatactgcctgcgcgcgtcggcgtccgcttataactcgctctcggtagcaatccgcggacactcgcgcaacgcttcgctactcctatgactgtacgtatgcgccgtcgcctagcccacgtacaaccctgtcgatcatccctacgtcgccgtacccgccggctcccgcatctccgccagcacctgtaagtctgcgacatgccgcgctcgccgtgcgtcacgcgcttacaccatcgctcgcgggcgcccctgggcctcccgtatattcaccgctgatcgcttataccgctaccccgcgcgcacgccgcatttcgacctccgcgggtggcgcgcctccgctacgtagacccaacacgcactccgagtttagcgcgagctcgccgttgatactcacgccgcccggcgtgggtgtgagcatgctgccgccgcacgggagtctactccgcacgggccgcgcggtttatcgcggaagttcgcgagagatctcgcttcttgctagcgtcgcaccacgggacaccgctcctgcgtccacggcaggctctaacgctgatgaaaggttgctcgctgagcgccctctctcaccctcgctcccccgtccgacagggcgggccccccggnccccgggagggatttctcttggttcccgtcaacggtnaaattgatgggccgccgcccccctcagcggcgggaaggttgggatgtattaccgaagtacccgccaatcacaccagtttcttatttgtgcgccctttactttaagtccctcctcggtaacaggggggaacgaggaccactgcagggggttaaatttgcaaataccccaggtaaaactcctgaagtatgaggatccgcccctcttctaaactgtgacttcagctagagtggttgttgaacatgggaggtggaataaatgggcaaaaataaacatgtacgcgtccgagttctttctccgtggtgtgtccgtgcgctcccacccccccccggcg

SEQ ID NO: 7363 - DNA, 1726 bp, Homo sapiens
  misc_feature (1)...(1726): n = A,T,C or G
cggacgtgngggcgcgngngcactactacgnancatgcgctgctatagcgttcacgtncnctaatgagagtgcttatacagantgtgatgtgacgangctgcagtacattcggcgcgcgctctcactctgcgagacatactgtacgcagttgacatccactaatcactcctctgtgtcgctnagtacctctcactccgagcatcgtgtatcacgcnctggcaccgcctggcactgcacgcncgctgtacgatcaggtgtatacactgccgtactatgtacggtagccagcagtcttcagtgcgtcagcgcgctggtcagtntntgtagtgcggcacgatanctagantcgaagtcngggnccgatactccgcggcggctagtgtgtcgcgacgcgcgtctctcactgatcgnggtctgcgcgcgtctatacgtcgtctatactgagcgacgcatagtatggcgcgcgnggcgtctcatagggtgatgtgatcgcgcgcgtcatcgctactagccgatcgtggtgcgngagtacgtggtatatgntcacgnctgcgcaactagtctgcgcgcggtggcgtcgctgagatgtctgcactctatacgcatctcgcgtgtctcgcactcancgacagctgtgagngattgtatgctcgcgtncgcgacgctcatcaatatatcatcgacgantacgcgcacttgctgatntcgtcttcatcantataggctgatcgtccgttgtgctgcacacgtgagcgtacacatcacgcgagtctatcgctacgagcgtgctgtctctatcgcagtgcgtngnntcgtatcttanacaatggtcgtgctgacgaggtnggcgtacggngtcggcgatcatcgagcgagatcattgatcctcgcgcgngcgactgatacatctactcggtgctgcgatctgatgcagacgcggcgcggactatatcggtatcgatctcgtnctcatgaggagcggcgcgcgacgcgactgacnatcaccgtcatactgtgtgtactcgcacgctctcgagcgcggatcgctgtccggctatgcgngtcagcgaggancanatnacgtgagcgatatcgtctgatanttatacatatcgtcatctgactgcacaccagcacgatcatncgttacgtcagacatgacactcgacgattcgttctctgtactctgatactntncnttgtcnctantctctcagatctcaatggancctctcgttggtgctcgatactagctcgctactncccagcactcacgtgctctagctgtgactcacgttgaacgtgcagcgtacntatcggactggtagctgtacacgactgcgncaccgttttgtgctgcttcgtgctcgatagctgctgtcatgcggtctgngnagctagattatgtcgtcgacagtctaccgcctnttcgcggctacgctcatacgcgtgtgctntagtctangtgcgatnatatacgtgccactctgcatctgccgtgatntctgtcgtaagttcactactctctctcgctctactgtccgtgtagtctccncggtcgtggcgcagggctctcctcgctcaccgctnnaaaaactctcgtctcnctctcccnncgttctctctcgcngtggcgacggcactctcgtttgttcgtctcggtctctgcgcgtcgcgtctgctcgactatatcgtgtgctgtngttgtgcggtgtgtgctcgcag

SEQ ID NO: 7364 - DNA, 482 bp, Homo sapiens
ccaacctgataccagatgcatgccccacgatggagtgcactaaaatgacacagcatcattcatgtggtatttctgccaaaaatgcatcacctgaatctcatcatgaggaaaaaaaaatcagaaaatcccacattgagggacttcctgtagaaactgtcctatactcttcaaaaatgtcagtttcatagcagagaaaggagattgaagaagaatgaaaacaaaatgcaatgactgatcctgggtgggattttttttttctgtgaaggatagtttgggaagaactattgaaatatgtatattagatgatagtattgtatcattgataatttcctaaacttgctagttgcattgcgattataaatgaatatccttgttcttagaagctactttctgaagtatgaagggtcataatgcctgtcatttgtttaaaatttcataaataattattatggtattcatctatgtgtagcaataaatataga

SEQ ID NO: 7365 - DNA, 825 bp, Homo sapiens
  misc_feature (1)...(825): n = A,T,C or G
aggtgctcagtggggtactatgctcttgttggggtgttacgcctgggaaccgcccgacccggggccggngcgtcgtgtatattttgcgtgggcgaggggccggggcggtgggggggggcggggtgggggggggggcgggggtgagggcggggggggtggtggatgcgggtgtggggggggggggaggggggaagggtgggggaggggggggtaatacagtgttgggcgttctgctcacgcgcccccggccgaagtcccacctcagatagtgagacgtgaccggtcgcgcagacagtatacgacagcttctagtctaagatgtatttataatgatataacgcgccgacgcgctggtgagctcatgactgtgggatttctaaataagctcnctggctgtgccctgcttcaagttcatttctctgttaccctgtgtntactttccccgctgcttttggcgggggggagcgtcgggggtatcttgccggctggccgagctagtgctctagctcgtcgtactgttattctggtcccgtgccgcgccggcttgtgncgcccgaaaaaaaagtttgtcgttttttattaacatcaatgttgtcctctaaaaagtgtcatcccaagctnatcatctgccatttgttgcctatccagttactttngtcttttgttaccttcagaaccaaaagactgncaccgtttatagtattccccnagaacaccttccaatcttctttttcttgataggtctacagctaaacatgtagnagttcgtcaaattcttttttttctttttttctttttttctctttttctctccttcttctcttt

SEQ ID NO: 7366 - DNA, 771 bp, Homo sapiens
aggtctggcaagtttttccacaagcgaagtggtctccaaaactaaaacaaaccgtaataaaggaaactgcattacggaaataaggcaccgaatggggagatgctacaactactgtaggtcgccaccacgtaatgagaattataaaatgcaccctaactgtacagctttatccattcgatggtgatcaatcctaaaatctcaaagatgacagccccttcttccttagcagtgtcgcttaacggaaccctctatgtggcagacctcggaaatgtttgaattggtaccatcagcaggaaccaagcccacgtgaatgacatgaacatttatgagattgcttcacccgctgatcaggaactgtaccagttctctgtaaatggagcccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgaggagcacctgaccaatgcaacgtttcccactggagaggtcagcagcttcacacagtaaatggagatcggccac

SEQ ID NO: 7367 - DNA, 359 bp, Homo sapiens
aagaaggaagcagaagggcagatcaggaaaaagagacagaagagggagggaagatctgaagtgtgagagggacttcacttgctgttgctggctttgaagatggccgaagtgggctgtgaaccaaggaatgtgattgcttctagaagtaggaatggccttcagtttacaaccagcaagaaaatggggaattcagttttacaaccacaagaaaatgaattctaccacagcctggatgagcaggaaacagattctgccctagagctttcagaaagaaatgcacctgctaacaccttgacttcagtctagtgagacctgtaccagacttctgatctatagaactctaagataataaatctgga

SEQ ID NO: 7368 - DNA, 506 bp, Homo sapiens
cactgatgcagggaattaagataaacctcctgctgaagatgatcatcaggagaaagtgattctgacaaatcagtgaaatgcataaagaaaggacaaagagacaggacatgtcacaaaagatttttttgcgctacgtcacctctgtgggttttaagagattgtattcaagtggatattcttagaccacattcttgaggcgttattagtataagaacctgcctatgggagaagtggacctaccatgaaagaagaaagctgaagttctgtctgttggagaacatggggaggaaatctggaacacccaatccagctggtttagccacctaatgaaccattccattagtaactaaagatctttgctttgttcatgttacctgcattagaacctgaactccttcaaagaaattctctttctcttggtgctatagaaacaatggtgctaaaatatattacatatcatttatattgggaaggctatgataaataaatatgaaaaataaaagaga

SEQ ID NO: 7369 - DNA, 791 bp, Homo sapiens
actcagccagcctgcacccaggtgaaataaacagccttgttgctcacacaaagcctgtttggtggtcttttcacatggacacgtgagacatttggtgccaaagacctgggtcagcgggactcctttgggagaccagtcccctgtcctcaccctcactccatgaagagatctatctatgacctcgggtcctcagaccaaccagcccgaggaacatctcaccgattttaaattgggatcttgcttcaagcgccagaaatctggccactgggccaaggaatgcctgcagcccgggactcctcccaagccatgtcccacctgtgcagggacccactggaaatcagactgtccagctcacccggcagccactcctagagcccctaaagctctggtccaaggctctctgactaactccttcccagatctgctcagcttaaaggctgaagactgatgctgcctgatcgcctccgaagccccctggaccatcacggacgccaagctttggtcatataagaaaacaggaatgtcaaggcctttggccccagcttaaccggcatattcccctggaactgcttgtttacatcccaaagggcctgagacaactgcgagatcccaagaagaaaattgcccttcaccgattgcattccaaccactgggatttggttctcggcccaccccaaactgataatgtgcctcgcgacctcccccaccctttataaagtgtctttggatttcccccaccccttgagaaagtgcccggggaaacccgcccctcccacaacaaaattggttct

SEQ ID NO: 7370 - DNA, 590 bp, Homo sapiens
gaagaagaagcaggcattcattgggatggtgagcatggcaggagcagcaagaattctatcatcaaggaaatttaaagttttggtaaagactgtatattttaatgccaacgctaattctaaggaaacaacagatgtagcagcagttacgataaaaaccaagtgctcttgtctgttaaaagaaaaaatacaaatttaaaaggatatttatttatgcggccggcggaaagagtttgaaagtcattgaacccggtgggggaccgtttcccttgagggaggggtaattcagagacccccttacataactccatgcactgggtctttagggtggggtgagggttttaaagtcctgaagggcggaattcccggtttcccccggaattgggggtaaatcccggaaaaaaaccgtgttgagcaaaacgcgcccttagcgcgccaaacctttaaaggggcgcttttttggctttttgtaagtagctccccccctcggagagagttgataataggcccctctagttgaatgggcgcgcacccgcgcgggaccttagattccctaggtgttccaccggaaagccctaagtgcgccctgagtg

SEQ ID NO: 7371 - DNA, 743 bp, Homo sapiens
caggggctgcgacgattattagccccgggcggggggtttctccgcgatttagtgaataaatatagagggcgttttttagttgagctgcgatatagagggggtgagtaacgaggtggtgggggctttttgtgtacggagaggtgtatatatggtgcgccaagttttttgattatgtctgaagagctaacacttaaccgggtcaggtttttttgagcaattaaaaaaggcagctagaaaaggatggggggagaaagtagtcgcggagcattgtgcgcgccttaaacaaggtttatttaaggcgtcggggggcggttgaatgtaaacattttaagttttaataagtgcttaaaacactgcgccaaattatgaggtaataaaaataaaaaggtgctcagtcccatagggttttgtccctctcaaaaaaatataatttaattgttgcgctgcttgcaaaggccgaaaaaacatatgtaaatgtgttgtttttaggagaatttttcacaccggtctaaataccggagtttttatcttgtcattaaaaggtgtgtttttttgggtttcaagtggaagaaagaaccccccccaggggtgtttgcaaagaaggggggggttcaaaaaactttggtgggctttcagaaaataaacacccctctgtattaaaaaagcaccgtatttttttaaccccaaaatttagttgtccaaaagggtgaataaaaatttttgttttcccccccaccaccccg

SEQ ID NO: 7372 - DNA, 1078 bp, Homo sapiens
  misc_feature (1)...(1078): n = A,T,C or G
cgtgggtggtagagtatatcaagcgcgctatatgtcccttacagggtggaggaaatgtgcagactgcatagcgagacaaccgagtcgtaatgacgcggcaagatctgcactaagtacgtgatggattattgaatgtgagtaagagggtgatggtaaatatagatggacgcgataaaggaaatatatgttatacggtgtatcgatgcgaagtgaacggggtgaaatagcatttgtgggagacaattagactttacacctgcgtcgaatggagggcgggtcgcgagagaaaggagctcgccgcgtcacacttcgaatgggctagtcgagcacgagtattgtaatgatgtgtattgtagggcgataggaggaacaaatggtatttggatgacggactatgatgagattcggactagggatacatgaggatcacttgtattggatggaggagaataaataaagggagagcaggtcagagagcacactgggggatgttcgtgaccctataaccatagtagttatgtatttatactgttgggcggacaatgcatggggggaggcgggcggatgagaaaggaaatgatggatacgaagtgggtagacggtaatatagagggaatatgttgggcggatactggcatctagaagtgtaccgggaatgtttaattctatgcgaactgatcaccgcgtggtgacatttgggagcgtgtcttccctgagggagatgcaaagatatcgccccccggcaatgtncgtttaataacaccacaccgaaaggtctggcgcggtgtctaacatacatagcctatgtggtggtgcatcttctantcaatataacacacccacgcctcccggttattgaaagaatggccgcttgtattttttctaccccgcaatatttgaggttggcccaaggggtgaataaaccccccgggtgtcccgcgaatgaaaaaaagccagaaaagaaaacaacaaatagcaaatagaaagagctgtgttagaaaaagacaaaaataaagcccgttcccggccgaatcttttgtttgtttgcgtgttttttacgtgtcgtgctcgtgctccg

SEQ ID NO: 7373 - DNA, 586 bp, Homo sapiens
gctctctaattatccaccgctacagatgaaaatatagccagaaagtatcccaacagatacccaaagactaaggcgggcgttgcaagtgactacctgagaagatgaattcaccatcctcacaggaaaagactgatatccccagagactgaggagcatctctgaagaaaagagtctcccaagaagccacaaatgtgacccatgaaagactctccatttaaagctcttggcaggggcggagctcaacaataatatcccaaaatgccatctgtcacctaaaaacctgcccctccttctgggtgtccgttaacagttccaatgctagaggagccagagaaagcccattgcactgaataggaggactgaaagtcattggtgcagaaatgacaaggactctgactttattctcccttcttcaatggatgtaattcgctctaaaaaaacccgcggggcgagagggcatgtgggcgacttctttcaactctatgtgaattttgacacgctgatagatctatcatgaataccttgaacgaataatccaataattttgggggctaaggttacccgaaggtttctcaaaacctacaaa

SEQ ID NO: 7374 - DNA, 599 bp, Homo sapiens
aaacagggactggctttgttgcccaagctggccttgaactcctggcttcaagtaatcctcccaccttggcctccaaaagtgctgagattacagtatagactatttgggaatcctgaacaagaatgcctgtatgtgcacaatcaccacttctattcaacagtactggaagtcctaaccagagcaattaagcaagaaagaaaaataaaaggcatccaagtgggaaaaaaagaagtgaaaatttatctgttcactgacaatatatagaatgccctagataatccatcaaaaagctgtgagagctgataaattaatttaaagctgcaaactacaaaggtaacctacaaaaccaggagcatttctatatactaacaatgaacaatctgagttctatttacagtagcataagaatacttaggagtaaatttaaccaggggggttaaagatccatggaaaacttttaaattgttgctggaatccatttggaaatggcccctattagatgaaaagataccctattgttcttgaagtagaaagaattaattatgggcaaatttccctgccatcaaagggagttacaagatgaatgccagccccatcat

SEQ ID NO: 7375 - DNA, 926 bp, Homo sapiens
  misc_feature (1)...(926): n = A,T,C or G
cagtgttgttggtttggagtttacagacgtgagaggggttgtggagtatgatggggggggtgggggcgaggtaggtggtgcgggcgacgcgtgagcgggggggagaggtaggggatcggggatggaggcgtgggtggggtaatgtagaagcgatatgaaggatgggtggtgtcggggtgcggcgggggaggagggcgtggggagggggtgtgatgggggggtagtgcggggacggaggggggttgtggtgaaagatagatagtctgaggacccccgatatgatgttgcgcttcgactagagacttatctggatgatagcactgtaaatatgtatatcgagtaagaatttataatatatatagttgatgtattatggtatattttataattaatatattgattgcacagaggagggctttatttaaagagggtatggtggggttgataggagacagctgaaccaccgagcagggtggaccggggcctgtacgtgtggcnncgttgtttctcgtgcgtgtggggtgggggtggtagtctgtagagttgcttgtgtttctgtctgttgctcgtgcgtttggagaggtgttcacgtggctgcggtgtcgggtcgagagcgcacgttaaacttaatattaatttcacacaatataaacacgcaataatactaaaatttacaataaccttctaatatcactatgagggggagacaaaagtggtcgaaagaaagaaaacttgtatgcgcgctcggtgcatgaattcataatactttataaagttatagtaatcacaacaacatagtactgacataaatctacatatatcaaccaatgcaataggatagaaagcacagtaaataaacccagaccgatccgcnnnnnnnaannnttaaaattnnntcccnnnnnnnnccccnnnnnnnnnntttt

SEQ ID NO: 7376 - DNA, 1724 bp, Homo sapiens
  misc_feature (1)...(1724): n = A,T,C or G
ctcgtcgatggctccttcgcgttgtgctgtctcgtcgatgtgtgtgcgagtgtgtgtgtggcgctggtgtctcctgactccctgtgcncgcgtcgtgtctcgccgactcgtgtgagtcggctggtgtgtggttctgcgcgcagccgcgttggtgctggcgctcgtacgcgctgtgctntgtcgttgctgtgtcgcgcttctggtccgctgcgcgcggtcgtgtgatgggcgtctggtccgtggcgcgccgtgtcgtcgttgntgtgtactcgcgtagcggcgtgcgtcgcgtgctgctgctgcgtgtngccgtgcgcgcgtcgtcgctcgntnggntgcgtgctgatcgtcgtgccntcnggtcgtgctgctgtgtcgcgctcgcgtacttccgctgcgtngtgtcgtgctgtccgtgtctgatgcngtnccgcgcgtcgcgttcntcgtagtcgtgcttctggcgcntctcctngtctcgctccgactgncctcggatacgctctgctgcggttgntgtcntctngtacntnctactgtcgctgcttcgctgctcgtacctcgctngcgcttctatatccgtctcgcatgctgntctctctggcgcgtcactnnctgtcgtaggcgcgtgatgnctcgctctgctgncgtctgtcgcctgctgtcgnntctctcgtactcctgacagcctgctctctctgcgcgtgagctcgctccgctgcctcggtggcctgttgctcactcgattgctctattcgtgcncgcgttgcctgctgtgtctccgcctactcgctcncctgcgcgcgctcctcctcggcggcgctgntctcgtcgcctncccgcgcgctctctcgtctcgcgtctgtctctgcgtccttctcgtctctctgcgtctncggcgcttctcgcgttcgtggctcggttgggctgntggtgtcgtgcggcgttggnctgcgcgcgctgncgcgtggcgcgcgctgtgtccctctcgccgctcgcgtgngctntctgtgnctncgttctcgtcgctttgctctctctgtgcnttcctctncttntgtcttgctcgtgctccgctgtgtctctccctcnnttcgttctgctcgttgcncttcttnctcgttgctgcctctctctctttctctttgtcttctctttgctcgccctgctctcttcttcttcctnttctcttcttctctctcgtttctcncttcgcnctctncntctccgctcgtctctccgtncntgtctcgttctnttcgttgntgttcagttgttctcttcttcgttttcttgttctcttcgctcgtgtcgcccttcnnctcttctttcgtcgctccgtcncncgccgccgtctttctgtgttctgtcgtggctgcgcgttccgnctcngtcgcggtgnggngctgtctgtggnntttnntcctcctnctccccgggcttctttcctnccctcctctcttcttttctaaagagcttttctnctcttttcctcccctccgccttctctctttcttctcttcgctnctctngctgttctctcctcctccctctcctaagaggctctttcttctctttttttggtcttctctccctcccttaagccctctctctctctctataccctctcctctctctctctcactctcttatctctctctcacattctgctctcctcttttgattattatttatatatatattatatanatttatataaatta

SEQ ID NO: 7377 - DNA, 779 bp, Homo sapiens
tcaaaaagagaagaggaattttgctgaaggaagaatcatactccaagttttatatgtaactgatttagatgatttagataatgagactttgaaccattgattgatatttagatgaaattttggacttagaaccatgctagaatggttaggacttttagaaatgttgggatggggtgaacatattttgcacctatggaggacatggattttgggccagccagagaatggactgttatggatttaattgcatctctccaaaaggtatgcttacatcctaacctccagtaccttaaaataggaacttgtttgtaaatagggttattgcagatgtaattagttaagatgtggtcatggggcagtagggtgggtatttaatccaatatgactggtgtacttattagaggaaaagggtttacagagctagagacacaaagggagaaggtttccatgtgatgatggaggcaaagtttgaaaagatgcctttacaagccaaggaacaccaaggttttttggaaagcaccaaagatgcagggagggattctttctacaaatttcatggaagcatgtcccttgtaacacctttattttggacatttaactttccaaactgtgaaaacataattttttgttgtttaaaccccccatgtttgggaatttataccacccccatttggggaattttacttaagttgccctacacacattttcatttttgaacatttaaaaaatttttaattggtttaaaaccacacagttgattgtttttttaaaaagttttt

SEQ ID NO: 7378 - DNA, 736 bp, Homo sapiens
atcaactctggagttcgaggggagggatggccaccagagatccactcggtcacccaacagttttaccaaccaccccgggttcggaactaataggaaaagactctttgtgaagaagcgagccagtgactgaaacaccctggtggaaacctgttgacagaccttgcactttgtcttcagaataagtagctgtggtggatattattatgtgaagaaagaaaaaacagattttatggtggaaaaaacagtcaactcacacaaagaatggaaaaaaattctgagtttaattagtctcatacctttttcggtcggataggaactaacctttttatgaccacttttatacctattgcgcttttaagagaatagtgggggtgttgtttcttgttgattttttttttatttttttccacttcttttttgttattttatttaacactactaccctgcggggacgctgggtgggatagcgcaggaaatccccggaagatgtggttgtctttatttttccagttttggccttgtcctttattgctttttggtaaaggttaaaagatgggtgtttgggcgagcgcacaagtttttgttttctattgaagtttagtttagtagctttatcagttttgttttgttttttttattatacgtttccgtttggtttgtcatatgtgtgatgtttatttttaaggttgatgagtcccagtcgatttgtttttttgtcctacgtcgttgtttctct

SEQ ID NO: 7379 - DNA, 297 bp, Homo sapiens
  misc_feature (1)...(297): n = A,T,C or G
gctctaaaaaattattccttttctttctccttcccttccactttaggcctgggagaaccaatcnaccctccttcccccctanatcttnaanttctcancctcanaactttnanaaacacntttctttttttctataaaataatantaataaaaaacttccattcanaaaaaaaaattcaatttcaaanngtgctggtggtaannncatacanccttnttttaaaaaaaaatnatcatacctnntntnactntaataaaaanaataaaannaaaattnaccnccnaaaaaaaaaaaaa

SEQ ID NO: 7380 - DNA, 1090 bp, Homo sapiens
  misc_feature (1)...(1090): n = A,T,C or G
cgacagcggtggggggaattaagccccaaaaaaaagattttcggcaaagaacgcccaaaaatggagtttgaaaagccatcgcggaccataaaacggggcacatccagtgattttgctgggcctagaggcctaccaccactaaagggcatccgccgcctctgcttttagcacaaacattccaggaaatttaagcgcgcagatgactcgttttatattaaaacacccggtgacacgggagctcactagctaggcacccgttgagaaatagagcaattctttttcgagggcgacagcaatgacttttttgtggaagaggtgaatcccgcaagaggagaaacccaatcaattcgacccttttcctacacgagggccccaggagaagctagaaacaattgaaacactcccccccctccaaaccaggggcagaagaaaccaataaacgtagtgccgtactcccttcgaaacacggaaggtgacaaccgaagaggggcccgcattttattcccacgcaccccaggctcaaatcattagacgaagactagttggcaggaatttcttggccctcccggaggaagcgcggcctctcccctcttaaaagcgggaggagagcgcgcacgctgataatattccctcctatagtccacccttccttggcgtgagagggaaatatgtttgggggtgttgaaacactctctcgaaccggggaggagagagggtagttcctgtgtttttctccatgaaaacacatagttaccacagaaacttcgggctggacctgtatcgcagaaacgcncctctccattgcttcncgcgcgagggggggcgccgccaccccgcctctgcgaaagtgaaaaacacaacaaattcccgcccggcgagaacgggggaaggagagagaganaacaccacacgcgaggggcgctctcaccttattatgtgtgtagggaccaccgatatcgtaccctacccaccctctatccgcaccagtcgcgccatatactgccccgaagtcatatataacaccatataatagcggtgtatgcggcgattcccaaaccaccggatctcacgtgancgtgaatgaactant

SEQ ID NO: 7381 - DNA, 966 bp, Homo sapiens
  misc_feature (1)...(966): n = A,T,C or G
ccaccttcccacccccntntnnnnnnnnnnncaangnattcttataacccccaaaaaaaatcccttgctttttcccctcgacatttggacaacctacaaaaaccactatttcacccccggggtgtgagttcctccaaaataaaaaccacaaaccaacacaacttaccaccccccccttttttcattatccctttataccacacaaaaaaaaacaactaaaaaccaccactaaatatcacttcttctaataacaacacaacttaaaacaatccctccccccccggggggctttctaatacactcttaactcaaaaaaaacacaacccctttcaactatttaattcctcctaactcacacagttcaaaataaaacaatctatttcatacattctatctcttatgtttaccctttaaataaaacaaaaataccaacaaaaaaaactatatagacatcccaatccctccaccacctccacccatctaccacccctacatccccattatacacaaaacataatcattctaaattataaaactctgttaaaacaacaaactcttacatttaatccttacatcaaaatcttcttacaatcacaccacccccacttaaataataccacacaccccaccacatctatcacactttcccattaaaacaactaccaactacatccctaaatctccaaatttaaaaaattataatcaaacaactcccaccctcacacccattaccaacaatcacaaaattctaattaacatcataccaaccacttcaccacccattcttatactcctctactaccttacccacaccatctagcacaacattattataatcaataaaatacaccaacccccaccctatatcaccctaccatcaacaacacaatcataatcatatataattacatattacaccatctaaccacccaccccgtaccactcaagtcaccttatcacacacat

SEQ ID NO: 7382 - DNA, 1158 bp, Homo sapiens
  misc_feature (1)...(1158): n = A,T,C or G
gcgttcgccgagtgtgccctgacatgaaaaaagggacgcggggggcgggggcttctggggggaacaccggcgcgaaggattttgacgtngagcatgacctgcgggaggagttgggcgcgggcgggcgcttacccactcaattttttgtggtgtctctcccaagccccctcgcccgtcgaactcggtaaatttgctcgcacggggagttttcgacccccacgccaccgcgcccccacccgacgaggggccgccgattgtccgctatgaaatttccggccatagatggacacagtatgtcacacgacaaagaaagaggcgttggttgctggaaagatgcgagtgcagacaacaagtagcagtggtggtatttatgtaagtgcccgcacagtctagcgaatattaaggggagcgaataaacagaaagacaacgaagggggcaggcggaaagcaagcgaggtggcggcggaagcagaagtaagtgtgtggtagatgtcacccggccctaacgcgcgcccagccgtgtgtatcgagttgtccaccgtgttagaagcgacaagtggaggtgcagaatgactactaattcacggcgatggtaggtcacccgcgcccttagtgtgtgggcagagcagtcggtggagaactcgatgtaggagcatagccgaaaacgacggagaagagtatgataatagaggttagagcaagtagtgacttggacgagggacgtatgaccagtgtaaaggtgcagtggtatgtgaggttcgccgttacgatatccgacacgcttgacgtaagtgggaaacgtggcgtgagcgcaactgcgccaggtgacgcatcgaatcgggtgaccgtgagggtcacagcgtagcatgtatcaccacgggtggaaatgaattatgcgcagatgttcatagatacggtattggtggtggcggcgccatggccgaatggaaggtatcaacgacgcgacgatagctgtaaggagtagtgtggcgagcaggcgggcctcgctgtttcctcccacccatgtcctatattattctatatgtgagattgacctcacagagtgtcacatagtttccgcaacgccggggcgagatgttaagcgttacagttgaatgttccaagccatgttccggctgtgttgtgccacccagacgg

SEQ ID NO: 7383 - DNA, 1097 bp, Homo sapiens
  misc_feature (1)...(1097): n = A,T,C or G
cttgggcgcggcgcttttccgcggttttgcctgcgctttccttcgcgtccctcgtccttgggcggtggcgcgtgttcgtcggtcgggccctgccgtcgggcggctttggtccccgtacccgccccacgtggcctctgttgctctggtgcttctggccgcgggtgcccgtcgtccgccgtcccgcggcgtcggcgtgggcgtagcccggctcgcctgggcgtctggtctcctcttcgtcgtgcgcgtgaaacccgcccgtaccctctccgtggctgggtgtggcgcccagtccgtgccggagccgccgcggcctgcgcgcaggcgcgtgccgcgcccgtcctgtccccctcgcgcgtgcgcggttctggtgccgcgttgcgggttctcgccgcccgcgccccgcgtccgctgctccggcgtcctcgcggctcgccgtagcccgcggccccgcgtgccccgcccgtgcgcccgtncgcgcggcgtgctcctctgtgctgtcccgctggggccgcgtcgctgcgggtttcctcgcgggtgcctccccgccccgcccgcgctgcccctccccttctccgcgcgtccccctcgctcgcgtgcgttgccggtccggcgggccctgccgggcgccgcgcggcgtgtggttgccgcgggggggcgtcgcctcggccggcggcgtggtcccgctggcgcggcgcccgggggcggccttttttcctcgccgtggcggcgcctcttgttccttctccgcccccctcggtgcgcgcggagaggccgccctcgttcgcgcgcccgcgcgggctgcggggcggccgggcgcgtgcctcccgcggctccgtcttccgggcgcgcgcgccccctggccccccgcctccggccgccgtcttcctgtcgtgccggcccgcccgctcgcggcgggcctccttttttccctccgggtttccccccccgtggtcgaacgtggcgcgcgcgcgccccggccccgccgttgttctttntggtcttgccccggccaaactgnggtcgggcgcttctccccccccaggngctcctgttgcgtgtgggcccccgcccgctcccctcgccgccgcccgtggggc

SEQ ID NO: 7384 - DNA, 824 bp, Homo sapiens
tcttaatttccaccgctacagaaacaggggactgtggcagacccagaaagaaaactccagagatggaaaactatgatcctttgcactatgaaataagctagagcacaactgaatgtctgcttggaacacacgacatccacagaaacatctttaaacacagaaggtcttctccaagctcatctctggtgataggacaacagtgggcctcaagcttctccagccagtagcagaccagatctggtttcaacaaacttggaactctccaagccctttcctgctgtgaactgatttatttggatccatctcgcagagcgtgactgaaaagtgtccggccagctagcaccccatctgcaacaaatgttgtctcagaatgccctgcgaggagaggctaatatggatttcacctgcccggtccactagttctcctttagcccccccgcgaaaaaagtggaaatgggccgaaatcctctttatgacccatgagagcccagaaatttatcatggcattcggggggccccatagcactaagaagggctcccttgctcgtgccaccaattggccgaagaccttgactttaccctattgagggacctgtgataaaattgtacttacgcgccgctacccttctatgaaggataactcacaaaccctgcctacttgttttcctggcactcataataccggcgtgcggagagcgaagatttcgttacgtcagagggtggtattcggatattgcacagtattttgcggccagcactgagaaggtaactttgttgcgcaatgtacgcacagggccataataccataatgcgccgcagccttt

SEQ ID NO: 7385 - DNA, 729 bp, Homo sapiens
  misc_feature (1)...(729): n = A,T,C or G
ggcaattggctggctggccctcccaaagggtaagattccaggcatagcccccccctcacccctaattttttttttagccaatttgaattaaaacaaaagtcttctctaagtagttaaagataaatttgggtttcaaggaaaaaaagtcactcaggcaacttccaagaatgggagggacaaagggttgttataggatccagtggaaataaatttgggaggaatctcaatcatgttccaagagctttcaaggggccagagaaattctcacaattaggcctcccaggaaaagcaaaaaccccgccagcaggaaagcttggaggctaagagttcccttggaagttgaactactgcctgagaatatttaaacaaaaacagcaacccgttaatagccagcccttaaacgagcctctcaacttttgataggttatatttacacttatggactttcctatcccagtttataatccagctaaggctagtagccttgaatatttttagggctgcaatttgttcatcatttaagctaacagatgaaaagtccccccctagttgcctaagcacaggtacatttgttcaacaacaaatctttacctgaatgtccattgtatgtccgacgctgtcctgtatcctggggtggcagcctggggacctgaaaggactttgagtggagctaaagaaacagaaaataacctcccctnactaaaagttttttaatatctcttgcaatgg

SEQ ID NO: 7386 - DNA, 1150 bp, Homo sapiens
  misc_feature (1)...(1150): n = A,T,C or G
gcctccgctgggctcgcctccctttgcgttcttctccttcttcttctgggtgctcctctccggctgtcccctcgcttcggtctgcggccttcgtccggcctgggcgcgcgtcgctggcctccccggcttcggccgcggtcttcttttctgttggcgttgggctgtcgcgcgttcgcctgctttcgcggctcttggctccgccctttttcgctttcctggctttcggctcgcggggggccgcgtggctgtggtggcgggtggtcctctaggctctccgcgctgtctttggtcgggtgttccttttgtttgtccttttcttcgtctcccccgtgcggcggggcttccctgcgcttggctcgtcggggtgtcgtcggggccgtcgcgggctctcctctctggcgcccgncctgcgtgttgtccggtgcgtcgcgcccgggcgtcgcctcctcccgtgcgcgcgcccgtggctggcgctccgccgccctgttgtgccttnncgctctgttcggcttctctggtgggggctggtctctgcgtcgnggccggcntgtttctgtccgcgcggtctgctcgtgcgccctctnccgcgtcttctgtcgcgggggggccggcctctcgggggcgggttcgtggcggcgggtcgctccctggctgtcttcctgtccgccttggcgtcgcgttgttctcccccgtgctgctgtgcgccgggcggtgccgtgtgggggcgtgtccgctctgccgcgcgctcgcgtctctgggttgtgcgtcgccgccccgtggcctggccgtctgcgcgcgtgtgtgttggtctgctctcttgcctgttctccggtcgggcgccgctgtgcccttgcgtgtgtctgttcggtccgttcggccccttgcgccctcttttgcgtttgtgtggttgtgtccggtctggctctcccctttccccgctttgtcttcggtgggttcgggctcgttcgtgctgcttctggtcgcggtgtctggccgccgtccgngttgcctcgtggcgtgcccgcggttgtgttgtggtcgggtgtttttcccggtggggagggtttgcgtcnccgtttccccttccaggtctctttctcgtctcttcgtcctgtgcgccggcgtgcggcttgttggccgtgtttccccc

SEQ ID NO: 7387 - DNA, 1577 bp, Homo sapiens
  misc_feature (1)...(1577): n = A,T,C or G
cagaagtccacccagaatatgtcgtcacgatatcagtagatctagtttaaacgcagatagtccaagtgacttttagccangaagacgacaacacggccgcgcactaaatttttacgcattgagagatgctatacattcgcgcaaattgttgctgtccgacttcagcatcacgtcgaacacacgcagcgtgttttctatcccgtagtatcgacctgcgcaccctctcccatcgacgtgcaatgatatgagagtgtaatctattcctcgccagcgtatgatagtgactctacatggtcgacgcgcacaccgcctatctccacgtatcgtgtcgctccgtcgggttgtatgtcgcccactattcgtctgtttcacagcaccgttattatgcgtcantcaagttcaatagtnatcacatgcgtacaggtataggctgcgtgcgcggtggcggcgcngcatcgacattctacgctcacgagcagagacaccagcaacgtagatgatgacgagcacactaagacgtcctatggattagatatgcagcagcttccgcacgctgagttacgtcgagtgacgctactctgacctgcaagaccggatcacgaccgacgaatgtgatgagggtgcatggtcaacanatagtagatgggtacgcatgccgtgtgacacggagtaaatttgttatagttccctagagcacaatcgtatggacgcacgagcggagtatagagtgttgtgtcgcacactccatatatcgtgcacgatgcagtgtagtttcatagtgccgatcaataagcctcgcggtaggtgagtgtgcgccacccctcggacatattgatggacgtacacattgtagatgatttgcactttgtgatgtcgacgtagtcaccataggcccgtctgctgcaacagcgtaatcgagtgcgatgtctgatactgagtaagatgaagaacacggtgaacagaaatatatgagcgcatctataggtatatactacatagtggagtcggntggtacaaattatacatacagcatcancgaccatntngatgtaggtgatgcaactcggctcgtaccacgtcttgatacagttactgtataccactatattctagacagtagtaccatcgcgtgtgatcactatgagtaatgagagntacacatacatctgagtattgtgagtactatgatcccgtgcagtntagtcgnacanagttacgnctctacantgcgtagctnacgntgtcacaagacgagggaggcgctatgagcacacgtgtgatgtnatatgtacacaggagntanctagcaccgtgtcgtgtacggcgacagcactgacgtacgacgncgacataatcgtgagcgctcgtgcacagtttgacagtatggagagtcagcactnagtntgatctacgtcagcaccggagcatgangactcgtatntgtcattcgcacacgnacgcgtncacgacataagcgttgttgatatacangtgtcgctacactatctgttgatcgcgccacaccngctatccctcactctccgtgtgtntgatatactctgactctccgncgtctg

SEQ ID NO: 7388 - DNA, 1768 bp, Homo sapiens
  misc_feature (1)...(1768): n = A,T,C or G
cacgaggccgtgcgcggtcacgtggtgtacgatagcatctgagacgagagtagatacagnanngtnatgacagacgaaagnaaggnncggttttcattgtcgttccgagtaccacaccacacggtcgttgactacgagagcgtaactcgcacttctgtggntctagtgacacttctcgctgtgtgcgtccattcactcatccgtcggcatgttcgatctgaccacacagaagaccagtgacgatactatataaccagatcatacgcgagtgcgcgtntgcngtgagtcacttanctactcgtnaacagactctatatgacgaggttcacgtgtctgcacactctnatgtcacgtcggagtatgcacaaccgactacgacacattcgatattcantctaantcgatacgcacagacagnagcacacagagatgatatgtgtcgggacnaatcaggcgaatgagatatcacagagaggcccnctgctcagacactgccatagcacgtgcgcgagagnctgcgcaccatatagctgcgctngtatanatacacatacagactatacgactaatngactgatgagcgctgcactagtgaggctcgcgcattatacagtgacgagagtagagagcggagtgcgtggcgtnatctatctcgcgcgcgtatgacgacgctacgctactccnatgaattcacagtattaatgcaccagtatgtgacgcagcgattgataatgacaccagcatcagcnatgagtgntgacgtgatacatcagtcgcgactatacnantcacgcggngagcgtgaagtcgnatcgactgtgagacgttattgatgtgtacgnatgcgatnagctcgtgagtgaatagatgaaagagtatcagcacggagctgcacgcagatatcgaatcgcgaatcatagtgtctgtgagctcacttgacgggagtgcgtagacaagactacataagagtcgnacggcgcgttgagcgccgttgcgtagatagccgtgagacgtgcgggcgtgctacactcgcctccgctctataacgtatgcgcactgccgtattagtctcgacacgaccactgtacgagacttatcacattttatnagcagtcgtatcacgttctgccttactntcgtggcgagcgacgcgacatcgtcataaatcgctgcgacgcgtatgacgcacttacgtgatgtcattagcgcgatccttgtgaagatgtattatcgagcggcgccgccgtcgactggtggtctacacgataacncagcccaagctcaccatacggcgcaggatctatatcagtgttctgctcagcatgtattaagaactcgacggagatacacatatgtctgaccgtgctccgtgagnagcacatctcctcggctcntcacacacccactcgaggaatcctggaatgtataggaactataggatggcagtggcggacgagacgtagtgcgctagcangcgcagcgagcagctgagacagtagagtgttcttgagtgataatgtgatacancatatactctattgcatcgtcgcagatgtgatgcaacaaccgtgagngaactagcgtgctgatagnctgctgtccacgcacgcgatgattgtcgcgcncagattacacgatcatcgaaaacagcctgatgtantgtnataatagacagatgtctgtatgtagagcgncgcggcatgagcgcagactcancgtcgacacatcnccgctacgcgcagaacagcgagggttcgncgcgctgcag

SEQ ID NO: 7389 - DNA, 1181 bp, Homo sapiens
  misc_feature (1)...(1181): n = A,T,C or G
tcgtattaataacaccaatataatcttccgcgtagcccgcgcccaattccaattgccgcatttanattttatgataccgactttccgcgattactctttttacgcgaacgaggaacggttgttcccgatatataaattttgcgcccgattgatctcttgttatcatgtaacatagtataatcgccgtcagcccgtggagagtgaatataaatatggtatggaagcgaaggcaatgatggttattaagatagacagaggatttatatagttaatagtgacggcgaaagttcagaagcggtacgttaaacgagtaaccacaatctgatatcatctcttttatttattatgacgataccgataatgcgagactaagataaaccccgctatcgattaattttataccgccgccaccgtcacctccgtactcgtatttaccggtttcgcaaacgcgagatattgcggttcgtatatgtcgcaagagaatatttcgtgttgccgcttgcgagcagttgatggggcagggaatattatttaatttaccgaccgtgttgagcgcgcccacattttctctatcgatgtacgcgccgctcgcctgttatgttatccattttatttattgctgcgccgcaaatttatgcccgaatatttttcacctcaaagcgagagcgcataatatgtttatcgttattaaacagtcgacgcggtaatggccgaatttcttattacgataaattcaacgatgatcggcctacgctttataaaatattattaatactttgtcaaagcccgacgcggctgttttaatacaatgatataatatacgctccgccgccgcacgcgggtgtgttatatcataatgttgttaaccacagtgcccacgacgtgataatacggatgttatccgcgatatatagagtctggtaatgtactcaacgatatgtgcaaaaactatgtttatgtcgaatgcgcagatcgtcggcggaccggtgtatattagtggttgaggcgacgtgctgaatgattattcttgcttgaattgtttacctttgactgcactcgcccatagactatactaatattaggtagacgcaatctcacgatccccgtccggcgtacagtaagatgattatgtatgaaataacggtgcgagagcgcagttatagaccaagactctcaacaat

SEQ ID NO: 7390 - DNA, 1070 bp, Homo sapiens
  misc_feature (1)...(1070): n = A,T,C or G
gttggggagggngaatgtaagagagaatttgaaagaaattagagaagagggaaatgaaaaaagcttaaaatggaaaccggcggggtgtttaatcagaatgcctgcgctggtttttgcttatcttaccgaatacaggtagcagtttgtgaagggagtttctttgttgtctccgcccgccctctcatgaatggcctgaaacagccacccaccggaccatcccacgaaatacaataactagtgaatcgagatgtggaggaaaataaagaaccaacacaatcccttccttctctcccatcatcattcacggtatcttgaatttctataatttataattttagttctactaatttgttgtcttgagtgaaatgcggtgatctcagcgggagagtgtagtaggacagacggattataaaaataaccgttaaattaaataagatgtgattgacgtaggggaacaaggaagaaacggacgaccaaaggaagacaccagaatcaagttttatataagtaataaatataaatagcattcctccccttcagacgtctcaaacaatcctatcccgcttaagccgtcctaccattgtactagatgtgcctgttagggagacggtcaataagcgagagcaccatttagaatttagataccagcaaactcttgacgcgcagctgcatgagacgctgatctactcatcaccacatctccgctgccgtttataagatgaccgtatatggtcttactgataaccatcccatactatatcgatatcatacgaatacttgacaggatggacgtctctctattacgtgtccactctctgactctcgatactatacgtcacctcataatcatcactagtctancttantatcggctcttactctgtagagttacagctacaaagtgtatttcattacgactatggtgcacaccaccgtacacatcgtcgtctcacatcttcctttctcttataccgcacgctaatatgattaattaatagcacacttcgcgcacccgttatacagtcaccatgtacgtcgcgctcacatcactcaacggctatacgacaagt

SEQ ID NO: 7391 - DNA, 1156 bp, Homo sapiens
  misc_feature (1)...(1156): n = A,T,C or G
tatttaaatttattttaattattattatataagcctcttgccggtcccttatatcatagtcagcgtagttttatattttatatgtgatgaaagatagaacacaatataaatcatattacaccgattattgtataattaaattatacgaggggagagggtgacttaacacctacagaattccatatataatatagcgtcaatacgttagtaatagtagatcgatatgtatacgaatcgcgctgcggcttatgcgcggataatgtatatattaatcagaaatcgattttagctatatatatcattgttaggagttatgggtccccgccaattattagtttcgtatggattattgccgccggggggggacccaataaatttgttgccgcttttacgatacgcataacctctacggtttcgtggcgcgccccgataattagtgtacggagttgaacgggtgtgggagtgtggttattgagtattatgtgattggtatccttcaattttaatagggtgtattgtataaatgcttcgatatttatagatgtttaagtgcttattataggaaggcggtgacgtgaccataaattttgcttttgtgcgtatctttttggtagtataggagagtgcgttttgaaacatttggaaaatatgtgatttgttatattggtcagagtcgcgtgcgatatgatgttaagtactaaatatccagttagccctctgttaatatagtatgaaggatttgtgtatagattaattatgaattgatataccagagtgaagaaatatcctgtgtattgagcagagagaaatcgattattaatattattatgaatgtaaatatagtatatcattctactaacagcgctttatctaagtgtaataatacatatgtaggattacgtaatcttgatcatgtgcgataattaatcttgatgtattagatgtatttcatacgttagtggtcttcaacggcacagattatatatatgtcagagtagctgacagtatatacgtctccgcgatcaaacatgctcacgttagcgtagcatatatagatatgtatagtacgtgtacataacatgactatattatattagtgacnactagtatagcaataacgtatcgttagctgctattttatgtgtgatttattgtt

SEQ ID NO: 7392 - DNA, 935 bp, Homo sapiens
ctcacctctaaatgcctggggtatcccggctaatgatatcccattcaatagcaccttcccctctaccccctgtaaggaagttcaataataccaagttggggcaaagagcatcattcctgcagaactgcccaaaagagttgccagtattccatgaagaagttagaatattctatattaataccaaaatgtccctgcctccaaaacaagcttagaggaagatccaagcagccagaaaaatgaggtatccatgagctcatcatgtcaaggtacaaggaggccacgtcatctgctcaaaaaccagatattcccagctatcgcactccagtgaggctctgatggcaggataagaataatgggaagatgaagataaagaaaggatgactgaaaggaaaccctggaacaggaagtcaggaagatgggcctgaattatgtaaagatcagaggtttcttcagagtgatggagtttggacggtactacccccaaaatatagcaccctggcatttgagagaacagcagaagctattctcataatctccttgcccttctttcctgaagcagatcataaaacctaggaaggtcacttctcctgctcctttcccctgacgcaggacataagaccctcattcaagaggtacccaccctacacctgcaggaaaggaatatccttatttctgaagacaaggggatacagagaagaatcaaacaggctttgctaagttcaccccaatttattaccacttctctatcatacccactctgtccaatcatgcctttgcgtgactacttacttcttcatcaaacctaaggatttataaattatttataaaggatttataaaaatacatagttttctctgtaatatttgtatcctcatttctgaaggctcctgtgttatgtaaagcttataaaataaacgctggatgctgtcctgaag

SEQ ID NO: 7393 - DNA, 1117 bp, Homo sapiens
  misc_feature (1)...(1117): n = A,T,C or G
cgtctgtggtggtcgtgtgtcccncggttccgcggtcgtcgtggggtggttttgtctgtcgtgtgtggcggctctcggtggctctctggtcggggcgcgtcgcgtctgtctgtcgccgcctctgcctcctctttggccgtgcggtgctcgggcggctcggtgtcgggtgtgccgcgtggcttctgtcgtctgtgtgggcgggntttcggttntctctctgtgntggggtctgcgtgtcctctcgcgggtctggtgcttgttgcctgttgccggctcctccctctcgtcggtggtcgtggggcggggcgtttttgctgtcttgcctgtccgcttcgctggccgctgnctgtctctgctttcgcttcttggtcncccgttgcctttgtggcgtcttctctgtggcgtgggtcggttggccgtcgtggcgctcgcgggcttctccccctccggtgccgggcctttgcgtgtctctcgctttcggttcttnttgtgttgtcgtgtttctggggggtgcctcgtttcggtgcgctttctcgggcgggcggggcttgctcgcttcgtggtttcgtcggggggcgttgtcgtgggtggttggggcggggttgttcggtgtcgtcgccgcgcgggtccgttgttgtcttcgggccttcgccgtcgcgcgtgcttgcgcgttgtggcgctgggtgtgtgttcgtgggctgctcgtggtgcgtgcgacaacgngcgcgcggtgttttggcgttcctgccctggttgggtggttgttgtggtgccgggtcgtcgggttgtgttctgtttggtctctgttggcgcgccgtgcgtgcgtngnttgtggtctgtctcgtcgtcgcggggttcgtgccgtggctgcgtggctgccgtgtcggccgctgccggtgtgcgcgtcggncggtgtcggtctgtgttgcgtnggtcgggtgggagtcgttgtgttntccgctctgngcgggctgtntgcgcggtngtgntgtgtgttggttggttcgcccngtggcaccgggttngggtgtgncgttcgtcgttaggcacnctttttgtctntgtgtcgtttgtccggtcggctgcgctgtctgcgtgggcgtcggggtctgtccgt

SEQ ID NO: 7394 - DNA, 612 bp, Homo sapiens
atcaagtgttggatgaccgtgcctagtggggagcttacaccatagtgtgacctatcacattatgcagagagacatgttgagtgggccaaaccttatgaagacgacggctgaaaagtcataacatgtttcttaagtttaatatgtttattttttgttaggatggcacttatcaatcttaccttgtgggttttatctatgatgtgttggatggcttcgtaatcttgctctcttattgtttgacctactctgtctcttttatcttgtccccctacattagaatgatgtgttcttcgccttgtttttttttttttttttctttacccacgagatggccttcgcgggggcctccctctctgtgtttccgtcttgtttatctatttcacgtttttagtgtgtttctttttccccttttcccttgtcccatatcattttcctcccttttttttcttttcccctcccctttttcctatatctcccccttccttttctccctattttagggttcgtttcacactctctttccacctttttctttctttctgttttttccctgtttcgttcgttctcgtcctccccctcgtctctctgttttgttattctccatcatttatt

SEQ ID NO: 7395 - DNA, 905 bp, Homo sapiens
aaaaggcatatggaaggagcatctctctttgctgctctcctacatcggaagagatacctaccatatatgctaccaccacccttatgtgtgtatatctcgactgctatcctactagcttcacttgcatataaacctagaatgggtactattccgactggaatgagattacagtcctttcgttcgcagtcactaaccatgcagactcggattgcattcactagcttacatgctcagggcattcggactcctctcactagcccatagaaataaacctgccatacaaatcttctaccctcagttctctccatttctcacagggtgccctctcacatcgcatacacaggccaccaaatacttcaggatgctatacatacaatgcataacgaaacaacgctgctctaactgtacacagtctctcacaattgataatttatttcaatccaaaataacattctctcaacgtatatttatagattatcgagcgacataaataataccaaatattcaaaaccataagcacatgcaccataatctaacaccctccgtatacacacaccaatataacacacccagcactcacactaactaatcaatcaactcaccccccctaacgatttccacaccaacatgccacccactgacaccgtgctaacgcgcaacactatacaaacacgacattacaccacctaccgtcccgtacatctacccatacatatccctccttatacactccataatataatatacctatctgtctgcccattaactcgataccactcacatactcctcacacatattacctaaaaacccaatattttatgctccatacctatctccctaaccttacaaaagaagcccatacacacccacacctaacacacacacgtccaccatatttcttttg

SEQ ID NO: 7396 - DNA, 1275 bp, Homo sapiens
  misc_feature (1)...(1275): n = A,T,C or G
gatccantgtggtactagtatgatgaatgtctagtgagccttgcgtccgtctcttgtcgcgtctcaataggaccgttgtctgactcgagtcggtgagcgtagataggcngcgcgtattggctacacgtatctagtctcacgcacacagctgtcgtgcgcgtctcgtatgcgcatccgtatcctatgcgcgagcgatgcctgatgtcgcgcgcgccctcctggacgttatctgataattacaatacgctgagcacaactttcttcacgatagtccacatctggttatagtctctcctactcgtgcactcatgccgtgtcatcatgatctgctctactgatccttccctcgcacccacttcatgctagtcagtctactctagccgtgtcttgagcgaggtatgcagnccagcacagagcaggcagtggtatctatgttcattggtgtgtcacgtcaatagtctcaatggtgcgtcaccttggtcatgcgcctccacacctcacgatgagggcatgcggtcttcacggttgactaatagataacttgtcgagcatgttgtcgacgcttgcgtaaccaactcctcatccctcgactgctgctggcgggacctcataatgagagacctaggaagaggacgtgtacccttgatcgtgtgaatgtcgacaaactgtggggctgaaagcggaccacaaataggcgtgaccggggacggcagaactgccccggtcaaccaggtttatctagacaattcacacccagcacgagtanaacattcagagagtgtgcttgcggttcactcaccgatacacacctatggaccgatcgcgacagctatacatgggataggatatatttgtaatgtgcctgttgctgtgcttccatgagatcgatgtgggaactgactcgggccttcttcatgctcgtgcagcaagcctgagcccgaaaatgcacacctacttgcctcacgctgcgccgcacatagaaggagcgagcgctagggtgttctgttcatggcgtctgagagagagagtaacatcctggtggcgcgcatcatcgtctcgtatcgtgtggtgcaaaggcgctgaacctgagagccgtcgacttaccgcgagtggtgcaatccgctacttattcactttgccaatatctgtcagcggcttcagcagcccacgaggcgtatcatgtgcacacacatctgtaaattgtatgtacatcattgtagaatatgaaagcgacgagcattccgcgccatgtaagccgtcctcctcctgctacag

SEQ ID NO: 7397 - DNA, 2098 bp, Homo sapiens
  misc_feature (1)...(2098): n = A,T,C or G
ctctcttcgaaggatagccagaccacccacgagacagggatggagaaggaccttaatgtggcagaacctgcgcgcgggagaggcgcttcagaggagaaggaagatctagcnctctcgagacgagcataggagcgcgccagaggataagagagcagcgccttgtgaggaggagcgacgagtgtaagnatgcgcccacnagacgcacggatcatgggcggtggtcgcgaggtgagcgacgcgtgattgcgtaaacagcgtctantaggagtgacacacggcatgagcactagaacgtaacacnacgtcacacacgcactngcacaacacaccaatgcacggcaccactgcgagcgcctcgtatcatcacgcgcgcgccaccatcgcggcctgcacncagtgagcatatggtcgattgtgctcaagtactccatgtcacagcagcaccgtcagtgtccacctncatatcatcgctgtcaccgcnacacacacgcggcgccacacatcggctcgccgcacacgatggcgcacaccgcgtggtcactggatgtgcgganngagcgcgacgcgataagatngggacgngacgacacaacaacacacacgaaancactgtgcgacatagacatccaacanactaancgagtaatgcagatggtacnctcacacgtgtcgacgtgcgcaatcacagacgacgtcggngtcgtcgcactatcataacgacgactatactcactcactactgaccgcgccgtgcgcgactgtcgctgcgcgaacntaancgaancccgcgtcacacacagncnacnatgtctccgggactcagtgtcgcgatacgtactantnatgcatgcattatgagtacgatgatatcacagatctncaatcatagctcgtccnagtgcgactcatgcaccagcngntcgtcgncgtactgtctactactaaacgacacngtgtgctgatgtacgacnactcgctcacactatacgncgagcatcgtgcaccgctgacncncgntagagnganatntngatgaggacacnattacgatgtgntgggcagagcgacgcgacgatnacacgcgcagancattactacngtcgnctattacgtcgatgtagtcgcntggcaatcgantagtgtggcgtcgtcganagcaacnagtgngtaacntgacgtcntaccacnagagatgaagcncgtagtcgcgagnctgcgcagagtacagctgacagcacgacgacgagtacagtggagntgtagtgcgcgattagatcgtcagtcataccagacatgantctnatagcgacatngttcggaatactatatctgatagatctcgantgcgtgangtctgctgatcgcngacangatcntgantangacgtcatttncngaccacgacgncagacctnacagcatcancnatcagcngtcgacgtgagncgncgcnangcatgngnccnntgcgtagcacagcatnatnacncgngtcagcnggcgcacctaggccgagcgnancgncgatncacnacnntctgatncagcanacntacagtatgnctgtggatgaatganaggcanacactnctgattgngtatancgtcnatntncgcagtnntgtngtgctgagtcnaccgcatcgntcngtacggagcgtccagtgctgtcgcgatngcnnaactactcacannatgctgancagtcntacgtnantcgtnnctgtcattagctacgacgtcatcntgatgtnataancactnctcagctcatcaactgactancnacnnaccaacgntgtgctgngacggatcgnggngacgcggtagggcaanncgtncagtcgactagcggntgacggacatnanngtacgtacgcnatggtngcncgatcagcagtcagtnntggatgngtangtnncntcantantacccgtcctatgcngtgtngcgtcntanntanctantgantcnnanntggtcatcagactcganngtnagtganagtggganagngntgataacnnatgagcantgnntcgatgtcacagctgacgatcattgacgacactacgagatgatgagacacgatagtat

SEQ ID NO: 7398 - DNA, 438 bp, Homo sapiens
aagttccacaatggatgttcctgatgagtgtgcattcgtataattattcagagactcaaactcctaccatttaatgtctcctccatttctggagtcccaggagtcctcttcaagagagcctctgtctttggctgaccttcatgagaaagtatatggaggtcacatgggtgatatttcatgctgagcctgtaagttacacagatccctctgctcacatttcacgggccagacaacgcatggccactccacagtatgggaagctgggacctgcactccagttctgtgcttagacaatagaaaaggaagattttgaacatttaatagtctttcttcaacttataattggaaatacattttaaaatagtcatatattcatatagtagaataaaaaacttgatagtagttatcaaacttttttaccattcaaaaaaaaaaaaa

SEQ ID NO: 7399 - DNA, 880 bp, Homo sapiens
  misc_feature (1)...(880): n = A,T,C or G
cttaattttttaccaggccgtggtttccacaacaagttttgaattaagccccatgctttttttaatttacccccccccagagatttttggttctttgggtttttgggcatgcgccaaaaatggattgaaggttcactagtagtttgacccgtgctgttccccccccaagttttcattatcccagtagtcctttgttatcagtggaccttctgcagttgagctccatggggctgtaaaccttgaagataagcccaaatattagccaatatttgatagtttagccccagtgaatggatttctgtctggtgataaagtgaacccagtgtggctcaactttaagttccctgtggatatccttggaagagtttgggagttgagtgatattgcccatgatggaatgcttgacagagatgagtttgcagttattttcctcattttccacaagagccagatgaaataggcagaatacatattcccacattttaaaaatgcagaaagagaaacttaaagtgacttgaattcttgttcacagacggagtctcactctgtcactcaggctggagtgcagtggcgggatctcagctcactgcagcctcggcctcctggattcaagttattcttccacctcagcctcctgaggagntgggattacaggcatgcaccaccacccccggctaatttttatatttttagtagagacagcgtttcgccatgtttgccagactggtctcgagctcctgataataggtgatccactcgcctcggcctcccaaagtgctgggattacaggcatgagccacctcttcaggcccaagacaaaaatatagttagagtagatggggaatagtagtgtcatcatttaataaacagagatgggccg

SEQ ID NO: 7400 - DNA, 2038 bp, Homo sapiens
  misc_feature (1)...(2038): n = A,T,C or G
tccgccgtaacagtctattgagntcatgtctctggtganancgacngngngnngngtntgcgcangccgngtgngnnngngngngnngggngnggnnggtacgctagtanagctnngncgnaangtacgcgacntngcttgtgctgttcattnntatatatctacancnacnacgcctcgaccaacngctgagatngcacgngcagaancnatagatgacncntacagtcgatatattagntatgtattaatacagantagacgtaactctgtctgactgcntatanntacaacgagttgggtgcatgagtcgtggggctgctccgtcanctaatanacnacaaacagcagacagtgcanaagcccgcgccncngagncngagccncncnancgcacgtctgacgntgcggntgcgtatgctnatatacgatactatatagctatatntacagttagagcgnatacnagccagagcagacatgtggcgtagcagagcgcatcatgagtgacgggcgatcntgctcgtntantcatcangcatcacgnagcgcgcgcatnagctngagtatcatcgctcacagaagtctgtgagcgtaagtagcaggaggcagaagagtantgtcgcgcagtctagagtagtatacntatgcctcactggtgtgtctctcctcagctgtatgcgtggcgatggtgagtgcgactgctcnatcntnacncactgcaagatatgatgagagcagatatacacgaatacgataagancatatataagncacgncgtgatgatgtcactaacntatagctgcgcgacggcgtatngtgtactagcatatactacagnctcacncacgcagtcacgacgtgtctgtagtacttactgatnagctacgcgtcgatctaggatagngatcangctcgttgcnccngagtgctgtatntggtcgacgtcgcacacgacgcgttgtgcacacgacgcncagagcanctgagcaggtcatgtgtgcgcgcgcatgcgangagactcgacggcacagctaangatatgattgatcgtacgcgcgctgcgcncgcgcacaggcctataccacagacgacgcatattcatatgtcgactgatatcatcgcgagacgctgagatatatacgtgagcgaatganantgacacgtcaccactccgcgctacgtctctctncacatagatgtatgatcacgtaatattnatnattaggatagagagctatacagcgctcatacagactgcagcacatatagcgacgacgctcctcgctataacngtgactgcgaccncaccacgctgncagntgcacagcgctccgtcgtanccgcactgcgtacaatatagatgatacagtcagtcacgacgcgatatcagctcacngtcacngtccacgcatatctatatgagtntacgtcngagcgataanagcacacatcagncgcagccgactctatctgatactagcacacatgacagtctgatcaganncagnntatnccancntctcgcgccngnccgcgacgagtgatncgngtaacttcagtcgagccccagnagtcngatactatgagtctgcagcatcatgtacgtgtnantagactgccacgacanctnacgccctcgacgtgcagacgacgctcagtcatcgacgagtgagctgaggnatgctattcgtcgtcatcanatncgccgccacgcacgatcgacgcantctacactcctcacgtgtnagcgatgtnagacgcgcntgcgatgtgatntgacgtaatgctcngctgcacgnctctagtcgcgcagcagtgcagtatatgagtgagatagatgantgcngtcagtgcgntactgacgcgntgantcgntcnagagagtaccgcancacgatncaggcgtantatgcacncagatagtatgttgtctantntactcagcactcccgatatgtaagantctaacgacgngatcagctatatnacgactagcacatgatgatctgntaancagcgaagtgtagaganacg

SEQ ID NO: 7401 - DNA, 881 bp, Homo sapiens
ctgaaactccgaatgtttttgacacccatggaaaaatcacgtgtgaagcccagtttttttgccaaaaagcctttacaggttgatgccgcggcgggcggggttaaaaaaaacaagtctgaatctagcggccagggatctcttaaataaccaccggtccaggtaagccacctgtttttgactgttacaaatcccatggctaaaaacaggggctggcttgaaacagttcccccttccctgaaaactcttcagcgtctttaagtttaggccaagtatgtgacttagctccatgccagctccagaaccaaccaacaagaactgatggatttcggtacatcttttggggctcctgcctgtgggaaacagcttgtctttgatgtctaaccctctacatccatgtctccttcctgtctgtgctgtggacttcaaactccagcatcagacatgaagccaacatcctgcagagattgctttaagcagctcccacagttataacaacatcatggccctatagcaaatatcataaaaatttttccacacctatattcacaaacataaaatcttttattggctctgtttctcagttgaatcatgactgatacaatatgagaagcagtatattattatttataggtaaggtgtcattaattacagatgcatgggccaggcatagtggctcatccctgtaatccaagcactttgagataccaaggtaggaggatcccttgaggccaggaatttgagaccagcctgggtaacaaagtgagactctgtctctacgaaaaacaattttttaaggtgcatattataaacctagggaaccactaaaatatttttaaaagaagcataaatgataaaaaaacaataaatggagatgcagccgg

SEQ ID NO: 7402 - DNA, 372 bp, Homo sapiens
gaatctggagcatggaagttctataaatattcaagaataaaattcatctcctaaagtattctcaagtatgagtttctgaactaatacaggaatgaatatcacagaattcagtgggaggacttaactctgggttaccaaccaagaaactccttcctccttctcaaggttaaagtgagaagtaatgttactttaccaatttctccagggcaccctggagaaacagaactctgtgtggccgccctgcaccgagtgttgctcttcatatatgtgtgaataatagcaaataacatcaagaaaaagccgcattcccctatgtagagctaatggtattgtaataaaagtgtgacaattgaacaattaaaaaaaaaaaaa

SEQ ID NO: 7403 - DNA, 127 bp, Homo sapiens
  misc_feature (1)...(127): n = A,T,C or G
ccgggatcccggagggcctcctcacggcggcgaaaatgttaataaggcgcggaaaaagccggggcnttgttctcctcccgggctcttaaaagcgcgttaattttccccgtgccgcgttgtgtttaaa

SEQ ID NO: 7404 - DNA, 2055 bp, Homo sapiens
  misc_feature (1)...(2055): n = A,T,C or G
cgcatgtgtattgttggtattagtctaccgtctgctctccactcttgatcaatatggtatgtattgctagcagaccgtcatctaatttngttttatatagcccgatctcagattctcattcatctctatctctatctctatcnctatatatgtggagctgctgatcatataggaagtgaataggtaggtctagagngcgcagtgctatacgtaccgtacagcctatnttntgatctccgcgcgccgcgacggcacctgtcgcnacacatatgatgaatatggcaatatcgcatcgcgagtaatattantcgtcatgtataagctganctatatgctgctgttaagttgatcgcgatgatagatgtngntcatcgaagatatgcatcaagtatcgaacctgtctgtgcgagttgttctgtaatagtcgacagcgccgctatgagcangatgcgaagcagtcatacgcgcgcgcagctgagactgtattgtagtctcgtcgcactcagtctgtcgatngctgtagtacgggtagagtgcgtnctcgacnctatgactgcactgtgagtcgtatgcagcncttcagctacgtgcgctgatgcgtaactcnatagggntaccacgctcngatcgtgatgnantcgcagctaggtcggcgcgcntcgtctanacgtatgttagacntgtccctgttnatatgacgtccgcagtctcggctctgcagctagntctgacattgaatcagctacatcgcgngntactatgcgtcgtagatcatntacgatcagtcacatgtgtctgcgtgctgcgccgtgtatgcatcattcgacacatctagtagttncgacgtctggcgnctgatactgtcntgagagtactgactagcgacgagcttgtactctgctcgacagccgcntgtagntatgcngtcattggntactatntcgcctgctgcgacgtcgcactgcncngcantccgattatncatatcatgtccgcagntattnatatatncgntgtatgctcatccccggtcactcgcgccgtgagtantgtacactccacacatcnatgtatccgtgcgctgactgtcacgaccgccncctgtcgactcgnagtatagtatcagtctcgtcgtcgatanatantgatagtcgcgatcgtgaagtntgcgccgtncatgcagtctgcntcgctcgtntnancgccgctgctgatcagtcatagtgtgncatcnncatcagtcgcgnagcgcgtgtatantagtctcagnagtcgacnagtcatngccncgacgatgnnagtattnatgatntgattatcatcacgtttgtcgatcgctagcatcgnatcagtctgcagcntctccctcantantgattatangtaacgatcccngcgcncttgatacgcncgtgctcgcgcagctcgtctatgtcgangagcacacgacagtatgntcgctcttacgttgtcatatgcnatcgtgcacgcgtccgcagtagtantactantatctcgtccacngtcncgctagtcatacatgatactgcatctcgtcntntatgntgtagcatgcgcgcgatgcagcttgccattagntccagtcgttagtcacgtatctcgtatntgntnattgtgatgtntncngctgattngtcgtctgccggcgncngacgcgcantgtgatcgatccacgatcgacggtagatgcatagtacgacgctatatgggtatcgtcagtgtacagataggagctgctgctacgntcatcctacgnncgctgctgcgtaccgatactnccntaggatgtgatcgtgcngcatccagttcgattagcatgatgctaatatcacgtactgtcgcgttactcncccggttnctncgtngtgcgacgcanatctgcagacacatttngtaatccnctgcngnatgatgnntactaatgcgagccgtactatttncatnatcananatcacagcagacataccatagtatgnacngcacattcatctcaagtgcccatatcgnctgctncgctcttagtctagtcgact

SEQ ID NO: 7405 - DNA, 308 bp, Homo sapiens
tttctcatcttctttaatctacccaactaccgtatcctcgcctacaagatctccccttcccttaaatgcgatctcacttcttcatacccacattttccccttcctcatcactcggaggtcataaattttattaattcctcccaaaacccatcctaaacttttccacatctttcaaaagtccatactaaacgtgacggtctggttatagttcatcgcgcccttcctgatatccccccaaaatttctctcagaccccactgcagtacacccccgtgggcatccccgtatttttctgtccataaaccccac

SEQ ID NO: 7406 - DNA, 1534 bp, Homo sapiens
  misc_feature (1)...(1534): n = A,T,C or G
agcgagtatctcacggtgcacagacggcggcgcgcgagcatcaggagtaatcagagtanatctatagtatataaatntagtatcgcgctgtattacttgnctnggagncatcagantanactatactatacatatngaaatatttcgctgctacnaccgcaccacnagatggnatcacgcgtgtcgcgactgactcgtctgttctgagctntcattctatcactgatatcgatcgtagtantgcctcacacatcactcgattctgagaagtcgcagcgactcatcacnataattgtatgaaatatcangctcgctanacattacataagcgtggtctgactcactgcgatctcncaacactcgtacgcagcactctgtcgtgcgagagagcngctcagaggagagtgtgagagaagtgagacgcagagattggaangtgacatcacgcgtcgggcgttnattagtagtcgtacaatgcgggcgtgaggtagtcgtactcgttgtacccgacttccgatctggggataatgactgttaattatgatgcaccgcctctagcgtcgctctcccgatatcacgccgcatcgactcgtatcgttatggaccgttcatttcgtagcaggtctctcctcacccagcgaatctttgccgcgagccgagttatgacagagtttnttgttcattgaatatcataagtttgataattgacagtataccgggcagtgattcagtgtatactatcggttattcagtatcgtgcatgttatatcgtctatccacgcctcttatagttaatatcgcgccttaggtccgcgctgctgatcgcagttgctgtatacacccatttcccccggtgagcccgattagttgttatgctcagtgatgagtagcccgctgtttagtgtatccgctccgatttctgatatcatcatcgtgtcatagcgtacggctgtacaactagtatttgctgacatactcgcgcttcagcgcactctgtgtctgtagtcgacacgtctcgtcacttgctcgatacgcacgcgccgatgatatatgcgcaactcgtcacagtctccttcgtttncgcantattatgcgtacgcgccgtggtggccatcgtccgaatctggatctgcgtgcgtctatatcacattgtatatcatacacngtcacactcacgacgcggacgcgtgccgattcgatatcgataatgtcgcaacatctntcattgatgngcntagctcttcgctgtttcgtgctactcgctacgagtatcatgtacactaacgtgcgaggtatgtgtatttgatgaagtgcngaccgtgttagttgaatncagcgtaccctcttagantaggcgcgatatgtcctacatctatgatgtaatagcgcgttctagagatagcatgtgaagtcnacagactgcatctctcacgtcgtcccgantagtattngttgtctatgcccgcgcgacgcgctcgacanatgatacagcggcgagatagatatcgtacaatcgatgctncgcgtagcgcgt

SEQ ID NO: 7407 - DNA, 784 bp, Homo sapiens
  misc_feature (1)...(784): n = A,T,C or G
acaaataaccgcgagacccaaaccgggacgcggacgcagcaaaccttggcagagaactgctaagcgccacacttacaaggccaacaacaccgcggcggcaangcgcggcaaccgcggcgacacgccccaccttctgggggcgggttaaaaaccccacgcggggggcggacccaggggaagggcacaaacctcccaccacgcacccgcgcgcgcaacacacccaccactggacaccatgcagacatgaccgacacacaaggggccggcgcggcggcgggacacatgcggggccacacacaaggacaccgagacgggaaacaaaacagaaaaaaacgggcagcaaaggggaacaacgggaaaaggcgaggatggtgggtgcgcgcacgcggaacacacccaactcgcgcgggtaccacacaaaaagccacagggacagtgcgtggcgggacacccgggtggcggggcgccacgcggaacatataacacacccgccgcgggcgtggggcaaaaaccacaccgcccggcaaccgcgacccgccacaaatagggatacacggggagcacacacgaggcgcacacgggaaacagtacaatatcaacacgcaccggacacagggggcaaacaagagggggggggggaggggcgacaaagaaatggaaacacatcaaaacacaaccgacaccacatgccgcacacggaccacacaatacaacaaaagggccgggagtgggggcaaaggacaaaacaggcccacaccgccgcgcgggagcaaaaaaaaaaaaa

SEQ ID NO: 7408 - DNA, 1746 bp, Homo sapiens
  misc_feature (1)...(1746): n = A,T,C or G
agcgctcagattagtattcctgatgcagtcagtctctagtgctgctcagctcgcgcacgcccgctatcganagggagtngcgcggtgngcctangcntctctgcagaagaccgngacgcgacgcctgatgaactatactcttctgcangcgcgcgnacacgagaacgctcnacggcactgcgctcgcagagcgtggggtggatgaagcgtcgagcataacacagtgaggatatatcgtatatngcgtcagagtactattatatactcacgagcaccttgntcatcgtgtccaactaagagctgtcgtcgactgtgcgactgaccaggctgagngagacgcacagctgncatgacgtcgagagtaggcgatgcgactgatatcaccatcngatctgagacagtcacgacacacgcagcgacacgcgcgacactgatgtgtgcgcgacgcatgcagcaggtgcatcggaccgcgacgagtactcaggacgatgatagacgtgtcactcnagcattacatctatagagctngntangtagatgatctgcatcgtccgcctgcatgccgccgtgtgcgntgtgtatatcactgactctgncacgcncgncatgcgtgtgngcgtgtagacagagcgactcatcacgcnagtacgcgcancgtncgcagcgcgatagcgtactacatgacatgcacgatatagcggacgcgtacagacgtcgtagtggtgctcgcacgcgctgcgntgtgtcatcaatacgtcgcaagngacacgacggcgctctcgagtcatngtgcgtggatganactggtcgcgcgcgctatcctgctctcttatcgtcctcgccatgatagatnatgcncgtctcnctacgtgacgngtgttgtgacaggancagtcgtgtcataccancgtgtgcgcgtgcacgagcgacatncgtagcaccgacacgtcgtgctacgttgcattatgagtgatacgcagcgtcgcgtcgcgacgatcgcatgcgcantaacatatactcgcantgataatgagtcgcgtgttgtactcgccgtaccgcgcgagtgtacgtggaccatgttagatcggcgcgcaccgtctgggcgccgctnacccgacgatagataacgtcgccgatttaagatagcgcatcgtagtcgcgcgccatncaacagcgccgttatgcgcgccgcgctctaatatcactctcgtctcgcgccgcttcgtgctccgtcgcgatggccgccgcccgcgtataatttatccatccggcgctacnctcacagtctcgacatatatatatatgtcagccccatacgctcttacgctgtcgcaacgtgtcatcgcgatagtacccanangctctgcgtgtaccccacgcactcttatgtggagactatgcgcacagacggcgcttcatacgacncgcattttggatgccaccgactctgctatcctcatagtcgccgacctgtatgtcgtgtctctctcgctgcacgccgcgcgcgcccatcatactccgcgcatgaggagctccgaggcgtatatattgtatgcgccgcgcgcaccacgtcgcacgcgattactcgtgacctgtacacgcttcgctcaatatnatgtgtgcctcgtccgcacatcaccttcgtctccgcaggagatagcgcgatagtaccntgctcacatatgattccgcacncgcctgcacgaatgatctgnacagcaccgtacacgatggagtgttatgacg

SEQ ID NO: 7409 - DNA, 943 bp, Homo sapiens
attatccttccatgtcgttctctttctccctttcgcctggattacttatcttccaatgctgttgcctacttcatctccccgaccccacgaccgtcccccctcccgccccctctcaaatcaacagtgttccgcactatcaaacccccccaccctcccctccgtatttcctctcggacgtcctctcctttcgtggtgtcccccacggtaacctcccccactcaaaaacggcacccgtgaggcccttcactgcacaaacacccatctcctccactctgtaagtgctccccgccccccccttgcgcactccatcccccacctcccacgcacacctaccatctgaccagcatacctccggcggttcggcggggtgcccatttcactctcaccgtccacccccacagcacaccccgttcccccgtgccccctcccgcaccctccgccccctccccccccccacaacccctcccaactcccccctcctcccccccacagtcccccccctccacccccaaccaacttttttaattcaccccaccccccaaccgggttctgtatcccccaacccctttacacatccctcatgcaagcacgtccccatccttgcgtccacgggtaccaaacagcgacaatcccatgccccccaaatcatatgaacccccctagcaatgggattgactgcaaaggagcccaagggaccttcctggggtgatggaaatgttttgtcttgattgtggtaatgattacatgactatgtttgtcaaaattccgaggcctttatacataaaagggtgaattttgctgcatgtaaattacccctcccacacatgactttttaaaaaggcctgaaatcttaactactcagctaaaaataaaataaaataaaataaacacggatgcggccgatcccttttcttctaatattaatatctcgcgcccgtatacc

SEQ ID NO: 7410 - DNA, 1078 bp, Homo sapiens
  misc_feature (1)...(1078): n = A,T,C or G
cttttcctgtgttcactcctctttcctctcctcatccatctccctctcatatgttcccccacgcagtgttggtgccccttgtgagaatataccccccccgccgaccagccagcggcgctgtgaagtgtgagtcccccctcaacatcggtgccttgttacccttcacactacaccacccctattccccctttccagtaaacgtgtggttgtggcaagcccaccctcctgtgtttcttccctcaccatttggcncccctcgcccctcatgttcccccgttttcctctcctctcaccccactctcataaatgtgttacttgttttggtaccccaccggatggtgtttggtgtctcccttgaccgctcccctccctttgtatatcctctctcgccccatccttgttctttgtgctgtcccactcgtccctcctggtcgcggcggtggtgttgtttttctcctccaccttccatctcccaccctacgatgtatctcctatcccgcctcccaccaggcgcccgcgtagtaggggtgttacgttcatcggtccgatccgttgactcgaccacaccaattaacattcgatctcaggttgtccccgcgacactgcttatggagtggccacaccccccatctaaatcccattccccctnttcctgtctcttcctttccaacacttctccatttttgtccgaattattactattaaaggaatcaaaggcgtaggagagatcacgggtatatcgccccgatggctttgttcatggcgcggcaatataaataaaacccgccgcccaataaaaaagcttcgccttgtgtttcattttgcccacaaaaaagaggggttgggagtgagtagtgtccaagtggggttcatttttctatgaaatccttccaggagcatgaagggggtgtgattttaaatacccctttgtgtcaaggcagttgagaggcacatggcgcataactaaacaaacccgtagcttgaagacccattcagtgagtcggttaacaaatataaaaaaataatcaagttgcgcccacgtccccttttttttttttttttttccggtatcttctac

SEQ ID NO: 7411 - DNA, 1535 bp, Homo sapiens
  misc_feature (1)...(1535): n = A,T,C or G
actacaacacccgagcgactcaaccgcaccccgaaaggccagagagagagaacttgagcggcgaaaccactgcggatgatcttttcccccggaccgtaccacggcgccgacaagccgcgatcctaatcgcagaggcgaacgccccccccgccccacgggtcgcgtcgccacaacattacatcgcgccacacagacgataaaataagaggacataagccgagagtaatagtgagaaccctgacgcacaggacgaagcggcccatcgcgacagcaacaaggaccaagcagcacatcgccgccgccggcacacaagcacaaagcctaccgaccaacgcacgcccaggcacagcacatctcacgtgcattttatccccacggggcggggaggctaccactgacatccgcgatataagagccgcgagactagaatacactcgaccgacacgtaccatgaacttcgtacgagtgaaactatcgacaatcgcaccagcccgncgaccagcagtacagtatattaacagagaccacatagacgaacgtcatggggagcgcatgaccngaacagacataaaatcagagacgcaggatgctacaaggacgatgtcgccgaagtgcgcatcgaatcagccgatcacgcatgtcgtgcgtcacgcaggatgcanacagcgtatactacatgacagcctacaaggatgatccaacgaactcacgccaagatgagtatcgcaggctcgantgacatacgcgagtatgctaagagcgatgatcaccatatagagncgcgcgactgacgtatgacaccatcgcngcgtagctcatggcgcgacgcgtgagcacgtatcatccacgccaggctagcaccnagctcaggagagagacacacgcgacacgagaacgcaacacaagcacatatagcgacacggcagtacacgacccaccccncgcagttanatgancgtgaanctgntcgacagagtatcctcacgcagagacaagagactagacacaacagacatcgctacatagcatagctcgctcatgtagagagcaagcgcgatacacgtcatgtagaganangtacacaatgacaacgacactgtagacacgcagtcacgaagaccnagcgagtatcagcgnccgagatagatagcagcgcactcgncngnacagtagcatcacatacaacacgccgcacaagccacgatatctacacnacgtaacgcctacatacccagcgcgtacgataacacgctacggatcganangaactcaggcgagtgacagtgagaggcgacgagcgcgccgacgccgcgagaccggccancacatcacgtacgcatctcacacantcacagaagnagtcaccgcngccacgtaggcgctgncagcgagaganctccgacatatcggagcgtacaccagacgacacgtcgancagcagagtacatacgctatcantcgcaactgcgctgcggcgaaggcagcgangacacgcgcgtgcacgcgantagnagatgcgcgcgcccnagcgcgag

SEQ ID NO: 7412 - DNA, 1049 bp, Homo sapiens
  misc_feature (1)...(1049): n = A,T,C or G
gtcgtccgcctctggatcgagtcctgccgtccttccccacctcccacatgtcctttcatcgctagcatacgcggccaccacgtctccgtgcggaaagcaaatgagttgacaccgcagagctgcgggcagatatttctctgacatttatacatctcatcacccctcacacccccacctagggttgtctccgcctcccgtctccgcccgttgcgtggttgttccttaacttccccaatgcgtattgcanactttatgccgccgggataggtggctatcttcattatgctgtctgcccttccctgccctctcattaaacaccgccctcatccacacccttcactcgcccattactcatctcgcatcttcttgctgtactctacttctctcgcccattattccttcgccgctggttgtggcgtctcgctccccctgcgcgtcatacttgccctcggtctaccctaacttgtttaggtcacgctgtattcacacaagttttcttaatctctccttatatactctccccctctatcttcccatccaactcttctccctcctcgacaccctgacacacccttcccctctttcctttaccgcaaataataatacttttataacaatcttttttacacccctcccccgcctcctctccaattctttcttcgcatctttggcgtactcttttccgtctcgcgttttctatctttgccttcgcactccctattccgtccgccctcataaataaaaatgcccggaataaagcattttgatatctaaaatcccccaactccgcgaaccacctgcatgtcgtctgcttcctgtgccttccctcttcatgctctgggtgtcgcaagtctctgatcctactcgccggggccggtttttaaaaacatggagtgtgtctgtcctgctttgcccctctactctctccttatctaacacaagtcttatacatcagcttatataatacatgggtaggtttcaataaagtaattacgactgtttcgtacagccccttctcttaaatttttttatttgcggggctactctat

SEQ ID NO: 7413 - DNA, 832 bp, Homo sapiens
cggtgtgtacgagggagaggtggatttgaggttggggggaggtggggtatcgtggggtggtgacaggacaggaaaatgaggaaggaaatttgggaagagtgaagagataatgatgtgcggagagggtaaaggtgaggaaagaattaataaaattctccccttgcgatgggatccgtgggtgggggattttgtgaaggtgggttttcttaagtataaatatatagaaagaagaagagggggaaggaagtgaggtgtaagagtagagaagggaatagtgaaaaagaatagaggaagggagtgaattttaataagattgtattaaaaaagagtaagggaaaaaatagttgtggctgagaggaggggtgttgtgggggaggaaggagtagaataaacaaaaaaaagtagatgagaattttttgtgggatagaagaaaataaaaaattaatgattttttttggccgcagaaaaagaggagggagagatatagtgagtggtgttggtgaaaggggggaatttttaatgagaaaacaaataatatttttttgaagaaaaaagattattgagggtgattcatttttttttttagggaaaaaaagaggatttatccccccttctgggggggataaatttttgggaaagaaaaaaaaaaccgggggttttttaaaggggggggaagttttttaaaaaattttattggggggggggggggggggggataaaaaaaattttttttaagccccccccttttaaaagagccccggggggggggtttttatactccccccccgggggagaatttatttaaaataaaaaaaaaaaatttttttttttt

SEQ ID NO: 7414 - DNA, 1057 bp, Homo sapiens
  misc_feature (1)...(1057): n = A,T,C or G
gggggggggcccccccccgggggggcaggggggggacccccccttgcaacccgggccccagggcccatgtcnggcgggccggccgggcacacaggggcgggcgggggcccgcgggggnggggtccaccggggnggtttgaaaccccccggggggcagcacaagggggaccaccccatngggggcgcccacccggggggggaacacgaaacccccgggcgggccccccccacccgccccaggcaccccccccggggcacccaggcacccagaacaagggggccacacgggggaggaggcaaccatgcagggcaccgacacacccggcaccagggccgccacccaatgcaaccacggccacacaggcacaccgacacanggggcagggggggggccacaccacccccaacacggggggggtgggggggcacgggggccgccacacgggggcccccgcccccccccccaccggcgggggacccccacccaccacacggggggaccccacccaccggcccggggggggggggggccggggaccccccccccacccaccggcccaacggggggggggaccgccacgggggtggacaacatgcgggggggccacacccccccacaccacacacggggcgggggcacggccccacaagggggaagggggggggccacgggacccccccgggaccccacacggacggggggggcgcgccacaccccccacccacaccaggggaaccgggaccacaccccggaacaaccaacaacaccccactgggggggacccacaccccaccctgcaggcggggacgcacgcctggcaacttcaacgcctccaccactacctcttgccgtgggcaggacctgcggngggggcatgcaccccaccctcccgctggtgacgcctgggggtgagggggccaccacacggccaccccaacggcgccgcggggcggggggggacccaccacaagggcacaggcggcgcccacgggggggccccggggggccaccccaccaggaccacccccaagggggcggggggggggggacccaccg

SEQ ID NO: 7415 - DNA, 1473 bp, Homo sapiens
  misc_feature (1)...(1473): n = A,T,C or G
tggtatcatatttcgatctcgtcagatannntnnnnattacaannnnnnnnnnnnnnnggnaggctaggctggcngntcgnactncttctttatattatcncacnncgctacagcgataacctaccttactaactaataacgccacggcaggctagacaccattgtacaacgtggtggttgggcagctcgtagcaaggaacatctctttacaccacaactttactgtgctgccacctggaacactaaaaaaaagaaggcagggtgcgccaccccctctctcttttgttacccttcctggcttgagccgggacgtggaatatttagtgatgattggaggatcgagcgacctcttaaacgctgtgccccaccttttcgagggggggggggaggggcaaaattaattgtgccctctttttcaagaaanaaggcctccatcgtggcgccaccgccgccgcattatattaaacaaagtagcagatggatcgggatggatgggcgggtggcgcgtggcgtgcgccacgcgcctgtgcaagatggggagaaggaacagaacgcaacatgaggtcgcagcgcgcgtgatgtgctacgccagccgtggtgtcgtggcgtcgccttattgctgcggagggcgtgtggcgcgggatggtagtgggtgtcgtcgtgcgcgacgcanatctacaagagacggccgcggggcacgggacantgaagtgagcacgagtcgtgagtagaataagtagancttcgtgtacgtcggatatcgggcgcgtgcacgcgcnagaagtagtgagatcggtactgatacgtccacantngcagccggatgntcggcggcgtaggagttncancgcggtcantngctgcgtgtgcgtagacgacagatgacttgcagatgcgcagaagtggtgcgtgtatcgcagacgcgcctacgcgggcggatcgctacgagcatgtgctatggacgtgcagacacgcgangcgctgatcagtaagatgtcggtgcacgacgtcgtgtgagagganacgagcgcagctcgccatctgtgcntgncacgtgtggatcggcatcgtagngtgattcgtcgcnagtatagatgagcntgcctagctgnatcagatngantgtngntcgcagatctncgcagcntagaccaacgatagacagacgagacgctgacgcagatgcgtgcagtgctgcgctgctagtgacncnacgcgcacatgggcagatgccagcgcactgcgtgctgcgctgctgngagacgcaagatacgagcgcgtcggcncagcgancagatgtgcatgagcgatgagatgngtcagtaggnaggnagtgacgcgcgcgacaaggagatagtcatgnacgcantacgctacggtacgtgttacgtatattgttcactcaatangtactacatatcangagatgacgcaggatggctgagntgagtgnagagtaggtagcgacgagg

SEQ ID NO: 7416 - DNA, 786 bp, Homo sapiens
acaggatctcgctctctcacccaggctgaaatgcagtgatatgatctccactcactgcagcctcaactgccctggctcaagtgatcctcccacctcagcctcctgagtagctgggaccacaggagcatgctcaacctgagtgctcggcaaggcaaatggaatggaggatccacactcctggaagcagctttcaaccaacaatgatggacagttagtggctagaaactctcgctttatcccttagttgggcttaccctgtatgagcatataccctgtcgacagcaccactgttggccagcactgttgagttccagttgctcagcatagtgttgatcaagaatttaagggtcctggaaccaatccccaatggatattggagaaatgactgtatttctcacttcaaattcctctaagaacagaaaccagaagattcttggtggggaagaagtgaggacatttggggtaaaaagggtaaatgtgctttaccacgcttaaataagggccaaaactggaacaatctctgttaatactaaagagctatttagggaggggtgcagacaccgacacagggaatttctgggaaataagggggggggtaatatttgcttttgtaaggggaaatatttggtcagaggaaatgggagggacaaaaccccccgtcttgggcgcttgggggttctggatattgttaaataaatagatgaggaaagtgagaggtggcgtgggggggggagaaaattttaaacatccgctcttggaaccctacagctctgagggcctgagcgt

SEQ ID NO: 7417 - DNA, 853 bp, Homo sapiens
  misc_feature (1)...(853): n = A,T,C or G
ccctttttagtttaaggtgtaaagttccaaaaatatctgagcctgaacagattagaactcacgggttataagttagattgcccaaaagtgagccagaaagcaagccagcttgacaagttgttgacttgctataaagacctgaaaaagtaaagagtctaagagagagattgcttttgtattgttaaaggcttggcacaaggcttcactgaagttagattcactaaggaatttcttcnatctctctctctctctttctctctctcaagccatccatccatctattcttttatctatctgtctatctagaattgttcatggtagagtgtttggtgctgctggcctcacatcattttagttatactgctaagcagtctggactgtataagtgatctggtaattgagtttatacaatatatctgggctcagtgataaactagaagagagtagtaattatgtaatgttctgatccatcacaagtcataagctttagtcactgccttctgacaggactcagtggatacataggcacagggatctggagaagtgatgatatgagggtgaaacagaatttgttgctatttcactaatcctgcttatatcagtaggggagaggggctgtgatttgcctaatgacacttgtgtggtgaggcaatgcttaataagaaaaaaaaaaaagattataatattttcaccataaatgacatttgaggcaccttcaatttttttaaattccaccagagacattgataagcatttttcatcaagtcttgtttattagtgagtacagtcattgtgctatagaaaagaatagataaactagaaatagattaaaaaaataagctcagatcagacg

SEQ ID NO: 7418 - DNA, 780 bp, Homo sapiens
tttttagtaaagacaggttttcaccattttgccaagcctggttgcaaactcttgaactcaagcagtctgcccgccttgggctccaaagtgctgggattacaggcatgagccactgtgcccagccagcctgtgaattttgacatgctgaattccataaagcctcaacagaaccactggaaatttctgtagaattgatctcttctgacctgcaacaagaggaatatcagagaaatgcaatttggccaatctaaagactcctcccatattattaatctaacacaacactttagaaagatattttattttttaggaaaagagccataatcatcttaaatgtgaaaaaccacatccaataaactgatataaagttttaggaacaagggaatatcttattgtcacgcattcacagtgaaacccattttaatgcaggtccagagccaactgcagtcctgtccaatcccataggtacaagggcctggctcctcttcctgtgtactgcccgacttcctcatcttactgggtccagcataaagcagatgtccactgtcttcctcacatgctgtgatcttggcttagaggtaggcacagtgccgctccagcagcgaggggttcgcgttacttaggaacagcagctcttttttcccttcttctgtaggagctttctcatgttgaagccaattgttttccaaataatactgaatacaactttcaaattcctttgggttatagttggaaaccaggatgggaataaagggaaccagggcatcaaatccttcctag

SEQ ID NO: 7419 - DNA, 881 bp, Homo sapiens
ccgtcgcaccctcgaacaacacatcacatcatcaccccacacctacataccacacccctcgacgccctcacaaacctcgccagccccaaccgaccggccaaccagctctaatctccgcgagtaaaaccaggtatttcttgcgcaaaaagacataaccccaatcaatgttgtaagccagtcagagcctcttactccccatgtctcaactttaaattgcaggtactctctaaattaaccacgaaccagatttaaggttgcatcaagggtcctcctatgtccccaatccaaatgtatgggaataatagggcagacaagttttccagttcttcaggaagtagcaactagaatcaaggaatttgaggcccaaggctccccaaacccaagagtaagcccagcaaatatgacaagggggctgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacatagcaaagactcaaaagagattctgcatttcacatcagttcacaagttcaagagtcttccatttatcttagcttttggaataaattatctttgaggtagaaggacaatgacgcagccacttaattccttgtgtctgcataaaagcagatttattcatcacaacttcatttatgtgaataaacacagatgcggccag

SEQ ID NO: 7420 - DNA, 472 bp, Homo sapiens
cttctgctgcagaccttagatgcctgctttccagtattcgataagagaatgatgtatacagctgtaaacaacttcaaagaaggacacacttgaaatgccttgtgtgctgtagttgctcgttattttgagttcagtccactcttagggcaggcacagaaagacaggacctgtaagtaaactcgctggattcatcaaatctccacagaccatttgatgtcttcgaagagcccactggatcctgataccccagtcccctgcagccttgaagcgtgttcacgctggctgtggttgggtctggccctgcaatgcaggacatctggacgtgaacacagcctcttcccagagagatgagcttaaagagaacgacattatgggttcagagcatgagtttcaggaaaaagcttgattagtaatttattttaaagaaatatttacttacgattacttaaagaaataaatagcgatgcggcag

SEQ ID NO: 7421 - DNA, 1003 bp, Homo sapiens
  misc_feature (1)...(1003): n = A,T,C or G
ttttgtttgctactcattgtgtttcattggatgtgcatactaccttaccaccgttccttcctgggctcttcttcgtgttgactttctcttgtttctatggttctggtgtggtcacatggcgtgggcgggcgtctatttgtggtgtttttccacattgttggtctgacaattggtgttctaactctttgtgggtgcccacatgggtgggtctactgatccacttgtgttggtggtcacattataatacctgcatacgngcacaacctctactgggaccttgatgttaccattcgtccattagtttttttgttttgtgtgttgttgtgttaactcatggtgtggaattgtatatcatggaacatggaanggaaatcactggccacacgtgggacacattggtcacntctactggttgattgggggggcaaccacagacaaacggggtgtggtgcggatggagtgtctacgattggggccaacacacctactcaacagttttgctcccacacacacccatggggcactattcaccgtcaacggggggggggggacgtgaacacacctctaacctttgcccctgggtgggggcggtaccgcgggggtaaaacgttgctggccgtacatccacacacactgggggggtgatatcttcacttgtaagttggggaaggtacaatgatgaccacaagtgtggggtggtgtgccctacacacttcatgggatctgtgtccccacatgtcctatccctccacaatgggggcaacgcaccctaacgcgggtggttgactctgcactgcccatacatcatcataatacttttcttcactttcttgttcttttactaaactttcttgtgggaaattcgtgttgtgggggatctcaacggcaccactaggncacgtgggggggggtgaccatccacagtggcaaaccttcccctccgtctgtactctgttgtcctacacccctgataccacacacgtggggggggcgggtgcccagt

SEQ ID NO: 7422 - DNA, 1495 bp, Homo sapiens
  misc_feature (1)...(1495): n = A,T,C or G
agcgagagccagccaacaacgagaccacagcgagcgagagaaggaacaggncgttcctaggtgggacggacaccgacggnaggagcgctggacgaggggaaanacaaccacgaccgcgcgagcggagacggcgcacgcgcggccggcgaccaaaacaggcctcttttcaaggacacgatgcacgggnaaagacctacaacaaaacgcacagagaggatcgcagagaagaaaggagaccagagaaagtcagagaancacacacggagggcggcgagacccaaagagcggagagagggaggagacgacagaacagaacggcagcacgcaccgaatcacacagcggaggcacacgcacgccggcaaagggacacagacagggaggagaggantaccgcganacagaggcacaacaaagtgttttataacaganaccagcaggacgacacagaagcacgcagcacacagcgaccccgcggcgaaccgcgagccgaacaatcacagaggagaggagcgaggggacacagaaacnagacaacaagcagaagaacgagagagagcaagcaggacggcaagaaggataggagagagacgcacgcgaagcaggcataggaggagagaaggtagaaaggcggaacgagagaacagaagaggtgtaaacgaaagcagaagaaggggaggagagggggaaggcagaggagaggagggggtagaagacacgaagagagaggaacgacggcaaccacaagagaggagcgacgaacaaaagacgangcgaggtgacacatacaaggtgagcgtgaacgcgccagcagacgcagaaccaacagagtgcgagagagaggaggagagagaacnagaatcgtcgaggacggataggtggcgacgacggcgagacagcgaagagagagcgacacacagatagagngcgacggcggagagagcgcaaacatcgacgcataagaaggtcggcgacgcgacgcaccgagccgcgaagnacaacggaagtcaatagaggatagaatgataacaacaagggagggtgatgccacgcnaggcacagagtgagagagtatgacagcgtgcaggagagagcggaggatgtgtagcgcgcggagacgctgacggcactcgcagagcagagantaaacgaagcggagagagatcgcgancgcagagacagagcgcnncgagcgcagggncaacagagagtcagagatatggcgcagcgaagatcagtacaatagagggcgaggagagagcgcggcgagagacgagagntacacaacagcgcagagngcaggaaggaggagagantcgtcgagaggaacgcgcacgacgagcacanagagagcacacagngaactggagcgcacagatgcagagacgcgcagtcgcagtagacgcgcatagtacgatagagcagacgaacgagcgcagcggaggcgagaacacaganganacgagcgcagacnctagagacgctcggcgacacaaa

SEQ ID NO: 7423 - DNA, 644 bp, Homo sapiens
ggaagcgggggatttaattaagttggtccgggttaagaaacaatattaagtatttttcttcaccaacctaaaccctgaggttttgcctggttttataatatcccttgctacagggactgtcgaaactataatggttgttgttcttaaatcccccatatttttagatgtttttcggagaaccaagatcatcggaagaataaagttggtggtggggctattttaggcagcggagagcgtagagcgcgttgccacaggtgcaagtgtgaaaaataccgccctgcacaatttaggttgtggtgaatcgctgggagccacttggttatcttttgtcgctgcgtcttgcgttctagcagatgtgtattagcagttgtgcgagcatcattccgagatccgtgtgtttgtgtatggtacgatcaagagggacgcgccgcgaacactatttagggtactgtgtgttatagaaggactagtgtgtccgttactgagactcttatctgccgtcctcgagtgaggattggtggataatagcgtctcggtctgcgtaaagatcacgggaggtcgcagggagagagaatcattagatagatgggtaagggaattcaatattaatagtattatccatatcttttagtttgataggatat

SEQ ID NO: 7424 - DNA, 1100 bp, Homo sapiens
  misc_feature (1)...(1100): n = A,T,C or G
cttataagccacactataccaccacggcacttagagctgacatgcctctctttttaaccaccgttcagggtcacactctgtcgcccagactggagtgcaatgacgtgatacttggcttactaaaacctccgtctgacagacacacgggttgctacaatcccaccctttctgaggagcctgtgactacatggtttgcttctttacttcacacagcttgagaactactgcgtgacccgcagcataaggtaatcaacgcggaacgaaaaccctaattgtactacatctagggctatgcgaagccactaccagattaatagtgtttnatgatgcgagacgcatggctccgcgtgcgagtagtcgcgcctatgcgtcccgcttactaacaatcatacgatcagcatagtacacatcccgctgcagaagctctctgtagtccttcaccgagaagtgctggcgacgacgtgtcctacggacatagaaaactccgcaatgggctcatcagtacacagcgcatcaccatcccatagattagggaagccggcagagtatactcatgactgttgaaaggtagtgagacactaacaactattcaagccgctactcttgcagaccctcctagattatataagtaagtggagcgaaatgatgaaggtatagtcttctgacctgtttactcactaagcgcgtatagcgactactctactagatgtattatatgagagatgacgagtacgatacgggaagatccgtatattgacagacacccctaggtcgctgaaaactgacacggatcaacagcaatcaacgtcatgggattcgcacgttcataatagtacttgaacattagctgcgcagtccgactattccactatctgcgacaatcccagatgtgcgccacactattacgatatacaatacttcaaccgcatcgccgcgacgtcccaccaacgntacncgtaatatannatatataataaatactaacaatataattatgttgtgctaaaatattcgatattgtcggctcgtatattctacgcgttgtccactcatattttatatacgcctagtgttattgtcgaataccatcgttccgtccc

SEQ ID NO: 7425 - DNA, 1006 bp, Homo sapiens
gacagggcaccaccaagcaggagaagcaattttgggaccaagggcagctcggggacaccgggacaaggcggggggacagggggggctcgaaggggggacaaaggggaaaaagggaaaaacagggggcaccggggggacccaaaagggggggaaaaaaaaagaaaagggaagcaacaaaggaggaaacggcggacaaagggcacaacgggggcgggcgccaggggccaggaggccaaaacgggaggacagacacaaacagggcaacagggacggaaagaaaggcacaaagggggaaaaaggggaaaacgaaacgggggacggggggggaaaaaaaacaaacacacagcagggagcgtagcgccgaggagagaacacagcgggccaaacgaccacacagaacacggaggggggacaaaacaaccacaccggggggacacacagaagggaaaaaggcgagggggggcagggaacaccaaggagcccaagggcaagggggggagcccgccaggggggggcaccagggggggggaaagacacaacaaaaaaaggggggggggcgcgcacaaacaagggaagggcggggcgccgggaaccaggggacaacaaaggcagggcggggcgggcacaccacaaccgcaaccgggcaacggggcacaccaaacggaaacaggaagggtgaaacccgggggggggcaacggacacaacaaaccgggaggcgggcggggcaagcaagtgacccagccaaccacccgccccaccacaaacggtgttgcgcatacggaagcgggccgggggcgggcacacaacaaaccgggggagcgcgggagaacaggggggacgcgggggacgacaccagcgcaaccaacaacagcagaacaagagggcagcggggaccaacaacacacagggaacagggcgggcagcacacggagcgggacacccggcgcgacacaaacaaaccgggaagagacaacgagggggcggcggcggggagcgcaacaaaag

SEQ ID NO: 7426 - DNA, 1406 bp, Homo sapiens
  misc_feature (1)...(1406): n = A,T,C or G
atgttatcgtttagttantattatgttgtgtttacatattctattctggtttattattaagtcttacctgtaagcatgaggcaggtgtgaataaaggagaaaagaataaggaagagtcaaaaaacgacctaagagttgccgactcgtgcggggcagcgtgcgaggtgcgcgtgctggcgtcgagcacgggcacggacaagagtgagcagcctctagtccagcggtaggtgcaggcgtcctcgatcccgcccgcacctacactaccaacaactgatccatcatttcacacaccacatcctctacttccctccacactacagcagttcgtgtcactatctcgtaatcaaccagactagacaagaaactcgtgcgncagaagaagcgatagtganacatacagagagagagcaacgtagatacgaggcgactaataaagcnatgcaaggagtatatagatcgtggcagaatntaggatcgcacacacatatcnatatacatatagatcattaagtcaacgcgacagcagaaactacactaagaatagagaaggcatacgagganatacatacanacataannataaatngtagatgtgcangtataatgcgcgaggcatgtgtcacacacngagccgagtagaggtgcaaagcgntganantgcgtcgcactaccacgtcagcttgataacgccatctagaatagtcgatcgccgttcgatgacgagccggagtacataacagactcgatatatatatatagaatcttagtcgatatctgagtatgctaactatcagatctatgttcgttcacgacactatcagcanacaacattcgcagtatgcacgtacatcgcatatcatatncatatcagtcatgntcatagatgatagacggtgannctnangagtacgcactagtatagtcatggctgagngttacatagtatcgtgatgcaaggtgcgctcgagattatgcagagtgagaactcgacagatgactagncacgatactncgtcatagcacgatgagcagatcactacgcgtgacgcctacgccgaganagtgctatgatgagatttatcatatcgagntgcgtccntagtacatcagtgagtcagcnaagagtagtagagggcgtgcgtgatgcgctcagagatagatgcagctgagtgagcgagattcggtgagtgtatactagtatacgtacgttctagtcnagtcgaagacatacaaagcgcacgtacgagcgctcgaacgctncagtacgacctnatattctcgtccncgactctatactnatatgtaananagcatgancaaatatcatagtgagcagactacattcatgcgcaccatgtagatggagtgattcagtgtaagcnctccgacagagtctngagtgtaag

SEQ ID NO: 7427 - DNA, 1127 bp, Homo sapiens
  misc_feature (1)...(1127): n = A,T,C or G
cagttgtaatagtcttgatatcacttattcacttaattatatagacttaattcttaaaaaaaactgtgatgttgagttactcgtttctaantttgatctgtacaatggagtgaatcaattgcgatcgtcttgatttatattttcgtaatttaataccttggttacgagactgataaaaatcaactgcttgacaaatgtgctcaatctttttacatttgctaattcctcatcatatttgtgatggaatctgataaataactagactacaataatctaatatcgtatgctcactttttaacttgtctacaaccgtcataggactgagagatcatatatgctaatatcatctatatctaacatattaggctatcctttagtgcacgtgcaaatataacaaatgcgaatgataggcctattataatataatacaaaaattatcttaatatatgtcgacacgtatgttaaaatgagtagtactaataaaacatcaatggcacggtatttgtgtgagcaactacatattatagtgtcgttgatcttcacaatttgtgtacctatacacaaacgaattcgtgtgtttatgatataaatattctctatctctcaagtagacatatttcatacattcagctatagccacattctgtcatgtactaattaaattacgacagacatttaacatattatccgctactgaattatagtatgatacancaagatttggtacaaatcggtgcaaggtctacgttaatttggtaatttgttaatactttgtccattatcaacaatattaatttttgttgcatgtcctataagcttttttttccttgattatatatctcaagagtaattttgttaatattccttctctggttatattcagctagctgtattctatggcagttaatttatatcaatcaccttctctaactcattggtggtagtggtatggatgcactgagcgtctcacagtatgggtcatataaaatcatgatgcagagtctgacactaagcatgattttaatctcccggtataatcgcatggaagacttctatcatattctgtaaacgaaacgggtttttttcttcttttttatttataatatgttattaattatatcatattc

SEQ ID NO: 7428 - DNA, 1296 bp, Homo sapiens
  misc_feature (1)...(1296): n = A,T,C or G
ccttgagtgtagagtgttacaaccagtnaagacgtgtcggagaggagcacactgcggcttaccttgcaggaacacattactaacagtggttactttcttacgcttggcacggcaacccgagctatggtgctatattctggtacacattctgactcgcacatcgctcgcctcgctcgggatacattgtgtgtgaggactgtatcaacaacgacgtgggctctaatactgttcgcgtgccagcacactatagttggcaaaccccacctctgtgggtaaaacggactcagagaaggggtggttggagaccacgaccagaaacaacccatgtgtcgacgtgtacaacaagtgtgctagcaccgctgctactagtcgtgcaacgctttgtcggtggtgtggttggctgggacgtgtagaatcacatcatgtggtagttgtgagaaaattatgtacacccggctaccgtgaccacgtgggaagaggggtgcaagaaggtggtagaatagtagtgcgggaggtgcggacaccacctcactctcttaatagatctggtgggtttagtgtatcctgcgtcatgcctgatggtgaatctgcataatatcgaacactggaacatgtgccgctcctcccacacacttaccggggagtgaagcagctcacaaggcataagaaggtagtgatgggcgacaggtgcatagaacaataactgctcgccacctgacccactggttttgggttcactgttcataatgtgtgtgtgatcaaatttgtgtggtgtaatcgcccacccactacttcacctgtggggtgtggggttgatatgcatatgtatgtctttttataatgcgtgtcaactctattagacaaccatcctatagttgagaggtgtgaacataccaatctccactggttacactggccaatttggcgtactcctccgccttcacatctcctcgcatgtgctagattgtgtttgttgacgttttacacaataaaatggtatgatgtgtggctcgtcctgcaacttttctctacatcatctcctctctacattgttgggtatatgttatgggcacagtgtgaggtggactatcaacaacggcgcgtggtggattgtgattggtgtgtgtggtgtgtccacacattcgtgatccaatacactgtcatactcgcggcggtggggggaactaacaccaacaagcgtcatctattgaatatgatagggtatatgcagatgcgaatgataatcacataagtattactacccacatgctttcatgagtgttaggtccaaacaag

SEQ ID NO: 7429 - DNA, 1529 bp, Homo sapiens
  misc_feature (1)...(1529): n = A,T,C or G
ggtgatgatcgcatgatctcngtacnagaccgcgacgctacgnatactttnacgtatgtgacgctgagtgatgaggagttatgcttttcgatgtgagcggagagacaccagatgctatgagacgctatggagactgcgacgcgatgcatctangcatatgagtgctctatngtgcntcntagcgactcgctctcactatgatacgagatagacattgtgataangtagaggtgtgacgtccgctacggtgaatagagacatgtagtatcagtgcgatcgtgtcagtatccctagacgtcgtcgactatgctgatcacacctgttgatagtatcagctcgtgcgtgtcattanttnattgtagcagtgtctgtaagtgtatgttatgcgtcatagcatatagctgtagtagtgtgatggcaccgcggcatttacattcttacagttgtacganggtttctaatgctgaacagcaggcctgctcgcactcgtcacgtcaactgagatacgtgtaagagaagtggtatgcgactcgctcaaatacagcgcacccgcatcatgcaccgcacgatctnccagaagatgagattagagacatagcaacagaacacgacatagacgaggaaagagaatggagatggagaagagacacatacaagcatgtcgtgcccgctgcacctaggtgatgtagactggatacttttatgcgcccaacatagcgagaccaatcttctctacttagcattgtcgccgtgcactcgcagcacttttatctggtcgcttacgttcatgtggttgcggtggtgtttataggcacgaaactatagaatggcgtacctgccacccagatcttagattacgcccagcctcttctctattgatatgacttacgtgataactgtttagtatcgagtgaatctctgactcgttgcgagtgttagtcgtgtactatttatatgtctgatgttgtcaattgtacgagtcagttagtagntatagtagctctctaccgtctactcgcgcgtgcgtaatatgatacatatccaatctctcatattgtctacattgagttgcgtgagacgtgaccgcgaaggaatatgcgttagtgcatantgtacaccacaataccgggatatgtatttaatggtctaggatcaggatntggagacacgagcatgcagacacaacacaatcatactctacactattccgagcggtgaccgaggtatctatatatgctctctgttatgtatttatgatatatgcttagtatgttctatgatagtgtgtactgcacgtagcgccttcncaaggtcgaggcgtatgagacagcgagagcgatatgctcttctccttatgtccaantctatgtccaatacaggagtgtntctccgcgatacacttgacttacgagatntatagtgtgctagacgctgattgctcgatatagcgncatattcatatgagtggttacactcagataagttcatagcgagacncgcgcatacttacgtgcacgctgtgctatgta

SEQ ID NO: 7430 - DNA, 1738 bp, Homo sapiens
  misc_feature (1)...(1738): n = A,T,C or G
ggtcttgtagtatgatgacgtagcacactacgcagcgtcgnacgacgcgccgtgtgcagggtggtngtagacgcagtgccgcttatatgacngtgtagccgcacctatcgtcgtngagtgtgtgagtcgcgctttgtnaggctgagtgagtngatgagcgtatngtatatacgtgagcgcgcactgatatggttgcgtagagcgatgatctctagtgtgcggagcaacgtcctgtagcttggatgtgtctgangtngnatgatatgtgacagtgatcaactgcnatcgtgcatngatgtcgtcatctgcggtacgntncttcagcgncgtatacgcttgtcgagacacagtangtgtagtgcatgtataatctcatcacgcctcccgtgntgtgtgcctgtgtgatgcgacagcngctctagactatcgctgctntctctggtgcngancatcggcagngnctgtcagtctcgcgtcgtgcgcatgcgctcgtagcnatgctggtgcgntgctgtgtgtgcgttgtgtgtcgtcgtcgtcgcagcancgacagcatgtacgtacgtaagcagcgacgggcgacgagctatgacacatatacgctgccgacggacgtgttgcacactctggcgtctgcccgtcggccgnctctcgtccgtgtacgactacgcactacgacaaacatgtacggtcgctcgtacagtcgcgtgcgagagcgtcatctaccgcgtcggagtntagatcagcntcatgtgtagtactcgtgatgtgtgatagtgtcgaggnctgcgtgctgagcgcgatacgagagatgttgagtgatatgagttcacctggtcatctatgacgtgcgggtcgtgtgagatagagtcgatatgagtgagtgtagagatgaattataatgaaacgtacntcacactagtgtntgtgttagtataattgcatgntcatctatgtcgcttgtcatcgtattactgtgtgctgggcgtgaggtagactcatgtccactcgcttgtgacatcaccagcgatcgacggtcgtgctgtctcngattgttcacagcttcagtgatantcgctgatntgtngcttgantgggttnatgtnnantatcatacatagtgtactngagtgagctatgtccgagagcacgcagcgtcaagatgtgggcattcgcactacacgacnacactatagatctagtatgattgctgtcgacagtgctgagacgccatacncntcaagtgtactcacacgtcagctctgttgtntgctcgatacggtgtgcagctggtncgatctcgcaggcagccgacgctgtgagtgtcgcgtagtgctgtaccgangacagtgcactgacgtgcatcacatgacacgatgagcagcgcngctgagcagtgtagtacganagtgtgangtagtttctgcgcgtatgtgtgatcgtgcgcgagtgtacgagcgcgctgcatcgatgcagtcaggtcacatgatctcgtgatcgtgagtttgtcacgtgtcagtcacacatacactcacgcntcactacatgacanctgctgagtgtctgtgtaggcgtggccatgcgcgacgtctncacctggttctgtnatactcgctnatagacgtatacgtctctctgncnatctcatgcgtctagtgatatatcatgcgaatacgnctcgagtgcanatgaancagcgcagcagcgtctcgtgttctactcactcgcagctcntcct

SEQ ID NO: 7431 - DNA, 1973 bp, Homo sapiens
  misc_feature (1)...(1973): n = A,T,C or G
actagcagtcatacatctatctagacgcgtatcatcacgatcatatcantttacnanactaatatatataatatatatcntcncacancantatcagcacagctgctgttttgattgtctangtntcgcgcagatcagcgacgngtcgcngttctatttctatagtttnacttaattacncatcgcgtagcgctgtgtatcgtccangccgctctatatcanagtcctgaggcattcgtcnaaattgcactaagtatagctagtgngacagcatacgcactgtaagatnaccctganactctcatactactacatnacatatctcatcgtctgctgctagnctgagtggagntacgtgtgcgcgatatgagtaccgcnacacgatacagtacncggcanatnagcagcatcgtttgtacttcngctantantgnatctcantcnctcatcactcagtngtctgactgctngtagcttactgtgactagcntanancagcgaacgtagtgtgacgttacgtcgtctcgcgntcaccgactactgacntctcagacgcncatccatgtgtntcactatactantanctgtagtcgccaggagatgcattactgactatatcgttatantatcacagctcacgncacgctgcagtctntatacgacanacatactccagtatcgtcgatcgcacgcgcgcccacattcatattatatattactgaatcgcggacacncgcgagtagtcgcgcgcgcggtgcggcaggcncgancncacacatctgccactatataatcttgtntctgtntcgtctcggctcactattantntcgcatatcagcgatctatgtntacctgcaccgncaatcacgtttattatcatcgcctcaccatcatcccgtcaccagtaatattnatctactgctcgcgcagatgtcagaatataccagcagtgtatatgtcgtgtcgatgtggntgtcgatgtgactcgatatagacgagaagtatgcgtgtctgacccancccatccntaatcactatatgtntacttatactcactgatgccnatatatcatatantaaactcgctctcaccgcgtgtntatagtatatacgtacntntntatacatacgcgatacatgtagtacanactcacacaggtaacacatcaacagcgacaccaatacgacatggtgctatacgagatanctattcgctacgtacgtcgcgctgatctatatatcacnaagtctctactctgcacagntcgattgagtacctatatcactgagctagtcatanatgatatatagagtacatgacagactacacgcaatatatatagagcctgaggatnagcctgtactcgcnccatatctanactagaatcgtgnctntatntactgatgatgagttctctcatacgcattcntactctacgtatatgatattgcaaatcatactttcgacgctcattgtcgtatatatctagtatacgttattctctcgtatgtctctagatctccntcgaacctctcgagttacatccacgtgttctatctcactacggcatgagcacgcgtatcataatagatatatatgatnaccgcactcactgtgaggtatatgatactacgatcttatactccgcnagattagtaagattatgtgtttgcatgtacattgcactctacatttcaggtcgttgcncgtantccgaatgcctcacgtctacatacatgtatatacatgccatatacacgagctttggccaatgtgtacctgcttcacgcatcaggtctctacatttgtatctatatacnactncgttcacatcacacaatcgacacactgctacaatagnagatgacacnactacgtagattcaattataatattatatntattaatcanactatacatatatatatacctatacagcgtatgtatctatgatgacacatgtgtcattga

SEQ ID NO: 7432 - DNA, 1081 bp, Homo sapiens
  misc_feature (1)...(1081): n = A,T,C or G
ctctccttacacttatctacacccggctccgacgagagggatttcatccccattaacgaataggagactgttnaccaccgcaccttnaccctttccgagtgnagcggagcgaggcgccagaggcgcccgntcgcgatggggcgccgcgtttccgcgcccctcncgctctagtacgcgcgccctcctgaggggattcgagtccgtctgtttcctcttcgcgcgcacgcgtgcgtcgctttcgtcgcccgctctttgtaccgcgtgctagtcgactttcgcgtcgctatttcgcgtagggccggtcgagatcgaagttgatagccgtcagtgtgatgcagccgccgatggttagcgttgctctttcccgttcgttgtgttgcgcgccgccggtcgcatcgctatttttcttgaggatcgttcacgctttgatgcgtctccgcccccgtctgcgcgcgttgtctcttctgttttgtcgcgcctccttgtagcggtgttccgcgtctgcaaggctccgggccgtctccgcgtgcgcacctcccgcgccccggcggtgtgttttgcgactttttccgcccccgtcgtgcgtgccattgcgtcggtattgggcgagcgcttcctgctcccgcgtaccccgcgactacctccatttgctcccgatttggccggcgtgggggccgtttctgctgcgtctgttttgatcccgccgtctcgcgctgtcggttatactgttattctgccacgttgaggtgcgccgctcccgccgcgtcttcccctccgggttcgcgttcttcccgcggcgggtgcgacgcgtgccgtggttctgtgctcgctccgtctaccatgttagtcccgccgcgtccgccgagccgtgatccgcgtagtggattctgttggattgtggtgtcgcgtacgccccctcactctccggcgcctgtgttcatacccgctataggtcatgccgcgcgtcttgtctatcgggctcgtgttgtcggcgtctgtgcgcgagggtcgctgtgttctgtgtcgctcggcgcgctgcgcactaccggcgctgccgcctatccgccttcccttccgtgtt

SEQ ID NO: 7433 - DNA, 1515 bp, Homo sapiens
  misc_feature (1)...(1515): n = A,T,C or G
tcggatcatatagaggacttatacgatactaaatatagttacaccaccagtgcggcgttcgttgtattgtatacggtatgcatcgcatcattagattatacttcgcagaagttacacagtgtatgtcatcccttgttttatcctatatagagttgcgccgcgcacaggacagagttactacctactgagtacaggatagagatggtagtggatgaagcggcgagagtcaccgccgttagttgacaatagacaacgtatagtggtgccaagatcatgttttacgattcggatagtgacgagcgcccgcagagcatctaccgcagagaatacgttagatagtgatggganggccggagttatgatgagggtgtgagtcgaagatatttcagaatgacgcttgtagtgtcacgncgccgaccatattgagtaagttgagttgttgagatttatcttccgcgcngcgcgcgattcatatcgcattattaatttattgactgcgcggtcttaattcgcttttcgcgattntccggcgcgtatgtttatcgtgtcgtccgcgccgccgncatatattttacgtcagaatataggtatgcaaagtcgcgcgcggagtgtgaggacgatgacagtgatgttgatacgatcgcgacggtaacctatcgataatctaatatctagttagtgcatttagagtatatgcgcgagcgcgtaaggtagttcatgtcagagcagtggtcagaatagcnagtagatatatgctgatcgatncgaatgtggtggcgtatatgtagtatgattaatcggtcggagcgcatnttgtcgatgtgtatcntncggncgttattgccgtatcatgtgaggcaatttgtatctattatgagctactatatgagatagattagatacgtcgagtgatccgcgcgagattagtattgangagcagtgatgcgcgtcagtctgcnagatggtagcacgtccgagcttanatacgatagagtcaatcacgcngnntactgacgcctatgcggatgcgtactgtgcgatatgagtatgagctgcggtgagtgntgtctgctatagctgcgttcantatgcgatgnttctcgatagtgcgtgtagtacgagatatattgatcctgagtgagagagggagagagacactgacgcaccgatcactctctgatatgataattantagtgtgactgcattgagatatgnatcgaggatgtgatggaagngtcgtctagtaatcgaattcgcgcatgcgatctgagtgcnatgtgatcgagtgtgatagntnatatatgactagagtatgttngacgctatgcttacagtcgtctgatgtatgacagcaanacggatacgcacgtgattanctatatctggtgcacgtgagnagagtngtaagaaggttagagagtgataatagacantagnantataatagaatattacatcagaganaggtgcgcgcagtcgagaatcgtcgtatagtatgttgtatgtaantgtgt

SEQ ID NO: 7434 - DNA, 903 bp, Homo sapiens
cgggaagatgatgcacaccgggtgtggcaagagggggtcttgcactttcgccgcccacggtgtggtgaccgagacgataccgtttcgcaattataataggaaggcgtttcaaacaaaaattatcgccatcaagagaaggaactctccactgaaggggagctgccaccctgggcggagggcctaaccaaacaaccaccgcaagcaaagaggcccccatccaagggtggcctgggcccaaagaaggagcgcctaaggcaagggcccctccttcttccccaaggagggtggtttatagtggttaggaaaaccctcaaaccctccagcccggatggggcttgattctcaatgccgaagagccaaagcccgttgccccattcccaggccccttagggttaaggcagacagcccaggaagtcaaaagttgagccctgccccttgaaacattccagcaatgaagctgttcacctatctctaacttgccccccagtcaaagcctcagggtcaatgaagagcataaaaccaaaaaaccccatccaaaggacagctacttcaaaggataaagaatcatcagcccacacagatgagaaacaaaaacagtgcaagaaatctggcaactctaaagccagtgtgtcaacttagctctaaaccaccacacttgcttcttagcaatggatcataaccaatgtgaaatgcagcaatatcagacatagaattcagaatcttgagatacaagagaaggatgaagcccaatccaaggaaaacagtaaaatgatccaagagttgaaagacgacacaatcattttaagaaagaaagaaatggaacctctggaaatgaaaaattcactacaggaatttcaaaatgcagttgtaagtattaactacagaataaacctcgatgcggca

SEQ ID NO: 7435 - DNA, 1228 bp, Homo sapiens
  misc_feature (1)...(1228): n = A,T,C or G
agtatggcgtcttcttactacgcgtgtgtcatcgtgctaccactcttgtgctgagtgagttgccgtgntcgtcggttggcgtggcgcgctgantcgaacacgtgtgagtacatgtacgtcagatcgtcgacatgattataatgctcacgtatctcgtgtcgctgactgtgcgctcctgagcatgatactacgtgtcgagtngcgccggttactgtgtngtccgatgtaagctgtgttactccactgtacggtggtaacatcatagtgatgtacacctgtgtgantgttcttgtggctgccactgttgctcgacgtgtatcttattctatgtgcatcgactcttgtgtacatcttcatacgtattcgatctagtgcgngcgggtgaacatctcgtgagatcactatcaggcttgttcatcattgtttcgcgttatctatattatatcgctcacggcttgtagctagtatttaaaatactattattaattatagtttaagtttctgaggacgaagtgcgttgtgtaggtgtctgtaaagtaggtatattcgaatcgatgattaggggtattattagaggaagtgcgatgtacatctgtattgtctgtgatacagcacatctgtgcacgagccgcgaggcgggcgtaggcgcggaggcggaggtgccgcgcggtatccgtcagcagatgagacattgatgtcattggggcgagtgtcccctcgtcgtcgttcggcgcgtcgtgcggtgcggcgcgggagtcgtctttcgtgtttacggcggcggtctctctctgctcatgcgtacggacgctcgcggtctggcgtaccaggatcgtggcgcggctggtgttgattatctgtgtaggttcgttgtatatggtgaacgtgtgcgatgngaggtgggcaggtagaagaanggaagcatggcgctgctctgaggaccgttcacctatcacgaataattctaacgagaaaaagcatatcagtcgcggttctcacaaactaaaaacgacaagcagcgtaacacagtggccgttcgtgtttattgtaatagtactctatcatttattttatgtgtgctcgggtattgttcttgtacagttgataanttaatnagattcgcgtataaaaatnnnnnannnantanntnaaaaattnnnnnnnnnnnnnnnnnatanannaanacnaaannacattaanaannnnttnnnnnnaannnnnnnnaaaaaaa

SEQ ID NO: 7436 - DNA, 1770 bp, Homo sapiens
  misc_feature (1)...(1770): n = A,T,C or G
aagtcgacaagtctttgtaggcacntactcacactcacttctctacaggcagtccctacgtagtatgtgatgtactgtcgtggtgtgtggttgccatgtttacaacgcgttctctcggttnttgcgtcgcggaggccaatantggcgccgtcaacgttcgactgtacgtgttggtcatgtatgtgcgagtgacgtgttgtcatctcacgcacgttgacctagtcggctggtgtattgagagtgagtggcgtatcggcattgcagagnatcacgcatggctctgactcgatggcgtgcgctcgtgtcatgtggtgatacactattagatgagatataatgtacgcggtcgagcgagtgttcggatcgacacatagtgcgtggngggctgtgtctacgtgntaaccacgtgtgagtgagtgtatcagtgtgctggagctacgctgtagcgagngcgctgatcgntgatctggagtagatagtgactctagtgtagtggatcggaagtatgctcgtacttgatattactaantntacntgttgttacacgttatgcgatcgatatgaggtantgtgctatgttattatgcatgntngatattgatatgtatagtagctagtactaagatctcagtatgtntgnaacgcttatgatcacgaatgcgcagtgtgtctgatactcttgcctgtccgcagatatactgaggtanaataagtagggcatatgctgtncgcagcgtcagctgtcgttgtagagcgcttcgttctggatggtcatangtggtgacatanacatcgcttgagtgcacatatcgtatgagtatattacacgtcggcagcagtcgtcgacgcatcatcttgccgtcggagctcgtgaagtgtgatctctctctaatattctgntgttacantattcacacacancggctgcgccttccgtcctgctgccgtgtgccgttctacaactcntcatatcactcacngtcaccgccgtgccggctacgtggtatatctccgtgtcgtgtcaagngtanntcactccatacataggcggtgaggatcttgaatntagtgngcgtatgtgagngatgacgaggtgcggcgcggtgtgnagtagtagagggatgagggagcacgatgnatgagnanangagagacgcacggagctgntctgcgctatganagtcagatcgcgatacgtgagatgatcnacgantgtgtcactacgcgtcgtcaagatagtaagntggcgcgcgtgcgtcgcncgtgggcnctcgcagcgcgcgttagtcagagtagtcgatagtagcacgctcgacnccggagatttagcgtgtgcagacaacncgcgtatgatcgcatagtacgcggtgctgtctttgagcgtgctgtacgggtntatgnggagtgangttcncnagtgattnntnggatgtaatatacanagnctattgcgttgagntgncgggntcgcatcgtngtgantngtgtcggcgngcgnganntnntcgagnttctannctatnntnnncgtcggtnatgancagtanntatcnatcggcgaatnangnntgtggacntnnnnannnntnnntgnnnnnnnnnnngnnnnnatnnnaaannnannnnnnnnnnnnnnnnnnnnnnnnnnnnnnnnnnnnnnnnnnnnannnnnnnttaccttnnnnnnnnnnnnnannaattaannaaaannnnnnnnnnnnnnnnnnnnnnnnnnnnnnnnnnnnnnnnnnaaaannnnnnnnnnnaaaa

SEQ ID NO: 7437 - DNA, 751 bp, Homo sapiens
  misc_feature (1)...(751): n = A,T,C or G
ggctctactttagtacatcatgttaatagtaaaaagccaagtaagatggctaaacctcaccctagcattttaatatcctccggacaagggaagctagaaagtcgagtcaatcactttatacatgtaagagtagtgttccaaagtaactaagaagctgctacatttttaagcagggaggaaaaaactttcattttggtctttgtgttccagcaaattatactttcaattaacaccaacaatgatatcataaaaaatgctctgcttttaaatttctgaacttcttcaatacaaattagaatagtactggagtcttttgggaggccaatagctagcagctacattaattggtgtagaggagcctccttatcgataaccaggtccaggttgggtatagccctgaccaaagggaggacggttacgcgcataaggattaggcccacttggaggaggggtcatggtacttccaggaagtgaagtaaaacctggtcttggttgataggccccaggttggcttggagccattccaggttgagaggcaggagccacagtataattagtaggctgagaagtttgggcagtgtaagtttgtgcaggatacttgctcgcctggtactgctgtggcggctgagcaggcagttgttgaggctgaccagaaaaggcaggagctggtgcctgggaagttggttgctggccatatccctggaactgctgaggttgttgaggtnccagtctgctgactatagctcgtagg

SEQ ID NO: 7438 - DNA, 581 bp, Homo sapiens
agcgagggggggtacccctcaaaagggcattaagtgtttaagctataaaaagaggacccggggtttccaattctttttaccaggaccttttcaaaatgcaagaacattctgctaaggccggaggggttcccttacccaagctgaggcattgttgcaaaggcctggtttgggaggccctaacggccccttttgatgttaaggtgccgtgatgaatagaaagaaaaatggcctttagaggggattaaaagatttttgtttgcattaaaaacaactggtgtgagaaaagaacagctgggtagtacaaagagaggggttcacgttggaccacagcagagtgttgtgggagaaagggtctgaaatcaaaagcagtactagtccggggtcgtggctatctcatgagagagcatgcggcgctaggtttgatgaggggggagatacaatacttgttgccgtatgggtgcgatgcgcccggtgtggagggggtggcggttagtgccgtgcttgcgctgtacgacggaagtgataagagagtattttaaattaattcacattaatgttgagcggatcatggatattcaaaa

SEQ ID NO: 7439 - DNA, 1379 bp, Homo sapiens
  misc_feature (1)...(1379): n = A,T,C or G
ggtcatgtttctctttaatgaggttttttgtactatcagcggcagaaaatttaatctagcagtggactttctcttaatttatcaccactcgtctacagtttgtcctcgacttccctagtcggtgtgagataatcttatagatatcaggggaagagggctgtgaccattgctggcgacacccatatgggcttgcggactagagtctcgcatgcgnaggacgccttctgccttttaatatattgattcctcgtaaatttatggcatcgctttgtagtatattccgagttgtgccgcgataacgagatcgcttaatcatcttagcagaatgtgtctcttcctagtatattgttgtataagcttatctggcttaatcgctgtcttgatacctaaatcgtactgatctagtattatatgttgagtagagccgtacataatctcgcgcgncttatacgctcggttgcgatgttaattacgcctccgtggtcgctcatcttgattgatattattaaaaggaacgtgtgctagtcacttaattatcatagatggtttccccgatatccgatcctcgatatatanganacgatattattctctatacctgcggtgctctttcagagtgtcatgtgtacgtgcggttgctgctggtgagtgtttgagttaccgataacattcttgagggctatttacttacacgcgctgtccggcagagatgatactttatcttgctgactatgtggcactctacgtcggctattgatcgtagattgtgtcgtttcgattgattgtggtctagtggatcgtcttgtacgctcgcgtatctgctcgatctgtccgcggctgtatatcttacccgcgcttgcaatatctcattatcacacgactgtgtatatatggtgccgtacatattgttgttgtgtcgtgattgtctcgtgtgattactgcctcatttatcaccatatgatttggacaatatatgcagaactgcnactgttggatgagttgttgtgtacgatgatgtagtatggcttctattattatggatacgtgtatgttcctatgtgagtcagtttattgttatattacagctacgtctgttgccatttatgtataccacgagccgccatctctcgtccgttntaatcaatctatcatcgatgtatatgatgtgctgttatatactagtcgttaattgtctccgcatcgcgtttctgctctcaatatttgtcgtattctgatcttgatgacagcgagcgttgcgctgttggttgtgtagacgatattattgattagcatcagcggttgaggtggtcatgtatttttattgatgtgtgagtgttggtcttttctacacctgggctgtttcgcgtgtttctagattt

SEQ ID NO: 7440 - DNA, 1550 bp, Homo sapiens
  misc_feature (1)...(1550): n = A,T,C or G
ctgcataattaattcatattcattanatatataatacgtcattatattgatgtctcccccagcaccgtctttctctttgatatttccgcatcatcctnctntatnttattatgtatatatatttatatatgatcactcacgacgatgatatgctattctcncaattgttatatcactatgatagtntaatgacaccgcgtctgacaactgatgatnttaataatanatcatacaaggcgtgtataaanagatcaccttcctgatattaaaccatagatcaatcatgtcgccttntgttatcgacatcgcttctatcaatatattatgtggagtgtgtgcattattattnacatacagatattgtgacgtacatcgacgcagtcccatcactctnacgcgcgcgcgatatatacagttatctatgtgtcgtatagagtcgtccgataacgtatcgatttagtatcatagagnattgcgttcgcatcagatgtttctcacatatatatatgattaccagtctcgcgcgcgactattttatattagttttcattgcatattcgtcataatatacggcgcggcggcggggggctcgccaactccctatatattctttattctctcacgcgcgcgcatataataccgtcgataacaatatactacgtcacgatctgatatacgtcctctaccacgaccgcgcccacacattaacaacgtctacgaagtatttgtacatatgctgagcagggtctatattacacggtgtagaacactcactctgaagtattgcactactaggtcgcactccctcacgaantatatnttagttcgatatatgcntcggtgtatgangatgcagcaccagatatatatactcagaacatactgcgacgcacagagtaattcactatattatcacgacgatattaattgttcatcttatttacatatatcgaatacgacgagaatatataataaaacatacattgataggacgtaaatcattggcaatgtaagatttagtcttcggatatcacgttgagatatgcaanactcctatggcacatagagtacggattcatcctgtgtagatctaaatctacgccgaatatcaatctttatatagcgcaacagactatgatgaactacaagtcgtacatgctgaatacgacacgcggattgattcgtaagtagtatagtacacacaccaatgtgtcttttaaatatgattcatgcagcatctagtgcccaccaacacgtacccgaccaatacacatgtattatactttagtgactacatctatcaggcagtactattatacgactcaacatacattncgctataatatatgtatcgactaatatggctacaataatcactccttgccatatatcactagattacgtactctataatgtcactagttataaacacgcgacttgtgtatattaatatagtcgagtagttatgactattacgatcnataatattcacaacataaacatatctacatatatgctccagtatagaattcacgcatatagagatagat

SEQ ID NO: 7441 - DNA, 954 bp, Homo sapiens
  misc_feature (1)...(954): n = A,T,C or G
ctatgtgtggtttttacaattctatcggggggggatggcgttaggtggccctcatgtggagaacaaataacagggggatctcgatcgcntctgtggttatcacaaatctacacaactgaaaaggttactcgtcttagttggaagattataattcccggacggcttgtcacatctggatgcaactgcatggggggggtgatggaactaataaacaaggacgagggggggaataaacgcataaatggagaaaagtaatttaatataatattcatacatattattattaccacagttctttgtgatacaaactcagggggcaaaactgtatgtaaccatggggtaaccggtataccttcaaattaaactacaggactacattaagtttggggaccaggcacaacgatcaacggggacaaagggggacataaaacgggcaaggggtggtgaaaaacaatggggttatgtgatggaattattgatatttgatttaatattaagtaatttgggggggaccatcatgtaaagaaatatgtgacaactacttgactatctaccaactgttggaatcaaatctataaataaatggatggtttataaaaagacatactattgtttgtcgtccaaggttgtcacaaacaacaagttacataattttgtgaatcaatggggatgtttggggtgatacattggttctaattacacaaacattacatgtgtttgggatcaaacttcaaaaaaaattaacgggtatggctcgggaacactggtaacaagtgattttgcacaactgtgtgaactaccacatatagggtcaaatcggtagaacggacaaaacaatcaaaaattacatagattaacaaggggtccgggaaacataagacccttggttactactaaaaaaacgggaccaaataggaataaacaactattattctgatactaactttcaacaat

SEQ ID NO: 7442 - DNA, 1084 bp, Homo sapiens
tgtggccatatcaagttggcacgcttacaccattcttggcttgtccactctgtcctctttggctcctcggtgatgtgggcgttggtgaacactgtggtactaaaccattgtatttggattgatctgtctttgtggttacgttgggctgtggctgcttgcccacccacttttcttctgcttggaaatcttcttgtgtgtctcctaccccccattcttgtctcgcccttccttacggctgttcctacttttttttgtttttcttctggtcttaccgcgtgggtcggtcgtgtcactttggacgtgtgtcccacagacatagtaggaactatgctctacggatacaccgcggggggccacctgtacttactggcgacaacgggggtgggcaagtggtgtacacaatagggataatcgatattgacaataaattaggtggacacaacaaccactgacaccacacaagcggcgtggggggaaaccacacaacggagcaatgtgcgccgtggttgggggacacaaaacacggaccgtgaaaaaccgacacaaggggtaccacggcgggccaatgtaaggaaggtgaaacatgtgcgagtggtggaaacaagtagtgcgtcgggtgctggtggttcaaatacgcgcacccacgcgacacacgactgtgtgacaccactggataatacacacaccaagactgggcgtggaccaaaatacactggtgccgggagtgcagactgcataatgggatggtgggcagtaaaaacacacaaacaaaaagaggtggtgtgtgcatcctgttattaactatgtggtacagtaaaaattggtggtaaaaacgtccatctttaaattcccctgtgctggggacgtggggtcgacggcaacaggataaacaatacggtgcgaacacagaaaataaacacggcggtgcgcggggcaggcgcgaacctggggagacaccgttgcctccaagttgttctccaacggggaaccaccgcgggatggagtggggttatgggagaaacagggaaaaatgtggggggcgggggtggcactccacctctacgcaaaaccggacaacgcgtag

SEQ ID NO: 7443 - DNA, 756 bp, Homo sapiens
tttcccatgtgggctcaagcaattcttctgccttcttcccaaagtggtggtattacaggggtgagccaccatgcccctgtggtgtttacatttaaaaaaaaattagttgttgatacataaacattgaagggtttcaataaatatccaaacttctgccttcccttacaaaaccagaggcgttgtcaacactaagctgaagttgagtatcagctgcccctcttagaaagtgccctttcccttatttaagaagagtctgctctgactctagacactgttgtccacaacccctgccatatggtgcacatggggcattaacaatctgttgacaattgaggttacttgtctctatgtttgtacagatcttggttgtggaatctttaattctggttgttttgtgcaaatgcatggaaagcaaaagaatcatcgttataaataaattgaagcttgaggatgacttcgtaaaagaactaatatttgcaaagaaaggggacgaggacattttctaataagcattagccaggagcagccacccccaagtacattttattcccaggtatatttattttgggactaatagcaatcaaaacagagtaagcggaaggtcttttttgtaagggtaagatgactgtgttcctgcagcctggacactgactgctgcaatgaaattggatctgttgagcatgtcttccaaggacagatttggatagtaagccaggtagaaggccagagctcccacaaagcttcaccagcacccta

SEQ ID NO: 7444 - DNA, 1771 bp, Homo sapiens
  misc_feature (1)...(1771): n = A,T,C or G
atgacatatatanntcactctatgtgtactagaatgtgngnatctatgatgcagtntcgtgtggtncgtgtgtgcgtctgtgangcgagtcaggtagctgagcancncatattnctagaatagagtagtgtangatgtgtaacgtcagtgcaaaattangtgactgtgtagaagantatgagtagtgcgcatnacagacagccacgggagncatagnanacgtgatctgactagtanagcgtgcgcggtgntgacacgataagatatagagagcaagtgtngaccacagacgctcgntgacgcatgaacatcatgactgcatcacgatggcgcatctccacttctatcacaagtntncgtgttcaattcattatataagtgatagtacgagaggnggngcggcacactagatctaccgctgtcggagctggatgcttgtcttctgtgtgctggctcttcatagcgtgtcacattacttgtgactacactcgcgcgatgncgcgtctctattantgatgtatgtgtngngtgttgctgatgcactcangcatgtgacacttgcgtgtgtgtangatnggacgatgcatgactcgtcggannaagcatcagctataatatgactcgatgactatctgtgttggggctacacatatcgtagaagtcatgtgcacgggacgatagggtgggggagtagtgaacgagagtagtagatgtgtgatgtagnggatgcgganggtgagacgaattagtgttagnaagtaatcgatgcnacgatatatacttcgcatatcagaaacgtggagcgcttgcggagcaaggaaggccgtcgtgcgcaaccattaaatataaaaatgtgtgttgtgcgataatagcatcagcgtgggcaacgcgcgcttgacaacgtagctgagcattattcgtcgaatcacaggacaacgcagacatactgccgcgctnacaaacctactcgcgcgagatgcggtcaacgatcgatatagagccatggagtgagttcgtcgtcgcattcacgcgtcgcagagccatatgtacgcacaaatcacatgatcgcgctcaatagcgattcgtctcgaagtcgatcangncatccgtgatgtatatcgttgggaacacgacgccggcatacgatgtngntgcgattatcacgggcagtcgcgagcngtcgactagacgncntgatgacttagagataccagcatatgcatcatagatgtcgtagatcgcatgagntacacctnatcactgncgtgtacgacacgtgaggatgaacgtcgaggtangacatcgtgagcctgctgcactacagccgatgcncngtcagcancatacatagctatcgacntcagattaatgaatntactcatcgtatgtagagtcgcgnctcgcctctcgcagnggtngcnatgtagcngtacatagcagtctggacgcgcagtgtgtgagtatgcagngtcgtcagtatactgtgagnatcgtcgcggtcattaatatatcagcactctagactgcgactgtcactgtctctnatncggtgtcgttcggtcatcgtcgaatcangggatggcattacgacgatnatatatcacgtgcaaactacatactatatcacagccgaccgtcgatacgacgacagagtctgattcgcgtgtgtgtacgtggaatactactatatngcgatgctgctgttaatgctgcgtaatactgcggcggagactgnctcgtgaatagttcantcactatatgcagctctagc

SEQ ID NO: 7445 - DNA, 1567 bp, Homo sapiens
  misc_feature (1)...(1567): n = A,T,C or G
atgtgtcgagctatcttgctactggtctntactcatctgtgacgcctccatcgttgagtaatcgaccactgactcagctctaatctaatagtgcgcgtatcaggatacnantctcttgctcacgcttgtatcgcnacancagatcgctacgcatgtatactggtatggcactctattacataagtagacagcantnccatgcatcggagacgcgcgcagtcttgtatcaggatgatgatngcgcgcgcagcatgtgcgtgatgatcgagtaagtctaggcatctatttcaagcgtagagtacatcgctcgcatcatatgctgcggcgcgcgctctcctccatgtgtataatattatttataatcacatcacaacacatcgctnagtctactctactctacgtatgtatgtgatggtgtgtgcttcacatacgtaactccagtccgcatacacgtcgtcaacatcgtgcactgacagagagcacttgctcgcngattatggcgacaacgcctcgtaggntgcncgtgcgntctagcgcatctcgttatctntagcatctanctctgctggtattcccgcgcgcgagggaacactcaggtgcactgtctcagtccgccatatagtcgtatatcttactacaactnacataatacgaccgncgaccgccagcgcgctgtgtatgcacgactanatagcatccgccantcatgaatcggcgcacggagcgctggacatttgatgtggaggcgagtgagcgcgcatcatacatatatatatatatattctaacatcatctacgggcaacagaacggtgctctatatctggaaatatgaatacgatgaacagagtacatcacgagtacgcagggagtgtagacatctcttacatactctgctacaacgtcantcgacagcgtcacaaactatctcagcggtacatgcggcgatcgtcacatcagctcgcggtgtactcaacatccgctacatgctcgtcgtcttactgcgtatggggatcttgtcagtacgcacgacgatggtattcgtgttanatgtcgagtagtgcaggctccgctcaatntctcgcgcggtcactacgccacgcatgatgtaatgtaattacatctttctaggtacagacagccgctgcgcgctctgtcctnttagtgtcgacgatgtgttgtctacatcgccagcgctntcgtgcgcnggctgacctcagacgactcataacttctatatctatgtatcgagatacgcgcacnctcctcgcggatcactgttgctactgacgtacatcangtggtacgactantactaactaccggaggtcgtatctcggtagatcattgagatgagggncaagtagngtgacgcgccaaactggcgtcatgtcacaggcgagcacgctctgacatatattatattacgtttgtaaggtcgatgcgcgtcgtagagggtacggtgtacgtcgtgtgtatggcctactactancgtggactgatcngatatacgtcgacatctgtagcatgctctgacgtagtcgtcagctatcacagtcacgactctgc

SEQ ID NO: 7446 - DNA, 1159 bp, Homo sapiens
  misc_feature (1)...(1159): n = A,T,C or G
aagggagaagannnggggnnnnggggnnaaaaaagaaaagnnngaagagaagaaggaaggaaaanaaaagaaggagggagngagaacctgagcgaggaagaaccgggagcccgcccancctcagnggngcgacgagaacccggacccacgaccggatgagngggggcaagagaaggcgcaggaacatctaaaagagcagagcacgagaaggccagggaagaagaagagggngagaanncgccaaggcagcgagagcaggaggcngaggagaccgcaacagacggagggnnacgagagagagaggcgcggacggagaaaagaggnagaggcaagaagngggagggaggaanaaagggnagaaaggaagagggaggaggagggnggaagggaggagaggggggttttttagaggcaagaggagagcaagaggggagaaaggtacccgacgaccccagaaagcnccgaaaacaaaggcggacgcnccaccgaggcggaggaagaacagccacgcgagcaccgncccccaccgccccacggcgccgcncaccgccccccgcaccgccacgcggagccaacccccccgcgcccgcgccgcaccacgccccagaaacgcgcgcgggcagaagagcgaggcnnccgnaagacgancccacagcaccagagcaacaccgagaaacacgcgccaacaccgacaccccgcccgnntgccgccgccgggcaggacgaccagtnngcgcgagagaagcgggctagaaagagagggnnaaggagcgaggaggagaaaagagaaacaacaagaaagncagaagcagcaagggggagaacggatgaacaggactnccgcacacgagtccgacagcaggaagaggagacaagacnccaagacagacacacacacgacacagctacaacgacacgagcgccacacacgcagcacacaacgacccaacccagaggagcgaccgccgacaggcaggaggcaccgaagacgagaggcctaagaaaacgcaaaaggaagcgcaagagactncacagaacgaacgagaacaacaagcccaaacacgaacgacagaagaggcaagaagaggacngcgaagagcgacgcgaggaggagccggcccccacaagcagcacacacccccacaagacgccagacaag

SEQ ID NO: 7447 - DNA, 853 bp, Homo sapiens
ctttataacaataagatcttggaggcaggttcttccagctctagatttaattcattggaggatcttgcaatcccttcttaagtgaggtaaaataatccaggtaaaggaaagcctcctgttgtagaacctgggggaaagaaacactcacctggggactcctcccgggaactcaaatttgtattaataatccctattgtagattgctaccatctatggaaattgctatgtgcaaaatgcagaaacacatttcctttgttagaaaccttaatgattcattagagcttttcttttggtaatctcccaaatcacagctactaaatattgcatgtgatagccatagatacagtcattattaacgtggcagttatcatggggggtgtttcagcccacattcacagttatttgtcttttaatataaaatggcccatacttttgaacaatttctagcaattgaattttaaagtttatctttaaaggcaaagcattccaggaaaagaataggacaaatctttcttctccatatggaaataagtatatgtgtttgtgtgtgttgatatagacacacggatacatgtgtgtatatacataatacgtagatttcttagtgtgttatgaaataaattttatgtaaattaaaacaacctattcctgataaatacctctttctaaaatgatgcatattttcgagttgcagaaaactatttttaatattgtggctcagtatatgcatgagataaactaaagaatcctttcctccccgttaaatgtgaggtttgtgttgatgctgataaggattcctatgaataataaaacgatggcctcgtggcactcagcggtggagcgtctcggctag

SEQ ID NO: 7448 - DNA, 1496 bp, Homo sapiens
  misc_feature (1)...(1496): n = A,T,C or G
ctactacatgcgtcagacgcatgcatgatgtcataccacggctagatttgatatgctgattatcgccantattatgagtcgcgctgttgctgtatgttctcagacgcgtcaactngttgcgtccatatgatatcacgacctacgtatattgtgtnatgcnancagaatgagtcangtctgcgcggngntctgcacacatatgctgacatgcgtatcacacttcggtacataatactagaggtgaggttgtgaactcagctcgattgtgtcaatgtagtgcancacgtataagaaacataantataatcgtagtgagtatgtgtacagtatggaacggtacatgaaatattttgtggagaaattctattagtttttctctgtatcaggatcacagtgttgtagcaccgatgcaccgcggacggtcttcgtctactatataatatgagctgctcttcccacgttccactcncatatctcattgtaggcccattaacgatcgaacaatagtgtgtgcaacgtgcgtagtaatcagcttatacactacgtttgctgaacgatggaggtaatcaatgattcactcgaggttgtgagccgatagatgcacaaaaganagatntagtacacaaaataaatgtgcgcaggccaccgcgccagtacgtgagcgatacctacatgctatacatcctacatgcgactatcttcctgtaccacgcacagggatactaccagagaaccaactgagagagaacacgacaganaagttattcctctcgctatacgtctgtagttcacaatgctacaatgttggattcattattattgatgactaatatcttaatccaaagctgccatcaccttgtaatgatattctgacaggctgatgtgcgctgtgaatcttgtgtctcggacagcggagagcacggatgctcacgtctttctgtcatgtggcgggatgtaaatagaccggctgtacatcggaagtgaaactaccgagtgtctcgacatacacactagatgaccactgactcgagtaggagctattaaggtgtaatcgcgggaacaaatacagtgcgcaggaagctaatgactgaccgtgggtcggtccgcaggaccgaccgtacaatatcagcttctcaggggcgtgatgatacaactactggagcnctcttacgattgtctctacgagtctgcgcgataacgtgaaataaggaacataacataccgtcaatctggctctgaagtgttgtgtgataantctgacagtacacatatgtagggagtagacacatatgcaagatgaccaggtttgggagtgtgtattgtntttgtttctacacaccaataagataaagaagatccccaaaagaatagagaggtggaatgcgagaggccactatacatgatcaataataggcgtgtgcgtgtttactgctcgcgcataaacatctttatatttaatactctacaattgatactcgacaaagtggagacgtatc

SEQ ID NO: 7449 - DNA, 843 bp, Homo sapiens
agtcccccccaacacccctgctaccccccccgcaagtcgcccaaacaaaagagcaggttttctttcataacatcctcccccgccccagcaccctctctctgtccgagagcgcccgcacccaaacaacccactattccactccccttgttcctccacgttctaaaccctcaagggtgttccgccaccacccccttgtttctcagcccccctaaggcccagaagggaaaatgtagggaacccccctccagggtccccttaactttctcgccaagggggggccaggcctctctctcggaaaattatccagcgggtcgccgacctagtgccacccccacactcaaacatgaaccccctcaagggctgtgggctgagggccctcaggcctggaatggggcccggcataagcaaaccctgggcatgtggtccccccagtaaccccctgcagggcctgtgaaaaggtttggcataaagggcctgcccctcaggcccatttgctgaagtagagaggccggggtacaggtggtagctggtgctccaggtgctctagctgcagtgtgggggatgccccacagcacctggccttctccctacccttgtaccccagctccagcaccagggggggcactgtcctggcagctgcccagccggacaaggaggatccagcatgatctcagagcagaccctacacttcttttattttaaaaattatgtttagtatacagcataatgcatgtttattttgaaaagattagcacccatgcacaagtaaaaaataaatcatcacgttttctcccaaaataaaaaaatggcctcgttggcctcagcgggtggagtgttgtgcta

SEQ ID NO: 7450 - DNA, 1120 bp, Homo sapiens
  misc_feature (1)...(1120): n = A,T,C or G
caaaccaaanacgcctcggtaatgttggcttcacgcgcgctatcatgcgcgtattaactcgtcgccagttgctgcggaaacaggcgtgctgtttccggtagtngtctacgtgggaatacgctatctgcactaggtatgtgtcaggcgaactcaacacgattcaatagggagaggagggcagctacgtgcgtgtacatcttactagggcggattatccccgtctcggcttcgggtagtgtataagatgttaatattacttactacataatgctatcatgggcatccacatctgctcctccgatcttgcgctgcgcttctatatgaccacatggtaagctacctgctcacagaggactatgatgcgcgtgctggccgggaccatacgctctcagcgataggagcgcagccgccggggcgcatatggctccagcaacatatgtgtgattgagaggtgtgcgctatgggcataagactgcgctagacgcgagtacgcgcattgcgacacaccgccggttcaatgtcccgctcgagtcgccatctgcgcgcggccgatcataacgcgcacgcctagtgcgtacacgtgtgcgtggcgtgcactatacctatagaaatcaattaccatggatctgatgtggggtcacgtcggggtgacgtagtcaatattttcggtagcgcgcgaatgggtcggcgggagggtaacatagaatgggacaagggcggcatgaaccatgtcaggcgccgcgagccagtagtcgcgtgtgtaccgatcggagacgagtagttatggcgcgtcagtcgctatcttcaagccgtttgtggtatattctaacgtgcgtggatatggctaggattatgaaaaatactcgcgtgccggatacgttaacccggcgtaccgccgtaggttgtgtgaatttaaagtgcatttttctgcggcgccgggagctggtaggtccggggctcgtgcctatacaccctataataattgagagtgtgcggcgtgggaatgcagccgtgttgtatagtgctagcggttatttcactccctcttctcctcgtcagctggtctatcattaacgacgtcatatacctgcggggcctctgacccgagatcttacagcgc

SEQ ID NO: 7451 - DNA, 2469 bp, Homo sapiens
  misc_feature (1)...(2469): n = A,T,C or G
catgcagcncgtcgantacccaatncacgtangtcnacgatctagangcgagngcagntgcancaacagagcagcgtacnctgacagacgtcggtactgngagngcaacncanntactgangactgangctagncagtgaagtcgtacgcatcgtatgctacggacngcagctggacncangcagctgctgctacngcacggtgcactcancgcgcgtgcagttancgcgtcatacatcctgatcgccccagagcgcggcagtgatgnggcagctgngcaaaggctataagcnanatagntaactacgtcacgctcgagcgancgacgtgtgagagncacgtcngagcataatatangtgctgcacagctcangcgntgcgcgtacngctcagtaccagacctcacacacgatgcgcgnccgcgtacgcgcgctacgtcantgacngtgtatattactctctatgatatatacactnattcacgtacgctgcgctggcagactacgtncggatgngtgctcgcantcgagcgaacgacaagcagatgcgtcgcagtntancatgacgctacgtcancgcatcgagcactcataccggctgcagcgagcgacgccgnccaccgcgcgatatcgatgcgcgctcncagcgcgcactcctgccagctcgtcaccgctaggtcgngtgtgcaggtctgcggcgtgcangcagtgacgagtagtatagatagataccgaacacctgncnatgacgctcntactctgcgcagnacgacggtccgacacancgcggacgcacganacgtgctganacgtagtatacagcgtaccgtnagtacgctactacgtagactgatnctgacntacatgactgtngancatacgtnatgtacgatcgcatcgacgtcatctatcanntatggcgtngntcgtanctgagctcagtagtcgacgtcgcatcgtcnanatcactgtcgtngancangancgtcgtgcgtctgcgtgcacttgtcgctgttgntgcacgtacggcgcgcntacgtgnanacncncntatacancactaatntactaatagcatcacntacngcgtcantctanacgacaaccgctgcangnngncaaactnctcgctcgtctggcgtgcntcngatgcgntatcgtagcgacgaagcgctgcgtcatctagctgncgngatactgcngggctagatcgngctgantgcagtgtacagatcactcacatactacatcgtggagtagagtnctacngngagntnggatgtgcataacnacantanccnatatcgatgactgcaaacngagactgcnacnactaagcaacngntngtctgatngaccggantgcgtagataagcnanatgnattgatgtcaacatgagtgcgntanctgnagcgtganctagggtcggcactctatagatctncgaagactactgcgcagcagtgngtactncgctgctcgagctactacaccggtngannggantacagtctgtannggngtcaactcaatntgcatntgacngtactgacganacgcgtcagcactgaactgcancgatnancnantcnnagcangctanctactgatcattcatcatctactanantangattcnngtactattgatncggatcangganngcagtgcagngtcgactntgncatncgntgcagtcngatgnangtncngagcgagccacngatcgtactnatgatcngtcancattacgtcgtatgctgcaggctgcggangctgagcagcagaccatangagcancactacatcgcangctancatgnaaatcacatganttcnataancatnacnnatngtggctagttcnacncggctgtctgcgtntcnagccaggataggactcgtgcagtagtcatgtacntgantgagctgcnttagatgacgtgatnttgacgatngaacngatntcgnatnatcgtatgacnagcatncnncgatntnncggacgtccagnttgatctagtnctngtatnatnntncgngccgatgcgacgnagtngaccangtcgtnggtacgancagtcncantgnngnnagcagactgncgatcgacatcgatcgtcngtantccgcagtctgactacggngctgcgtactcgatcatgctnaatnantacnncgangcagtnncaagacgatcnacnnancaatnngactgcagnatgnntngcagcgctncatnangcangcaccggcgagtncgcagtnttnnagtncgtcgtcgacttcganttcatnagtngcggtantctncctntgcancgnctnagccgtgactaccatgnatcagatgcaattgnctnatnagtcgggacttcngagtactangtcgatnacgtcngcgtcgnaccngngacatgnagtctagtgtactgantacnaggtacnnnactantccatcagatgag

SEQ ID NO: 7452 - DNA, 832 bp, Homo sapiens
  misc_feature (1)...(832): n = A,T,C or G
aggttgatcatcacagaaagcggtattgcacatgctgtcgtaccaaggtagatgggattaacatggggaggtatcggcgacatcccccgtcgaagattcccgcgtctcctgcccccacacacatagaaaaggggttggtaggatgtataggtaaatatccggggaatatcatggtagtgggggtggcgacgattattgtagcataaatgggcgggaatatgatgtgagcgaggggcgggggaattaagtattcggaaanaggggggggaaagagagcccgcctatgatatcctcccagtcgttatcgaggatggttattcagaaactaccttccgccctgcctcctcgtgctcgtcgagtaagtgggaacaattgtactggcgcgctagaagcgccctacggctacgaccgccgagtaatgcgagggcggaggatgtgatgagtttcacaccttaaacggggggtcttggggggggggggcgggaaggtgtagacggctagccgttcgggggggatgaaacaaggggaaggggagcgtaggaggggagtggaagaggggggaaccagggagaggaatggcgtgaagattaagatttgtggccccgggtgggaaaatcaggcctccctcctccttctcttgngggggggggggtgatggcgggagggctcaaagtataggggatgataagtgttcttttttcctctctaccgcggctaaatattgatggtgggaaaaggaagtatatgtggctgtgtaaatttgcagtgaggaagtattatggggcggaggattgtctatacaagggacgattttgggatgcggttgaagcgg

SEQ ID NO: 7453 - DNA, 592 bp, Homo sapiens
gagaacctgcccagacgttttaaaggtaaggagtatagtctccatggggagacgaaatgtttgggagaggacaggaaccgatgatcaggatgggcgcaccagcccgccgctgtgcggactccggccgccggcctcgcggacgcgcgtgcgcgcgcgcggagtcccacccggcccgcgtggcggtcccgcgtcagacgtagaggtttaatgagtgtagagggtgtaggcgtaggataaggtttgaggcctccccccacccccgcccgtccactaacacacaaccacccgcgcgtcccccccagcgcgccacccgcacccgagcggccggtggaggtaccctctccaccgtcactacaccgccgcgggcaggcgctcaccaaagagccgctcccgggccggggccggcgcggcgcggtcggggctcaggttgtggcgtcttgcctggcccccggcgtgggcacgggcgcgcgagcgcgtgccagggcaccgtcggcctgcgcgcagcagcgcaagattatgataggccgaggggcccgctggcggcgaggtgatggacccccactcccgggggcgtgcggagaaagcgagggag

SEQ ID NO: 7454 - DNA, 796 bp, Homo sapiens
  misc_feature (1)...(796): n = A,T,C or G
caacccctgtctccaccccacttccggctgccctcgggcggactaaccaaaatatctggtgaactcaacaacgggttttcctttttaacactggattttttctccacttgcttccnctctagtttaagtccgcgaatattagggttaatcctttaaatacttggcctttaacccgatttaatcttaacatttggtttataaaagtttggggtgtttaacttcccttgagccaaatgtcgcagctttaaacaaggaatttcaatcctttagggtaaaataaaccattggtaagggggaaaaacagagcctagcaatacgtcattccccccctgggttataaggttggccccagagaaacctttttcctcccttttatgagaataagcccatttcatgggctctgtatcaaatagaaatttaccctatgcttatgactacagggggtttatctttcaaagctgttctatggaaaagcataactttctaactatgttagtaaaagattatgtcatctgaggtgattacgtttaaaatggcaaagataatgatgttaattccactcgcgccaggtaatgtttttgatatgagaaagagcagttttgttttttaacagcttattttgtattttcataatccattataaggtttggtagtaatatagacatgagaaatataatataaatgttgccatgccaaatgtatatcataaagttgctcccccgccccgagtgctagttggttgactgtatttcacgatttaaataaaaggttggcatcgttggcatcagctggtgga

SEQ ID NO: 7455 - DNA, 1412 bp, Homo sapiens
  misc_feature (1)...(1412): n = A,T,C or G
acgtgtgcgcagntagttacctcactgctatctacttctgtcgantnatgtacacgtcgcacgatgtgtgatctgctattatcagctgtgtcgtgtcagctcactcgcttctgcgtgcgatgcttcgatgtgntcagctctnacacggcgantncgctgcgcatgagcgcgcatacacantaatcagcaaatacgcgaggcgcgtgtgcgccantacgcgcgtaacgncacgcagcantgctcatcatcgcgcggtgcacgcggtnggattcgaagagtcgctaatagagctatctctgcacgcgcgtacatagtatngctgcgagtatgtggcgcgcgcacgttacgcacgacttctcanttatatggatacgacatatacactcatcaccgccgaccgtcgtacgacgtggacagatngtacntgactcgcgtgagtgcgcattataatacgcacgntcagcctgcagagaccgcgcgcgcagtgtcgtataagacatcgatcgcgagtgtctgcggacgtagcatacagcgctacgcggatcgcatcagctctggcgctcgcgtgggcgtatccatctcgaccatagcaccagacgtggcacatatgtcgcacgatgcaacataatagagtgaagctcgcgggagtgacaacgtcgtcgtacgatcacgactgatactacacaatacagcagtgcgtcatccgttccggccagaggtgcgccggactctancgaaccgacgtctcaatcctcctagcggatatngcgtggcgtgttagattganagccgctggcgcatacacacgaaccaccacaacatatacactagactatcggttccgatanacaagctatctgagcctgtgtgacatctatctcgtcgcacctctcgcgtgactaaagcacaactcgcactgacctgcgtgcgactgattatgtcattcgcaatatcagcacttgaattgacatacgatttacgtcgnaacgccgcgactctgtagcgggagtctagcgacgacagtggctgactatacggacatcgcttgagtggccaacactcgacaggcttgccgggcggcacatcgcccgacacgcggtcaacagcagcggcgcgcactctcgcgcggaatgattgatacacacatacgtcttacgtatcgccgtagcgcgtcgtcgagtgatacacgatatagctgtgaggcggcactgcatgacgtcttctttattcgcgcgcacctctagcgacgacgtttaccccgctgtctgctcgcacaacagttggcgttctcactcccagcgcggtggcgacagtgagcttcacggggatcgccacctcaaataccgcgccgccacgcgcctccgcgtgttatctggcctacttccacttgtgcgtacgcagcgaaaaaagcg

SEQ ID NO: 7456 - DNA, 833 bp, Homo sapiens
  misc_feature (1)...(833): n = A,T,C or G
ataattttctagaagtctgcaaacgccggtagaggtgctacatgacacatcagctaacgcaacttaggcgcgtcatgaccctatcattaatggaaccacgaggcttcgcagggatctactgtcaacaaacgcaccggcttccactgtgaccttgtaatgagttacggtgggacaatcgtaataagcaacacactgcacaaccacacacactatggtaggaccgctagcggacttaaagcgggaagggagggaaagncatgaggaacgtagaggcccaagcaaaggccagtacggaccggcccccgccccccctaggaccacccgcgaagaccccgcacccccatacccgcgcgcggatgggccgaaggagagagaagcgcgctcacgcgtcacggagcaagcctaccgctnacagacccgcctgcacagcagccgacccgacccagcataaaggntcggggaggggcccccggcacagancgtgtgagagaacatgtgtccaccaagaacattctagtctcagaagcaccaactcccgcacggtccaataacagccaccagagggcagcagcagccgctataaacgccgcgcccacaaggagccagcaacggcccaccgatcgtacagctccccgcgccacgcgtaacgcgacaacgagcccgaagaacgcattccacgcaggcctaacagagcccgagagcgcggtacacagagcggagcagagcatgacggccacggagaggcaagtgcagtcaaaagcacataacaacaccaacaccagaacacagagaanncaccaaccgtattaagctcctcgagtagaggtacgagt

SEQ ID NO: 7457 - DNA, 881 bp, Homo sapiens
ggttcttctttaacccgtaaaaatggcttaccacacccccccctctttttaatcaattaaggtttgggaaattcttcttctcaaaaaaaaaatcttctcacaaagccggtaaaaaatctaagccccagtctcttaggggaaaatttttatttttagagctcaagggcaaagtccacaataagagttagctcttccttggttttaaccccagaaaaaatcccgccttcccttttaaaggggtttccaaggtacatggaccatttaaaataataatattcttgtaaggttaaccaacctttccaaccaaagaaattttctaatactctgtaaaaaatattgggccagttaaccagatatgccttagtagggtttcaagtaggtgtcaagaggcgtagtactgaaattctcataatcattttagtgccacaatgaaaggagtaagtatgaacttgatgttcaatgaaaaggaaaagaattccaattcccagtaaacaaatgccattaaagaaattatcagaaaggacaaaaaccaaatgggatattatttgaaggtaggattgttttacataaattcagcaaatatgaaagaaggcaataatcaaaataacaagtttaaaggaactaaatgatgctatcaccccctgaatagacactgctaataaataagaacagaacacaacatacaagattctaacaattccttccctgaactcttgaaatttatgcatatgagaatggagcattaatatttggtacacaaaagcccaaagctttaaggaatttggaaaacccctaacccgttcatatagtactctactatcacaaaggaatacaataaacagatggcctcgttggcatcagcggtggagctttgcggctag

SEQ ID NO: 7458 - DNA, 1469 bp, Homo sapiens
  misc_feature (1)...(1469): n = A,T,C or G
cttggcgcagaactcccaacaggagacttatgctacgtgcncatctaacattatagtgtgatgaacatcaaatatctgtgtcanaaatgtgagttatggactgatcggtgacacgagctattatgagtatgtgtantctangtncgacatacatnaagatgtcgcccccagatacgtagtagacgcgcgctcctcgaagtncacgtccagtgggagtggtgtgacgagagatacaggttgcggcttggcagacantagcgcagcgcgaaatatacccatgtggagacagtagaggcgacggtcgatctccatgacttatcttatgtagaataattaaatatgacgncggcagaacgtcagagtcagtgatagtgacgaggagtgagaggacagtgtgagagtgaagagtaagtaatacagtgacacagagatcgtggactgttggaatagagtatataagtaagatacgagagtaataggaagcaatctagtagaggtaggatcgactgatagactcatgcagacaacagagatataccacaacgataacatgagatgagagagcgagagttgatatagggtggatagtgtgacaggcggtantacgcgctgctagcagagtgtgttatgaagtagcgacgagttgtcangagcactcgagtacgagtctatagacagaaaatcgcaggccaacgatgaaagccgggagacggggggagagtactgaaagatcgtgaggtgcgcgccgccttcgcntaatnaaattatatcatactaggtctaagcgacacatacgtagagcgccgcatcgggatggcagtatcgatcgaganaatcggatacgcagtatagcgacgagaaatccgcggagagcaggaccgatgacatataacgaacaatgcggcaaatncggagactagacgnctaacaacatagtacggcgtgatatgagggatcaagcagttgctggatgcgcagagtacggagagtggagcgangnattgcgtgtatatatcagncggcgggttagtntgagtgaggattgcgagatgcagtgtacgacagcgcgtcgacgtgacgataactatagtgagccgcaaatgactcggtgagagcgaactatacataactaatctcttctcgagctagccgataaatagtaggacagagcgagagaaacaaatacatatatcatagtcaggcgatctatctacgaaagataataatattcaagacgacgggccgcagcgcggtggcaggtataagtaaacatcgtgtgtggtcgtcgtaaaaaacagtacaggatcaaatggcaggctaacgacggaaatggaatacacgtgtatgggggctcccgcaccggataaactatacaggcgacggtctacgcgtggaagcgggaagattgcaatatgaattaaatacatatacaatgcgtaggcgggcaggaggcgttgtacatacctccg

SEQ ID NO: 7459 - DNA, 842 bp, Homo sapiens
  misc_feature (1)...(842): n = A,T,C or G
ctcttggtcccttaatttcacaccccagggcaccccctcgtttttaacaaaccccccctccacccccggattttcacacagggtttccttgtccccccatacttttcgcaagccagattgccttaggacggaagctgcccctccaagccccaacactccctttgaaagatggcctcccccttgtctcaaacctccttccaagcctcctattttttgatggcctcccacgcgaccacaattccaattctctctccaacaggcccccattcttactttaaaatggaaacccctttgtacataaagcttccaacaggagagctaaaaactaaatatttcccccccaaaaattgttgatttaaataagcagctcaagttctaaantcctcccnccatctccccagtcctctgtcctcccccaaagcataggataaagctgttctctaaaattccctcatctatctagaaactggacctaccaaagaggaacacaattgcctgcctcgaaattttattaaccagagaagagtaaaattcatatcccagaggaagaatcccaaaccatttcttctttttgccccattccaatttccaaatggccagcaccttccaatttactaaccattgtcggaccattaggcccatttatttccacctaaaaatcatttattatccctcagattgccacacttcccccattttcccttcccctggaagaaggggctataagtatntgtaccccattgggttactcccccatcactctcctgcaactcccctgtgctatgcacattaaaataaagcactggcctcgttggcatcagcggtggagctctgcgggctag

SEQ ID NO: 7460 - DNA, 1267 bp, Homo sapiens
  misc_feature (1)...(1267): n = A,T,C or G
attggtgcagcttaatagatccgtttcatttagagtgtatagtatgtcgagtgtgagggcgatcgtcatattatgtatggtatagtgaatttgtattcatcgcggcgagtctacatgtggtatgtgagagctagcggctgcgatactacttattactggttatgaagatgtgatgtggagttacttttgtaataattgtgttgaagggggtggtgcgatgtctgttagtttattcggatctggacttaagtaatcgagagatggggcgaatttcttacttattgtttatatttttaacgagaatgggtgggtcgaaatgtgtgcggttgatgagttatgtggtgtagggtatattatgtccgacacagggtagcaggtcggagaagttgagttagacgtgatgctatatcgggcataattaatctagactagcgtgtttgatcgtcgatcgagtctctgtatatggttcgaaaatgctatgtgaacgggttactgctcggtatgaggatgtatgcttggtcgaatacagtaagttctatcatttgttgaacgtggtgttgtggtatggtgtggggtaacgtgaatgggtgaggttaagtgggtaaggagagtgcgataatggtggtattaggtgtcagttgaccctacatcacaattaacataaagcggccagtagtggtggctcggtgcgtatatagaaaaaagtgtagtcacatatatgataggagtattgatggttgaaaatagatagggcacgcggtgtaacgaaactgagagggcgttatgttgttgcagatcgggttggactctgtatggatagtatggcgatatggtacggtgcgtgcttcggagtgtggtgaacaccaggtattgagcgtattctgaggggggcacgcggatctactagatactcatgtgattggtaggtttgtgttagtggtgcggttacatatagaatggtcgagggagagatgtgattgtactgtaattcattttcctatcagtgcgcgatgtgcgcgtattcattccatcacagtgtcggattggcacgatcactctactggttcttatcttaaaggtggtgtggtgtgtgtgggtataatgtactgtatgtatcatacgtcgggaagtgtgtgtaagtactctttattatttantaggatcggctagtcgagtagttgtcgagtgctcttctttattcacagtatgcgttattatgttcttagatttgcggtgagcgatatgtatgttaatatccatgaggctg

SEQ ID NO: 7461 - DNA, 842 bp, Homo sapiens
  misc_feature (1)...(842): n = A,T,C or G
cccacacacagtcctctccacacgaagtgtcccccccccccatcgcacggtgaaacaaaaaaaaaagccagcgtcccctcactttcaaacaaaatttacccaccccccacaaccattcctttgcccctcccccctcttccacttataaacaaaacggttccattcctggttttcactcaaacttcaaattttaaggtggttttctcacaccccccctgttttagacggcccactctaggccccttaaggagaagtttcgggagcctgcattccagggtcccatcggctttctgcaagtggtggacctgtctctttcctgttaatttccaatcggtcgcctgccctcttggccaccccactcatacatgtacgccctccagggctgtgggttgagtgtcctcagtccctggagtggggcccgccatgagccagccctgggcatgtggtcacccagtgaacacctctagtgcctgtgagaaggtctggcatgaagggcctggccctcaggcccatttgttggaggagagaggccggggtacaggtgggagatggtgctccaggtgctctagctgcagtgtgggggatgccccacagcacntcggcttctccctaccgttgtaagcagagctccagcaccaggaggggcactgccgtggcagctgcccagccggacaaggaggatccagcatgatctcagagcagaccctacacttcttttattttaaaaattatgtttagtatacagctaacgcccgtcccttttgaaaagattagaatttatggataagtaaaaaataaatcattggcctcgttggcatcagcgggtggagctctgccgctag

SEQ ID NO: 7462 - DNA, 1463 bp, Homo sapiens
  misc_feature (1)...(1463): n = A,T,C or G
cggttgggagtagtagtcatgtccttatcgtcggagtacaccgatgacgagccgcggatagggtcaataaatagcgtggacacgttcactcacataccggcggcgcggtgtcggtgtggtaagccacacggcagtgatttcgcatcacattcgtcaagggatggtggactaggagcgccagattagagcaacctagtggaggacgccggcggatgcttgatccataccattagatatgcgtggcgatgatatgcaggcgtactgaggcgtcgctctggcgacacttatgtgtatatatatgtcaatatgtataacacaccgcgcgtcgacctcatagcgctgcgntcagatacgttcgagatggacgtacgcgtaatcactatcactacactgagacncacatggtcgccgagcgctcgcgtacgaagaccgcatgtggctgaagtcgcgccaatngacgagcgtacatagaccgcntgtcacggtcgagtgacattggtgttacatanctgtagcctcagactccccgcgcgctgtcaggccgggcggaccaccaggggcactagtagccgcatagccggcgtcgtctccagcgttggcactcactagactgagggttggagcagtcggccgggttgggtgaccgcgaggtgtacggctacagcccgactcggcgctatcnccgagtggcgcgcggtcggagaagggcggtgctacctacacacatctaaaataaccactatactcgtcatctataccaccgngccgcctcttgtcctctccgcatgtaccgacacanccgcagtggagcaatagcggtngaggtggcgtggctcgtgtgcgcaatatacatcgaccctcggtacaatcgcggtacacagtgcgatgcgcatcattgggcgatcagtgtgancagcacatgtcggccgctgttccgattacggtctatcattggtgtacanctgctggcgcgttccgccgtctgctcgtgttgactcgtcgtgttaactgcagtgtaacgtgcggcgtcgcaatatgcgggcaggcggacggtggggccgcgcgtcacacgataacactcgccttagcgctgcggttcgctgtccggctaggagagcgctgatgactacctcactggagctgcttcgggcggggctcagctcacagtcgttatgagaatttttatttctcttcgcgctgcgcgccgccggctctccctgagacatacgaggtcgcatgatgnctcattgagagatgagaagcattcgtatgataactcactgctctgatagcaccggccgtagcgattcgcggcgcgctcggtgtgctaccggccataagtatgtcactactttgggcgtgcggctcgtcggcgaggcttatcgtccgcgtctccgactcccagctaagcgacggccgaagtgcgggtggtgcagacgcccagctncggtcagtcgatgctc

SEQ ID NO: 7463 - DNA, 868 bp, Homo sapiens
cctgaaaaaataggttagatttctcatagcatagggccaggaacccccggaggagagaaattttggggggcccctttaagggtagaccctctgcgaagttggggtctcactctgaagtcagcaggccccaaaccccttaaaagggcggcaacttcggggttccacccttaaagacggtaaaattcttttaaaggttgtggcgtcctcctcaagtcagcatgacccaccaaaaaagggaaatccggacacatttgacattttaaggaacaaactccagacaccccatcttgagaactgtaacactcaccgcgagggtctgcggcttcaattcttgaagtcagtgagaccaagaacccactggaaggaaccaattctggacccagaagtacattaaaagatattttagaacagtatctaaattcaacatagatttaactcaatacatttttgtgtattgtctaaaaataaaactagtattattctcagtatcgtgatgtagtaagaaaattctttctttggatatctcttattttcttttacactattttatatttcaataagataaaactgtcactgtctgccatcataattattagtgtgaaatagcttaaatatatattgaaagtttgggtattttgtaaaaaaagaaaatttttcaaaactaattgtcatgaatttagcattattgattcatttcctttgcttaaaaccttttcaggactttttgctcttgttagtcattgttattgcctttctctttcaggtttagtataccaaccagccaatttagatgcttaataaataaataaatgtaagaacaaataaaagcctggcctcgttggcatcagcggtggagctttgcggccag

SEQ ID NO: 7464 - DNA, 940 bp, Homo sapiens
actattcctcccatgtattttgatcgtgccgtctctattttggccacctctccaggcaccgcatccgttatgtccggctctgctactaccaccttgttcttaacaaccactctctttagatactgctatgagacgggaccaaccagtaatgtcccgtcaccccttaagagcatttatagggcgcccatcactcttttccctataactacacatacttcaccacttgccgggttttatcacaatatctcgcatcacgtttgaacaccccaccccccaccccacccttgaacacgtgcctttattaacacccaaagtgacaataacccccataaaaactacgacgagtctttccccagcaatttcattttgtctgataccacgccacaagttacacacacccatttccctcggtgttcgcacaactaagacaagtccccaaaacacggtcttttccttaccgatacaaataaataaaagggcctaatccctgaagtatgctccactacaacttgggccttattaataaagtaaggcgggagtgaccaaggcgctaagcatcacgctgggatattcccccccccaagggtaatagaatcattcttttccaaatttcagcattaggaaatacaccccatgtaaggtaccttccccccaatttccaaagttttccccttgaatttggaataagaataaagagtaaaaaaaaacaattaacagcaccatagtaccttgtacatgtgaatctacttccctttccatcttttacttacaacaatcctttgatataaatttccttgtgtattcaactccattttctatagttgatgaaatttctcacagattatggcaataaatggctggcctcgttggcatcaagcggtggagctttgcagtctagcttacgtttctgtttccctcacactacttcaccccaattgtt

SEQ ID NO: 7465 - DNA, 690 bp, Homo sapiens
ccccgcccccccccacccaccatgtgcaccccatcaccctccgcccgcccccccggcgcgccacgcccacccgcgctgcccccccccccccccgcgccgccctccgcgcgcccagcacccacccccttgacgcgcgcccatccctcgatctcccgcactgcctatagtcaaaaattaagctctccccccacctacggagccatgtgattcttcaccgcgcctcgccataggcccctgggaaaacaaaaaacacgggggggagagaaagccccccccaaaggggggagagggcccttggaaactcacccccccccagccctcttacaaaaataaaaaaccaaaggcgcccccgccctcaaaaatttagaacacgccggaataactctgcgcccccgccccccataagggcggccggtaagagcaagaaaaatttctaccccgcgggctttttttggtgttgtaaaaaaccggggaaaaaaaaaaaccttcaattttaggcaaaagggccctccttaaaaattaaaacaaaggagatttcccaccgcctttttttaaataaagggatttcccccaaggaagggttttaaagaaggcccagaaagggttttttcctcttttggggtttccccagacttgcatataggcaaacacccccttttattttttaggacagaaaaaaaaaaaaaaaaa

SEQ ID NO: 7466 - DNA, 1724 bp, Homo sapiens
  misc_feature (1)...(1724): n = A,T,C or G
cgcacacggcggctagcagtcacctcactgtcctgatactgttcgctctccgtgcntctctantgcttcactcgcatcatactcgacgctncatgagcgtgtgtctgttncactcnatctatcactcagtcacttncncactctcctcnactacaccgtctcattctnctctcctatcacattgcgctcgcgtccactggtanctcgcacccgtcttttcacgtgcncgacatcaccttatactcatctcatatatacgtcacagcacgtcgcgctgccattcataancatgcgtataancgcgcatgtgagagtcgggcgtctctgccgacggtgctgatctctagacgtctacatactatcacgatccatcgatacgccatagtgcgatgatggttctattctcacgctctcatccacgtctncactactcgtctcatcgncgatgcggccatacggcgcgctgacagcgcgacgtcatccncgccagctcatcgccgncactctctccccatnataaattactcatatatacctccatctatccattnactgctcaccatgcacgtgcacgacgcagcacacaccgcgtgntgactgtccctcgaggcactcgantgcgncacatcttccaccctctctcgtgctacanatacttcatcanagcactgtcgtttctctacgtctctctcatacactctctctctctatantcngngctccttctggttcctatacttctntgcagtgtcgtangcgacctgtgcntacgataacatnactcatngtgtaccatatataccactgtgccgcgcgacactcatccactacaatacacgatatcacgcttagtcgcgatcagatcatctggtcgatcgacggctcacgctgacactcatcggtatccagaacacgagtgtatacaactgctgacgctgcaatggtctagactacacatgcgcgccgngcgcnggactgcatccctctncactgcgctcctcctctctacagacacacctctgactgctcttcactgacatgataagcgacctctcccgtatcgaagagccgatcttgacgatacnatactgctctgcatnccatacagccctccactcacgcagcatcctcgatcgctcatatcacacaccgtgtcatatcananaatgtggaacagctgcgcgncncgcagcgactcactcgctacatcgagtgacntgatcccgcgtatcttcatgctggacagcacctgcgaacaaanatcagcagcgnacgctcactcnanccagacacgtgttcacgcgagtagatagtacaatgcactcgtcgacaacactctacagtatacgcnctactcgctacgccaaccacactcgtntgantatntaggccactntngctntcacaatcactcatctatctcgacaacactcccgtgtcacacatcactgcatgtgcatcctctactaccatctattctcacaactctagtgattcttctcantgacttcctccatcgcctctcctcaacgcaacatgttcgacacaatatcagcagcgcacgacagtatacgaacacatgaaacacacacgtgcgcccgtcccgttcgcgacactatcgagccgcagtgngtttgatcgtcttgccggcacaccagccaactactccctctccactccacccgcatcctctctactcaccatctcgtccgactacctcaccc

SEQ ID NO: 7467 - DNA, 876 bp, Homo sapiens
  misc_feature (1)...(876): n = A,T,C or G
taggtattgtgagggttatcaataaatgggtcgccgttttttataacaaataagagccctatttttataacctaatccccatacttgaaaagagaactgattgggtggganacttatttcacattaaaccaagggttgacaattttcttccttggtttaaaaagcactgagaatatgtcttttgtaaaaattttccaaaaattttatccaggtgttaaatattttggaattgagttcctaaattatttaattttattttttgcaaatcggttaatgatcctatttatgaccccacaataacgaaccaaatgccccaacccacaatggattttttttaaatcagttacttgagtcaaattatgtatggttagttaaattatatgctaataggtatttcctatttgggacatagtaggtatacgcttttccattcttccaacacataatggacttttgcaaatccagtatttaaaggcctacattttatataccttttcctgcccttagaagaactgccatgagtttactgtggtaccttagtcagctgttcagtggtggaaactatagggctgaatttgaggatgcaaatcagaatgattttgtcatatacgtatacatgtcctggtcacatatgtgtataagtcttttagtaaaatcaactaaaagtacacacattaaatgttaccgctaaataattgttgacacataatttatttgtattgttaatatatattccaatccttaaatatcttgatcttcacatttttaaattatgtttttctgattctcatgcttctaagaaatttgaaaaataaaggaaaatataaaaataaaaaactggcctcgttggactcagcggtggagctgttcggccag

SEQ ID NO: 7468 - DNA, 616 bp, Homo sapiens
aagaaacttttgttgaaccagcttgttaagatagttaccaggacaggcctggcgcggaggtacaggcctgtaatcccactactttgggaggccgaggagggcaaatcacttgaggtcaggagatcgagaccaggctggccaacatggagaaacctcgtctgtactaaaaatacagaaattaaacacgagaggtggcaagagcctgtcataccaattactaaggaagctgaggcaggagaatcaatggcacctaagaggcagaggatgttaagagcacactaaggctccactgaactacagcttgagagacatgtgcatgagtgcatgtagatggaaaggagcgagattaggacagcggcgagtgagagaagtataataatataaaacatactagctacaacgcaatctgagtaccgtaactgaggtaagaaaattgcccaaaaaaatcggtgaccacccacggttcagaaagccagcctacggcagccacacgagcgtgtgtccgcgctcgtcacacttccgatacagaaactacaccgatgaagcagggacgcaggggccaggagagaacagacaaaaagtgtcaccacatctactgtactaatgcacaaaagat

SEQ ID NO: 7469 - DNA, 904 bp, Homo sapiens
  misc_feature (1)...(904): n = A,T,C or G
atctgctctcaccttcgaaaagtataggccctcaggtcccttatgggtccccatctggcgagcgggtttatcccggcaataagagggancttatctctgctcatcgtgggttagggttttaagtctccccaattggatcagatcgggtcccctttgcatatgtttttcggggaggtgccctggttcacgccatccagctaaggagaggtgcattatgtcttccaggaatgattatagagcctccttttccccttttagttcggtaaacttcccccttgattatatttggaatataaaataagaattgctacatattcctgttgccttttggcctgatctctgtagaataacggacatccaaaaatgtctatatttgaatccgtagaatctcaggttatatgggtaaaggaaattaagatagcagccagaactagattgctaatcagctcacctcaaaatagactgagtatcctgagtttccaggtgggcccaatataattacaagggtccttcaaagtggaaaaaaggaggcagaagagagaaccagagatcgagcagtgtgaaaataactctacccaatgttgctggctttgaaggtggagaaagaggggcatgagccaagaaatgcgggcggcctctagaagctggaaagggcaaggtaccagcttgtcccctagagcctacagaaaaatatgcagccctattgacataagcccagtgagacccatttcagatttgtggactgcagaactgtaagataatacatctgtgttgttttaagccattaagtttgcagtaatttgttacagaaggaactatacgcaatctttttcattaaaaattactttctatctctaataaaaagatggcctcgttggcctcagcggtggagctctgcgggccg

SEQ ID NO: 7470 - DNA, 838 bp, Homo sapiens
aaagtttatacaagccaagtattatttattctctaccaaaaagacacataacaagtgtgccaccagatctcttcatttttggtcaatatacactgtttgaaataaggctccccctttacaagaaaactccccctctaacacattaaaggcgcgcggagagaaaaaaagttttctatggcggcgtgggggggcaaatcttcacatcgtcgccaagcctttacaacacccattcgcgtcattactgccataatgggagtaaatcgctatcccttttatttttgtcccctgttctttaaagggagaaatatgaaacccatttggttttttctagggtctccaataaattgtacaggctcgttttctttctagcgatggaaaatttatcgcatattaatgagtgcgtaaagtaccttagtgttggtaaacctgttctaataaacagtcttctttttgctcactaaatttttcttgaatttacccttaacattaaggtagtgtaccttttaatttgtttttttacgatttgcatggctttatattttttacttaacttgtttgagaaataattatttcttgagaacaaaatactttgtaacttatgaggattacatgatggtgccaatatgttgcttagccattgcttacgcactaacactaacagaagtggatattgcataacagcaggcaatgaaaattatttgcttgaaaatttttactgggtcaaagtattagatgtttttaattcaaatgtgctgataataaatcaaattatagtattttctctacattcctactaacaagtttattgtataggaattcaattactgtatttcacatt

SEQ ID NO: 7471 - DNA, 227 bp, Homo sapiens
cttggataaaattttcatgtctaagttacaaaattctggtaacaagaacttaccactgaaaggctttaagatggcaaacttaatcgaacacatatacactttaaataaagcatctgcgccaaacaaatgactgcacgcacttaaaatgctttacctttaagattgttctcctgctgcgaaaacactgcgattgaacattttccttaactaaatccagaatgcgcccg

SEQ ID NO: 7472 - DNA, 843 bp, Homo sapiens
gccatcctgtgtgctgcaagagggagtgtacactttccgccgccagacgcggccttgagtttaacaacagccagcccttcaggagccagcagaaaagatacgggacctaccacccattccagaattccacaagaggggacggggagtccttcttcgaggaccaggtccaccatcgccctcccgcagcgagtacaccatgcacctgggtctcaaggccaccggcagctacgttgacttctactcagctgcccgcgccctacagggaactgaactatgaagctagccactacccgggggtgcccccactcctgggtgcgaggagcaagacacacgcgctccgggaacagtgcatcggcacgcataccacaagacattgcctcctgtcttgtctttttgtcctcacatgctagtggcacgagccctgtccataccaaggctgcattccccctcccgggacttttatcacgcttcttagaacgcgcagggattggcaggcccccggaaatccggccgacggtagcggccccgagctctcccgtggcgcaattctcttctaagcggaaaggtgagggatcagcattccctggattcgatgcgcccttgttgcgagcgggcaccccgcatcctgccggcggcactcgcgcggcacctgaacccctcgcatccaccaacgccctccacacgaccgacacgcgccgtccagaggaggcgacgggccgagccccttgtcccccccggctatccacgtaccgaacgtatcatcgcctcgaacggtcccccccttccggggtccggctggccgccttcccgtccttcgatcctccacaccggcgccgcgcccat

SEQ ID NO: 7473 - DNA, 1078 bp, Homo sapiens
  misc_feature (1)...(1078): n = A,T,C or G
ttttaattttaattttttntttntttgttttgatgtataattaganagaaacaaaaaagaaagtaaaagagaaaaaaaagnggccctgnngttngnnagacncaggggcagagcacctttgngnagggccagacacnaagagnaagacaggggacgcgacacagaccanggccagcaatctccacacagagaacgacagaagcagagccnggcngacagagggacccaggagccacgcaggcgcgcccgccacggagcggagagacacgcaaggcgaccacggggcgccgagagaggcgcccgggagacagacaggaggagcgagcgacagcgaagagcacccccccaggacaaacgaaccaccaacgagaaagaaagaattcttttttatcccggcccgggcggcgtgacgcacgggggagggtaggtggacgggtggcaggaagacaacggagcggcgggcggggcgcgggtaacaagggtgaactaatatgtgatataagcgagctggcgacgtagccggagtaggggatagagacggggacgggcgttaaagtaacgccataacaccgcctgcccactcattctttccgccaatctatactgcgtccatgaacagagcatagcagctccaaagtggtgagagaaaaggcgctaatgcgacgggggggggcgcgcaccatgcacgtaccggcccggagggcgcggccactggctggagaggtgcagacgagcagaaagacccgtcccgccagttacgataccgaggaatacgaaggcaatcacgccgagccacagtaactcctagaggtggtgtgagctggcgggaacaggatggcgtcgagcgaaacgcgggaacgagcgaggggaaatgcgagcagtatacctgacattcgcaacgcatcggcattaacactgacgtgccacgacattcatcaaaaatacaaactaacagccgtatggagaacacaacaatagaacgaggcaaaagcggcgcatgtagagaaagacaggctacgaatatctacggttaaacacataagggagcagtcgaagaggaaacacaagaggatggcaa

SEQ ID NO: 7474 - DNA, 722 bp, Homo sapiens
ctggtatatagggtacgtgacattagatcctttgggatgtttatgtatagaagttggggtagatggaatgcgaatggataattagataaaaaaaagggacggggatgatatggtctgaaatcgtatctgcgattgcaaccaaataaaaccgagattcccgaacagagttaataaactccgtatgtatgctttaaaagaatctgcacagacagatcttataatcctaaaaattagaacgcgagggtggtgtgtaatagccagatccataggaagggaaagatcgccagaaagagggtaaaaatagattctttagaaacataaaaaacataggacgttaaatcggaaaacggtagaaagcttgaattatacctcggtataacagtgagcagctcctttttagaatgagatgtaggaatagctaaaagtgacgttatactaaacgtggttgatgataggaggtacaaagcgttaaggccagtggagcgtcaatgttattgttaggcacaagatacagaatggtttacacatagagagggggtagacttctcacgctttgtttactctcttcatccgttgtgacactaggcttcaggatgcattggggttcctctgtacagcaagatgtttcttgccttttgttaatgcattgttgtaaagtatttgatgttcattacagattaaagaagaaaagcgctgttgtgtatattaaaaaaaaaaaaaaa

SEQ ID NO: 7475 - DNA, 1709 bp, Homo sapiens
  misc_feature (1)...(1709): n = A,T,C or G
accacacacgagcgcacaatatgtcaacacaacngacgtcgtcgctgcgcgtntgtcgntngatnctctcaccctacgttatctcttatacatatccccaatcactctctgccctcancncatatacgtgtgtcccgatgagagagtacgagagantattngtngttggtgttatatatagttagctttgntgtagagatngagctccnnatcgctngtttntgtatacaccgantgaccagagngtgtcgatcacncngcacgtacngagtcgcacgtgtgtgtnactcacctacntgacagatgnacgntcacatatgngtcttcgatgtntgacacnntaaagtcanatgtagagtgtactatcgactcgcgtgctcatatcacatcaccactgatacagaactacactgcactgccacacanactatataagtagtacgtgtganatcntagngncacagtatgcgcacagtcacagatctgtatgcgtcgtccatgcgcatgaaggtagatgatcgntggtaccgcacatactgtcattagcgaatngntgacagtagtccangatgagaggagntcnttcgaggcagtggccgagcagancgcgacganagatgagatatnatacngtgatntgtgacgtatgtagtataatcatcgcaacgaatangacagtangtngaccaagatgcgacggagntgtgngagatagagtatatataggtggantantagacatatnatatgggtactggtgcgtggtggcgcgcgtggttgcccncaganatcaacagatatattcgataagtccgcacagtccgacctagcgctngtgtgcgaccgtccatattgcgagagatcgagtgtgccacaacaagcaagctcgtcgacgctaggcgacggtacatcgacgngccgctaaatatgcggcgcggaatgacaacatatcacgactgtcaacaatcgtatcgcctactttgtgcgaagcaaccacatgcacatgcgatgactttcgacaccatcatgcgaacacgatattcgaccaacgcgagaatgctgtggggggtgggatgtatcgccatcaatgcacttctcttgagtgtagagagtgttaatacgcataccttccgggatggaggccccgccgaccaggcgaaacacaactacggatcagataccacgcatccgcctcaccgcctatatatcgcgtccccatagccatgtctctcactcaacgttcatacgctatcgaantcacaatgacgatgcatatatgagantctcgccggcgacggccgcatgacatcgcggcccaggccttatgaccggtatattccatatgcgcgtgatttcatcggtgttcttatcgatgtcatggtatctgtggcgctcgagttcattgtttccagcgttctcgcgcgaccacgcgagacagaaagaatccgtgtcgatccatattgatactagcacaacatacgccacgtcagcggctcgtgtcgattcgagtatttgaaatagatagagtatgntggatgagtgcggatgttgtttcatgaaggacagcgcgcaggacggcgncgctacacgataacgatcgatacgtatcgcctaccgtatcccggatatattggtgcgccacgcgttgcggtaattacgtaaacctatgcgcgaccacgtatagcgattacacatcctcgcctngacat

SEQ ID NO: 7476 - DNA, 928 bp, Homo sapiens
  misc_feature (1)...(928): n = A,T,C or G
cccttttgggaaactncggatccagaaggtcaagatagaactagtggattggaaatctctgtagattttactttttgtcactagctactataatagcctatagccttaatggtggtttcagcaactaagacacctggtgtggatagaaactagtgatgctactacaactgcaggtacgtactcgtgtgactacaaatccttctgattcaggaaaatgtgcacatgtgtgaaaggatcctgtcattgtgagaataaactgcatcccaaaacgattcccaacagaggtctagcacataaagtcttgactatctttaatgaatatatacattattatattaagatcattgcggactatgggatcgatcttatttaataaagatctagacataaggaaagcctcttccctggcctcgttggccctcagcggtgggagctctagggggcggcttccctttaaaggagggtgtaactcatgatacctcgggccacagaatcgcgtgcggcccgggggcgttcgggtaggggcgaggcgggatacagctcactcaaaaggggggattacgggctctcccgagatcacggggaaaccccgggaacaacttgtgagcccaacggccccactatgcctgaaacacgaaaaaggggcggacagggcgccggtgtgactgagcccccgcccccgttgaaacaccagaaaaagatagtctcccaacacaaagggggggcaaacgccatgggtgcttaagcatgcccgggcgtgtgccactggggggtagcggaggagcgctctcagagtcgcgacactggcgcgtgcagggtggatcacactgcttgttctcactctaggaagggtgggcgtgntagagggagagatatgtgagaggtgggagaggccggcagctgggtgtggagcaacagaaaggnacga

SEQ ID NO: 7477 - DNA, 791 bp, Homo sapiens
  misc_feature (1)...(791): n = A,T,C or G
cagtttatatttctagagctgtggaaggatctctaagccaaacgcatgaaggatagcctgggaccgcactatgcgactctcccaaatatgaagaaacaaccttccggggcgcgggaatggcgctcaccaccacagacagaaataacgctcctggacgacagaatgcggcttccccccagacaaagaccgcgtcagaggtccatcgggcaaaaggtggaaaaagacgaatccgtgtaacccataatcaaaaggtgcattggccggctgaatgcagacaaaatagactttaagccaaaagtcgttgtttgagacacctaaaggtcattttatataatcataaaggtcaatccctcccaagacgtaacaaatatggacacatatcacccaacaccagagcccaaaatatgcaaagtaaaaacggacagaattaaagggagaaatatatggacacacatcgcctaacaccagagccccaaaatacacaacgtaaaaaacgacagaactaaagggagaaatagacaatctgacagtgaacgttggtgacttcactggtcctaccttgaatgagtgatggagccactaggtagaagatcaacagacaggaatgaaccccgtgaaccaaccagtggatccagcatatgagcctctgccaaacggtccacgcagagccgcagccacgttcctctcgagaggagagcgagacattctccaggctggaccacacaccagagcctgaagaagcctcaggaaatggagaaggactaagatgcgaaagttgatgctnccctagg

SEQ ID NO: 7478 - DNA, 931 bp, Homo sapiens
  misc_feature (1)...(931): n = A,T,C or G
tctttttggaaataccgaggcaggattcgtanagactncagcaacgccccggcagggcacagacanccaggaagcaggttaagaggcagagaaatcaaatcagaacaaaagcagctgggcccaaagcgagagaaacacaaaaaaacggccacggaacgccgcagacggggagccctagcaggcgcttctgaaacatagagggggaagacagagacccaacaagcaccgacagcgcagcggcancatccgtaatagggggggagagacggcaccaccgcacaacatatgagggtaaacccgaaaacgcggggaggggggggatagccatattaaagaacagggcgaccaaaaggaccgacaagaggacacgaaacgagaaaaaaggagagaccggggggcccgaacagcaaaacgaagggcacaaccccgcggaggcacagagaacggacgggaagggggaaagaggcggaggccgaacatggcatgacagaagggccgggggggagaacggggagcgggaacaagcggaggggcaggggaaggagggggggggggaggcaggaggcgcgggcgagggggcacggccggcggaggagggccaaccagagggcgaggacgaaccaaagggggcggggggaaaaagggaggcagggaggaacgcgggcgggcgcgacaggcagcaagagcgcgaggggaaccggccgccggcggggcggccgggacaaaacaaccacaaagcagcgagaggagagcggcgggaggagaagacggacggagagaagagggcaggggagagacgacagcaacaaaggagaggagagaggcaaacgcgccagaacggggggcgcacgcacgaccggggggcggggagcgagcaaagggcggccgggacgcccacgcagaangaagaaaaagaccgccggaggaaggg

SEQ ID NO: 7479 - DNA, 1064 bp, Homo sapiens
  misc_feature (1)...(1064): n = A,T,C or G
gagggagagacgagtaagaaaagaaccaaaanaanancctgntggaagactgcgcgaccaggnngtgngaagctgaaactacgccccagcagggcacngaganggaggaagcaggtgaagaggactcttaaatctaatcacaacaaaaactgttttttccaaaggggaagaataaaaaagagggaaaggcaaacaaaaaagaacaagggcgcaggtaaagaaacaagcggccgaaagccaaaccagaccgctacccaaacaggcagcggagaacggcgcgaacactttttttcgggtggagggagccggcggccgccggagaaataagacaaacaagaccagaagcaggggggggggggagacaagagacatttacaccgaggggggccgggcacacgggaagcggcagagaggcacgagggaggcgggaggggaggagcccacacccaaagaacagacgcacgggcggcgcgggcgagcggggggcaagagggacgagcagcgcgcagcaagaccaccagaagaaaagagcgggcagaaaggaaaagccaggggagagacgagagcgacggagcgcgagacgcgggcgggcgagagaagaggcaggggcgagacgccgaaaacgagcaggcacagcacgggcagggggcggcagagcgggcgaagaggggggcgcaggcgcggcgcgaggcggagggaggagggccagaagcgagagagcgaggacgcgcggagccgccggcaggagagcgcgggcggccacagagagaggaggaggggagagacgggagagaggagggcgaggcagcgacagcaggccgcagcgaggtgaagagggctagggggaagggcgaacgggaggcagcgagcagcgcgagggcggggcgagggcagagggcggaaccgcgagagcggcacgagcagaaggactgcgaggagcagccagcccagcntanaggagaggagagagcgggaggaagcggcgacacgtcagctgagggaggagagagaagagaggaggtacgaggaggcagagcgcagggcaccggagagagaggagagag

SEQ ID NO: 7480 - DNA, 1193 bp, Homo sapiens
  misc_feature (1)...(1193): n = A,T,C or G
atagactctgcttagggcgcgggcgngagatctagagatactacctgcaactcatgactacttctgcatctatcgngggcagtgagtgactatctgtatcatatctcaccacttatcgtcgtcgtagagcgcacatatctagagtctatgtgaataacacctctaatcatacatatgcgattctgcatnacgtcagtagatgttctgtgtgtgctatattactagcgattagatatgtnggttgccgatatacantgtgcgcactagttcgcactgtaccacagagtgtgcacagagcgctaatgccacatcgtgatgtcacagcggacagcgcactctagtgaatatctatctgtgcgcgcgattagcnaatgacagataactgtgagcgcgcgtgggctgatgcgtgatcgcactatcatgactatcatctatacactcgttgatctgacgtgtctgagtctgattgcganaatgctcatccgactgtngtccggggctgtatcatatacatatgtgcgncgcgcgacggatcatgatagctctncagcgttactcgcatnacatgcgtcgaatgcggagccgtgcgatattagtatatcgatgcgctnatatgatgacatccgacacgacnaacgtagcctacagcactacggtcaacgtgtcgccagacgcgagagtctagtcgccgtccgcataacatcgnagtagtatattgacaggatgtcatatctcgcgcgcggaacttatgctacgcacggagcactaactacaactatcactaatcaacaanccatgcggggataccggcgggttcatctaatcgcagatgctccatgagaggcacgtgctggtcgttgtggtaatctacgtagcatcgaggtactctgtcactaatacagcgagctacgtactttgctgcgagataacacgcccgcgcgtagtagcgtggagaaattatagtgcgacgtctatgctgacgtgctgtcggtgctagtataatcacgttgcatatcgatcgcggcagctacatagtgatattcgcagtgctacatcgatacacgcttcacgataatcaccgctatcancgacatganttgcgatgcacagccggatggacccgtcgcggcagctgcgtcgactgctgcattagcgacggtatgtatgtgtcaagttatgcttcgcctcagtct

SEQ ID NO: 7481 - DNA, 1712 bp, Homo sapiens
  misc_feature (1)...(1712): n = A,T,C or G
atatctgtcntatatgatgtagcgagctcgtatcgtcactcgctctctgcgtcggngtctctccctgtgtcgagccgttcactcgcgcgtgtcatanatttatcacgtgtggcgtgtcgccgcttcgcggactactacgtcgtccttactacgcttcagtgacccgcctctctggtcctctgcggtcgtgtgacgctacacagtgtcgtagtgatggagatgctcagacgtatgggttgaagctctgaccacatcgctgcggccagagtctctattcgcgctatgaactcggtgcctctacaaggnggtgcttaaactcacaggtgggtgcgtgtggtcgtaggtgacatcattatatgtgcatgnatctctacgttatntcatcctccgctctccacgcgacatggtntctcatcgtctctgacctagcgtctccgctccngnagctatgactgtccttccaaccgcgtcctcacatcgatcgtcgcaacgctgatgagcagtaggcgtgaatatacggcagtgcgtacgtgacgctacggtcgctgcgccgccgcgctctcgctcgtactcactcacgcctcgccgcgtcgtgccgtcacgtcgtgatgtgggggtctcgtgtcgtcgtcatgtgtgctgatgtganatgtgatatagtgtgaggcgtgacgcgnacgccgggcgcggcatctgcgcgcatgctccgcgtgctgtggtgtcggctctatctcagcgtgatctagnggatgtgtgtgtcgttatcgttggttgggcgcgttnctgtggcgntnagacgagtgctcagaacgtaggagtgngntntgcgcgcgcgggaccagacgcagtcgacncgctcttgtgtcgtgtggccggcgagcgtcgtacgagttagnatatcatgcttctgacactcccacgcgcngctgtgcttnntgccngtacctgtgtctatctntggcgcatacngatgcgtgtntagggtgactgtngtctcgttgatgaaggcancnactaccgtcntacanctacacaccaccacagagagcacagcacncgcgcgagtacgcctctccgcccacgcgcgtctcgtntatncttctgnatntcgaganattaatcgantgggatgactcatgacctgtaggagcgcacgcagtcaggggcacggagacgntatatctactgtgtgctctncttattntccagtatantcgacgtctgacgttgntgtcgngtctgagncacgtctggcgtacctgatcttnctgattatntacgantaganaccatacagactattattatataangngntgtgtagcataatctatacctcactatctctctcacctgctgagactatctcaccgtacaccagctcattcctactctctcatcantatccactctatttggctctgcacatcgatcagtctccncncntctgtcngtnnnnnntcncgcnnctnnnnctctctctctccgctgctcntctcctctcnncgctgtcgaaaaaacctcacntatnttnntcttcttntggttctcttctctatctactntaagggcatttctttattactnnttancctccccctccctactatatcctctacatcctncnatctcaccccactcacacacccacacnnntcntncnnnnannatctttannacttntntntcnnanttctntnnntncctcacta

SEQ ID NO: 7482 - DNA, 1887 bp, Homo sapiens
  misc_feature (1)...(1887): n = A,T,C or G
ctctgtacagcgctctctgcgatgctgagtcgtcgcgcgtgcgcgcctgctaggctcgntgcagtcggatacagtcgtcgcggtaagttagtcgctatgtcatagcgtgtgngcgtcnangataggtctagtnggtggtcgctagtgagaccttgtacagctagtgcctagagatcgtgtcatgttgcaatagactgctcatagacttcgctgcgcgancagaccgactgtgcacgcgtggatggattcgagtngctgtgtgcgacangtatatgatctacggtggcgtacacctgctctatgctacgattgatgtctctcagcanttcganttttgcgtaatctcgcatgttgttgacaactaccagtgacgaacgctgcacatcgagagggagttgtatagtngtctgctcgatcattcatcgcgacatacatagtctatgtctcgtaaagcaggcnctactctcaccttgcatgacgtagcgcgcgncaacgcgcgtactggagcacgtgcactctctcgtctagacgtaggcgactatccgcagtcacgtgatgcgcactttgngtctactcgtctcgctcgctagtgctcgtgctacatgnggangaccttgatcatgcgactctcgtaataattgtcgattacgtgatcacttatcatagctcagtcactgcatagcgncttcacaatctcaccattctctctcctcagtcctcagatggttacatagtctgtctagttatcgtgtgctgatctacacangctcgagtgacacacggtactacttggcactacanatactctgtcatgactctagtgtcggatgactcgcgtgctgcaccacgantgctagtagnatccgtactatagactacgagagcgtgttctacgtgtngtcagctncattagtcgtcggtcatnatcgtaccancgtngtcacatgagncgatcatgatcagcacagtgtcagctactgtcatnactctgtgctcgcgtagtcgtacacggggacagttcgtatatgcctgcgatcacccgtcgtccttctatacncgccgcagagatctagtagtgatcatcgagtgtgtatgctagcgtgactcgactgtgttccgtcgtgacgtctgctctattagtcttatgatgnacattctctctctagctcgtctcatcntgtcgtcatcgctctgcgaccagtcttcgtgtctactctcatntcatactcgacgctactgnctctcngncatattnacttatcgtatgacatgatcattactnacacagcgcatatctactgactcgcgtcacgtgccagntcancnagtactctgcanccgtcctgcactcgacacgtacgcctacttatctgcctcncgtcaccgtctcgtcgtattnctacagtgtcagtnatggccttctagccacangtggcatccgcactgcactgctgactgtntcactcacgctatccagcagtcaatctcagcacactncctgtacgatgtaccacttcgcanactcgctctcatcgttctgctctcgcgtcactatngncgaccacacacatgagcgaacnagcagatacgctgcaggatcgcngtcgatgtngtagcaacgcaggacattcagagggtcgcacaaatggntacntgtgccatcgcggtcacagcatcgatgtagcangcgccagcgcgatgtgtctgacccatcgcatgtgngtcagcngctggagctagcgataggctctctgatttagcacacagccgtcaccatgtgttctacttgactcatatcntaatctcangtgagtgatatacctgtgacatactgncctcctngcgctgcttgtgactgtcatcgctgagcgtggcatatctgtagtc

SEQ ID NO: 7483 - DNA, 887 bp, Homo sapiens
caggatggggaaagattaaaaatgacagtgtagaatacagatcataatattgtgcgcgcagtaaaataatcggtttggactgagacactacgttattatgttaataagtaatctataagcgggaaataaaagtgagtgatcccgtaactacattaagcgggaacacacaaagcgggggataagcggggaaacagtgatggtaaatgagaacggtgaagaggggaaataaaagaaaaggagtaaggtgtgaaaacgataatacaatcaggagaattttaaacaataaattagctaagaacacaattttcaggatgaataagacaagctaatataatggaatgatggaccaaggaaggaaagatgaggagtccagcgcacagtagatacaaagtaagggtgcgggatgaaaagacaagctgacaagttgtgcgaaaaaaacaggggtaataacacggaggcaagaataacggaattgtagtatggtataaataaaaacgaggagattaaagctgatataaaacacatgaaatataaagcgaagcaaatagccggagagattacagaggtcagtgttggagaataaaaccacagcgagaaaaaggggcaatgggacaataacaagtggtatcataggagcgaaaatacggctacaaaccataccttgcttgtaaagctatataggcctatacagtttgcacatgtccccaccctccactacagatgtcttgcagcaaacgctccaccctccactttccattttcccccgactactgcagcacctccagagcctgttgctatagagcctatcctgtatgtcgaataaacactgtatccgacgaagggccacttatcttttactataatagggatatcgtgacagaaaggaa

SEQ ID NO: 7484 - DNA, 359 bp, Homo sapiens
tttgggcttgggaagttgagaaacactttacattggaaagatgtatcgtgaaccctgaggggattttggacaagtaagtgtatccgtaaaacccaggggggtgcaggggtaatagagacatatatggggaaggttatgggacatgaaaaggtgggtgtgtgaaacaatgtcgtggagaaaatgtgtaaaaaggtgaaagtgcgggaattacataaagaaggggaagtttggctgggaaacgtttgagaagcgtcatatgtatcaatgtacaaccgggttagtaaaagacaatggtgtgtgggcaacaccggggtttgtatagtgtcatgtggtatttaaataaattatggggaacaaag

SEQ ID NO: 7485 - DNA, 590 bp, Homo sapiens
cccctgcctaggtccatttgtcggccacttttggctgcatcaggcctactgcctgggctgtgggcagccccaggatgagggagacatggagaacactgtgtcctgcattacccccggctgccaaggtctctactgcctcacttgcttacgcctcctggacaatacctgctccgtgtgtgcatctgccctctcctaccagggggacctggacctgaagctggactacaacgatgaggagggccctaaactgtggctgactgagacacagaagaaggaccctcaacaagaatggttgttgctcgtgctgctacgtgactggctaggatgaaacctataaatgaagagactcttacagtaccgaatactcgggtaagcagcagcaggccagatgaaggagtcttatcaatcatagataagccccacagcataagcctccagacctatgctgttgacatacctgcgcggtgcccctgcctcctcctctcccatttccgcgtgatgctcgtgctcccttcgtctgttcttattaccacgctcctacggtcccggctgatcggtcttcctcttagaggtcggcgataccccacagt

SEQ ID NO: 7486 - DNA, 835 bp, Homo sapiens
atggaatgaggatagtagataaatagtaggggggcggaatggtgcgagggcaaatcagagggaggagagaagatacatgagcacggacgtggaatatgaacctggtcatatagttaatgtgggatatataattgtgcggaaattgaagggggctggtatggggtgcgagagaaaggagaaagaaacattgagaggggaaaaagagataaagatagtaagaaaagttgaaagagggaaagggaataaaagaggataggagcaattgaccaatgtggaagatatactagaaatagcgatcgtgaagatggaaagctgagagaggtggtttttggtgattgtgagccacaacgaaaccagaaggaagtaataatgaaagggaggattagtggtagaaagaatctaagatggcacgtaagaggttgcaggatgtagcaaaattatatcacttaaaagggagaatatatcacgcacacatagtatgagtggttatctttaaagagacaggatcagtctattatgactaagtaaatgtctaataaatacccaggtttgaataacctaacatttcttgttagctattatttcaattgaaaattattttccatgaaaaagtaacaaaatcaactcacaactgtatcacacaagtgctgttccttaaaataatcatcatactttgacttccagaagctaagtatgcatatttcccagctatcacaaggaatgtttaaaagatgtgtactgaagggtcgatattgtaagttaatttattttagtgctgtttcttaaatgaagtcaacacttgattccttttaatgttctaatggataaaaagtaa

SEQ ID NO: 7487 - DNA, 1744 bp, Homo sapiens
  misc_feature (1)...(1744): n = A,T,C or G
tcttgatcatatatgtgatacactctataaatgaagtatagtataagcaacgcgaagagagagagaggcacttagagtnccgggaagacgcgcgacgatagagagacatctttgagagagagcacagataccgaatatagaggaatatagtataataatatcgaatgcgctacgcgtcgtgtatacatgaatgttgtgcgattgttctcgcgcattcatttgtcataagtgtaagataaatggtgttatccgcgttacgctaggactgtttctattacttcagcgcgtgtatatgagagtatagtatagtatatgtcggccaggcacgacgtcccgccgattatagataattgtgttgtgctgactacctgaaactagtgctgatgggatataatagttaataacaagagtgttgggatcggggcgcgtgtaattggtttgtttgcataatcggtgattatgcgtccggcgcgcagcccattccattccattatatttatagttgtcgtcgcgctctatattatcggatacggtcgatatgacgatcgtctcgcgtgtgtcatcgcgcgcgtcgcgncgccaattatattagtatatcgatatatgggtatcctgcgggaggctgcgtgcgagntntgtgatgtataatatttgtatgtctatgtgatcgcgtgtgttcgcgcgtgatggatgtgctcgaatctgcgactgacgtaatgatattaatactgtgtacgaggatatggtttacagataattcttcagctactcgtgatgatgtactatgttttgcgtattactcactgtgagcggaaatagtataagagtgtattttgtagatgaccgacatctaactgattatattctgatcggatcatgattctgcgttatagtatagtctgtnatggatagtattgtattagacgtcgtatacgtgtggtcacggtctcacactacgctcttgttacattattnagtgtggatgcgantcacatatgtgacgttangtgaattcgacgtcgagtgcgcgacttataagtgtgncgaagtgatactgcatgcatgagtagtgtgtntagatagtgcagacttagtacatctttgtcttgtaatctgatacatagtatattagagtgtaagccatagctgttagtgagtcacntctgttccganagatgnttacttgtggtatagtagtcttagtatcagcagtgacgacantctagatgncgcgtcgagtccncgccaattanctacgtgcatcacgtgngacaagattcactgatgatagtagcgatgtgtcagatggcaatgatcgnancagttcatnatttanagtcgtatgcagcgacnagcncgtngtagcgagtttncgtgatgngtgctctagnagatgattagcagcgcgatatgntnctgtntntgtctgctctnctaagacgtgttagtagtgnatatgacgacgcgagngatgatgcntgcgtagtagtagtntgatatcantacgnctgtcgaggactcgtaactgcnatgtagtggatggtaactcatncgangcnatggttgnagtcgancagcggatgtgatangcagctggtgtgananntatantacgtgatacaantagtacnatataaatgatagtaaatnatgattgantganntantntnntnagagcnagatacgnagncnatgantggcagtcgaagatgcatancgatcgtcgatgatagantangtatg

SEQ ID NO: 7488 - DNA, 1214 bp, Homo sapiens
  misc_feature (1)...(1214): n = A,T,C or G
gaggaggaggggacaagaaagcaccgagcggagaggaaaagagagaanagggcctcaagggggaacggccggacgacgcattaccacgaggaaacaccgcggagcgacgcaggggcgggcgaggaaacaaagagcaacatttcgcaaagaagaagggagcgcccccgagcccggggacgaacgccgaaccaaagcacgccacgccacgccccgcaaaacaagcagacggacagacgacgcgcgagaagcaggcagaaggcggaaagaacaggcgaaaaaagacggcgcgcgaaaaggggggcgacccgccggagaaagcgacacgcgcgagatacccgagcccggccaagccgcacggagcacgtccgacaaggatgcgggtgacgcgcgccgagagacgggacgcaggggaaagcaccaataaacgggtacagaaaagagcgagcggaggctagtaagaagctctcacanacaacagacaaataaaacacacagaagtgaaggaggaagagggcgagaggaagacgcgggcgaagagaggcgcacaaggaggggagcggggagaacgggagatgcaagcgcgggcagggcgaggagagggagggcgacagagcactacgcgcaagaganagaggagagggcgcaagacagcaaccgagtagagcgcacgaagcagggcagaagaggggacgccgtgtgcgggatagagacgagcgaaggcgagggcggcgaacgcggagagaggaacgcaaagcgagaggcgagcagaaagcaggaaggaggcagacagagagggagcagacggcgagcgtcagagaggccgccaagagtaaagcccccgcaagagaaagaaaagcagaaaggcaggcgccgccgagaaggtaccgcaggagcgaggggagacgagccggaagcgggagagacgggacggcgaagaaggggagaggccggacgaaagcgcggagggcagggcaccgagccaggacaccaccgaagcgacggagcgccgcgggagactgacgtagcggggcggggggagcggagacgagggcgacacacaagacgagacgagagaaccgcgccgacaaccacgaaagaagaggcggaaagagacgaggagggggcggagcagagccgccgcagaggaggggaaagaggaggaggtaagagagaggagcgcgacgtgcaggagaagggaaggtcgcccgccgaag

SEQ ID NO: 7489 - DNA, 1209 bp, Homo sapiens
  misc_feature (1)...(1209): n = A,T,C or G
agtatgtaatgcgaagagtcgcagtgctgaggcatacgtagagagagctcgtcgagggagaagggagtcttgactctaggcgagacctactcgacccggacctcatatttcgatagtgaaaatcaacctggagtttatgcacagaggcgtctgtgagtagtacacaattatgagtatacagttcgtcgacattagtgcctcaggtggattcgatgggtgcgcagagtcagtgtcactgaagcattgcttcagcgtcgcgcggacacgcacccgagcgtatgtcgttaatgacaccgtctcgcactcccgacgagagtataccggtcacatcgcgcagtgtaatgacttggatgagaatcgtctgaaaatgcaagtgtgagccgaacggtgataaactaagttctgcacttcttcgcggacgtggccctagattcgtcggccatcatagattagttgagttgagaagaaggacgcagagtagtgtagcggcgttttggtagtgttccataatgcacgcagcgctatgagtgtgtttcgcgataagccgcacccccgcgggagattataattcactatgcggtcgctgcgtattacgttaactatgaagcgatctcctggtctcgaactttctgcactcctgtgtcgggttaaagtatgcggagcgaaatacaggaccgtacctattagtatctataagatggttgaaatgtatgcgcagctcggagggttagcgtttgcgccacgatgtctgtcgtctgttgcgccgatgtgtcgtagggtacgatgctgcagcaataatatacagtgtggttgcggcaccccaggtatattatattcggcggtccagtggcggtagaggaagcgtgaggtggttctaaactgttctataagactgtagtaccgcgtatggagtgcgcaacgtatgatagggacgtgcccgaccggtaatcgtgtcgcttgccacggtgcgtaacgacacactcccctgtcactacgaccttataatgatgcgcatatattaaagtagagttgaaggtatcgtactcgtccatcgagaaccgtcagtggtatgggattactgtctaggtacgagcatagcgtcagttgatcgttgcagatttgttgtgactttacaccgccggcagacggttgtgtgcacgtctgacttctgattncggtctcgatctagtggtagatcgagtttattga

SEQ ID NO: 7490 - DNA, 905 bp, Homo sapiens
  misc_feature (1)...(905): n = A,T,C or G
aagggcctttccagttaattgtcacgcagcagggtttggaccactcaatcaattttgtttcctcggcaatttaatctccctcattaatacactttgcccccccggtgttcttttcaatggatattcgagttttccaaaatccataatcggaagataaggtaccaagttcatggaggggctatagggnaggatataaactttacatcccaggaaaagaagtatccaggtaaatattaaagaattgtttaaaaggaaaattttcttcccaattagcgtttttacctaacaagagaaaccccattattatctgagggggtggcataatggccaatctcaattacctttctttggtcaaatcataaacggttctttttcccttttggggccagtataacttaataggactggcttatccttatgttatcattaaattaatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagcccagaatgctgcccg

SEQ ID NO: 7491 - DNA, 873 bp, Homo sapiens
gtaaatccctttaaagccgaccaggtattaggagctgaattataaatttttggtccccttaagggagttcagtcgaagtttccggaaatttccttttgaagataaccattttggaagctgataggtaagtttcctgaatatctccattcaaaatataaatatttgtttatatatttagaagttgtaatgttgagtacatttgtattaggaatgttaagtcctctggataagttgacctcattattatatagtgactttctttgtcttttacaatttttgatgtagtctaccttatctagtatagatatttctgctcttttggtttccatttgcatgaaatcttttttcattccttcactttcagtctatgtgtgtgattaaaggtgaggcgagaattttataagtagtatagagttgggacttttttgtgtctatttatctactttttattggagaatttaatccatttacactcaaggtaattatagatttactactgtcattttttaattgttttctaaatgttgtatagatccttcgttactttttcttgatggcttccttttggattaggtaattttctctagtgatatgcttcgattccttaccttttatttttgcgtatttactataggcttttgttttgtggttagcatgatgtttacataaaatattgtatatttaaaacaggctaatttaaattgataacttgactttgattgcattaaaactttttaccgtcgcatcttatgtttgacatcacaatttatatgttcttctattgtgtatcccttaaaaattattatagccagctattatttttagtagctttgtcttttaacattcatattaagaataaaagcagatcggccg

SEQ ID NO: 7492 - DNA, 1779 bp, Homo sapiens
  misc_feature (1)...(1779): n = A,T,C or G
tgtattatttatcaagatttctttcttttatcatcccatccctgtcacttaactcgcacagtcttttctttatttttatccactcctctacttcttctccctatttttcctctctcactattaagaataaacctataattatnctnaataatgcgtgttgtctctctgtttcttcctcccctcatatataacgaagtatattataatacctcacaatcaccaaactcctgcatctaatctattattgatatcttatatcccacacccatcatacatccgaccccttactatttgatgatgtatgctgtgagcatctctgtatatatccagcctattgtaacgatgtttattactcttcattctttctttctctcccgcctctcatttttaatattatattcgattacgctattattactcccgtccgcggcggagaggatgccctatatctttccttccgtcgccgctgtatttcgcttctcgccaatatatccatcgcatctgttatatcgaccgtttcctccctcaccacttatatacctaagctgtataattgtaattacttcagacgtggatgtgtaacantattgagagtacatgtnatacccatgcattctcgctagacacatcatgtgtataacgtacggtactgtgtccatctgtatagaccatctcctcgatatactatgctacgtctattcacttgcacctgatctgatacgtagttattatcctaagctcgcatcttatagtgtcgtctactctgtgtcatgttgtttngcgtggccgtccatatatctatcttactttatatcacttatgtagagtgtatgtagctctcggtatagtaccgtgcattgtgtatgactacacgcttagatctcgtatatgctgtatagtctagntcatncgtatactatcgctacgtgtatcgtcatnatcgtataatcgtatcgagactattatgtcattntaatatcttctctgncatacgtgattcacttcgtgtctcatacttncatgcgactatacattncancatgcgcantncgcatcatgtcgctgcattctactataatcgtcgcgtatgtttgccttagctgaatgctntcgtatcctatatatanatagcacntcagcgacnancgttctcgctaatatntntcatctttcatnanatntatctctactcgtactgtntnnatagtaatgctactntgcgtgcgtcacactagtcgacgcccgtcgctgtaganagactgatcgtactgtgatgatcatcgacccagttatgcganntcactgcnacactatcgtgtctcntnctgatcgnagnctgcgtctcngctncgatcgtgttagctacacttcctacntcatactacgtcntcagncagtagtantagtactgntgaagatcagntctnagttgnactntacntantnacntctctagtagnatngnattactacgtncagctaagcantcctcatnatcgtntacatcagttttattgntgtangtatantnacntcnncgnanagtcgtactacactanagcntnatnagcatggatgacggngtatcgangtaactgnagtatgagtacgcaagtgcagtcatnctacgntgtactactagtttatactagantatgttgntattnanattttaattnatatatcantattgcatcgtntcgtctactatcataccagcacttcgctacatctaatgncttcatcgattagtgttgtttantagtaacgtatgatcnt

SEQ ID NO: 7493 - DNA, 1126 bp, Homo sapiens
  misc_feature (1)...(1126): n = A,T,C or G
gatgagtggttatgaggtgtgcggagataattcgcgtcactagatgagtgctaggtggcgccatgactgaatcgagcatactgntgtgctggagattagaanggtaaggtgtgtgtagattacgggagactactactaactgtgtgtgatcattatgatctagcaggtgtgagtgtgatgaacggtgatatatagctgaggtcagagagtcgagactaaaagcacaatgtttganagggttattatgagtgaagaatggggtggacggatagtcggcacagtatggcggtcaggctcacgtatgtgagcgttcaaaataaaatgctggagttatacgaaaatagcgatggacgtatagtatgtaggtggtgatatgcgggtgcgatatggggaggggcgtggctcgagaagtagaggtggggagggtcggctgagggaggaggtggtaggtgaggcggggggtaatctacaaaggaggaatagagggaagaagaaggtggtaatttatgggaagctgattgagaagcgaggataattgagaaaggacgtatcgcatgaatgaatgatcgccttcggctgcgcgcagggtgcggtgggatgtgattgtgtggggtggatttataggtcatgccagttcttnnttatttgttcatctctgggtcttccattgataccgagcaagagaacagtggatggaagagatgacattatatgtattgtagtaaggacgtgggattgtacaccgcgaagtattcattgcgttccatagtcctattgctgtggttacatcaacatggcctttgttagtataaagcatgttccactatcattgtacttgtgattcttgtgctagtccgaggaaaataacgcagaatccgaacgtcctccgcatccttcctgtgtgcaactcaaaatcaagatatacttttcttatctcaatactctataaagaatttggaaccatcgacccctgctactggtgacactcgtggttccagcatcggccacatactgaatcaaataaaacaccagaatngcgggccggaannnntntnnnntttnttttttnnntttttttctctcctttttttatnnntcncnnnnntncttcttncttcnnttttct

SEQ ID NO: 7494 - DNA, 877 bp, Homo sapiens
  misc_feature (1)...(877): n = A,T,C or G
ggaaggctatttataggcaaaattaaaaaagagcttttgaggaanttctctttaagacctaccagagtgggaggatattccacgttaggacggccaagaagacccatcccctggtttattaccttccccccaggtccgtgcctcaaccaataataattggggagccccaattcaagatgagatttggtggggggcccagccaaaccaatatattgcattttgtgtcaaatgttgagggacataaagcactaaggattctattctgccagttcttaactgtaacactttttcctccaaataaaaggattattatgcacccaatattctctaacttttaccagaaatgattatccagtactccctcgtaatgtgtttaatagcccattaagactaaaatcttctttcaaatcacttaatatctgttgttatatggtcttgtgtgtgtgtcttcagctagagaggggaagaatatcactggccctgttctcagagaactcacaatttcataggaaatcaaagaagcaatcaagtaacaaacattgtgatatttacaacagtaaaggtatcgcagagaagagaaagaataattttgtctgtagtaaatatttattgagttgcatatgagcctcaatctagataaatatatttatatgacataagaccaacaaagaattgtgatccaaaaattaaaaaactttatcatatattgttgtggggaatacagatatatcaacataatgtcacaataagctatgaatgagttatccatagtagagcatatctgaattccccatgaacatatgattttataaacttcactagtaatcagagaactgcaaattaaaataaggagaaaaaataaccccgatgcagtgct

SEQ ID NO: 7495 - DNA, 775 bp, Homo sapiens
ataaattcaaagggagctatgaaaaataagatagcagaatttataaaagtttcaaaaaaataataaaactgataaaaagagtcaccattgtcaagatagcaactacaaatagaaattaaattacatcaataacaaatattatactaattgtataaaaatatgtaaagctacataagtttgagacggttaaactagaaagatatgggtaaaaagcaataaacatgcgacatactgcaatatccaacaaaatgaaataattggtatcagaatatgggctcgcatgaggtcattatgtagtagcatttagatgtcgctcattttagtcatgcatccaaattctataatgtatcagctagatataggtacaaatacaagacccaaagccaatattcttctgtagcattgcagaatccattcatggacattcccttgactcttttcctgtggttacagcagacatcttttccatgcagatagagttgtttccttttgcagacaaatgggtttcctgatatcactttgccaggaagtcaattttcctcaccagccataggttttgtttcaatttttgtttcttgtttttctgagcaagatgtccacacctgagcatttataaaatcctcctgctttttgtttcagggaagttgagttcaagctcaacttttattccaatagtctttgtccctaattgcaatggtcttgaataaaatcttccttgccatttttaacaagtttccagtgcaatctttctttttaatagtttgtgttgggccat

SEQ ID NO: 7496 - DNA, 248 bp, Homo sapiens
  misc_feature (1)...(248): n = A,T,C or G
aaggggggagagcgggaagaagaaaaacaaatctccacaactcaccccccttttgaggctgcgagagcacccagtccatttaaagcaccgagtacaggaaagaggtcatcatatgtaggcaacaagataggcgagtagtctagnaggacacggagtcgtgaggaggtggacctggatgncctcgacagcctgagacgacataggcagaaggcgcaggtacgtcgcgcgcagtggaggagcagagcggc

SEQ ID NO: 7497 - DNA, 1337 bp, Homo sapiens
  misc_feature (1)...(1337): n = A,T,C or G
gacggggagacaggagagacagcacgcacgcagcccgaagcaagaaccgcccggggcgggcctangacagaaagaccgggaggcggggcggcgcttcancggggggcggcaagcacccgcggccgcgaagcggcgagaagagcaggacgccgcgccgcggaccggcacgcagcgcggcgcggcgcggcccgcgggcgcgcgaagaagcgcgaaaaacacagaagggaaacaacgaaacacgaaccgcagcaccgcaagcgaccggagcgcaaggaggaggagcgaggccgcagcagagaagcccgcgccgccccgacacaagcgaagcgcagacgaccggcgagaaagcgcagcaagcgaaagaccgcagacacgggacgcaacgaccgccggagagcccagccctccacccgcacccaacgcgtcgacagaggggcgccgaaaacgaggacgacgctaagcaacaacgacgccgacgggcggaccaggaaggccgcgacgggagaggagcgacaacaccgagacggncgccgcgacccaaacgaggcgcgaagacaacacaaacgggacgcgccgggcacggaggcccgcacaaccgagcaccgaccggagacgccacaagaccgcgcgcgacgaccccacacacaccccgggacgacccaccgcaagcacaacgcgacgaccaccgagacccgacgaaacgggacgacaaggacgcaccgcgcgagcgagcggccgagacagaccacggcgacacccgcgccgcacaacgtaaacagcacgagaccacgccggcccgcctcggacgccacgcgacaacgcacccaccacaagacccacgccccgcgcgagtcgacagaaggaccancgcgaggacgcaccgcccgaacgccagcacaggcccgcgacgcacacgcgagacacaccgactcccgcagaccccgggcaagaagcgccgagcgcacgcacgcagacgagcgcaaccgacccgnacacagcgcgagcgagcaccgcgacgcgcaagaagcacgggcgcgcgcggcgagacgggcgagcggcacggngctggcggcagagcgcgagcgcgcgcgagagacaggcagcacgcgacgccgacgangaagagatcaaagcgcgcagnagacacaggcgcagcgncgagcagcgaccgcacacaacagagccgcgcgacgcggagtggnggcagagcgagccatgaacgacgaacnaccgtaanaccacagacgacgacacgaccacgagagaacgacacgcacacgagcgcgtgagcggcccacagcaactgacgcacggcgagcgcgcgacgacagcacaag

SEQ ID NO: 7498 - DNA, 1504 bp, Homo sapiens
  misc_feature (1)...(1504): n = A,T,C or G
agcgacgagcggaagaacgagacgacgagacgcacggacgacagccgctacgcagaagcgcgaaagccgagcgagcgcagggacagacctcnaggangaggcgggaaacanagnncgcgccnggnagcgagacatcncccgcgacgngagacaacataaacacacgaagcagagcgccangagacacgaccggcgcgaggncagaagcgcgcggacaagacaccgcncagcgagacgcgcacacgacgcgccaccacacgcgcgacaccgcagcacgncgacgaggaacacacagcagagcacacgcgagaggaagcagcacgcgcacncggcgcgagcagcgccagcagngacacancancgcggagacgacacngcacgcagagccgngcacagacgtanacacagaggacgacgcgcgaacgagagcggacgcggcagacacgcgacgagaagcggacancagaagcagcacgngaaacanacgccacagccgagcgcggacgtgaaatgacgccacgcgatacgcgcaagcgaaggacacgaacagactatgataggacaggagcacaacagcagagcgcaggtacagcacgcgatactaccnacaagactcgacggcgacgacagactcgcggacaaggccgaaatcagcaggaacgcgcacgcacagaacggcgaaggacgcagacagagtagangaccatcgaacgacgaaccgacngcaagccaagcaagacacacagcggcaaggagaacgcaaaaagacgctcacacacccnagagacaacgacgcgcgggcagcgcgagagcaaagaacagacagaaaccagaacagagccgacgccgcgacagcgcggaccgacacagagagacggagaancccacacacgcgagagagacgacatgatgaccggagcaggctcagaaagcagcgaggcgcagcgcagcaagcaccgcagcgcagcggcaccacgagacacgaacgcagaccgcgaaacagagatgcggcggacaacgacggcgcgcagggaaggaacaggccgcgcaaacaacgccgaacgaaacgcacgtcgagacaagcgaacaaagccagaacgacataccacccgcaaaccgccacaaacaganagaacacacccacaaacgaccgcgccgcggcacacgcagccacacggaccccacaaccgacagcagacacgccagacgcaaccaaacactacagcatagcgagacacgcgaccgcgacgccacacaacaacagaanaccaaantagcaacacgcagcgaacagctacaagcggaccgaacacggaaccggagtgcgacgacnagcngagagctgcggncacgcgcgcactcgcgaccagcagnacgccgagaccgacgaccaccaccgccgcgcgacgacgcaaccaacgggcgagaacacgcaccgcgcgacaacggacgaaaacgcgaaccaggacgcggaggcgcagacgagagcaaacgacgcgcgccg

SEQ ID NO: 7499 - DNA, 938 bp, Homo sapiens
  misc_feature (1)...(938): n = A,T,C or G
ttgctgacgtgcctctcttacatttacccaccgctacaagatgagaaaaagtagagactccaatagatagaaaagtttacatcagatcgtcgactggcgttctggtgaaaatgggaacaagattatattaagatatatctgaaatagatgatatatcggcctccgcttccggttttgatatcttagcggaaaggtcagagagctgttcgttggctgcggggtcggctcgcgcgtttctttgttggtcgatcgcgtagcccctcgggggggggtggtatcttttctccgcgcttgtcgtccgcaagtcgcgcccgttcgccggcgcgccgcttattgtgacgggatgagcgggacgggcgtgtgggggtgggctgtgctggcgcgcggctggcgctatggactgcccgcaggccgttactccgcgccgattcatcctcagcgcccgcgcggccgtccggtgcgccgctcgggggcggtccggtgttgcgggcggtctatgcctttctctcgtgggcgtgctttccctcgtggctacgcgcggtgcggtggatagggcgtgtggcggtcgagtggggccgcgcgtggctcggggcgcccggatccgttgtgggcgggtggtcggttctgctcgcgcagcgtggtggattgtcggtgcgtcttttacgccgcctgcgccggtgggctgtggggctgctgcgacgacgccctggcctcgcgcgcttttacggtgcgtgccgttctgcagtagcgatcggtcggcgccctccttgccggttgctgcacgcgtagtgggtgtgtgggtggccggggtcactcggctggcgctcgtgttcgcggcgcgcgcccgcaccatgncgctgacccaggtcgggatgtggagtggtattaagcttttattcccttttaataacatcgtgtgtgagtggatttgtgatgtg

SEQ ID NO: 7500 - DNA, 605 bp, Homo sapiens
  misc_feature (1)...(605): n = A,T,C or G
gggagaggaacctcanaacagggagaccgttcggaatatccccgaaaagcctggggccctaatacaacccccttatttattggtggaaacccgggaaatgtgttcattcaccaccaaacaaggaggaaagggatccctcgtttggcgttagtgggacgaaaaacagaagaatttatatttgacaatctttttttggagggggcaaacccgcgtctttgttttctttctgtgtgcggccgggtttcgattttagcaaaggggccgagaaaaaagttttggtaaccacctccttcgttcagagacgcgtgggcccgccgatgtctcgggcggcgtaagagatgtatcgttggggggtgtaaaggccggggagcgattattattgtgattggggtagatgctgagcaggcgcggtttcacatatgcacgtccccgtcctaggcgagcataagccgagcctcagtgaacgattcgccggttgggatcgaacggtggcacagcagcacggggttgttcccatacaccattatcgcgcaagaacgaggtgtccgagagaaataatataaatattgcgattgagagagctcgtcaacgtgtaagtattatat

SEQ ID NO: 7501 - DNA, 1248 bp, Homo sapiens
  misc_feature (1)...(1248): n = A,T,C or G
atcagtttatgatatactcggtttctatacgactcatatactatagacatttacgagtagtncaatgatattttcatgttatcgaacaattatatagagctgtgtaaactatgattctgagtgtattatatcagattagatgtgtcgaagtgtacagatgatattatantataattattagattgatttccagtactagttgatattgattgttgaacttaatttattgtagtaagagnagcaatatattgggcaacgtcgagcttatgaacagatctatattacnatacgagcaatgcgttaacaaatataaacagcactggcaaatataacactaatgaatttcaactacttgtagatatacnttcttctaagttatagtaattaaggatgagtcttacacaacacgcgagtttataaactatacataacataatacgaaatcattcgcagcatatgagtcgaggagggtagattcgacgtccagacgtaaagaaatgaagagagcgtaaagagaacagagtgatttatagtgattgaatataagaatagatattataattattagtgatagttagtatagaggatagtcctacttccattattctgttctatnttacaattcgcgtgtttactactctctaagttatattaaagacatcaacagtcaacacttcatgaaacatttgtacgcgtaattataatgtattatcaatattgtcatataatttgcaaaatatgaagtaaaacgagatatgctattaatagataatattaagtaatttatgatattagtggaatgcaatggtagagaatgagcaagtaatttgtgaattactacgtatgagaagagcaatcatgtgtcatagtctactacgacaatgcaactacattaactcaactgtcaacacacaacaatagtatctanctcgctctagtagatgtattgacactngttattaattcnatatcagaagtaccatgtatcaacgtgttcgaccgctacgcactaggtatagcatatacattaaccgcgcgatgtactacgtattactatgcgaaagtatgggaggagactgaccatatacacacccgtgtctctagtgtccacttagtgagaaagtcgttctntcctcggggtcgtgtcgacacaaaacccccccttccttttctttcttacacttttatattttctctccttctcttatccctttctctttntctttctctttctctatctcctacctt

SEQ ID NO: 7502 - DNA, 691 bp, Homo sapiens
cctccccttttaacaaacggcacccatttgttttattggaggaccgtttcctgcaaataaaaggggggattaaccccctaaaaaaaaccaagggggcccccaacacgctttccaggtttcttttgaaaagaacctcccgagagggaacaaacgggttttttttttttttttgggagcagggaaacaatttttttcccttaaaaacaaccccccttccgttccggaaaaattagaaagaaagggtattctctccggatatataatccgtggcgatgcggctgcgctcacaaccccacaaaaattatacagccatgaaaagagacggagtggggaatctttaggcgccaaactataccgaacaagtgtgagaggtatatgtagttggtaatattggagacagtcaaagaataaaatccagtgcccaaatcggcggggcgtcagagctgtctactactagatgtatgagtggcggaataaggggtagtaattgattgggatccacaatgccgcacgcggcatatctatatatcaacacgaccactgaagccctcacggcaacgcgagacaggagcgtacgtgcaagcgaggcatagctgtccgataacgacatcacacatggatgacagcgaagtaaaaagcacatgacgaattaaataattaatagcattagacgggtagggttgaaagttac

SEQ ID NO: 7503 - DNA, 879 bp, Homo sapiens
cctcatgtgtgcatgcctatatgtctaggcatatcaagcgtgtaatacagtattttttggccaaagggccttctccgttaaattgttaacccgggaggggtttggacgacggtttgtgaatttaatgcaaggcttttttaattacccccgctacagaaataaagagtaagtgggtttaggcagggtttgatccaagagacagcctggaaggttcacgcggaggccctgcctttgagtgggggaacataacagccagaaaaaagaggctaagcaaatgtgtttttgttgacttgcaaccattagatctttaaagaaagagagaacctccaaaaaggaaaaaaaggcaccttgcaagcacactttgcctcctggacatgtccccagccatcatcctccaagaagaaaggtgaatgagggcaactgagccacagaaagtcaagtcacttggccaagttctttcagttagcaagtaaaagaggcaggagccaaattcaggcagaccagatctgcagtcctgtccacttaacactcacaccaacgtgaagtacccagcacagcatgtggcatgcactctagcaggccaaggaccctcagccccttcccagagacggggagagtggctaggacacatggaccccaggggccatggagggcctcgccccccttcctccagaccctccgtacctgggggtgggtagctgagacccaccctggccctggcattggtgcaggtgaagaggccatctcagcatatcatccttttgtcctttcacttgtatgggaaagggatccaagagttatttactgcagagatttcatcgagatgttctcacccttactgtacatcctttaaaggtgaaataaaaatagatgcggccg

SEQ ID NO: 7504 - DNA, 1197 bp, Homo sapiens
  misc_feature (1)...(1197): n = A,T,C or G
tcctaaaaccattaaaataaattaataatnncnnncgcgtttagctacaaccgctctctttattatccacccctacaacaactattctttctcttattcttcgaaaggcaaagagaacacaaaatggactattgtgcactccccacccaccacaaactctccatatgtatttcttttttacccccccaacccctccctcacacaacacatattcaaaacacccacacaattttttccctataatatattaatatatctccctacatcccacactataaagacaatacgataatattcttcaccacaatcacccccacataatatatatataatctactatcatattcgcgacgcgaggcccccacccataaacaattttctcccctcttaataaataaacatatacccacactatttcccccctttcccccaattaattcttttattttatataatacatataaatatacccataatcaacataatttcacacacctcacttccctatctaacataataaatatacncatatctaaatactatacaacataactcataactactcattaacatataatctcaataatatactcctacataattgatatcatctatattatatataatcaccactaattacatcaatcaccattcacaatccctaaatattcctcatcataaaaattcaataaacacatcaaactatattccaatttaccaatataaaatacaattatcttatataaattattaacacnactaattacataaatatatatacatttctatcatcaaatacaaaaatatatatcatattgatactttagataaagtaatgtatatcaccatcccactataccactattaactacaatcattaaacattacaaatataaatgacacaatcgatgctcataagaaanttataataatcattactctaatcactaagtcagaataatcaactactccaatcatacaacatctactaattaactcataaatcatttatttcactataatacagatcactctctatccaatacccatatatatctatatcctactcaacacttatatcagactcatacatantaaacattatacatataagattactttataataaaatatatgataagatatcaaataatacaaattacaatcacatctagtttaagtatatatttatattct

SEQ ID NO: 7505 - DNA, 293 bp, Homo sapiens
  misc_feature (1)...(293): n = A,T,C or G
cccccttggtggtttcccttttgttcttttcccccccttttttgttgtccccccctttcgttccctttgtttcgttccnccccccctttccttgtctcttttgtccccttttttcgtttgtcgccccccccgcctcccctggttcccctcttttttcccgtccccctcgttgttttccccccccgctgtttgtttttccctttctcctcccttcccctgtgttgttttgttgtgtgtccccccccnctcctccttgttccccttcttttccccccctgtcccncnccntatca

SEQ ID NO: 7506 - DNA, 1283 bp, Homo sapiens
  misc_feature (1)...(1283): n = A,T,C or G
cgcactatatattgcgcatcgagtaatatatatatcagataaacactatctagcgtgccgctggttttgattttctcgaacccatctcgattgagtgtgtatttaatggaagcgtgatcatcagatgactcgccacaattgtgataagtagtcgtacgcgcggccatgataatattaacactttgatggcgtaagatagggtgtcaagaaataaaactagtcatcgccgtaatggcgttgattttaagtcattacgccgcgttattacataacatgatgcgtaccgccacgtcctattcttccccacatattttttgggagatcgcgttgcgcgttgatgatcagnaaatggcgtagcgatgacaataataagctgccggccatattatattttgtctctcccaattggggggcgccgcgcctccctccattttttgttttgcttgccggatatatcctaacgactggtatggcgcgtgattaatatccggcgagcgcccgcaaataagtgtagtcgagtattagtctaagcgctcggttgaataattgaactctgtaatgtactcataagaaacggccactgcgttagtagagagaatactgcgtagaatgatgaagtgcgcagtgagtattcatggagaagagcgtctcggtcaacgtgaatatcatcgcgcgtctatagtacatacgtattgttctgttggcactcaanttatagtattatggacgcgtcgttggatcatgacgcggatggtgattgtgatgaatcgttcagcaaaatgcctcgagttcgtgcacacagaattttggacagacatacaataaacgactgtgagtccgcatgtataatcgatatgtttgacgactttgttatagtaatcataatgaagtatgaccgacgctcgtgtccgggtgaatatgtaggtgtcgnacgctcggatgggagtattatatattttatgtagactaaggntatgccactcngctaggtcggcgatttaatatggatggttgggctggtgtacattaatgtagtatgatgttgcatgactcgtatcatacatagagcggcgtatattcgctctcatatccgatgatctcaatcgtggattagcatcacagtaaatagcgctcttggtgtgcaggttagacgcaagagcggtaccgcgagcgtgtgtattgattngtagttcaaanaaagttaactatctctatatctagaattttatgtcacattacaactatgtctctaagttataactattaatatataatgttatagt

SEQ ID NO: 7507 - DNA, 1361 bp, Homo sapiens
  misc_feature (1)...(1361): n = A,T,C or G
tcaatatttatttccatttcacagngnnngnnnanttttaaaacaaanannggngggggnnnngctaagnctggggagaccactgtgctttaattttttccaccccctacaaccaagtactttttttttatcaccgatagattgccctttttttggtttttcccncncaccctcgggctttgtggcgcgaatagaaaaaataatttttttcgctttttaaaatttgtgtgagggacgcttcgcaatgaaaaaaacactctcgtgggagaaactagccgctcctttgtctatcccccccttcttcactatctcatattggtgtcttaacaggggtttcttcttctttttcctataccttcactcgcgcacccgcgccccccaccccactttaaaacaccactcctttttctgccggggggcgggcccctcctttcttttttgtctcgcccctttttccttatagaatatcccacactcattattctccttcccttcccccttttatatttccccatgtatgactccgtcctctattcgagacgggcggtgctttctttacgtctcgtcatctcatctccttacagtcaaacattaccactacacctcacctcatatagccntctgcccactattatctctgtcgtttcgccgtttcattcccgcgtacttttacacctccctctcagtgagccactcttcnctattatgtatatgttctgcctgcacagtttgtgttgatgatcctcgtgatatgtagtgacttcttcatcttcactcgctttnctcacctattatcctacatgagcgtcactccctacgctccaatgcagtaactatgttcctcaatcttagcctatattatacatactctcaccgctagttagcctagttgtactcgactctcgactctcctctgacncgcagtactggtacctatttatcatacgagctatcgtatctctcgctgactatcgtcacatcacntacatcgctctgtacagagctaattatttatcgtataatactctagtgacggtgcgatgctgcacactccgccgtccgtccgtgatattgctcattcttctagccatttcactcacgcgcttcttagactagagtcctgtgtctccacgtaactcagttcgacttcatcgtatatctgctatctatcctcattctgcatccgcgatgcccactctgtctccaactcactacgtgtttgtccgtcactccgtgcacgacatatctatatcgtcgctcgataactcatacgtgttgcacgntgtactctcccatatcaattcctatactccnttaccacacatctcgatcttgcatatacgatgtattatattctatat

SEQ ID NO: 7508 - DNA, 1119 bp, Homo sapiens
  misc_feature (1)...(1119): n = A,T,C or G
ataagagtatcgcgtgcgttgtgagttgtgcgcacacataaggcattgggacgcgtggggnngggcgctctcttcttctnacaatacgcgagtgcgacaaacgtgtatcgcacnacggaatcgcgcgtcgtgcggaatattgtcgataccggcggagtgtaatggcggtgtggtctttaatttcgggcgcatagcagagctcttacacccacgactataaaatggtcgagagcgcgcggccatgctgcgctcttgtcacaaaaaagtttttggtacttggagacgcatgggagggaggttttattattataacccacgcgtccacgggagaccacgcaccctgggagtcgtgctctttaacttgtttacatctctaccatgttggatctgtttactccaggaggcgatgaggccgaacacttctttgcacccccctttgagcttattctatctcaaatgagtgagaactcgcttaaagcgccacggcacaaaaaaagcgtgtatttctaatttaacgcctcgagccccacatagaacctatacaggcgaaaggggcaaaggccttggtaagggggtttttctctggggtgggtaagagtaattttgccacttgcaccactggggggcagagggtggcgcaaaagaacctgggaccttgttaacgggggtttccctcctcaatggagaaaaaactcctagtggtggtattattttgggtggcggtgtaagatgggtacactaaaatgtctcttttggaagggacggaacaggagggcggctttaatcggcgaggtctctctggtagggggttgaggaggcgcctaataaggggggggcacctatgttttctcttgaggaggaagggggaaaaagagaggtagcgaactgttttccgtaatgccactacttcggcggatggaacaaatagggcggaccgtggcagcggcgtggtggcgctcttngtttgtgtgttccaagagaggtgttctgcgaagagggaggggcggtatactttccgataaattctgtaaagatgtggcatgctgttccgttgtattgtcctaagaacgcaccacataaatcgcgtgcttagacacacaagagtagggtcttcccacg

SEQ ID NO: 7509 - DNA, 766 bp, Homo sapiens
aacacttaagatagacactcccagagtggccatttatagacctcccccaagggatgcaagtattttcctaaggtcttaatattaatatttcttgctaggaaaagaatttagcgatatctctcctacttgcacacccatttataggctctctgcaagatgaaaaatatggctctttttgcctgaccctacaggcagtcagaccttatggttgtcttcccttgttccctaaaatcactgttattctgttctttttcaaggtgcactgatttcatattgttcaaacacacatgttttacaatcaatttgtacagtaaacacaatcatcacagtgatcctgaggtgacgtacatcctcaatttacgaagataacaggattaagagattaaaataaagacaggagtaagaaattatgaaagtattatttggaaactgataaatgtccatgaaatcttcacaatttatgtcctctgccaaggctccagccagtccctccattcggggtccctgaattcctcctctagagcctgttgttaagcatctgccagcacaccactgggttggcctgcttgtcagagtctgaggatgtggagtgtggtctttgaggaggatgggagcaagagctgaactaggagcagcagggttgccggatgctgctgcaggcccagctgagggaggagaccacagttggacagggccaggcctgctggcattagcaaacgccattggctgcatttgttgaggactgggagttttgccatggtgccta

SEQ ID NO: 7510 - DNA, 845 bp, Homo sapiens
atggacaaagagtggctcatatagatcacccaaatacctgaagcaacacaggtgaagtatattctggacataaacctccacgtagaatagaaattcgattggcatactatagacatctgtagaccaagaaaggttgagccatcagtatcagtcatgcataaggtgccaacatgacccccattggcctgtcctccagagaaccccgtcagcctttgctgatgagaatataagcagccattgtggtagtcatggactccctgcagctatcacagtgaaggtcccattaatggtggtgagcatggatcccatcggctgccccacagaggatactggcagcttttaccattgagctatccaacaatcatggtcactgcggactccccagagacaaagacgctactgcaccctgcctgaagaaggagctgctgttgtgccacccaggaccagggtgaccccttgcccacaacaaccccagctcctcacccaaggcatattccaggacccaggaaccacagatgtcctgggtatatatccaaaagaaataaaatgacggccgggcgcggtggctcacgcctgtaatcccagcactttgggaggctgaggcaggcggatcacgaggtcaggagttcgagaccagtctggccaacatagtgaaaccccgtctctactaaaaatacaaatactgcgtggtggcgcatgcctgtaattccagctactagggaggctgaggcaaggagaattgcttgaacctgggaggtggaggttgcagtgagccgagatcgcgccactgcattccagccaaggcgacagtgtagactccatttcaaaataaataaataaaataa

SEQ ID NO: 7511 - DNA, 1385 bp, Homo sapiens
  misc_feature (1)...(1385): n = A,T,C or G
ctgttatattgcgattgataatttgattcatatataaanagnaagggagntttagctatggagactactgttctttattatattatacacaaatacaaccttgtacttagactcagctcttcggggggagataaccaaaaaaaataananaggggggtgtggtggtgtccccctctccataattgacacttataagtgcaccattttaaccagtgttaaaaaaaaaaaagaatccccccctcacccccgatatggtttaatgtgggttatctgggagttgttgaaataacgagtgtttagagaaaaaaagtgcggggagattatattattattatatacaggggggggggcgccccactctcccaatatttatatttttgtcgccggaatatatacgaatatgactatgtcggtgtcgcatgaatatacgattcgcggcacgcccncacacantctagctatggtacgaatgaagagtatcaggtgtctgcgcagcgagtgagcgtacgatgcgtgcgcgtctntagtgtcagcagtatcagcgcttcctcncagatgagtagacacactgtgatgcntcacgtgtcgatattgtgtatgatatcganctcaccgtatagtatacttacattctctcaagatagaggtctgacatgagcagactcgtctacactgaccacgctatactcattctggaggtangtgtatcatgtgtatctcagacggcgccgcctgattagtagacagataagcgctgcaggacatntcgtagctatgcgcgatttcgctcgcgtgtgagaggtggttaagtactgtatttgtaatgtactgcgttctagagacgagctaccgcgacgtgtagattgatcgtgtatcactgagtagctactgatgatgctcgaactataggtcanctacgatgtgttggccgctgtgatcgnctcgtgttngattttcctgtattctgaatctacgatgattgcttgtaaataaatgtcattattactatgcgatatagcagagtatataatttatatagtgttagcgtgaggtaccgagtgagcacgaggcgcgttctgctgcggtatttagtgagtatagatagagatgttaatgtcacaatgagatagagtatgttgcgctataagcaagatccatactgtcatatgtacagttcctttgtattgtatattatntcaacgcggttgttctnatagctatgaggaagagagtattactattgcacaatctattgatagcagatacatgaganagaatgacgataactatnatngaatatataaagataatagaatattatatatactcacatttgtatntattcacacaacgcatttgatgtacgtgatagttttgtaatgtat

SEQ ID NO: 7512 - DNA, 807 bp, Homo sapiens
tcaccgcttgaccgcgctatgatggacctgactccgccttcgggatctataaaagggggcgcatccagtgattgttctgggcttatgagcctaccctagctaaatggatgccgccgcctgcgcgttttgtctctgcagcctaaaccttatgctcgagtggctccttttaataacccaccagctcatgctaaccacatgacaccctgggtataactagaaaccaacctgtggactgggcatatatgatagccttactcgtgtctctgctggagggaggtctcgcatatttgcacggctctgctacgacgccctggggaacgaggatccatgaatgacctcccccaaacctgatggaaggacttgtacagacctgttgccagaggacccattctccttaccctaacgtatgtgacagagtgcccctggccctttgtcataggcgaggttcaaatgccacaacagtgatctaaagattttgacacatgtctttgcaagaatccgcgacattgtaatctgggctcaccaccaatgggagtgcattaactggtcatgctgcgtgcaccattactggggttgccaatttagaaataccccctccatatggtccccccgtgccacgtttggttaagtttgcaaaacaatggaattataacattgtcccgtttcttaattatagacagcacatatatcctcctatgacacccgctgggtcatatctggtacttccaccatattctacttgagaggcatagcttcatctggcgtcccttaccaacatcgaggaatatactggctttcggttgggag

SEQ ID NO: 7513 - DNA, 1873 bp, Homo sapiens
  misc_feature (1)...(1873): n = A,T,C or G
acggatcgaatcgcgagtatcggcaaataatntagagagaaaggggggggggagggggttagctngggagaacgactgctccttgaattgattacgaccggctgacgagacgctgaaccaacagtcgacacacacgaaggatgttgcgacgtgggagaagattatacnttggttggagggagcgaggaggtaattggtagaagagcatagagatgaggtgaatctctcgttgtataggaagatcaagagaggagacatgtatgcgcgagagtgttgtcggtcgatcagttgtgtagtatatgagccnacgtacgcaccgccagcgcgcgagagtaaatcgatttatgtctatacgcagcgcagcataagcgacgctgctagagcagtgagacgttgtagcggtagactgtttatatntcntgcantcgtgtcggcgccggcgcgcacttaagatgtgtgttgtatgtttattcgcggagagtagggggcgtcgcggcgcccactccatacacatatatataattgtantancngtcgcccgacatatattacgagtcatgccagatatacagcgtcaggagcgtgtgatgcgatccggcgcgtgacgcgccaccagatatatatatgaccgagtgctgaatcgatatgcactgctgtgtttagtgtagtgagatcgttgtgtgaggcntgagcacagtggatgatgcaggagcgtcgtgacgtcgcgcgaggcgatgatatgagtgaggtacatgattatgacgtanctgtcatgatagntactcgcgatcacgcatcatgtctgtacagacgacagatatcagtagcagagagatatagtcagtaacactgataggtagcnagncgngcgcacgtgcggcnncncagtcntgtagtatgatgtatgcgnatgccgcagcgcagaccgtatnnatagatgaatgantcacntcagtcgatgacgtatgacgatcgtatgtntgatctgcntatgagtgcagtagatanatagatcatgcagtgtgcgacacagnttagttnagagatcagacnacggcgcgagtcgtcagcatcgactcgcatntgatgcngtctgagtagcgtagctagacgnctagtgcagagnctncgntgatcgactcgcacacacgacaggcagtgtacttcgtacgtgagaaatgcgcaggccgtcatncgactgtctacggagtgagtgagtgantcgatnataacagtacagtgatacgcaacgtacgatgncagatcgatattagcgtacacgatcgtgggagangcagagagnagactgcacgcgcagncgacagcgtgagatagtagatcgatatgnantcgagtacgtcataacatcgtgcgagacgcgacgctcnacncacaagtacacagcgatgatgacatagntntatgnatgtacngnatntcgacgntgtaatagatacgtcagctcatcagtgaaacgatgtagccgtgatgggtgcgacgtcgcagctacgatcagntcagtactganaganacacgatgtgtacgancngncgagctantgcagtaancgatnagnaggatnatgactagtagttcgacgatgtantagatgactangagatgagcgtaccagatnagtatagagagcagtagngnacgctgcgtgatctcangtgntcgnacatgtagagtnntagatcagcgtgtgaaagtgacgaggnacnaggnactgntgcgacgcaatntangtcagctagatatgacagangagtacananatcggataacncaatnagtatcgnactantatgncgtacatnatgcgaagcagacgagataagtattagtagtgacgntatagngtatntgcat

SEQ ID NO: 7514 - DNA, 1515 bp, Homo sapiens
  misc_feature (1)...(1515): n = A,T,C or G
ggttatgtaagttccgtcagatttatcgaccccactcgcgacgtctcagatcgcgagatagtgcagtttaggggggaagaaccgagagagtcagagattttttagcccagataaaaaccaacaacgatttcaatatgcggtcgctagacgaagatctaattgacaanaatatatctgcccgtacgtatgtcatcggcgccgcgccgtagacgtaccctgcttcgagtcgccacgcccgatacgttacccgcgcttacacgcgcgcacgtaagaataagaattatactagagcgcacgcgcgcaaacaggacggcgctagatggtcacataagcgtgcgcaagtccgtggatgttacgctcacgcgtggagtgaattagtcagnccgcccaccctatgatcactacatcacccggtgaaatacgacggcgccggagagatgggcagagtccgagtaggtgccggtcatattattatgttcgtaattagtcgcccgccgggtagccgagaagtggtagacntcatagaagcatataaactgcggtatgtatatgccgtatgattctgagcactattaaattagatgagtatatgattgatatanataacagagagaacactgtgtagacaggcntangcgcggtctggttgnctgcggancgcgtgtagcgtgctacgtgtacgtagacgagcgatgttcggctctacgttcagagcaggtacgcgcgtacttgtacgccctagtcaccgatcgcgttggctcacttactattctccatgctccagtacaatcacgtaaggtatgtaaactcaagagagcggtgagagagtcgatcgagtgaagatggtcgangtatacacagcagatagcattgctgatgcgggtggactcgggcatgcacgcattgcacgtgacggagctcattgagacttggcgggaggcatgagtgaccgcggtgtcgcgtcgatccgcgtagacgctctagcagaagntaagccgcgtcagggcattagcattcgcgtccgcttatttatggaaccgagtgcagacgtcgtagtgacttcgcacgtntactgtggccgcactcgtcaggcggattactgtcnacgccgcgtgccgtgtaagagttgcgaccattaccggtgtgatatatagnatttactcacgtgacacaactctacgctgtagtcattacgaacgacgaccgtcagtgcttcggagcgctcactgactcagacgatatgccgccagggtccattatgaattataccgtcccgcntccgtcgctgttatgaacgatagttcatagcagatcgctccatgatatatacggcgccctccgctgcgcacctatatagatgtaacgtggtacatagcgatgcngtgccgcgcgaggcgccgtcaagtcaaccnagacagaatgtctccnacatacagctcgactcgctatgtctcgcgagcgtgtcgcgttgtnacacgcgctatgcatgtgtatatatgccccccgtccacacat

SEQ ID NO: 7515 - DNA, 886 bp, Homo sapiens
aggaaatataattgacaatagggtggacgcaagggggagaaatatagtggtcatggacattttggattccattcgataaaagagaatgacggattatatgcacaagggcttatacagtttggtcgttaataatgcagggattattgtgagagtgtgaagtaaaatccgcgatatttttaataatctcgagtaacgattgatggtagcgtatgctcactttctccgtttcctgaagtgaatatccaaggcaattactcgatgtgggatactaagataagaattaggtgatcttattgcgtggggataaataagaggaaatgcggttcaaagtaagagcctacagaagtccaatttttttctaagtgcaggaagagtatatcccacatcgttaagttcattggtcaatgccatgtaaatgatgttgactaaaaatcaagcgtgagggattatattattagagttcgaactgggtggtaaaacagcagagtctgctggcaacatcatcaacgcgtttggcccagtaatttcaaacgctacagtggtggctcaagaagttttgcaaaggagatgagacccttatatatgaagagcttagtggccaaccattggaagctggcaatatccaattgagagcaatcatagaagctgatcctcttacaagtacacgaaagttgccaaagaactcgacatcgaccacgcagtcattcagcatttgaagtaaattggaaaggtgtaaaagctcaatgagtgtgtacttcatgagctgagcaaaaactttaaaaattgacattttgaagtgttgtgcttttcttattgtaccccaaagcaataaacccttatgcggcagcgtgaaaggactttcctaccccggtcgtgcgcgccattc

SEQ ID NO: 7516 - DNA, 1158 bp, Homo sapiens
  misc_feature (1)...(1158): n = A,T,C or G
ctgttaagattatgagaagaattgggacattatcactatatgacatcacgctcaagcgaactttattatatgcggatacagtgtctctttagttttatgagtgggttattgaatagcaacgacatattgttttagtagtggttagcggcgcaacgaaatatgttgtaatagtaggtgagaagaatgtataatttatgtacgtgtggatcggttgtgtgaatgggcgatagggaggagtgtgttgttgaagaaagattatgccgtcattatgagccgttattaagagtttaggagtgtttaggtgctagatagcagtgtggtatatattcagatcatggtgtggcggcggttattcatatgtagttcgattccgatatatggcgagcgccggctctcctccttatttatatatcgcgcgaattatcgtttcgtgttgacactgaatcacatcggccccaataaaagacgtgtagataaatagtgggagtagatgtgaaaggataacggggagggacttaatgttttgaatgggtgtagatggatagggtcatggtagttgatgatcgtagtaagaatgtgagtagaaggccaggggggatgaagtgtagtgatgattggagggagaaaaaataattaatctgaggaatgagtatattgataagatggtagtatagagtgcagtctgtgtgagatctcgtcaggtgagttcacaatgtggtgtgatgaaagtgtggtatgtctatgtcgttgcgcgatgtagatactagagtcgattgtgctgcaatgatggtatgatgtctacgtatgaagatgtatgagaaacgtaggggaagatatttttttctagcgagcatatacgtattatcagtagtggttcttatgatgatattatgccgacgacgtgcacacagtgtacgttatataatgtatcttctatctgcagtgtgatagataatagttgatgaatcctcgatctgtgtagcggtagagagatgatatttagaacgtgatggagagagaagagtcctcagatgtgatatcctacgtagagagtaaatggatactataggattgggagaaagttagtgattagaatagttgataatatatatatattagactnatttcagcggtactgatatcatagtttgtagtggt

SEQ ID NO: 7517 - DNA, 1607 bp, Homo sapiens
  misc_feature (1)...(1607): n = A,T,C or G
tatgtacagtaatctcagtataatggatattcacgtacgcgggcgatgtacgtgattgatcttggtgtaatcggcgcactttatgtccgagtgataacctatcactcttacgactgatattagttattgtcagcgtcctttacagcttatcatcgaatctgtcgatataacagtgtataggagtatagcacaagtactgatagtatatgaatcgccgcatcgtgtttctatcccctactcgccctgcattgtcatgtacataatcccaatgccatgcgcgagtatagattacgcgcgngtatcgcctgcgcgcgtatattgcatataaattacggagcgatacgcagcagcagcggtaggacacgatgatattatactatataccgcgattgcgagataatatgagacctcgcgaaatataatgatccatcgcagctcacttatcagtctgcgccgtttattaagaggagtgatgatgtgcgctgagaagcgtatcgccacgtttatttcttcatatacgccaccgaaatacagtactagttgcaaataaagcataatatcgtaaacgtattacattgatgaagcaattatatcttaagctctattataattgattatgtataaacaccaacagtatgtgtacggatgccggttagaccgacgcggacgcgtcgtggaataacnttatagagtcagtagatcgtttaaagagtcgtgaacagtctggcaacgacgcgtgtctatacaggagatgacacgcatgcggtgacatatatttgtaatcgaatctactggtctcacactataacacatcatcagagagggcgagcacgcacactgatttagatgatatggtactgtacgactacgacgaggtatcaagctcgtcatgcgtcagtagcatatatatctggataccgtntgaaggtcaattacgcacatagctggagacgattatgtgtgcgatgaatgtagatcaaacacagctcagctaacactacgataagtccactaaagagcggtagaaatgattacgagatagtcacgacggtccactgcgtaagttggntacaccgtatacatagtgtgtccactatcaattgttgacatgcgacggcacccacaattgagttacgtcagactgagcgaggagtgattgacgcgcgcaccctcgagcgcagatatgtcgtccggtcgcatacacacatgtcgtgtatntnatactacgcgcggttcgagacgcgtgtgctgtagatgtgtagagtaagtctagatagcgtgagacggtcgtcgtcttatgcaggcgcaagtgggcacgcgagtatcactttagcgtgtattcgccgtggcgtggcacggcgtgatcgccgcactatatagacgtaacacatcagcctatcgagtagantcacgcgttcgcgcgactcagctatccatntgacacagatagatattcatcgnctgcatcaggcgaacagcgatggacctatttgcgncgtgcatcaatatacagacgagagcgtcgcagacgcaaatctgagagcatcnatgtgcccgtcatatgatcacacgatatagtctgattacatcgcgaccgtcatatatat

SEQ ID NO: 7518 - DNA, 1742 bp, Homo sapiens
  misc_feature (1)...(1742): n = A,T,C or G
acgcatgtaaatatactacantattatctgtgatatttganatctaattatatatgganacacacacccacgagtcttaatactagtccagaactactacgcgctcttatattattttccaacacnatctctacaaaccaattagctatcttaaagttttatcagagtgcgagatcgaccgcagcgcacaatacttacaaantaagatacggagcgcggaagacgcgtgctctgatgaatgacatatacaacgaacgtaccacatatatatataacacttcgtgtcgtcgtctgttaccgcctctcgacattacatacgaaagctcgcaactacgcgcgccgtcctccgtccccgccctatttcttattctgtgttggtcgtcggcctcgtaatagagagcatgcggaggcgcgcctatgagttatcatgcataacnatggttcagaccccgcaccccgacgaatctagtctatatagcctntactcgccttatacgcggagcgggcgcggggccncaccnacatcccatattatagttatgtgatgtccgccttcgtctgtatccataattacgacatatgttcactctgcatcagatatgtcganacctaccgcgccgcgccgacataagtagcatcagcccgatcgtagntatatgtagctccacttaatagtacgaccatananttcaatatatcgtgatctaaagcgactgaactcgcgnaggcatgtatcggtataactaatctaattcatatctcgtgagtatcgtcgtcacgcagctaattcatatataacctacacgatagtgcatgaagatcgaattcatatcaaggacactcgcgcagagtgttaccgaanaatactcatgtggagacntgagtatcagacacgactctccntcataattcaacgaccactgtctacgctgctctcacgttagacgccatgatggctgtatattcgtgtagtatccnctagtagatagagagcaggcgactgtattgcgctcgcgagtcagatacgtagtctgtactatattagcgcgaccctataatcgacttcatatgtcgcgcgatgcatgnacantgtatgtagtgtagcgacatagtaattaatgcgattatatgtgtatgnatctatagagcagagggatagtactatgatcacacgactcacatntagtagcacatacgcactatntaagagtcacagatgacatagnacgacatgatatatatatcnantgtagagatcgtgctntagacagtcgaanacccataacatgagcncctactancactcagtatcaccactaccagtactgctncatgatgcgatgtgatngcgcgatatacanatcgcagagagatctgcataacgccataagtcgtgcntgttgatctactgagttgcgtacttatcngatcgatatgtgacaatagactgtcaagatgatcgagatagctanacagngncgcgccgtatgactagatatcgtacgagtatcgatntggcacatcagatctantagctagcaatcnactagcttccgacgtcgagtcagcnctgangatcaagtcgtcatancngagantactagacantctagtaacgtnacgaaactntnagnaatcgatanctgcttcntacgcanagtgnaaagtacatatactcaanctgtatangcactgatctactcntgcaagnctaactacaanctgaaantagacatagangt

SEQ ID NO: 7519 - DNA, 1794 bp, Homo sapiens
  misc_feature (1)...(1794): n = A,T,C or G
gagttacatatgttgtcaggagangtggtggcacagctggacgccgatatatcgaacgtancacagctgcagatagtctcctcnacatatgcagttgtgaacgacacgtatgagtggagntggagantgtatatagtantcngattctgtgtcaactactacatagncactgtntgcatttattctgaatgataanagtcagtatactatanatntacatatacatacaacatatctgccacacgcacgtatgagatatcagtacaccgccacgcatagtgtcgtatnctaatgatacngattcgtcgtatcncagcgtatgctcatcacccgcactcgtccgtcgcgccggcgtagttttnattatgtanatatagtctcgagctagctgaccatacagtcacgcgagtnacgtgcgctattgattggctagttgatagtctgcgccacagtcgcgcgttagtatatacttcagcgtcgccgatagtttactgngtgctcatgcgcgatccgtcgtatatatcataatactccagcggttcttgttgccgcgacgcaccgagatccgcactcgccgcccctcaccccgtattattgacattttcatgcgccggcgatttacggaggggaataataacaaaatatacgagtactaatagatgtacttcgtaagcaatactttagatcatgagtatatcgtaatatanacttacttatcanaatacacagaggagaacgncgcggtgcgcgcatatcgagaagcagctgctcacagaccactgtatctcgatcaagtcgctctagatcgtctatgacgtttcactgcgacgattgccgagtcttaagatcgtcgtcggacccagtacgatatgtacgctagcgtcgtatgagtnctgtcgcgcgtcgtagagtgatcattgtgnacgactcatagagtagngtcagacagcagagtgtatgangntctgtcgatggttancgantgatantacagtctattacatgtatgaagatacgngactgtgcatngngtcagacacgagagtgtattntctatagagtatgtctctatctgtacgctacgcacagctantcacgagtgacagtgtcatgtgatcgatgatcgactatatgtcgcacgagtntatatgattcacctccgcattctatgctatctatgatgatccgcatanacatgctgtaatcgcntataatttagacagattcacaacgaagagtgagttgatactcagacgcgctataatagattagacttcagcgctgcatctctcnataatttactcacgtcattagtgagtatgatctctgatgctatgtttgagcgagcgccncgtcgcgtcgaggtangcacatttcgtagagcatctgtatgctagtctcctagtacgcgatgtcggagtgcgagcgagatgacagcnagctctgattcacatatgtnacgtatatactctatacgacatcacacgnaccgangtatgtcgactatgatagaaccgcacacgtactgtantcaactgatgataagtattcgtcgtcgtccggcccngntgtgccatcttgataagattatcgagtactncgacaanatgatcgcgagacgatacagatagactaatcgatgcatgcaatagtatcgcggatatgagacacagatngacgtacgtgataganccgtacncgacgacagtcgntcaatgagacattagcgtcgtatagtatntactacacgtctcatcattacgatataccgcgccgagacgcgcgtccacgnct

SEQ ID NO: 7520 - DNA, 1180 bp, Homo sapiens
  misc_feature (1)...(1180): n = A,T,C or G
ccaacacaaaataacaaaccaggaaaagaaataaaaaaaaacaagaaggagaaggagcttaagctaggagaaccactgctcctctgaattaattcacacaccgactaacaaaccgcgttctgaaccataaaagacataggnagagtggagaaggagtaaaacaaacaaccaacgggggggaggaggggagggggaaaacaaaacctcccctctccaaaacaccaaaaacaaaagaaaaacaggcgggggaacaacaatcccacccccccccccaacgcgaaaaaacaaacactcgacccttcaccacaacgaaaaaccacactcgggtatgagaggagaccggaaacacccaccaaaacaaaaaagatcacctcccaaaaggggggcgcgcccccccacccaaaatacaaatacgcccccaaaaccaacaccaacgcgaccccacctaaaccccaccacccccaaaaaaaaaaacgactaaacaaacgagagaggcacacacaacgcaaaacgctcccaatcctantacccaacacaaaaaacagacagcgcaacaaaaaaaaccacacgaatctacaagaccatcacacaaaacccacaaatacagcgacaacaaccacacatcgatactacacagccaaccaaaagcaacatacacacagaaacaaccattcacaaccaaagcacactggacgacacgcacagtaacagcacaacaaaccaggatcgcgcatacacatgtaacctcacgtccccgcgaggacaccatcgtaccgcagagtcagcaacaactccaaaaaaaccaaacaaccaacggccgcgcacccacataagacgggcaccgacaacatcagaatcaacacgcaaagaaatcgaacaaacgaatcacaaacaagacaccgcacaaagcgcacaaacaaacataaaacaggcctacagagcagaaataagtagagagaacacgacacacatcgcatcgctcgacacagcagaaaccaagaacgtgaaccgagcaacaaagcaccccacaacacgacacaactagnacgacggcagccacacagcaccgcaacacgacacagagagagcgatacacatgtgacgcacacgagaaagtagacagaaaaaaaagcaacacaaatataagcagtcgtgatgagacatagagacaatagaatga

SEQ ID NO: 7521 - DNA, 1836 bp, Homo sapiens
  misc_feature (1)...(1836): n = A,T,C or G
gaggaaagcagagaccgcgagttaggcgcggcgcgcgaacaaaggcaactcagaagggaggagaacactcacgaggggagaactagggcggcggcggagagacttacangagaaggagcaaaaccccacanccgagcaaaacggaagagcagggaagagagacaacaacagaaacagcgacacgccgcgactgtaancccatacccgcccgcgtagtcgcatcgcataatcgcgacgccgctcgccaggatgaatcaccgcagcgaccacgcacacgcgaagacacacaaacgtgtatgcgcgtacaaacaccagagcagtgagagaacagcggagagacgactcgncgcacacaacgcacgagacccagaggnacacgagagtcgaccgccgntatatataaagatattccatgctcgatcacgcatcagtatgccgtatgagccacacagatgatataagagngcggagcgtcacgagaggcgacaacaagagcgagatagtacccagcgataatntagttntacgtcagatagaccgccgggcgcgacatataancgagtcggcgcagcaatgagacanataatatataatacgcacaacatatcgagtagatcgnatatatccgtctctaggagaacaatcagcaacatgtatgtatcgataatatataaagaagacgaaganagagcgagaagagagagaggagtacgcatgcgcgtnagcgctcggtatgaggtgcataagtaggtgagcacagcgccatcacgtcaccagatcgtgtcgctacaagaggcacacacatgtgacggcgcacgcgtggagcgattgagtagcgacaagtagatcgtctcgacgacatancgatacggacggaggnatgcgaggcagaggcacgtcgcacgcgcacgtacgagcgagagacgnagcacaaacgtaggnacgcagattcaacagtgaaagatanagcacggaacgacncgcgatgtcgcagagcagatacgcagcaccagcagcgactagacgtcaacgtagaacagcgcactgagaggacgtctcagacgagnagatagcatagtcctcgcatcatacgcgtcgtatgtaccgatgacgacagttncgntatgacaccacacctacgacgcgcagtaagcggtgcgagcgactcaccgtgagtacgaagcacnatgcatcacgacgcgcaagntcgtncggancgccgatcgaacccgcgcaantcgggcgcgcgacgcgtgangtcacagacacatagacagncntctacggagcaccatacgcacgatatatagcacgagnacantgacgcggtagagaangactgtgagcgnacttgntacgcagagacacagagagcgtgncgatggaggcangtagtatacacgtacgcagacacaagacgtctagtaccgtcagactcagactagagccgagtcattacgcagacgtatcgatcncacatatacagntactagctctcggacgggcagagtagagcgcgtatgtatgacgcatggtactacanagacgacatacagacgcagcgcacanantgcatgatatgagagcacgncgtcgcgacgacgtctcatcgaccattacatactacgatcantatgtcgacatatagacggcagcgacgcacacgtagcgagcgagcatgctcaacatgatactccgtgacacgagagcagaccgtcgcagcagagacagatcaggacgccagcgtgtgcgtggaaggacgataatcncgcgcatcaagtangcagtacgcgctgagtcgagagtactacgnacgcagcgcgtcacgcatacgaa

SEQ ID NO: 7522 - DNA, 1291 bp, Homo sapiens
  misc_feature (1)...(1291): n = A,T,C or G
aggtagggnaaggagntgagaagangagaggganagggggggaaggtagggagaggggaagagagaggggaagtggaggggagaggggttaggggagaggaagaggagaaatgagagatgttgggaagngcggaagaagtacaanaagatgatagagcnagcagagaagacaagaacaagttcgttcttgtgtttttgntgaggaggaaggagtgaaaatcccccctagcgagaatcggcgcgcgagcacgacatccaacagacgacacataaaccaaacaacaaaaaacaaaataaagagagacaccagcgagaagccaaaaggaaggaacggaggactaatgaccaaggacgacgcgcgatgggagcgggcggtggtgcgcgctagtagtaagacggaaccaacagggggatctcctcccgccccgagggcgtgggggtatcgcgtcacaactcgaaaaccaacgcccgcgagacggagggcgcggaggaggcgcggagagggccgagtatgacctagcgatagacactggagtacgcccgaagcgacacgcgagtgaggcgagagcacacacagcggacgacggcgcgccggaccgccgcgcccccccccgcccgccncgctctaacccacacaacgtctccgcaacataccacagcaccggaccttcggtcctctcgtcacgccgccctgcctctcacatcctcctgaacataaagagctggcgcgtgggaccgagtacacgagccagcgccggactgttgcatgtcgcgcggacatagtaacggaggcagtaaggacgcgccatcaaacgtccaacagtcacgacactacgtacgccggcgaggtgaagtgtagtgacaatagagaagggnagtagccgatgcatacaaagataatggagtgagcgacaaggatggacgagtagaagagtcatcgaagaggtgagcgactcaagtcacgctagtaaataaagaatagagcgaggcgcagagatgtgccgtatctgtatacataccgcaagcgccgcagcaaacgagcaacatcagatggaacgcacacgcgcgacgacaacaccggacaaaacgcacgacaagcgaccacgcagccgcgaagagacacacaacaacgaatggcgtggagacgccacaaatcgctataagcgcaatgacacacgatagaacaccacacaaaaacgtctcgggaaaagccgatagatgactacgcagcacacagtgcaaacaccagcgaagtgggccgcagtagaggccacagagtacatgacgaagt

SEQ ID NO: 7523 - DNA, 892 bp, Homo sapiens
tctctaattatccaccgctcaggccttacaattatgacactggaaaaacatattcattgtttcaatcgtttggggagattatctggatcttcaaccctccagactaatcactaatcataaaaaaaaccggatctttttctaccctccaaggtggaagacttttgtggggacaattgaaaagctaactggaagcccggaacccccccgaaaaaaaactattctccctttggggccgagggtacaatttttgaaccctcgcgggttaccaaccaaatgagctgggttacttttttccccaatgtgtttgcgaaaaaacgggggttgttgttttgaatgaccagtctgggctccaaaacgcctaggtattagtaaaaatcttatcaatccgcctctaacgaacgtaggtcatgattttagataaaaatacgaggcggaaaatcggttttcgaccactaataaatatctcggggctgtgtatggttacggtgttaaccatatagttaacgaagcgccgccagcgccttatattttagatgattaaactcttatagtcccgctcgtatcatgaataccatttgctcgagtactagaagcaaagtacagaaaattaaatatcaaagtactgtagaagccagaaataagatgtaatacagcacgataggtgccgctcgatcgcctatatatgtaatgttccgatttgtatcacattgacactcgcataaaatcatctatttgacactatatcatatacttagagcgccaggcacagaactgtaatgccaggtttactcctagtcgacacgccgtgtccatgctcagatacataaaacaggataaaaatatatcactaatcctaaacacaaacactcagcccaggtttgagtatagatgt

SEQ ID NO: 7524 - DNA, 1659 bp, Homo sapiens
  misc_feature (1)...(1659): n = A,T,C or G
tgcctgtctattatattagcagctccacgatctatatatatattcttatttttacattgatcctgcgtcacccgactgtccctttatnattcgccgagaacaccatccagtcatctttatatatattatttatatactttgtattcgaacacaccttaatactccnatatatttatcatattatacaatgcgctcacccgtcgagtatagaganttgattantatataataatcggagtgacatgtgaggagctctataactagacgcagcactcccncgtgagatatattcaactccgagtaacgagcgctcatctattaaatccacactaggtgtttgtagacacacacacacgctaatcacgcgcgaatataagttatagcattataccgtatcgctcatctgtataatatagtcgatagtgtacaatattanttaaccacatcttttgacatctccgcccccattaatctattttgatcgttatcccttataattattcgcgcgggcgcgtagtatgctcattattattattaatatcttccccgacatatatccggttatgcacatatatactcgtcacattccatgtactcttcaacactccgcgcaccccatcttatattagtataatcatttagttgtanaaacacgaagttactgatgatagataatgtaggtgaggcaggacgacgatagtacgcgttcatgcgcgatagatcctagtctagttatcgattattattagcattagcgcgtatagttatgaaaatcgcgcgaccaatagtatagtagtacgatctcaaataccatatatacagatgatatacatatattaagtccgctcgactacgcatacgtntgagatntaagtgtattatatatatcgctgcaagcgatcgatttaatgaatatnctgtcacagtcggatatattactctattacactattacagactntanaatcaacatgcaagcgtntatcctattatgcgtacaatatatacgcagcatcgtcgcntgataantatctataatagagatacctaagagcacagtagtgcaccattgcnctnctctcgcagataatcacactatcgaatatatgatgatgtgcgacagatagtcatagcgtcgtcctgagtatgaatacaatgntgtataacgatatatgtcagtnactgacgctanacaacatcacctgctgcacgtgtataaagtgtatgattacatcgtcactgtagantattagatctatgccagacatgccgattactcacgagtaagtgtcactgcatatatatctcgtaccatgtatatagtcgtacgtcatagtacgtgtatctgacactcggttacacgcatacgtacacagtctctcatgaatncgcaattacacgatttgtatagaacgtctatgaccacacgatatataacacgctcngtatactactgtgatgtctaccattatttgtcttaganacataacatatatgacgacangntcaagagagtacctantacggatagatgagctaatcatatagagcgcgtgagtagantccatatatanatatattatatagacttcncgnagacactacgatattcacgcatcnactcatcgtctngtaatangtaatatgatgatattatag

SEQ ID NO: 7525 - DNA, 1324 bp, Homo sapiens
  misc_feature (1)...(1324): n = A,T,C or G
gtgtatgcaaatccgcggagtaaacgacaccgcccgagcgagcacgacgaagatggagaaagcctttaagacggagagaacagagaacgaagggaggaagttatancaggcggggagagaccggacggagaagcaggaacacagagaaatgagacaagagcaaaaaaagaaacacaacanccaggcaaggaacacgcggagccgtccgcagagtcgcaccacaaatcgcagaccgagcgcgcgaagcgatcgcgcaggagacgacgccgcgcagattagataagagtagatatcgagcagacgccagcagcaggctggacaagcgtaagggcgtagcaagaaggtagcgaagccgaaaaagaacgcgaaccgggtaagaagaaaacgagcacgcgcacgaaaagcgaagaccggcggaaaacgcgggagagcagagggcgagcgaaacgagaggagataaaaggcgagataacgcgccgaagaacggaggggacgcaagagaaaaataattaagtgcattaagccaaacacgaaaacaaacagagaacattgaacgaatagtaaggaagcacaagcgaacagcnagagcaaaccgaaggcgggcaagagcagagcagaagcgcagagacgaggagaggggagagaacagagacgggtcaacacgggaatacatagagaaagagcggcaaaaaaagagtcgcacacaccagcgagacgcaagaggaagacgcggacgggagacagggagaagcgagcgggaatcaggcgcaagacgcggacggggagacggacggcggaatgagccaacgcaagcataaaacgggagcagaggatgaatatgctgacgtcgaaccgacaaggcgacacgaggagaggcgccgcgacggagaagtacaccaccgaagagaaaccgcacgaatgagagcgacacgacacggcggcgcgcggcagagcaactacagagacgaccgcgaggagagaggcggcgatcagagaacagatgggaagtgacggacgggagcggagaggggaagagcgatcgcaagacgagacgacggagcagagaggcgtgggcgagcgaatgaaggcgtaaagagcaaggacaaggagacgggggaggaggagatgacatgacagaaaacagaataaacacgacgcgcgacgcccaaagaaantatgagagaaagatactgcacacaggacacagaagtgaatgagagagccgctgaatagtgagcaacggatcgtatgcgngagagatggtagcaatagcacgcaagggncgtaacgcgagatgagaagatcgagcggctgcgccgcagcg

SEQ ID NO: 7526 - DNA, 858 bp, Homo sapiens
tcacactgatgaatccggcaaccgggattagatcacccactgtgggttgagtgcatttatgttctcccagagaactcgataatcctgtttcccgcgatattgcacttcgccgtgttggccaatacgaatgcggcagaaccgttgcatgccggtatcgtgaccgcagatggcgtgtttgaccgtgagcaaatattagggaagtggcgtccggtattttttaataataacggcattcatccaggcgaaccggagggtgtcgacgcctgtatggcgctggtgcgcgatttttgcacgcagccagaacggctggcagctctgggaaaaacagtctttctgtttattccgctgtataacgtcgatggtagcctgaatcgccagaatacttcccgcgtgaatcaggacggccctgaatcttttggctttcgcggcaacagcctgcatctggatctgaaccgggatttcatcaaatgcgatagcctgaacgcacaggtattcaaccggtttttcagctactggagcccggacgtgatggtggatacacacacttccaacggtgccgattaccagtacaccatgaccctgattcagacccagaccgataaactcggaaatggtcttggcccttatctgagtgatgtgatgctgccggagatttatgccggaatggtgcagcgcggctggccaacctgtccgtatgtgaacccgatcagtgatattcccgatcacggcattgaagattttctcgaaacgccgcgtttttctaccggatatgccgccttgcatcacacgatcggtttcatgcctgaaacgcacatgctcaaaccatttgcagaccgctatggcgtctgatgcagcaag

SEQ ID NO: 7527 - DNA, 213 bp, Homo sapiens
aatcactcaaaatatatcacggcagcgactgatttgacaagttactctctgcccgaattaaaaaaattcatcgtcccatccctcgtgaccgcgcttgctctcatacaaacttcacttatacgtgtctttcccgacctaactacatttatcttaaatatacctggcaccatcaaaatacatccaggacaagaatcgccacaacttcaccgccac

SEQ ID NO: 7528 - DNA, 1630 bp, Homo sapiens
  misc_feature (1)...(1630): n = A,T,C or G
cgtagctataactagtatgatcagtntactactctnagactattattatttctaccgaatatgatactatgacacgccaacgcgcgcaggtagtagaactctttcagatatgcngcgncgangcacctnctgcagtcgtgatattcacgttatctctacttncgcgcngtcgcatcgctcacatagatcaggatcntggcgctcacagtctatcgatcaacnatgatcacgtctatcccgactgctgacacagataacggatactgtatcattcgtctgtagtngatcatggtagactgtcagatgaggtgcgcatccagtatatatactagatacgttcgatgcgtggcgcacattatatatcactcatgtgatatgtagtcgtgaagacntntntntgtgtaccagagtcatgatgctctatcattgatcagagtcagctagatncgtcgcncgcgacgccntgctatcatccgcacnacgntgtattcggtanaatagnatgacagagtcagtatgtacactcgtatctgacgacaggactgtccgagtgttatcgcctagacgctatgacctagactactctatctgttcgaacgccgcgcagccataagttagatntgagtgaatgtgtccgctagtcgtcgtatatattacagtcgcancgcgccgccgcgactccctaccccaatatatatctatatttgacatcggcgcgccatatatatcgtatatacgctatattcgtcgtcacaacacattatatctccctcgcgcgtcggccgcatatatatatacatctacgtattatatacactaaatgaacatagatgaggtgtatcaacattcgacagtgnacactacttatatcgatgagacgtctagtgctactcgatatatcaacgcttgactttncgtcactagagtagantttagcccgacgccttttatatctgaattgtatctctcacatctgattagcataacatgctgcgctctagtacgctgagtgcgtatatcagaagttttatgttgggcgcgatagtatattagtattatctctagaagtgacgttcatatcttcgcacaggtataagagtacaacatgagagtgaacggaatacacacgcgtgctcagttatatatccgtacattccggagggtcgcactngtactcaggcagagtgtaagtacgcatcgtgaaatgtgaacacgtgtgattacatatacgtatgcatcgagcactacaggtaggatgtattgatgacgtgcgcacagcatttcctttattactatgattcgctggcgatggagcatgctcgctcacattctacgcattttgcttaattagagttcgcaatacgaggacacagtactacatgaatcgtaccgacgctccgtccaaccaggtaggttggaagatgtaattnagctctnacaccgtcctactacgtagacgacgagccaaagactaccatattatggatctccacacgacacagatcgagaatgcggtctctngacgggattagattgagtagtgtatatgcatgttgttcatataattatatacatttctagcatctagtctctatcatctatatacagttatgaagtattaatatatatg

SEQ ID NO: 7529 - DNA, 1450 bp, Homo sapiens
  misc_feature (1)...(1450): n = A,T,C or G
gcgcagtattagattgtcgggcacgtgagtaaaaatacgacaacaatatcatctatagaccagagactccgcgatatnagcgtctagttcgcagatacgacgtcgctgacaaaatgttgtcagaccgtcggtagcatcgaggcgacgtacgccactaataatattgagataagttagtcgctacgcgagcgtcgatatattcatngtattactattaccgatcgatcgttaggagtaggtgagtcaatcagacagttagtacgagatgtagagatgtggangggtgttatgtctcggaagaagtatagaaatgtaaggtagctacgtcacgcgtccatcgtcctcgcgcgacaattatataatgtgtattgtcgagtactgtgtggtatagacagaaggacgtagagatgtttgatataagcngcgtcggcccgcaaatatattatgttgttcgagtgcgattatcgcgcagccccgacgcatacatgccatatattatttgaagcgcggcatatattcaacatgcgagataccacgcaagtatagtcgacagccactcggcccctgtatagaaagacgtgtatagaatctggtagcgtggaggagtgtttgtaagagacgcgtgatgacgatagcgacggttcacatacagataagttagtacgacatgcgtgatcgattagtcgcctccgtattagaatacaaggaatacggaagatctagagaatatgaagaatactgacacgagaatgatgtagtagaggtatatgttgactggtgtcgcgcacgctataagatataggtctcgtgctgagtcgagttactatgaggtatagcggagtaggagatatagcgtggagctatgagatctagtagctctgctgcgagcncacggngatatgatttagcgttacattngacaacggatatcagtatgtacgcgcagagtagtatatctaagtagaatgagcgaatgtgaangagatgcagtaatcgtgatagacctgcacacgcgagtgcgtacagagtataggagagagcatagatgcgacagtcataagcaggacnagcgtgcatagtacgagcatattatctcgagtatgtatcgtacgagactcgatcacgtgtcangtcgcgtgtattcgatgagatagtagaagcattagcatatcaggataagtatcagtgcagatagcatcatcacacggcgaggatacatatacgtctaaaacgtcgcagatgagagtaacatggtgagatagacggaactatgttagaatgcaatatagatgaggaantcctagcgtgactgtacacgtgatgcgatgcacttggtagagagtagnaagatgnnggcgtggcaangatantgtgagtcatattatgatataacataacagatntaagacaacataggactctcgatatatataataatgagctatanctg

SEQ ID NO: 7530 - DNA, 806 bp, Homo sapiens
caagggcgctatttgcagagggcccgtatgcaccagccaaaaaagtagtttacaacctgccacgccggaatacacttctcgtagcaaatcatctaccccaccgccccacccaacgtccggaatcaccggcgggaccacaaagctaaccactctcacaccactaatcggggtggttttctaatttcgcgactccttttcctgtcctcactttgattcaaaggccgaaaataaaaagggcaccgttacccccctgcaaaaaaagaaattttctctgggacctaaattaagaaatatgtcttttccaacacacattaagtttagcccccaattactttcgcatatcttttgttttagaaaataacaaaacacaaagttttcgggagccccaattccccccaataatgggttattaagtttagcaggaaagattgacatgggattaacacgaatgaagattttaaaaccgccacttagtcgccatttagaaaatgcccccagaaaaagtcttgtggtccaggaccaaaataccctccattttaagaaacccaaaaggcaatttatcagaatcacttttttagatggattgtgaggtaggagtgaaagcgaggattaagaaggaagactagtgcaatatgctgggtttctcaattttccccagcatgaacccacacttcaaagctgccctgaacaagtctgaaatttctttttaaaatctaacatagtatcttaaaaagccatgcgaatgttgtattctatcccgtcatatattcccattcatttttagagaaaaatttccataaatctga

SEQ ID NO: 7531 - DNA, 127 bp, Homo sapiens
ggtaaacaaagatttttttgccccaacgcccttccccagtaaactggtccgcgagcaaggttttacacacaccagtcgggacttaagtcgcaggccttcttaattaaccccaccacaagtgccctaa

SEQ ID NO: 7532 - DNA, 973 bp, Homo sapiens
tgttgcctctatcccactgtatgcttaactccctcttcctcccttttatctacactcggtattgcatcccgaagtcactaccgccggtctgcacgacaaatgtgtagcatatccaactttctccatatctctcgatagtacatcaataaatattcaccacgtccttcctctgagtgtatatgtggcctactgcacccccttgtttgcccctctctcctctcatcaccctcgcatattctaagtgctacctcctccgcaactacttctacaaaatttaattacacctcaacttcactgtaaaccgcggctccggtcacgccagaatgagttagctctattgataacatatgggacagttgctctctcctcctattaccccagccgcgttggggtgtattatcacccgcgctcactcctctataccaaaacgcaaactgagctacaccacccgcccatagtagttaatcaatgtgggacggttccagtaaaatcctgttaaatgtcccctatgttactaactcgcaacacacggggcacattccccaatcaagtcaacatccactctcccctcttagggtaaaggcctctctgatgtatgtgccatcactgtgttcacccctagccccgcactttgaggtttatacatccttgcgaggcactccaaattacccccttctaatttaaaaacgccccagtagttcagttcttcaacatcaccgagcttgatatgattgcagggaagtggcgcccctacgtgccctggaacaccggagcaagatggcatttgttagtgttcagatctgtttgagcaatgaagatgttccaagccccttaaaatctctgagtgcgccaaacgtggggaattatggatggaaagtaacacatctttaaaggggcatttgttactgcaagtgttggtaataaaacgggatgcggccgggtttttctctttatttttttctcggcgattctt

SEQ ID NO: 7533 - DNA, 921 bp, Homo sapiens
gggagctgcgcgagcgctggctaccgccgcgcttgacagagccctaccccaaacgccacaccccggccctggacataggtccccccgcctgcaatccgaacatcacatacggggggcaatcgtgggagcaccgtggcgctaaccctttatcgacaccctgcggcggcgcggggcggcgccccgtcgcgtgcggccggccacaacggtcgcaccgcgatcgccagaagatcgggcccatcaccatattcacacaccaatccaatcgacggaggccagatcgaccagtacgcgcacatcgccggcgcgtggataccacgcgccgccgcttcgggccgctcggcgccgacacaggccggacggcacccacccaattaacgaccctcaacgccacagcccttcacataccctagaaaaacccccagtccagtcggattccatcagggcgcccacagtagcaccgggccactttctccagcagcgtgaaagctctatcagcggtatccaaaatgtgtggcgtcaattgtagatcacccatatcaatggcaacagccattatgttcatgagttagaagatttaatattgtcccaatatccaggccgtcacaagtgattcgcagattcaatgcaattcctatcgaatttataatgttgttcttcaccgaaataggaaaaccaatcttacaacttgtataaaatgacaaaatatcttgaatagccaaagcaattttaagcaaaagaaagaaaactggagacaccacactacctgacttcaaaatacattataaagttatagtaatcaccccagcatagtactggcataaaactacatatatcaaccaatggaataggatagaaagcacagaaataacccgtgatgcggcaggctccactccccctccctccacgaccgccgaccaagca

SEQ ID NO: 7534 - DNA, 927 bp, Homo sapiens
  misc_feature (1)...(927): n = A,T,C or G
atttccctccccccttttcctcccctcacctcccccattttcggtgaccgttctctgccgatttgtcatatcccccccgcccccaacacccttgttttctcttgttccccccccatctctcccctttttcccccccccctcccccccttaccccccttcccgtcaagtgttttggcccttcccgcccgtgtgggtacggctctcctttcttccccccccacccattttcctctctcccccatccgctaccacccaaccactcctgacattgccctccccttcccgccgtctgggcccacataatttcccccaaatcccccatctttcccactacacaatagacccccactcccccacgcgtttctcttccgcccacagggtctcggactcctccgctccaacccacagtctttctccccccagttcaataacaggaccattcctccccaagcgttttttttcaccaatataattcacccggccaacgccaaaagttttattttgtccccaaatttccccaacaatttccttttaagcttcaattttaatttcaatgtttgaaaagttccaagagcttgataggtattttaacgccatctctggtctgtctgaactcatttttttccgtgcacaataatatatcccagtacgcctgatcaccaaatctttatcagaaaaaaagcatcattttatttagatttactagtaatatctatttccatgcaaatttaataaacattttagttataccccacagtttgaacactcctgttatttgtttttttgcattgagtctcccagtaccaaagtataatgatcttttattattgtaaaagaaaattgataattatggtgaacactgagtttgaataaactacgatgcggccaaancttnnttttatatttatttttctccggtcatatttt

SEQ ID NO: 7535 - DNA, 985 bp, Homo sapiens
aggttgcatccacaacccgctcccctctacctagtccgctgacgcgtccgtgccactccacccacctccccaccagcacgacacccacatccactctgagcattcacgcggctgcgcacctacctacaaccacttcctacgacgcccgagacagggccaccccggagggcacaaccctcctacccagatatccgttgtcccgtgctggcgcgcacaccatctgccctgtccaccgtctaacacctccactgcgccctccgtgcccccacgctcggctccgcccccctaccgttacaccccccgccgaggcaccgcaccgtatctaacggctccgccatcaaatacaccccctggcctcgctcttccgacttcgatttatacgggtgtcggctcccgtcgtcggcgcgacctggcgtgaccattagcacgaccagccctacactcgtctgcttctacacgcccttccccagcacctcgagcccctcagccctcttcatgcggctcaattctaccacccccctaactcagccactccactcccctgtccgtcgtcaaccacggcaaccgcacccccaaccacgcatttgcacccagggcttgcgccatgctccaccccccgctgctcctccatgcccagtctccttcactccccataccggcgtcacaatttccccgcctggctaacatcagtcacccttagccagatttgttatgaacccagctactctgtcgctatcaaatgggatcagcattcacaatcctgtcccacgtcatacatcaagacgcaaggcctgtcaattttgattgggttcccgagctaggtcgaaagaacctttagctgctctttcgctcttgcgggcttgtttcagcagaggaaccacccatctatcccccatggacacccttttcacaccgatgaccggtcgacgggtgcccgatccgcccacacactccctctccaggacctcaccggccgagcccgtcc

SEQ ID NO: 7536 - DNA, 885 bp, Homo sapiens
  misc_feature (1)...(885): n = A,T,C or G
tattcccgtcctattagctctccatcctacacccctaattttttaccttccctcccagtcggcgtactcccccacccccccccatgtgttacttttcccccccatttaccccacttttcctccacatatccccctaaacccgtcgcatgtgtgtgtggcctgcgcatcatgtactgtccttctcctgtacttcaccccccatattttttccccaccgatcgacctaagccccccaaccccttttatttccctacccataaccccgtttttatcccctaatgtatcactctcattccccattaacgcacatatattcgtgttcccctcccccccccggctgccgggaggaccgcccccctctctatccacccactaacgacccgcgagcggcccccaattgccgcccagtactctaccgacccgccgccgccaagctcaagtagatctatctttatcagctataaaccagaaaactctaaaaggttgaaccaaaaagtgattatttcaactttccccgctcccaaccagtcttttaattatttcggcaagctggaggtaacaatattacaaactggtgtgtttagaacaagcaatcccacatcttcaagaaaacccccctaccaactgagtccttttagtacacatttcttgttgaacatgttaattacacctgtttatgaggatcataaaccattttctgccattcaacattgtgtttgaattaataaaactctttttttaatattttaattttagttaatctacagctagtttctaataaggaaatcaatgataatgtaatatatatgttatggaaaaaaagctgttaagaaatcaaaaaaccagagcggcaaatnttnttttatatatttttccgggttaaat

SEQ ID NO: 7537 - DNA, 1390 bp, Homo sapiens
  misc_feature (1)...(1390): n = A,T,C or G
ctnggtgttcagtcgcaacgtatgttcactccccagttcggcatctatgcgataacgtgcgataggacgtatacataccacacggagatagatattcttattaccaccaattcagcacatagaatatcttcgttgaccgaaggcagtctcgattgattacgctgtaacaccactcttcgccgatctatgtcactcatatatacgacgacggtgtccgtaatacattaatgagtcgttgttgatcgccacacataaaggatagatgagtgtatacgagagtgaggatttacaaattgggtatgatacattccacagatgaagtgctaacaatgatgtctgactatgaacgggtgaggttatatagttataatcgggacgataaccgnatcacgcgcaatacccccgccgcgatacacttaatataacttgtccagacgcctatgccgtctattccacgccttttgatcagttttgtaaatcacgacaccccgtatgtcttatgttatttaccccgcacccacgaatctgctcgccggattacgataatgtctaggtaatatgtcacccaccctatcgtctccaccaatagtccccgcaccattgtcaccacgaccaaagaatacaaaatgaatcgtaaaggattagtgcgtattgtggtgtacancactccacatctgcgtacaagtataaccaacaaggacccgaggtancactttgacaaatttagtaaacgcataagcgatgtgattaataatatccatacaccacgccctttgagtaaaccgctactcgcgcaataagccgaactgctgtcatacaggatacgcctcctaacaccacaagatgcgattgtgacgtcccgtgtgcccccgtgtcgaccgaatatgagtgacagtggctcaacgaaattagtcacgaggtgatatgtcaggtgatgtacacagtgtacaaccgtagaacggtgcaacgaatatcccactgcgtctcaacatcagtcaatgaacgattatccggcaatgtcgttgtcggcgggcagttggtacgcagtaaaatcnatgcatagtgtgataatttgatccgttcatgacgaaccgcaccgtacatgtacacatcggatgaagagaatacacctgtaacactgctgacatctcgatactacagaacgcggtacgcccgacagtgatacgaagtaaaagacataacacaacatccgtcgtattataagatgcgggtggacgataaaacgagagtgtttcgcaggggcatctaatttgtgcggtgtgatgaatcaagaaagaatgaatcgtgtgataattacgtgtgtggacgtgctcgaaccncatattactcgcagctcaccgatcaatatatacctgatcgatctacaata

SEQ ID NO: 7538 - DNA, 947 bp, Homo sapiens
  misc_feature (1)...(947): n = A,T,C or G
aaaagtgagactccaatagattgaagagtttacatccatcctgactggttctggtgaaatggaaaacaggatttattaagatatttcataaataaatattattgagggtggtttttccgttcttaataccattactggagaattaaaaaaaaattagattgaggggtcccggccccttctccccttttagtagaggggtgtaatcccatagattccctgcgctgcactggacttctccttgggcttcgggtcttcgtcgcgctagcgcggcgaggctntcatcaacgcccgaccataaaggggctggtaagttctgttatttccaccgaaaggcacgggggatgaccgtccgcgccgccgagtcgttgcgctcggtcgcgcggctgcattcgcgcgcgaagttgcgttgtcgcgaccgcagcagctcggtgctccggcgagcgggcgtgtctttggacgagcgcgccgtcattgcgtgggtgccgcggtagggcgggtggcacgctgaggtagtttgctgcgcgcgcggcgagcggcgtggtggcgcgccacatgatagatctgtcgcgtgtgcgcggggtgccgccgctgaccaggtgagcggcgcgcgtacagcctcgctattggctcgctcggcttcgtcgcgtgtgcgcctggtagacgcgcccgcgcggtgatattcgagtgtcgtggtcacccgtggcgcgttcgcgtcggccggtgcgaggttgtgggcatgctgtgcgggcgatcgggtgtgcgatgtctgagcatatgggggtacgcatcgcggcgggcgtgcaccccgcagggaggctaggaacgggcgcgggtaggccggcgagggggcactgccggtgcgccgaggtgcgagctcgtcatgaagacangattaaatttatatcacactcgacttccgctccatccgtcttattgtgcttggagtc

SEQ ID NO: 7539 - DNA, 778 bp, Homo sapiens
gttgtgatttcacatggcacgtaatggaattgatgagagttgtgtgaaataaatagtttatactcagagatgataagactattacatataccgaagcgattagcaagatagagaatcacagagtggcaacgggggtaacatcgccttcacaacaattagtagggtctagcgacgggaataacgaccgggtatagagtggccgaagaagtatactaagactattacccataccagcttatatcgaggcggtgtaggaaaaatgtagcgattccggcgatggcgtgcagttagttcatggaatgtgggtgtacccgggcgcggagggcggcccgacaattagataggtggttcagggggacatatgtgtgcgggtgtgtgcaactgataatagggagggaaagggcgacacgaaagaataaaataccacagacgtgtgttagttatgggcgcagtatgtcgagttggagcgccacaagatcgagaatggtgtttaggaagctatgggaggtttacaacgtctttacatagaaaggcgcagagtttgccttgaaactgtttagtcgcttttacggggaggggccctgtagagggattgcccccggggggtttgtcttatgggcgttggccttttgagggacccccccccccttcctggggacaaaaggcccctttttttttgggagcatttaattttttttatcccccaaccgggggaccccccccccattaaaaatgtttggggaaaaaattttttttctccccaaaggagtttttagag

SEQ ID NO: 7540 - DNA, 388 bp, Homo sapiens
atgaaagaaaataaaacaattacgtcactcgcacaaaattaaaaaatataaaaccaagtctgcacacattctattacaaaacattccacacgaaattactgcattcgtaatcccgctactcaactccataaatcatataatataagagacttaatctattatactatgacatttatctcatacgcattgtacaattaccgattataagttaaatataagataacaaaatttccgctatcatctaaaacattatataatgacaaaaacttataatctaaatatacatcaaaccacccacctcccccaatacacaccactttataaaatatattatattaaatcgcgtaacacgcaatcactatcccatacatacaaaaaaaaaaaaaaa

SEQ ID NO: 7541 - DNA, 827 bp, Homo sapiens
aagactttaacacaattttggattgagtgaatttttttttattacaccggcggagaggtttttaaataaaacggggggccaaattaaaaaaggcatagttattggggggcatttgcaaatacttgtcataaataagaaaaaaggtaactcttattaggggggcgcattcgggggtgaaaagattggttcaggtgctataaaatagtccaacaactcaattttgggctgtaaaattttgaaaaggtttcaactggataattcttggattcagaaaacaaacacctgaaatgaaggcctcagaattcagcctcaaaaaaaaattttttccatgaccttccccatgccctcgaatgtttaagtcccattctcccccaaagttagacatggacattagaatcctttttccccaaggtgggttccagaaaacagaatcctttttccccaaagccagccagaaaacctaaaaatatttttgtaactttccctctaccgtgctgtgtaaaaactggtcataaaaatttatctgacctaccttgtttgactgtaggtcataagacccccccactcaagagaggttcagatctacactcagaggaaaaagtgcatgttcagagaggccaagaacaatctggacagacaggccttgctgggtttccccactcagcatattagcattagatcatacacatttcgttcaattatatttctacatggatgtctgtattttgttgaacctaagcataaaaatggacaattttccctgtatgtttgggtcttcattctgaagacttctatgtgtatacattaaataaatttggatgcggccg

SEQ ID NO: 7542 - DNA, 844 bp, Homo sapiens
aaacctataagaaggcaagagaccatgtagcaaatgcacttaccataagtaatacgaagtgttatcccttaccatttatcattcccaaaaaagaagaagggcgccccccctacataatccataggagtagtatgacccttatttaaaaacaagccataacctcgctaataaaagaggatttcgagcgagtacctatataagctccgatgcaggatcgtcaacaaaataagggaaagtgaatccagcaggacattgaagaagttaatttccaatgaatcaagtagactttaatccctggaatgcaaggtttatttcaaaacaatgcgaatcatgtaaacgttgtttatctacattaacaagaggtaaaggccaagagaccccatgtttatttctaatagatcgggaaaaggcttttgataaaattcagcatcattttatgttaataattctcaataagctaggtagtgaaggaacatacctcaaaaataataagaactatgtatgacgaatccacagccaacatcatattgaatgggcaaaagctgaagcattccccttgaaaactagcacaaggcaacgatgccctatgtcaccactcctattcaacatagtattggaaatcctggccagagcaattaggcaagagaaagaaataaagtgcatccaaataggaagacaggaagtcaaactgtccctgtttgcaggcaacatgatcctatatgtagaaaactccatagtctcagcccaagagctccttaagctgataaacaacttcagcaaattctcaggatacaaaatcaatgtaaaaaaatcactagcattcctgtacaccaacaacaatcaa

SEQ ID NO: 7543 - DNA, 1033 bp, Homo sapiens
  misc_feature (1)...(1033): n = A,T,C or G
gtatgacgaaccacgggaaggaggggaaagagaaagggngggcctaactggtggacacggcgcgccgactttaaccgaaccgcctcgccgcaccctgctcgatcacacagcagtgagtcattgaaccatgggtatcagtcaacaccaactaactggaatcggccgtatatggctttatagcgtgatcaataattcactaggataagcgtgcagatcctataagaacatcttaagtgcacaagcatccgatattcaaagatgttttgaagtatcacctagagcagtcagtactctcttgtaacaacatagatcgaggagttgatacttcttttgcctaatgcctatttttttctcctcgactcgtcacattcgcgattaactccgcttaacatagagagatcgatcgcgcctgtctttgtgatctaacagaacactattaatcatcacggactcatagtcacggtatggctgacgagtgcttaacatcgcactgaagcacaaaatttagacagtccgaagatggccccccgtaactatcagaaaccgagtgtttaaaatggagtattggggacgcctctttatagagggagatttatcccccctctaaacacggtgagatagcacagactgtaacttattatgccttctgcctctagccgcctcgcaagggagtatattcgcccgagtcagcgggcttgacatgtccttttttaacccttagttttctacgataagagacagacctctcggcaccacacacatctgttactacatgtgaataagaagagaggcccagcggagaagagggatcgttgtgctggttgtcggacgggaggctaagtagattagagtcgcgcgagcactggttagagtacgaagagtggtgcgtcggataataatggacgcgtgaagatatacgctggtgtcttcgggtcaaggcggtatttcatctgagatgagattagagacggattgccgtagcagaattgatgagacgttatgaattgcacaccgatatagtcgggcgcagcgt

SEQ ID NO: 7544 - DNA, 1287 bp, Homo sapiens
  misc_feature (1)...(1287): n = A,T,C or G
tttgtgttcaattaaccgaacggtggagagggaagggggggctttagcggaactaccgcgcgcgttttttacgtgaaccgctacgcggnaccagatgaccgaacacatttaatcattgagccatggttatcggctagacctcactacactgcatactcctgcaccatggctcgattagattgattttatcattcactactgatatgcggtccaaaatcctttgcagatcaatccacgcggaacagaacagccccacttattggtctcccgtatttcgcctagtgacagacataactcactaccagataattcatattaaacgccgcattggtaggacttacactaattagtgttatttacctattactttctttctttattgtgagtatgctattaaaaatactccaacacagacttcgggagccgatgtactcgcgtgtcagagatatatgcgcgcagtagtgaattggagcggactgcgcgtagtcattcattcgtcccgtacggcaaggcgtgcctagctaagcgcggtgagctatgcaccgactgttaacacccagacagtacggatggtgagtatgtgtagagatcgggatttccgccgtactgtcagagtagagcgacacgctcactggcttatactcgtgccgactcatagagccaagctgcgtggtcacgattacatatgcatgtcacgtaggtcacgtggaaatgatagtccgccgtgagtaatgtagaccgcgcgcagtgatcttcgcacactatgcggattagctcacgacgtgtagtacgataggtgaagaccggtatgttcgtctcacgcccgcgtagtcgatatgtcgtcgttgcggatacgctgtatgaatgaacatatctctatgacggnagaatgctctactgttactgtacgtatgacatcatgacgacgaccacggttgcgtgctcgtagccgcncgacntgcggatgtncgccgtcantcntcgcgattatcgagtctgtcagtacgtgatacgagcagcgactgcgccgtgagagacatcacgacacacactacatcgaagtaatattcacatcgtgtncgctactcatccatatgatatactatctganatcacantatntngccaagtcgtgacgtcggatactcatcgagtacgtaagtgacggacatatatcgtatgtgatcgtcncgatgtcgacacgctntataacgcaagagagtatgacgcgcaagtataagtcatgcacgctatctagtanatagcacgccgcgcgcgaccagaatg

SEQ ID NO: 7545 - DNA, 990 bp, Homo sapiens
  misc_feature (1)...(990): n = A,T,C or G
ataggatgacactggcgtcgtatggaggagagagaaggnnnnntctaatccctgaccaccgcgcgcctatttaacttgaaccgctacgccgtaccctgagcgatcacacagcaattagtaaattaaccatggtgaacagttacacctcacttactgaaatctaccgcataaggctttatagcttgatcaatcattcaataggataaacgtcgaagattctatgagatgatgtggatctgcaagatccctttgagagtgttttaatttccctaagcagcaaacgcttgaagaaatggtgggggggaaatgtttcctaggttatttttcctccatctgcattgactggccgctcgctagtaaatctagggccctggattaaattatcaagacgcgtgatggccagaccccctgtggcggagggtgttgtgtctatgatgcgtagatattgagtaggagacatctctaaatgctgccaggaacatagtaagaggaatttaataattgggctgggactctggagtagggggaatgtacgcgtcgtctatggatctgggagtgcggggagtgagatgattatggctggtccggatacatttggatgaatgagtatctggcgtctcttagccattccaccgctgcggctaactcgagtgatttactatcttggacgcgtctgaggtgaagatatatagttcagtgtctggcgtaagacatggatgttatttcgccgcggtttatgtagtgcctgtgctgtggtgtcttttttacctcgtcatatcgtccgcgtcgcgtgaatgtgttcgtatagtatactaagctcgtgacgtgtgtttgttgagagatacatagcgcgaacgctgcgatagtgtgatgtaggcgtcgggtttatatcagagtgagatcgtccggcatatggcgctaagtagtgttaggtgtttgtcagccgcatccgtggttatatcatgcatagcgcggcagcgcccgtgagga

SEQ ID NO: 7546 - DNA, 548 bp, Homo sapiens
gcggctatttcttaagaccaggaagataaaacggccatgtgaggatgcaacgttcttatcctcaaggatgagaaagttgaggccaaagtaattctgtacaaagaaaccttgttaaatgaatctttaccttcctaatcgttgatctaccaattaagtacttgagtgcagtatataagtaactcattctaactacctctcaaggtagtcatttcctcataagggctcccatgccatgtaaaactcatattgaatttgtgggcatttcgtatgttaatctgtgttatgtcgatttatttatcagacccgatggatagaggattgagttaaagttttgctgctcctatacggacaacatccaaagtaatggcttattcaagtgaagtaggggaaattaagaaggaaagagttaaactcaaaagtgtttacaattttgctttattaaaatattcaaatattttaatatctatgctgtaaacttaatgttattattataacttggaggctttaagtagtgcatgattgctcacacaataaagcctatgcggccg

SEQ ID NO: 7547 - DNA, 981 bp, Homo sapiens
  misc_feature (1)...(981): n = A,T,C or G
ataatgaataaagtggcgtgaattacatgcgcgcgtacattaaaatcgcgcgaacgcgaatagcaaggcgaatactgntatcggagatatgcacgttaatggctgggtaatactagagaagggtgtgtcgaacggaggggaatgtatttaaatagatcttcgtggggtggctcgggtatccaaaacattgtatatagaggtagattatattaatggcacaacctgtgcgaggacacaatgtaatgacgtgcggaatgggagtggttgctactattgaaagtaagcaccgtcctacaatatacgcttcttagtgaagtgtggtaaaaaagttggagaagaatataatatatacgcagaagcaatagcgtaaataatttaaggggatcggttaaaagtggtattataatgaagagagttagataaaagaagggatttcattgggcgaaatttaataatatctttcagagtcagaatcgtattgccgctttatctatgcccagtgaaaactatatataatattagataggcaaaaagggaggcataatagtcgcggaaaattaaatatcttgcaagtcagtaatggtgaacagaatgggacacaattatttacaaaaacaactcccgatgcaatggtgtaaaaacggcatgtctctacactgaattgggctgtcaagtatgatttaatctgccataattacgtgacctctcaccaaatgaatgccacttctcgaagccatttcaaccacttttttgcagggaaaatgctccgacaaccagcaggatgcagaaaaccctctttcccagagttcatcgaatcccaaagcacagaattttaagctacaggaataaacaaacttatttcttattgggaaaaatgtctcgaatgtaatggttaccgactttgataatcaaagatcgatgccgtgctgaaacatttattgggttaaatgtcaatcgaagaggtgaagtagacaaattatg

SEQ ID NO: 7548 - DNA, 1015 bp, Homo sapiens
  misc_feature (1)...(1015): n = A,T,C or G
acctcctgtctctctactctccctcgcgtcttccctccggtgctcccgtctccgcgcgntgtggccgtgcctccgtccttcgccggcgcgtcgtcgcctctggtctctcccccttcgcccctcctacgctccctcggtcgtggtggttcgcgcttctctctctctctcttccgcgctccgtcgtgctgctccgccaccgtcgcggtcgcccgcccgtcttccctgtccgtccgcttcttccccctccgcctcctcgcgctctgctctctcgctctgcgcgcgtcgcgcgctctccggggtcgtctctgtcctcctctcccgccttgttcgtccgtgtcgcgccccctctngtgctctcgctgtcttcctgccccttcgcccgcttgcgttcggcccttcgtcttgttgttgtccgcgctcccggttgcccccccggttgctctcccctccctcctgccgctggtgtggtgttgtggggggcttcgtgcccgttcgtccgccggccctccccccttgctcctccgctccccccttttcttcttgcgctttgttctgtggcttgtgtctgcttctcgtttcccccccttccgcccccctcccctcctcccccttccccctctgcccccgctccgtcttccttctcttcccgctgttcttnttcttttcccctgtgctttgctcgccccggtgcgttccctgggcttgcggttggtgctggttgttcgctgctcccctctcctcgctcgcgcttctcctccttctttgtttgctgcttgcttttccctcccctgttcttttttttccctccgcctcccccgtctggcccgcccgttgcggcccccggggttcacctcccctctctttaagatttttttttctctctctctcttcttcctcnngtttgggttccccccccccagaacccccccttttttttttttctttaattttttttccttccctccttctttttttcttttctctttctcnnctcnannctnnncccccctccccc

SEQ ID NO: 7549 - DNA, 1523 bp, Homo sapiens
  misc_feature (1)...(1523): n = A,T,C or G
atgacagatatatgagtaatgatagatgatgagtgctnagatgtgcgtttatnacacggtgattccgaatagtttgtgagcgcagagatggtcgactgcatattatatagtattattctccgctaattctcgccatgacgcgtttactgtcacantcacatgtcactnctcgtagatgacgagtcgtctattgctaggtttctcagcgcacataggatgggagttgtgagtcgcagagtgcgataatatcaacgtcgctcgtgattagtcgcgtatatcgcgcaccatccgtacnataaantcgacgtgtacactcatacagtgaggtaatcgcatatgatgttacgtcgccgatcgtgatgtccctacatgtgactcatgcagatgacaagtaccacgcagttacgagtgctatagagaatcntnagtcgatgtcctagatccattatgtgcttactatgtgtcagctgcatccgntgcaatgtntgcatatcagtagatacagatgacgtctcctgatctacgtattcgagagagtgagtgtcagcccgcacgtcacgcgatgcagatagtagtatactgccgcgggatccgaattcgtatacactgctgctntctcttgtactactctccatcccccgccgagtctcntatattatcatatctattnttcntcgcgtccttgctccattgtatgttccgcgctctgtcatacttaatgatctcactataatcttgatattgacgggcagtagctaccgacgatcgaanctgcacgcgcncatcncaccagcatatagtcatgtgtgtctcaggcgcgcagagtatttaagacagaatccataancataatcatgcgtatacatatatgtgtagcgncatatacgatgtctatactatcgtagcgcgcgttgacgtatcgcgcggcttatataacggtgtcgacgcgacgcgagcgccacgtccccacgttccgatcatngttattaccgctcgtaacatggatatttattaatgttattctatacggcggcacctattcgccacgccccctcgcagcgaatgtgtgcagtacgtattatanttnaccgtatgtgcattcgcatgatatcacagtgtggtacgagttcatgagtccgtacgttagtgttctatttgatagtctagcttcactgtatacatttatatagagagatattttcgtacatgcgcctcgcgtgttattatatctaatattagcaactacgcacacagtaagtgtcgcgattcgtcacgcgactacccctgcggagtagatttagtgctgcactgcatacgcatgtgatntgtatcactacaccgttccgcatcgtcantgcttcagactccatncgctgacgcgtctcacatcacgctatgatacgcgacgtatctactcgccactataacgcatgattctattacgtctgttatgataccacatcgcgcacgctcgcacatttgtatctcgcatgtatacgaactatagtgcgtgtctatcttcg

SEQ ID NO: 7550 - DNA, 903 bp, Homo sapiens
aaatataaatatgtcggaagtatggtgctaattataacgtccctaacgtatctcaagcatattttcatttagactaagaatttactgggaaatataatacagggtttagcagagtccattaactattaaaaaatatttggtgtcgctgcgttatctatttcaatagaataaacggtatttttactctcatcacgctggggacaataaataacagaccagatgattcgtcaataaaaaaagaccatccatagatatttcaagcgcaagattatataaaaacatcacaccatgaaaataaatgattttatgtcgtcattaacaacaggcaagcgaattatatatgttagtttttagcaagagtcaacatatgtcacatttggaggtatattatcttcaggcatccgatcctatccaaaatatgttgatgttacgccacagtggttaatatcatagttatcatataatctcctcaggaagtatttgacacaataaagatttgtcagcctcatcttaaacttcaatcaaactgtctgaggtgtgcgctcaaaaatactgtagtcttctctgattatacttaccatcattgccatgcgtcagatgccaatggctggagggcctgctttgaaatgattgtctgcagagtctcagcaaccatgaaaaccttatgaccgtgctaatgagctttgctctcaaattgttgacactcaaatctctgagttacaaaagtgataattcccaacatgtaattgtgtaagtcaacattgtgcctttcctacttctttatgtaatagaatgttatatacctaagcttatataaaactacggtggaataccaaaagcaataaagcatgatgcggccagatttccttgggttgaaatacggaatatgtgatagaaataatg

SEQ ID NO: 7551 - DNA, 1339 bp, Homo sapiens
  misc_feature (1)...(1339): n = A,T,C or G
gtttatgcgagtgttgtagcgaatagcgaagaaagagaaggagggagagnggagagcctaaactagggagaaccactgctacttgaatnttttaccacgcgctgacagcctagcncgtagactacccgacgtacgtagatagaatanacctaacagatcttctgaggagaggcggttacgcatgctcggacgcccatgtgcgtagcaatcgatgacacagctgagtactccagcgcgatcgtggcggcatagcatcattgtagtaaggtgtatgaaaactcaggctcaagcacggatagtagagctccgaagtcagcaagagagaagtgggaagcgtcgctacgctgatgtatagtgcactactgacaattgctgagtgtggtatggagatagagtttatctctttatanggcatagagagtgcatacgcgaaacacataanaatattgataatggaagggacgtagtattattagagtctatcactactataagagtcggtgagatgaggctagagatgcgagatgatattgtttagaagccgagatgagtactgattaatagcggatgacgcatacagagtgagaagaacgatcacgagatgttcggntgtngatgagaggcgcgcgataagcacagaaagnatcaactaaaccgtgtgatagtgaatgagagacgggagacgtgggtagatgcacagtgccgcgcaagtgagttgagtatgtggtaggacgtcatgtggtgagaatatgtgttatgatatgtttgcgcgcataacgacgagagagacgagagtgtaggaggtgagatagtgtagtgtgcgtatactgcttnacgtaagttacagagtacgcacaggatatgtgagtggatagtgcgcgaaggagggcggcaagagtatgggcgaacgattatgattgattacatcgcaatataatttagatgtcgacatcagtaggatcgatgcggagtcgaggaggcgagatggaaggaggacaagacccatacaaaacagcagaccacgaggtgagtgagagtgtcaatgatgtatcgagtactaacatgagatgatggttgtgcgcgcgtgcaaggagtagagtgggtgtagacgaacgaatcccgcaatgctattcatgatgtatcgagagcgtacgagagagacgctgcgactgctctggcgcggccgacgtacgataggataacgagtactnacgcgattcagcgaatantggactatatgtagactcgacgtacgcagagggtggcattgaatctgtaagatggtaacagtcgtcgagtcgagattatcgacgcganaagatagagtagctagcgctgg

SEQ ID NO: 7552 - DNA, 562 bp, Homo sapiens
caggcaacctctggagagagaaggaggcttctgtgcaaacccaaatgcttgtggagaaaactgagatgcttgccgctgggcaaaccaagatgtctgcggagcaaacagagatgtttattgggcctttggaggtggtggagacctttcttctgtgcttgttgaggttcccttctcagtcttcagtggaaggatttatttcatctgaccaagtataaggctggagtgctacggtttgatctcggttcactggcacctccgcctcctgggttggagggattctcctggcaaagacttcagaagttgttgggattacaggggcctgccaccagagcgggctaatttttctgatttttgggaaggaaggggggctcacatgtgggcatgctgattttgaactccggacctcctcagggggatcatctgtgttgggctcaatagtgccgggattatatggcgtgaaccaccgtgcctgaagggagataactctttgggaataaccatggggccaaagaattatagatcccttggccgacagttcgcgggattaaccgagtgactcttg

SEQ ID NO: 7553 - DNA, 836 bp, Homo sapiens
ttacctatgtaccgcccaaatatattgcggagtcaacaataaggttgattggcaatgggaaggggagagcacatttctatttgattgtaagggttccaatttaaaaagtgaggaagactatggttcgttttatcagtaatagggctggggtagaggggataattaagggcaacaccggagcttctgcctcctgggttgaaggggtttctatgcaaaagcctccaaagatgttgggataaaaggggcctgcccccatgaggggccattttattgtatttgggaaagggaaggggttttaaatgttggccagggtgttttttaactcctgacctcatgcgggtgatccgcctgccattggccttccaaagaactggaataataagcgtgagccaccgtgcctggtgggaaataatttttttggataaaattatggggcccataacttacgacttgcattactttattactacatgcaaataaaccaggtcgctccctttgatagtggtagccagattttttcttttcttttttttttgagatggagtctcgctctgtggtccaggctggagtgcagtggcttgatgtctgctcacttatcaaccattctgaaaacaaaaggtgaagcatacactgtggaacaaccatcctcaaatgaaaagtttcattactcttattaaatgcctgaatgactatattataacagattgttactatttcttcttcaactatttccagctgtttttatttttctgtgaccttttgacattggagctaggacacaagaacacaaggatttgagactcctttgttttgttttatggaagttaaactgttta

SEQ ID NO: 7554 - DNA, 1757 bp, Homo sapiens
  misc_feature (1)...(1757): n = A,T,C or G
cccagctcacgcacatactctacgtacagatcacgctgctcaccgtatattnntgcntntactcatgacacgatagacgctctcgacgcgagacgccgtcgacgagaccgatgctcttacgcgcgncncacgcatagnagctacctatccactcgtgcgcaccatacctctctattcgctcacattactatagtgtattgtcagcacgtagcttagcgcggtgagagtcgctctgttcatgacttgcgcgcttcacgtctctgttgtgttgctggtgtggtgtagagtttctctcagcgacgactacgtacctcgcggctggccgagataatatacgctgctcacctctgttcgtgnaacctttctcgtcatgcagatgacttcggcgagattgtatcgccacgtgtgcgangnggagcgtcatctcgctctancgttgttgtctagttgatgcgcntatccgacgtgtctgtgctttcctcatgtgtatgatactacgaactacgatggatgtagacgctacaaggtgcgaggatagaccattgcatcgtgcgtantagatgatatactagtatangctntgtgcgtgttgcgtgtgctctgttatctcaacctantgtccactgtcgactgttttggttgcgcatcacatgcacgctacgtgtcgtccgcgcgtcgacgtctggctcatctctagacatccgaacatggcatgtctgcngcggcgtctcgtgcgtgtggagtagcangctgtgggtgatcgcgtgcgtcgtccgtctctgagcgcgtgtgggcgggtngtttttgggctggtgtagtggatgtggangatcagagaggggagggtgaggaggngagaggcggtgcgcgcgttgctgcttggctgatcatgcacaccgtcgcgaccnncgccgacctcgacacacaacaaataaccgcagagcgcgcgttgtgggaggcggcgnggcggcgcgtggatcgtgcgcgcgtggacggcgtgtctatagtggtgtgggtagcgacagatcttaggtaggcgatgagtgtggnatgtcggtgagggtgngggtgctgtcaccctcgaacgancggtagcacgattcaattgtcgttatcgtntagatgagaagcgcgcgagcgtatgctatacgcgacgtgnnacgtcgtgctgtgcgtgctcatcgcgcngctgtgcgattcgttttgtctctctgatgtgtactctnnnacgctngtnccgcnttgtntcgtactgcgagcanagtgatagtacgcacgtgctantctgtagtgtnnncacttaatgatagagagagcactgtacgngnanagacacgatanacaccaanaatnantntcagatagangagcacgtagtnagcacaacctttagttgctatatatntgagtgatgcngcgatatgatatgttagataagnactgannnngacaacgataaactatactacacacgctctcggcgctatatatgttcaatattcancnctnacacacatctctcccccccgntnctcntacctatctctctntcttctgaacacctcncatacatctcctnttactggtgtntnttnntcctntctttcaaaaggnatattatattcntnacatcatctattctctatanatatntaatttatatactataantatcactactatctctaatacattaatcatatctctatnaactatanaatatnatatattanattatatnaaactatatatattaa

SEQ ID NO: 7555 - DNA, 1293 bp, Homo sapiens
  misc_feature (1)...(1293): n = A,T,C or G
tacatacataagtaactaagcccaaaaacggcgaggagggggagagttttaaaccttgactatcgcagtgccaattttagcttaataccggctaacgcgcaaccgtagctgactgacacacacaatactcttatcgttacgacgggcatgatgcattttcctatttctcatatagggggagtagcggctcgcttgtcttaggattttactcgtcgccttgtgtcgcctatcagatacaacattggaactgaccagccattgtatgcatgttctcacactcaccctccatgtcggaaggaactagttatgaaaacaactccctactaggagctgtcgctagtatacttatttagaccatatccttattaattttgctagaagagatgctataaaagtcgtcgcttagctcattagcatgtaattgtacggtgtggccgctctcggtgtgccacatcatttctgctagacaaaggggaggtcatttgtaggacacagctgtgttatcgaagtgctgagtatccgtactgattattagatataaggtggtgtgctcgccgggagacgcgagattagagatgtctagcgcctctggtgcaggtgcatagaggataaaagtataggtaaagaaatcaaagcatgataacaggctagccgatccgatggtgtctacgcccgccatgatgcgcttcgcagaacgggtgacgctgtcgcgcagataggatagcatgtgcgcagatagggaagcagctcgagagtgtatattgaatattcctatgtagagcgtattttcgtcgaacataagtgcnagagaggacaatgagaggagcggtgtgctgagtgaagttataggacactttgttatatgagcgaggcagagtggatagatcatnacacgtgtgagacaaaggagagcacacatctcatactcggttgatgctaggtagagttcatgactgagatgtagctagagtctcgagtatgttcgacagttccagagcaatgatgccgtatattatgtagtatagcggagacaacgatcgctgtatgatgtgcgatcaagtaacgaatctttcgtatgcgatacgtgcgttgtggtttataaaatcacagattagatgtagtccacacaatgtatcattcgagtttgctgtatcttaatactagagatctacattcgtgtcatatcgatagatggatgtagattgtgtgaganatagagtgatgagtgattcatgttatatatagtttcacgaccagagtatactctgctcatntgtagttatcgttgctaca

SEQ ID NO: 7556 - DNA, 1814 bp, Homo sapiens
  misc_feature (1)...(1814): n = A,T,C or G
caggagagtgcaggggcgccactcgccagacgccgcaggagagaggagagaagagaattttcataccgcgaagacatacttggcacggcccgtctttttaacctatgcatatcaaccctgcagcgccattgataccgtggcggagacagacaacaaccaaggtatggactttctatacaacgtggtattaagcaattctacacacccatcccttcttcagggtgtgtactccggtgtgtgcacacggcgagtctgatatactatgtagaggcagtaggtactcacatctcagcccgcgcaatgcgtcctctcangcgccagacaccgcattatatcctactttgtgcttcacatcacacaccgtgactcgtagcggccgtgtcagctcgatgcgtcgacgtcgtgtcgctcgctaatctcgatagaaggatagatcagacatatacacctacagcgatatactctactaaccgacacgctcaaccagtcgagcgatacacgcagcgcacngcagcagctcgaaccgcgtgcacgtcgagtcgtgaatgcnttcgctgtcgacatctntgtcgatactgatagtcaccaggtgtgnancgtaagcgtgttacatnaataatacacatgtaatagacaatactactgacgcatctatgcagcnttgtctgctgagagtntcntgngcggctntgtgcgctcttcgatcacgacactncagctatgtgtcatatatgnntgactacacctatagctcggtgtccgtctcgctctcactatagtnatgcaatctctctcacacgacagacanganactaanacgagtntgttggctcatcattgtngtcatgaatatcagtcagactatctacatacctnaatcgtatagagctccaccgctcgcgcgtgtcgtatacttgttgtggagatcatatatacatcaagcatcacntntgtgcgctncaccnacatagagtactactcgatgagcgtgngcgacgacacnactacngattcccanaatgcgtcgtgcagcatatcgtgtgtcgtgtgtaagcgtgaggagangagatctatcgatacngttngntagtcacgtcagagcagtgttgcnacatatgactagngctctcacatcactgaagatagcagatcgcanancnagctgatatnactngctcgtcantatatngatcgatcgaacatagatcatacanctatcattgattatgctattacataagtacgtctatctctacatcgcgtactnntaganctantntcatctcgcatgtacgtagtcatgtatttacgtgtctgctgngtacgtgagctatcatatctgcnctgacgtctatcgtacgtctacctttgcgttgcgctcatagcgtctcantagacgcagtactatcactatctgtagcgtactnctatcacgttanatcantcactcttagagcgatactgtacataccgcgatcacgactatctgtgtggtgactagaacacacggtgagatgtagtatgcgataacttaacaaacggagtagcgttcgctgtgagctactcgagtgaggatgacacactacgaactacatgatacttagatgttagctaccgngagctgtgatcgatctatcgctanacgaccatgcagacnanacntntgngctacgctgatcatctggatatctactcanacgcatcgatatantntacattcatatgtctacgtcagtatgctatagctgcgatacgtcgactncatgtnnccacacagtcattnacactctcgctacgatcactncacgcanntg

SEQ ID NO: 7557 - DNA, 1075 bp, Homo sapiens
  misc_feature (1)...(1075): n = A,T,C or G
cgttcgctctgtagtacaacaacatgcggggactggacgtgcgagnngcgannnnnntttttataactccgtagcactatacagcgcgtctctgagtcagcagcttgaatactcagctacgcgcgagatcactgggcttacctgacacacacacggagttcaaactataagactgagtcatgactctcaccaattacatacaccggatacaggtcacgctgactgcttgattgtgtacataactacaaatgctcggagtgcgtacgatactgccctccatcctcagggttccccacatgacacatctggactgctaaagataaaatgagagaaacccaccgacgatgttgcccagaatcagaaagacttcaacagcttgataaagctcccatgcggggtaacaataataatcttgggcaagctggggaggcttgtaagaagtgttaaccggagcaaaacatatatcgaagtggtgagcgcccccaccacacgggattctaagcacacggtaaatggtgtgagctggctatgggaaaaaacagttacgagtacgggcaactggggccgtgtaggctaacggcgggggcacacacggggggggaggataacaaaacacaaaaaaaaggtgggcgggccggcgaggaaggggcggagcgaggagcgggggaacaatggggacaccactggagaggtgtggggggtgaaaaaacacacaaataaaaatggggggaatggggaaatcacaggtgtaataacaaacatctccccagtgggggggaaaaggtgacgacatcaagatagagaggaagaaccgacgggaacaacaacaaaaacaccaatcacccacggggtggcagccgcatgtgctgcgtgggcgcgacacacaacaagaggatctgctactgtattgtcgggtctggcggacacaaaacattggtacaaaagatggagtctacgtggggtggggggaaaaacaaacacgtgggccctcgtgtaccaaaccggtggtccacaaacgggggaaataaacaataaagagaaaaaaccaggggggcagaggttgggggcaaacatg

SEQ ID NO: 7558 - DNA, 1208 bp, Homo sapiens
  misc_feature (1)...(1208): n = A,T,C or G
tgagagtgacagggacaagaagaagaaaagaagaaaaagaannnncctttaagtgctagactaaccggcgcgaccgtcgtacagcgnggatacaagctacacgcgaaagcacgagctgactcgacacacacaggtagatctttttagaagacggaggatgacatctacccctcacaccaagggcatacaggctcggaatgcttaggctattgactccagactagcaatcaattgggactggggccccgtctactcgtacggccgagagatgaccgtagtgttcccacaacatagagacggatacggggaacaatccactctacctcgacgggagactcatagagacaatcgatttttctttggacaccagcctaacccggactcactatggctcggtaggggtgtacagctcgaaagaacaacccagcagacgcccgcaccccccagacagaggccgccaggacccttcaatacagccacagcagccgccggcatccgcgggggcgaagagccaccgcgcaccatcgaaaaacatcagagagagggctattaatactctagcaaagcggtgaccagaaagcagacaacatccgaaagacaacctcgcaagcagaaggcacgctcgcacgtgtcgagtgatacgcataccccagcggcccgcgcactcatctatcgagagacccgagccacacaacagaacaacaatagagagaagtagaaatcaacagagcttaatatgtattcgcacatatatcacacaaccctagtacgagaagaataagccatgcggaataaactaagtagattacaagtctctcccgacgtngtccaacacctggtagcactcatacgcctcaacctaggccacacggacaccacgtacagtccacgtatgcgacattactcccgacaaccggcgcacacgacagtggtgtctgtaatagggaaccgcactcaacactcattccaatagcaaactggacgaacagagaggggagacacgatatagggcgagcgcaacatcaactgcatacatatgaggcgaacggcagtggaccattccatactacccaacaggaaggaccggtagcacaccagcgatccagacgacagaccaagtgtggacaatatccggggtgatatacgtgagtacttgtgcatagggtagtaagcagaaatactcggcactcaatactatctgtcgtacg

SEQ ID NO: 7559 - DNA, 1069 bp, Homo sapiens
  misc_feature (1)...(1069): n = A,T,C or G
tgctcgaagtgagaaaaagagcgggcggnnnaaaattttaccgggccaccgcacgccgatacagctgaaaccgctcacgcgaaccgagctaccgacacaccagagtcaatcaacgatgatcatgacttatccataatcaagggatacggacaaaatatgctttatcccctcttataaggagaatgggggcctcagctatatccaagacatcttatcaacctgtctctggggtggaccataatatgtaaaaacatgaacctgttatataaacatctggcgaagggcaaaaaacacctcccttctttctggaacttgcaaagaaatgtgagtcgcctttcgtcccttgtcgcagagttgtcataaaacatgtgcaaactattaccaaatgatgtccatcccccaaaaaaggctgataaaaattaagaatatatcctgcaccccctaacactttaaaagcaaggatacaaatctgattctttctcgttacacttggataaattaaaaaaaatcaatgactctctcaaacattaaacactgtgtggtgctcggaaacaacccgtcttgcgtttaagccggttgttaattgtagacttaagaggcgctactggcgtccggtgaatttcactcataattttacgcaacctatctttccgcagaccggggtgactaacatcacggactaaacagataaatacaatactggtgggggagatagacatacatactaataataacgcagtacaggagtatggacagaactctcaaacatactcaatataatcactttangcgtgtaacggaaaatgggaacagagtggaaggacaacacacaccgagggggcggggtgacagacaattggcggtaaggtggggagaacacaaccggtgacaacaactacacagtacaacaatgctgggctgtgggtgntgacaatacaaccatacatgtggacatatcataatagtagtgtcgtaaatatgtgtgtgagtaaacatagtggtgtgttattatagaatcttgtgtgcgtgtgaaaaaanctacacaatcntcacacacancgagcggcga

SEQ ID NO: 7560 - DNA, 1551 bp, Homo sapiens
  misc_feature (1)...(1551): n = A,T,C or G
ataatctacagtaatcatcatcgtngcagcaccacgcgtccacgatcactgatacgcacgatactatacttgcctgccacgattagtccgctactatatcgactctagtccgtgtatcgcgagtctgatctcgcgttcaatgtggagaattcatctaccctggtacatgcgnactcactagcagcagatcagagcgtggtacggcagtatgtccatgcgataactgtcatggagtcatagtatacgacgcgcttattgactctacgcgagagtnagantagaacgagagagcacgatntatcagaccgtcggcgcgtcgagcgccaggcatatatcataggcagtatgatccgcagcgcagagcagtcgtagagtgaacatcagcgcgcatgngagngagcgtagacgcagtcagagttgcagattcgcgcgaacaatctcgtcgagcangnanacggcagaagtgcaatattcgcgcaccatcactngtagcatgaaccacgcacgcatgggagtaatgcgagtacacatgcatatgtttagtacgacagacgtgcatcgcacgagcgccatagtaacattccgtgtatcacgtcgcgccgcgcacancctagctaccagatgtagatacgtagcctcgacccgcgcccgatctcgttgtttacatcagctcgccgctgccgtattgttgcggtgcatatgaatgtgattgtatctcgccccgccgagcggctctattatgttattcgtatacgcacggtgcggtaccagattgtttgccgattataggttacggtaaccgccgaccgcgcatcatcggcgtgtagacctctanagatgaccgcattactctgctgcccagcgttcgacagctcgcattctgtcaccgcgaaattcaacccatcaccaacaccgntggaggcggccacgtagagaggancacacactaacaagtagacactagatcatttcatacacacagatgcccgcatatatataccacattgangacagaagccaccgatcgcacgcgtctcagctgataatgatccgcccaccagcaccttgtacaatggatacgtattgcacacacacgacttcgcgccatatcaccccgcacggaccgccgaccacaccgctagataagctgatgatattatacggatctcgcatcacagatattcgacgaggtaaggagaggccgagacgcgtcgtccagaaggctatcgtttcttcacctgcgcgatccatgcactgacgatgcgtaccatcttcacctaggtctgaaatatttagatttaatggtacctaacgagaggcgctagatgcagtgacgtgcccacccgtgcgaatgtacgcgcaacatacgatgataaattttcaactcaccgccacagccctctcctcgnacgctcaccagcaccatacctctcctgagtgggctcgtgatgagcgaccgcgcgtatgacgtcactcatataactcgtattctaacacccgccgcgccgaccagcttaacagcggtgaacgagtccgtacggaagagtgctg

SEQ ID NO: 7561 - DNA, 1054 bp, Homo sapiens
  misc_feature (1)...(1054): n = A,T,C or G
tggtgtggtgaccataacccctgtgggtttcgggagaaggaacaagccctatttgggtaactaacaccacggcctcattaaagtggattacacatgacgcgaaactcnggctgccggtccaccagtgctgtttttttaacactttggttgatctcatcctgtggcgcctcactggtggtacccttcaggggggttcaaccaaggaggacccagcacaaaacgggagtgacataatcaacaagacccccctttaaacatgggcaacactgccattagctaatgggtcttcttgggggcgcgaacacgatttttttttcacaggcaaagggcaacacaccggaaaaggggaaacggagcaagaacgggcccgggggcacacaccggaaaagccccgcgccggccccggatacacaccgggacccacacaaacaaaaaatgtatggcacaaccacccaccccggggaccccaaaggacacaggggggggcacggcaacaccttctaacctggcacagggggccacaccccgggggaaaaacgcggaggaacccaacaaacaaaacaaatgacgcgggataacacacacacggccctgtggcgacaacggacaaaccggcaaacaacggagtggggggagcacaaaacaaaaccacacacactgggcacacgggtcaaacaaaatgggcaccacacaaacccacaaaaggggggggcacggacaacactaacgactgagggcacacccagatggccatcaanatacaaaactccacaccacttccctccttgccgtcaacggacactgcgtacagtacggactgacaccaaccaccacgtactaacggtgtgccgacactgtactgagaggctggaaccaacacagtggaacaaacacaccgtgancacaccggtgcgacggggttggacacacacaataacacgggnacaccagtggcaccacactactctgtgctgaacatagggtgtgatacacatacaatcttgcatcaacaacactccgagtgtgctcgcggctcgtgatcataaccactacg

SEQ ID NO: 7562 - DNA, 1566 bp, Homo sapiens
  misc_feature (1)...(1566): n = A,T,C or G
gtccatgaaaggggtgagtcgctgagggcggagtgaggggcggccggggccttacctcggggaacaacagcggcagggcccgtttataggctgaataaacacctccgccgctatagccgtgggagaacccaaacacccaacaggaagagccatatttactagacggacgtgtatagacatctaaccaccatcaaatcgtgacncggggacgcaaggtccgcgattcccacgttcacccccgacacgcgagtagacactgggagtcgcatcgacgggcagtaggtggcgacgcgaatcgtggtcgtctcgatcgacaacacgaccgcaagtcactcatgaggcggggatcggagtagggtggtgtggagatatggggttgggatgatgttgtacatgagaacgaggcgttgaggcgcaccctttagtctggagatgtagttgtgcggagaacagccggctggncacgtgtcagcgcgctgacttctagacagaacggacgtagangagcgttgcactacgacaagagacacgcgacgtaggacatgcatcatgaagatacacgctgcgcaaagtagcagatagagagtagatcgtcgagccggctgtcaagatcaggtgagatantattcaagttctagctgctgtgctctagtgtgtacgctagtggatcagccagccgcntcgtgagcgatgttaattatgagatcgacatctagtgtgactatacagtatngagacacgtacgagangagcacactacacacncgagacgatgtaagtatcgcgtgacagaggcgacacgagacaacgccagcgtcgaagaggtatgatagtattcgcttctcatacagatactatngccgagcacagatatcaagcgagtctacgctgtatacagctgtctactctcatagantatagnttacaagtgcagcagcnacgctgacgctacgatacgacagagctgngaggagtaancagtcatagctacacatgtcgtgtacatccgtgagngatacagatgaacncgatgcaacgagagcgatgtcatagagatgacagcgggactgacgagctcgntcagttcgtaccatcgaggtggatgatntngagnaagcgcgctgtagactgtatccatgttgcgctagatagtacatcgtagagtatgagaggcctcacgtccgtcgacacactgnacttacgaagatcngcgttacgagacagtcatagatcaagagcacatatctctcgtgcgcgantccatatatactatacacgttcatctgctcatgtcattatcgagcagtcgtcacgcatgcctcgttacnaatatgtcgatgtcgctgtcccttgcggcggtgtacgggtgaaacattcttgcggtgatgacgatctgatattagangtgagtgtatnagtagcatctcggtcatcggcgcggagtcnctctacaacttatgtgccgctcgtgtccggcggttgctcaccaccgggacgaggagagnatagatatgcggagtanacgcgtgagtaattgcgagagcgtgacggtttgcacagactgat

SEQ ID NO: 7563 - DNA, 1059 bp, Homo sapiens
tgcgttgcagacgaaatccgcgcgcgaggggggggcagaaacctagcagggcacagtgagggcgacgcttcgggtttaacaaccgatcgagaattgggagggcgggaacgcccgagcgatgatcgtgactgtggggtgtgatccaccacgtccactgcacgtccgtgaacgaatcggtagatacaaactgagtgaccatacaaagcactggaaagacgaccaaaatatcttttctaagcaaacaggtgtgcgatggataacgagacagcgctcgggtctgaaaaaggctaccaggaacgccaggagtggaatgcacacgacacaacccgggcaacgggcgcagacgacgtgcgaaaggggcagcccccccccttgccgtgaaacaccacagggccaaagtagacgcggctgtcgctccgctaccacagctgtagaggagggtcttcatacagattatacgcgatcctcccaccctgccccattgctaccgatacccgattctacagtatgcgcgtataatacgttgataaacaaaatctcgaccccttcacacctccgcggtcgtcagcccacccgccgcaaccaaatcggcactatagggagcatcaatacagagaaccggtggtgcgttgggcctatcaaacagagacgatcgtagcgcggaatagaaagacattctgaaccacctagctgtagcgtgatgtcgtgccctccttcacatcttacatagctcgcgacacgaacgatcgagccaccccagtattaaccaatgatataatattaaatctatcagagcggtttggtagacgaagaccatgcacggcgcgcctcgcaccctgacatcggcttcgaagcgcgtcgctctgcggggctaccacgtgtgagtggggttagaacagggtataacgtgggcacatcttgctattcccacaatttgttgaggtaaatagtcgtcgagtctccaccgattacatgagtattgacgttcttcgtcgtcatctgccgacgcatcacaaaagtgagacgacaaacagaaacggtgagggttcatcacctatg

SEQ ID NO: 7564 - DNA, 1157 bp, Homo sapiens
  misc_feature (1)...(1157): n = A,T,C or G
agacacagagaacggagaagacacgccctaggaggggaggnangaagagaagagagnngccctttcgttagttggaccngacgncgcngcggccgcgctcanaggaggnaganagaaccncncagcgccgcacgcacggagacacacacggaacacaagcaggacgacctattctgagaagacgggatggagggaaatccactctcgatgacaccaacggggaaacgagggccgcgatggcggatataaaaaagcgtggaaataggagcgagaagaggagtagaggcgggccgcacccgccggcgccacatctcacgaaacagggcaggaacgtggcgaagagcgtgagggagggggtaaaagggaaaggaagggttttttttttctaagcaacggggcacgcaggcggcggccggcccgcggcgggcaaggcgaggcccgcgagacacaccacacggcggggaacggcagaagaggaggaggagcgggatacgtctaaacagggagggcggagagaagagagaaggtgaatagcatcgcaccgaacaagtggggaaagaaagcgatgtgaaagagagcggcgggagcgggggatagagcgggagagcagtcgagcgtcctgtaacgcgcacgaggtgaaaaacaccaacaaaggggaaacaatgccgaaaagatgacggcgacctgagagtgagtacatatagtgggacaaggagtacgaaagagcaaggaaagagacgggacgagacgagcaaagaagaccatggcggagcagacatgggcacgagagcaaacagagtcggcagagtgcggagaagacaaagtacgggacgggactaaagcaggagggcggggagtcgatgcgggatactgtaaggacaacccgggagggtgggcgggcaaacaaacacgggggggagagcagaagaaagccagaaagatggcagagaactgcgaagcaggcgggggcggaaggtggcggggggagtaaaaactagggaaagactgcggctgcggatggctaccgggaacaaaaggaaaggcaagggagggataccacgaggccacccagtggaggggggcgggaaaggcgtagaaggacgcgaaaacagagagggggaagatagggagagatggggaggtggtggtgaatgcgg

SEQ ID NO: 7565 - DNA, 160 bp, Homo sapiens
tgccatgccgaagagggcactaccagcaagacttgggttcctcgtcgccttttagtccgtactctcatctcagatttatataataagagtgccttagaagactaggagtggagtagatccgccagattgataggtattgcacagaagtgagttgaccata

SEQ ID NO: 7566 - DNA, 763 bp, Homo sapiens
  misc_feature (1)...(763): n = A,T,C or G
gaagtgattgacagttgctacacggggtcaaagatgtgaccactcgtcgtttcgttgatggctatatttcgagtgacggatacccaaccgattcaaaggcgaggttaacatgtattccccacataattcgtgcaaaggaaggcgtgttacgcttcccttcgagtgccctcctgattcggtagacaaaaaatttaaagttttggtccagcaatacgttcatccttctctattgncttaatgggcacagaccatagcactgtatttctttttatctaagacatcgcgaatatccaatantattcctttgtcatcggaagactggctacatccccgccataccatcgtacatcttaatataaactagttgctactcctcttttagaacatgatgttgtgctatatggtgctcgggttgtgaattaccggcgccagagttcttgtctaatgatttgttgtcaagacctttagagaagggtgtctattgtaatgtggagaataccggtgcgtgtnctgtgcgcgcacacacgtcgccttagtgcgtggtgttcggacccgcatcgcgttgatattattattcacacgacgtgtgagctcgcctgtactatgttgccacaccatcactgttacacacctccacgatgagagaccgctttcgaacacgagcgtgtgtcgatgtttgaattagtatgagtctctantgtgacagcccctccgccggcacgcattgcgccggagtagtcgctctagccgtcgatgttcatag

SEQ ID NO: 7567 - DNA, 292 bp, Homo sapiens
taccttatattcttttatagaactggctgatctgatcccacccatcttgaaatttgttatccggggacccgatttgattttgcccggctcaccccccgttattccgtttacgtttataaaactaaaaagtgtcatacttggaaaactctcttccgggcaaacctttctaggttttactgcctttaagacccattatatgtacacattatgtccccacattctttaggacggatatttaaatcttgttccccggcatacacccgaatagttaccataaaacgggaatagagtt

SEQ ID NO: 7568 - DNA, 890 bp, Homo sapiens
cgcgcacttcaggataatacgcatacctttttgctatatttatgtcagagggtgctaaggcgtgtcattgtaatcactcatgacggtgatcacgcacgaacactaattagatatgagtatcttatatacaagcacgttatacctactcgcctcacgagagtctcagaacatgtggcatgctatacttcttttgaacaagatttctctcttagcacgataacacaagctagctcagaaaacaaaaaacaaacattcatcttctcgtagcgccaggctgctcactactttacacagctcctcaagtgtttggttatgagcggctactatgttattcattacccacacccaaattctattccttttctataatttgtgtgacaccttttttttttgtgcaaatgaagttttcactccttgttgtcccagggtggaaatcttcggctcaccctttgtgtaactggggactccagcgcatgtgccaactcagcccggctgaattttgtatttttagtaaagacggggtttctgcatgttggtcagcctggtatgaaagtcccgacctcaggtgatccgcccccgaaggcctcccaaagtgctggcattataggcgtgagccacggtgcccagccgggaactttttaaaatgtcaattccattggtcatttgtctaattaagcattaatataatacagtgttaattactgtgactttattatgaatcttaatatctgatacaagttgttccacttttttcttttttctttgagtgtcttaggtatttgtattcatttcacttctgtataaatttcagaaaactacttttcagttcatacagacacaaacatgattatgtattgtacaccaattaaaaactaaggtcaatttaccta

SEQ ID NO: 7569 - DNA, 1815 bp, Homo sapiens
  misc_feature (1)...(1815): n = A,T,C or G
gtcaatctctatctctatatgcagacaacctatcacagtctcacgaacagccagtagctcatgtnctcgngtagacatacgcggacaacgtctgatcttnacngctgtagcactctgtattcgtagtcacctgccgacatgatatctnctaagtcatagaacacactctacacgctacgcagcgtgccgcgagacacgtcagtagcagcatgtactgccngtactcntccacacactacctcatgctgaagatattatcttggctctcgtagctgtgatantaattaagtgcctctcgtacctatcctccttcgtgagttacgtacatcagtcgatgagtgtggcgcagagctagtgtgcgctatctatntagtgcgaaattanactgtncgccnagactgcgagacagcactagtctagtagtatggagtgacgtacatacgagncgcncagngcacatctccttattcacactttgctcagcactcgctagacataactagcaacgatcngtctgactcgatcatgtggatacgnatagtcnctacataacgtcgtcttcggctgcnatcnatcaacagtgcgtggactgacctccacggtgtgtgatatcatagtatcatcntgtcctctatctctctctatacttgaatcagacacganacgccatgacgagcgcacaagacctagtgtgcagttgtgctacacgactgagtgcacancgccacgcctcacacacgagcctcgcncgctcgcgangctgctgcaccattacacttcgtacgtgtgagagactgtaagancttagctattcacactagcgcagcctgaggctcgtagtnacacgactaagatataatagacgatacgcaagtactgctcatcgcgcaccatagacatatctagtcgcagacagtcttatccgccataacaaacacgtgaggaactgtgtaacgagtcgtgcatgatatacatagtttaaacatagtattacttcgtagaatgagtgtatataatacgatcactcgtgcgatgatctacagtagcacctacatgcgagcagccggcgacganctgtaggcantgtggacactaanantcgagagagtactcatcatcactctatatgtctacgatattctatcagtatcctcacgcctcacaagagtncgacactctatatcgcnatagcgcttgcagagagactaagaacacgctgctacncgtatagtgatgtatatgatactctacgtacatcttantgcgcacatactgtnatagcactatanagaatgcgcgcgtctgagatatacagatncgtagcatagaccgtgatgtcgcgcntcgccgttnagcgtatgacatanactancattgcngacacagtcagacactcctagtcaccgcgcagcgagacacagattactgcatgtatcntnagctgataactatatctgtgagtagagatacactatgcacacaagacgagcttctagacgaaacatagtagatgggacgtgtggagcacgagtgtgactgaagagtgagtgcaacntaattnctgtgcgcacacacatgaagcactgcgccagcacaanagtcacacagcatagttgcatacntctactagtntgacgtattagtgtgagcatatatacacttgtgtgcatcactgctgcangacatgagtgaatagtgcactacantgatatgtgngatgtgctgtctctcgngtcgtgagtagtgtgtgctgtgtgtggtcgtgctgacgcgtaanatatagagaatatgcatgtcatctcgcgtacagcgntg

SEQ ID NO: 7570 - DNA, 308 bp, Homo sapiens
gctgctgcagacgactctcttaatgtttcaccgctacagcctttcttgcaatcggggtcggccatgtgactcattctggctgatggactctgagtggaaatgtactgtgtcacttctgggctgaggcagacacgagctggtctgtggtatccatcactctcttgctctaccgcagaagcttcgcgaaccaccacatccagaaggtacagctacagggtgaacgtggtgcctgatcttcaatgaacgggacatgttgaaccaataacactcgccgcggccagttacatgcagtgagggttaatggctga

SEQ ID NO: 7571 - DNA, 1169 bp, Homo sapiens
  misc_feature (1)...(1169): n = A,T,C or G
gcggggaggcggacacacgcgggggaggaagaggaagagctagaggggaccagggacgaaggtcagcggaacaaccaggcgggcacaacgaccgagccaggccgaaacttaggaaagagcgcggaacagccagagaacaaacggaagagcacacaaggaagggaaaccgcgggaaggcaagaagaggcaaaagcaacacccaaccagggacccaggaacggcggacgaaacgagggaacaaacaatacagccacaccggggcgagggaaaaaaaccccgcgcagacaccgcgaaagcgggccgcgcgcccccaagcggaaccagcgcccgagagcgaccggtagacaaacgcagcagggcgcaaccccacgccgaggcgcacaagtgtaaacgggcacagagcgcgcgggggcgaaagagaacgcgaagggaggcataatacacccgcacacccacaaaagacctccagacgggagaagatcgaagccgccgacgagacgcaagcgaagagcgacacaaccgcggggacgacaagacacgcgaacacgagagacgcancagaggacgcgacgggcacgaaagtaagagagcaggggccccagaacacgacagcccgagagatgggaaagcacgcgaccacgaccagccccgacaaccgacaaaatatcacacgacgagcaggagaaacaagagagttcgaagaaacgagaacgaacatcgcccgcgagcgccgaaccgagaaggtagcaggccggggaagaagcgccgagggagcgncgcgaggatcgccaggagcaggggccacgcgccgccgagcgggacgagcgaagaccacgcccgaagagcaaagacgaagaggaagggaacgaaccgcatagaggaaggagaggagtcaccagaaggagagaacaagaaggcgcgcgacgacggacgacgagcacgaagagcagtgatagcgagcagcagagacgagcgagaggtagcgcgccaccgaccacgacgccggacagggggcgcacggagtaagacagcgaacacccagtgagaagacgcaacggnaacgacccgcagcgagaacacgcaangagagacgcggcgaggaacagacacccggaccaccgcgagagagcagcgcgcgaggaagacgcacagacgcgaagaccgacatg

SEQ ID NO: 7572 - DNA, 2015 bp, Homo sapiens
  misc_feature (1)...(2015): n = A,T,C or G
cagagatcggcgacgcggaagagcgtcgcgagagccgagagagagcaggaggggagagggagnaggnngnnggggnnggnngggnncctanngatgtcngcangngacnncacgcnggcgacgacgagangtgctttcagacngcngganacacacaacananaagcgcngnngacacaccnncagaccggaccgcagcaccacanacagcgagnagcagncaacaaattttgtangnanaganangagagacagcncagagacacgacaacncaacgaagagcgggaaagagagaagcaaacgcaaagcagcaacaagngcgcgcgagaggcgcnagaagaacacgcaggaaagcgaggggcaggncacaagnanaggacggccggagaaattgaaaanacgaccngcagcaaacncacaagcgagcgnnngaagagaaaacgcggcaggagcaagcagacagagagaccggnggaacaaaagaagcaaaccgcacagngcagccagaagagcgncncgacangnagacgaaccgacacaacaccacnncgnaagaccaaattcttcgcngnagngggagcaggcgaggaggacnnagacaganagaagaaaccacgngacaccacaacagcagnagacgaaccgacancnnggngnaanagagcgagaagncgancgacgaganngagcncacacggccgcgcagacngacagagcgaaggcncgagagacgnaaanaggcagccacgacacacaacannccngcagaggaacgccacncacacancggacaagacgacgagngcggcacgcagacgcacacaaccaacgcgcncaaaacccagacganagaggaacgagcaagagagcgagggaagagagacgacaaacgcnccgagagcngnacgaagacagaaacacancgagagagggcgcgaggacagagagcacggnagcgaagagcgcacgacggcagggngngagnacgnaggangcncaggnagaganacanacgcgcgacggagaccgcgagagcagagaagacacaaaagncancagncagcagacgcgacaggagacgcgccngangcancanagcagagcaacgacacagcaacngcagcgaagcacagacgnccgccaccgagcgagagacacagggngcnaagcacacacgagacaagaganacgccgcgacgcgaacagcaanangnggngcgagcgggcagagcacagcgccaggaagcagcagagngncgcaaagcgagcagagcggacgangcagcaagaagcggngcgggacgnagncngagcanngcacacacacacgcagaganagnacgaaagcnagcgcgcaaancagcacacgagcaangaagacaaacacnacncacnacagcgagncngacgagacgacgcacgagncgncgacnacacgagacgaagnacgangcagaganangagcaacgancagcgancgacgcgncgagncagcaaacacgagcacacagagnagccggcaacaagacgagaagacgccagcagnagcgacgnaaacgagagcggcgananagncangcgacgagcnagncacacgacagcacagcnanacgagagagacgggacgaagcgagggncacgcacagnanggagcancancnnacgganagaganangagcnangaagnananagcagancaggaaaangagggaagnacgcgncgcagcaacgaaacgcagcgagcgcgnnngagcagacagagcacngacacancgaagcgncnaggaccagcaaanggcgagcgagcancangcangcancgacgagnagacagagnacggngacgcagangagagngcncgcgcacgagagaganagacgngacnaaagcaacgcgcacgacgcgacanagcagacagcggcagcgcgngacgacgcccnagagaacananagngncgcgcgcagcagacacgagcgaagcaccggagcacagacaaagaggagcggang

SEQ ID NO: 7573 - DNA, 773 bp, Homo sapiens
ctgagtaaactaattgttgggacaaacaaatttcaataagatttggggagatccacggttctagtatacactcttcgggtggctggcagtaaaaaattaagcagtgtcgcactacccaaaatgaaaacaattggggcgacattattttgaacaggaatcaagtatgttaaaatccaggacttctgagagtggattggccttcaagattccactgttttaacatccccattggcgggagaggtatcaaaggaccaagatgtgcgcagaataaggtcacagtccaattaaaaatggcagatggaattaggccccaggtagccttcctcctgtgttcccctagcatgaaagagaattcagtgttttgtctttcagaggaagtgaccctacatggcattttgtagcagatactgaaagtgtcctgcctgtgttccttgatgctcaccatttctgtgcatgtcgacttgactgcctctaagggccagcccttgtgactctgcctgaggactttctctggcctcggagcccaccgggcctggcctgcatgcatgcaggaaagttgtcagcgagctaatatccgttctcctgcagcaaatcccacccaattattggtggatagataccccacctcccttgccccttgatagggataactgtaaggcttgttgtaccctattatccaggaatcctcagtggaattgagccctggctggttacagggaaaatcagcttgataacacaccctttgttggcttcttttcctcccttgtttacgg

SEQ ID NO: 7574 - DNA, 1556 bp, Homo sapiens
  misc_feature (1)...(1556): n = A,T,C or G
gcgaaagccggcgcagccggctgtgatnatatttcggatgcccggattcacgttacgcgcgccttctctcctctaatgtgtcgctgcctgattaaagttaccgacaccggccgcccggaagcccccgcccgcggacataatgtgtgagatatgaacagatatttatagggctcgcatgtggacatgactagacagagaaccgaagtgtgggcgtggntagcattgaggacttattatatcgcgtctgcattaggtttagcgtattagatggacatccacgtatcgcaatcgtatttcaccctctacgagccgtcgactcaacgttaccctgttatggtngtagcgcgatatgcactctctcgcgcgtcacgcgagcagacagcgcatgtgtcaagacagtagggtgacatnatgttcaattatgtatntgtcagctgcgcggacgcaacaatagtgatgtatcatgcgctggtcgcgacgcgcttagtgatagcactgctcctgaacgactcattncatgtgagactaaacagctgtatgctgccgcaggtagatcagcatatcgtcggcaaacaagcagctgtagcgtcgtgtctatagcgcgccgcgatcactnatacgcgtagtgagagattcgntcagaacgtatgacacaactctcattatgagtacgatgcgtgattnctgaataatagagacgaattgagtggagcagagatgctgtatgcagagcgcgtgacaataagcgtcgactatactcatagctgaataacntcagcagntcgcgacgacatcngcaacacgatagttcgtctttatcagtgagccagcatacagaactggcattacaccggagcagcacgtnangctagncgacggcagtcgtgctagttgtccgttactcagcttatatatatatgtatcttcgcgtagatcgncagcaactcgaacgcatcatctgcgctggtatgcgcgtagaacagtccgacgcntcgtcacncgcgatacacgtgtatagagcgtgtntcgnaggataacgaactnncagntaganagacngtatatcgtctntgcgtcgttntctcgtgtcatactgtccagcgggntgacncaacagtcgnaacgacagctgagtatactcacgatcatctatgagcgattgtcgcgcgcagtaacgtagcgcgatatacatgacattcgagacaccacgtaantcagctatacctacacgtatcacgtgcatagcgcactctaccactatactagtgcaganatacataagtagacagtnaagtgtgctcacgacgcggatagagcttgcacgcgcacagtaagagagtattagtaanantacgctgagacgacggacgacgatggtatagacggcgacaatatatatggtctgctcgtcgacttcntatcgatntgcngcgtgatacacacgntgtctcgcatgaatgctgtntantatagtagctctagcgcacgttngcagctnctgtgcgctcgtgatcgcatgagtgcgtgtcggagatgatatgttgtatgcgtggtcg

SEQ ID NO: 7575 - DNA, 956 bp, Homo sapiens
ttttgttacaaaaagcgggggaggggcgggaagaaagttttacgctgccaatcgcgcgccttttgagctgaaatccgctaacgcagatcactaactactcgaccgcacaggcgtcaaacttacgctgattatgactctatccctttaaccaccggatacaggtcgcctgactcatcgtgtgtatatatatacttcaggatctgtacgtcttaccatatgggccccaactcagctagggtaccgtgtgacccagcggtcgcttgtgtggaccaaggatgattcctcccagtcactccgggactggacccgaaccaggcggcttttggaactgcacaggcgttggagtgcccaacaataccaaaatggagcgatgggtgggcaggggggactcggagccacggacacaactcaaaatgttgttgcaaactactctacattcctggaggacaccaaaacacgaaaaaacggggggcggggatgtcggcttatattttcactctccaaggggggatgaaccaccggcgggaaatcactatggtggcatggaaggtaatggcaaggggtgggggcggaatcaacaagaaacggagggcaggggaaaaccatgggacaaacaggaggtgggggttgttaataaaaataaaggaatagggaaacgcggcacagatatgtaccttgggggtgggacactgtggggacacaacaaaacaaaaggggggggggcacaacgacagggacaaaacaaacaaccacaaaatgagggaaggaagagaggagggggggatacaacatggggggaggagaacacacggggaagggggaccacaatggaaaaaataagagaaacggggagagggagaacaaccaaacaagaaagggtggggggtgagggagtgggaagtggaggacaacaaaagtgggaaaacaaaaaggaggggagaggggtggcaaaaaag

SEQ ID NO: 7576 - DNA, 1334 bp, Homo sapiens
  misc_feature (1)...(1334): n = A,T,C or G
attcatatctgcgtctaagcagccgctggagcgcgtgcggcgcccccaaccggggtgttatgcacgggaacacactcgcacgtctctcattagaagcttgaaatcacgctgcggctctatagcacggagctgactcgacacacaccagagttcgatactagcagactgatcgtcgactttattcccattactgaaagcgggtaacaggatcgccatcgagctgctactattagttgtaggaaatgagctacagcaattcagttacaaggcgctacactctatgtccgtgcactccggcgtatatgatgagcagacagccggcgtgacgactaatcgctgggagatacccgaagccctggaatacctctcatagatggaatatatgcatctctcataaacgacgcccaggtaggacgcgcctagtcagcggcaggaggcagcgaggaggacgtcgcggcggtggcacggcgacgcgatgcgctcatcatccggtacatactagagatggatagttcagtactgcagccacagagcaagctagagaagttcggggtgcgtcattaccgacaacagtactatcgtactgcccacgcgacgttcgaagatgtacgaaccagagcgacaacgctataattattggaatgatgtgacattgaatacgagaggtacacacgtggagccgagacacacctatgtagtatcattgagaaancattgaacaggtcgagagaacgcatgattgggagtggtcgcgacaccaatgagaatggcacttatgaagatgcggagagagacatattacatacattaatgtgtgtctagctgggagggacggaagactcgttcatactgactagagatcaggcgagagttctgagactgcatcgcgtgggtgtgttaacatgagcattagcagtagtaaagagatgagcatgacacagctagtgcttctggcacgacattgtatggtgtacacgatagacctcggcgagtgatcggtgtcgtgctcagagatgtagttatatgtatgtaaggttcgataactctcgataacacagtcaggtaggggagatatnttagtgtgataagacacgtgcgtatggcctcaagctacagcgaggacgctgtactacgtcgtggattgtcgtctgtgctctgagtggcatatgagttaacgtcggaatccacgagtgcgttcatgtgagatgtctctacgtacgccgcatacaggnacccgtcgtacctgcgcacaacgcatgacntgtgttctctagtatgtagttgttgaagtgggatgtagcgttgatgntggcacggagtttaagacacacgaa

SEQ ID NO: 7577 - DNA, 896 bp, Homo sapiens
gccgtgattaacgccctccccccacccctcttctgtctccataccctcacattcggcccgaaaaccagtcccgtattcccccccgatactcccctctcacaatgcagggcaatctcatagaccagcctacaactacatcacccgccacgcacccacaccaacccgtgtacccatctcgccacaacgctcccaaacaaacccatcccactcccctaaccctcccacattcacaaatcacctcactgcccccccccaccacaatcacctgccccaacaacccaccatcccatattctcccctcacccctcccgactcacccgctcccctctctccttcttcctactcatcctaaaacaaactccacccacccacacaaattgcctgtaaaacatattagtctactgacactactccgcccccccgtatttatggcagaataaaccgccctcctccccccccccacctctttaaacacccttcctacctactctatcccattaattcggtccgaccgacaacaacattatcaacagccatttatccacctacaatcctcgccttatacccccacacttaaaatatctccatcatttgtaacccagaattggcgcccccccccaaccctgtttagtagcgcccaaataacccacccttttatcactttgtccttctgtatgaagaaatagtacacctgataccagtaaataagaaccacatagtgtatctacaactgggtacatatgttgctaaaaactgtaagtgtctcacacataaaatgtatgaaactgaaaccaaggtctacttttttgtacaattaataaaaataatctggataaaaataaaccccgcagcggccgggtggaatcactcctataaattatcactcacacaacgaa

SEQ ID NO: 7578 - DNA, 1411 bp, Homo sapiens
  misc_feature (1)...(1411): n = A,T,C or G
gtagtgtgtgggtgtatatcacctcaccaggcgggatagggtgcgnggagaaaacacacattgtgagaactgtagactacccagggcgctctcattacagcgtgtatactcgctgcgcgcgacaacncggaggctgtactgaacgccacacgcgtgcgtcgatgtctagacagacgtggtgcgtgagcatcatatccgctttacatacaaccggggggcaggatacacatacggatatgattacacatggtgcggcacacgtgatcgttgaactgtgaggagcaaacaaagagtactcaccatggggacatacaaatcgggactacgcatggagatagctgctagtcgtcgtatgcgccggggtagatcaagggtggaccctacatgtggtgaacacttaaaacattgcgacaatggtcccactcgtgcctgtaaatatggtggacacatgtgccaatgtacacagtgttgttttgctcgaacaccacagaccgctcattcgttgtgtggatgagtttgccctntggtggggcgttaaggngctgacaagaggagtaataaacaccgcatacntgcttttcttctcacactnctgtcggcgcactcgcatctggcgcgtacgcgacaacaccaccatatatatcatatgtttgttgctctngtntgtgtctcgtgccatcttctactaataccactatactacactcgctgcatagtcntgggggcgtgggagtacacaccncatatntggggtgggagacacaatatctatagtgcgtgtggaacctgtncatctggttcaatacacacataatggtgttctgttagtggggatacacataatacgcggcgtgancgagttgttgggtcacatgtgggatatacaaaatatggactgaccatatttgtacgtgtgtggctgtgcgtggtacacacaactactcgcacgtcgtatagatgtggtacgaagagagtgtatatacaacaaacgtagcggtagggngttgctgtcacccaatgtgttgatgtacgcntctagaccaatacactancgtattggtgtggtggttaacacatagtactcttgttgcactatcactaccacgacatcacaactatagcctatggggatatgattatatgtgatagtcgtatgtcgtgacatcaacatgaagtgtaagtgtacgcactaaaaacgggtgcatgtcgttggtcgccgntcgtctgggactattcatcactgatgtccatagtagntgtgccgtgtgttgctcaacacaacctcacaacgtcgactatgtcttcgatgatcnagtgatctgtgcgttttgtgcgtatagtatgtccatacgtgcgtgggataattatactactggcgccatgtaagcttgtggtggtgatgaaagtcatt

SEQ ID NO: 7579 - DNA, 1117 bp, Homo sapiens
  misc_feature (1)...(1117): n = A,T,C or G
ttaatgtgtggacccaccaataaaggcgggggaagnnttttacggaccatggcgcctttaactgaaccgctccccaaccgagctaccgacacgacaggagtcaaactaaagagggggatgactctacccatcactaaagggaacagccgattgaatcccatttttcactggacccatataagaaaaagtataacgttntgcatctctcaatttccccaactttcttagggtagacgagggatctgctttactgtctgcccattgcgatggacacccaggaaggcttgtttataattagtgccacatttcgatagaccctttgatcttcctctagagctgtgcatagcgaaccacaatctttacctcgcagcgatacagactatgcactgctgtgancgacttgtcgtgggttgtcaatgacacgcggcgcaccatcgcgggtgcaagatgttgtcggatgaccaccattattgcgcttaaaacgtgctgataagaatactactggctcatacaggatcgccgcgagaatgagagctagagtacctgctatatgtactatgtatcactgttgccgccatagggtgtatactccgccccggcactggtgtcatagctgatggtagtaggtcgctgggctgtgcgcttgacggtcatgttgtgtgcggcaggtgtgcagccgccgtgactaagcaattgacggtgagagacatgtgagctggtcctgtatcccgctggctcgtgccggccgacacatgctacagcgcattttgttaagttgccgacggtgtgtgtcagttgactagctaccattgctgtgggtgggaaaataagtgagtgtttagctcatagaattctctaatgactcatgggcgatacctacatcggatgataggttggcaatacacataggcgcgcaggcagaggccgctctgtggtatcgtcctttgtcatagtaagtgagaatctcgaagtgtcatatagatgtagttggtggttgtcaccacaccttaactgtcgtctgtgctttgttgtcgatcgaatcgcggctgtgcgtactgattgacaacgaagtgtgagatagacaatgcgagaatctgattcggctgtgtgaatacgt

SEQ ID NO: 7580 - DNA, 862 bp, Homo sapiens
  misc_feature (1)...(862): n = A,T,C or G
taaggcagaaacgtgggagagtataaccagtagagtggcgtatataagcatgtagggatgcttcaggtgcaccctacccatgggttgcttcccgcgcggatccgagagttttataagaggcggccgtgggtgagaaaaatattagtccctgtacgagccttagagaaaaagtaacaatatantggttaacaaatcattttgcgggggggggagaaaagatacagggtggggtgccgggggggggtgggaagaagggggttttgcaatgggcccacctaggaagtgcatgacctctttagtctatgttaggggtggtcgggggtcgccagtgnttacccagccaaccattaagaagaaaacaaaacagcagactctttcatctggcacttaacaaggagactgtgctccaagtatgtttatgccggccctgttcacaacagcaaagacttggaaccaacccccaatgtcctacccaaatgtttatagtatggataaagaaaatgtggcacatcatggaatagtatgcagccacaaaaaggatgagttcatgtccttttcagggacatgggtgatgctggaaaccatcattctcagcaaattgacacaagaacagaaaaccaaacacggcatgttctcactcataagtgggagttgaacaatgagaacacatggacacaggcaggggaacatcacacagcagggcctgtctgggggtgggggacaaggggagggatagcattaggagaaatacctaatgtagatgaggggttgatgggtgcagcaaaccaccacgtcatgtgtgtatacctatgtaacaaacctacactttctgcacatgtatcccaggacttaaagtataata

SEQ ID NO: 7581 - DNA, 888 bp, Homo sapiens
  misc_feature (1)...(888): n = A,T,C or G
ttgcgagaaaaggtcgtttttcttccaattgagggaaaagcttccttgcaggataagttggaaatggcggcatcaatcctccctccaggagcagcatccactcaaaattggtgattagatggagtggggataaacaccaggccccaagttcaggttgagcaaatcttaaggaaaacttccccggaatatgggagcaggtgcgcctttgcgcaaaagcatccggtttnactattccctttgccagagctaccactttcactcttccagcggttctgattcagaggacattcccttattggaaattgctgtagtgtcctacagcanatctttgtctcagtcactggtttcntagggactccaccaaagacagtacaaaatcaatgcatttgggggagagtctganagagtcttgatatggagagacaagccagaaagttcgtgcaataatccaagaatgacaggcgtggtgctcagaggcagcaccgagtgctcagataatgtaaactaatactgatcagattccaagaggctaagcctaatcaaaagagaacaaccagagctaaaacttttcctaccccaggcaactcaaagtcccccggcaaaactgttgcgtgtttgccagccatcctgggcagctgggctgcacctgtaagacagagcagggtgatcacccatccaaaggcagcctcactaccaccagaaccaggagatgcagtgaaatttgcctttctaaagttcacaacttgcttccctttggctaatgcacataataacaggtaccaggcactgacaaagtcgtattagctgatgaggagtgaatatgaccttttttccaaataaaaaataaacaaatggcctcgttggcctcagcggtggagctctcggccg

SEQ ID NO: 7582 - DNA, 168 bp, Homo sapiens
  misc_feature (1)...(168): n = A,T,C or G
cgcgcgcaaatacatgctaaaattgagccgcatgcacacaaattagagtcggcgccagctgcagaggacacgcccagatgcgaacgggccggtcgttactatagagagtcggcaagacgtgggggggngnnnnnttacttttctagtgccaacatcgttttcacacat

SEQ ID NO: 7583 - DNA, 886 bp, Homo sapiens
aaaagcacttatggtcccgtaggataaattgagcccctaaaaccaccccacctttggtttcaatgtaccccctttagtcaaaaagacaacaacagttgcttgaaaggaggttaaacatgaatcctgcttcttgaaaagtgccatggaaagtgaccctgtacaaggtagttagcaaagaggttttttctgctggtccatcaggaaagccctgggatgtaacttgaaaaagaaaaggtgaggtttcaaacaaataagggagtcatttaaaaaaacgtttgtttagttggtttttaccggttccagagcaatagcaatagagccaggtgtctcagtgacatctttcaagctttcccaaggtgtaacatgactgacagcccattctgttgagaccaccggtacccaggagagacagggagagaaagagaccacctagaatagtgtcatctgtgcaaataagaacattaaaacagatgggtggagggagccaatgaattcaagacttatccaagtttaagtgaaaacaagtcatacaaagttgagataaaatatagaacagagttagatttatttttactgcttttattatctaggtcacaaaaaatataaatgaaatgtaaactacacatccaaaggtatgcatgatacataaaattaactggcatgtggccaactgtgattttcttgcaaatattttccttaggggttaatgtttttaaaatacatcttgcaaatctatgtgaaaaactttaacatccagtggaaatgtggacagtgttcttgaacagaaaatcacagaaattaaaatattgttgaaagttaaatgtttcccttgtaaaaaaggaaagaaaaaataaagaaatggcctcgttggcctcagcggtggagc

SEQ ID NO: 7584 - DNA, 306 bp, Homo sapiens
agggagagaattgaaggtgatttatgtgactattcatccgagtgttgtattgttctgctattaagaagaaataagagctagggaaaggtggattcgggtgatgttgctctttacctctattttgtatttcaggccccgacgttgcaggggggtgggcacacttagaagggataaaattcttatgtggataatgggtggggagcaacaaaacatggtagagtatgttctcctggggccctcaagtttgtcgtaacggaaaggcaaaggtctggaaggctcaccgagaggtcgggcgggggggagaag

SEQ ID NO: 7585 - DNA, 851 bp, Homo sapiens
cgccaatcttttcccagtttgcaccccacgcgcccccatgtgcgccatccggggatagggggggttggtctctttccccctcacccaatttcgcactgttctttatccccaatttcgcctcccatatatctcccccaacaattccccaacacatttctccaaccattttcaccaaccaggccgtccccttattctccagcaaatcgggccggtccgcctccctggcccattttttaaacactatttcccaattttccccgtcactcacgcccagggcccaatcaatttaattcttgtcggttttccaaggaacaccaaatgtctccgacgggtttaaatcgcttgttgccaatccccccaagggcgtaaggcatactcaaaacctaatcaaagtagttttgttccagtcatcaacaagtcatttcccacttccatttttccaaagtttcaaacaatatggtcgtgttgctttcatagtgcaatacagtttgtaaaataagcaaaaatggactcatgagatattcaatacatattcatgaattttcaagtggataaaacacagaccaattgtcattcaagttcccctggttctatttttaaaatacatggttaaattttatgctaggaaattgtgttgtcagcctaaatcatccatacaatttcaagcaaatatgtcattttcactccttaatctattaactatgaattgttgtgtttagcaacttagctatctacattttagagctgtctgaaaaaaatcttgcataaatagtatagtttttaagtaatacatagagttttctgtaatagtagaacaaaaagcttttcaagtaaaagaggaaaatattgtc

SEQ ID NO: 7586 - DNA, 926 bp, Homo sapiens
aacaattgcaagggatattacaccgattggagagctctccagtcttatgttttttggttgtatagtttttacaatagtggtaaaggtaaaagcagaatactcctttgggaaattattttctattgtttggcagcatgaagtccaaatatatttgaaagtgcagttacacgttagtggtggtaaagttataaatacatagtcagaagcctggggcttctttcggggattgaaatttagttcacaaatgtgtggggggggcggactttgtatctctcaagttatatgggcaatatcatttttttttttccaacccccagtatcctaatttataaaatgatgacccccaatacccatattttatttataaaatggttacaccaaataaaaatgtttcacttaccttcaaaagttgttgtgggcattatgaaataatctaaaatatcactttatgtgctgtaaagatcagcataaatttaaaagattattattatcatcagggcatgtggacttacttattcttaacatagatttaccactctcaagaaaaacataagcacaattctgatttataactttgctcatatgagtgtatacatgcacaaatgtttatacatgtatatctgtaggaaataactgatcatgaagatagagtcaaatgtactttttatttgaaggcagtaggttctcgttctcacctaaacgcagggactaggggacccctgacaggaaaattttgcttttgttgagctttgctttgtgtccttgaacgactagagaggaaataaaaacaaaatctcttgttcaactcttgttagacccgatgtttttgtgttaaattacataataaacccctggcctcgtggcaatcagcggtggagtgttgcggccagccccccacgtctcaaataataaataaatcatataat

SEQ ID NO: 7587 - DNA, 163 bp, Homo sapiens
  misc_feature (1)...(163): n = A,T,C or G
ggggggaaggngtggggggggggggttnggggggggccggtgaaaaaaaaaaaaaaaggcagcctttatgtnnaccnnccccnnnctnnnnnggnnnnaccnnnccngnnnnnnnnnnnnnnnnnnnnnnnatnttngngnngnggggggggntcctctgtgt

SEQ ID NO: 7588 - DNA, 1021 bp, Homo sapiens
  misc_feature (1)...(1021): n = A,T,C or G
ctgtttcttttttttgttgtggtgtcgtggggggcggggggggggtctggggggcgccgggcgggggggcgccggcgcgcccgcggggcgggcgnccgcgccctgcgggcgcggggccgccccgcgccgggggccctcgcgcgngcgcgggcgtgggcggccccccgccggcccggcccgccgggcggtccgcctccccgnccgcggcgcccggcccgcggcccggcccgcgcgcggcgccccgcgnctcggggcgccccgcgcccgcgccgcccggccccccccccgcgccgccccccgcgcgcgcgcgcccccgccccgccgtcccgcccccccggcggccgcccccggttgcggcgnccccgcngccgcgggcgcgccgcgccgcgcgccggcgcgggcgnccggncgcgcccgcccgcccggnggtgggcngcccgcccggggccgcgcccgcgggcgcgcggccgccgccgcgccgcncnnggcgcgcggcggcgcggccgcgcccggccggggccggccggcgccgccgcggcggcgcggcgggcccggcgcgggccgcgcgcggcgtgcgcggcgcggggcccgccggcccccggcgggcgcccgttgggtcccgccgcncgcgccgcccccccnncccccgccccnccccaaaaaaaaaaatttttttttttttttcttcttggttgtgtccccctccnnncncgccctgcccttccccgtccgccctggtggccgncgccngcgtgcggtgtcccgcccgctgcgctttctcgccgcgcttgcggggccggcgttttgcctcgttgggcgctgccggtncntnttccnnnnngtcggggggcngttccggcccgttncntgtaagngtgttccncctgcttgnnnggnntntcggcngtcngtgnngtncntnncnngtncagncnnntngcgnnncgtnagcnnagcaggcccccnccncggcttttttctcaacgccccccccnncncccnnncnnncccttttttttcc

SEQ ID NO: 7589 - DNA, 867 bp, Homo sapiens
actaataaacaagagaaacatatacaacataaaaaaaaaaaaaaaaaaaaagctaaaaagaaacagtacctatttttccacacggagacatatttgagacatatatgaaaatcggaggagatttgcactcgcagagaacttctaatcctgttctacaaaagtccaaagaaggagcaaataatgccaacttcacttttcttgttttcacatcaataaagacattgattttactgacacaaaaaatacaaaaaacctttaccacccctcttaacaaaaaaaaaaaataacacacacacataaaaaaatcacgaatactaataaataaaaaaccactaaaacattaataaattagaacaaacaaaaacaaaacaagcaacgagaatgcaaaacacaaacaaccatactatgccttaccctcccataactaacaccaaccacccccgccccaactatttaaataccaataacactaacagaacaaaacaacatatacaaacgaaacaaaatcaacacacactaacttaatcatacatactcatcaacacaagtaccaacaaaacaaatcaaaacaaaatcaacaaatagaatataggtatcccgccatcaccaccccctcaaacaccccaacgtctcacaccaatcaaacaaaacaaagaaaaaataagaacctactacaaacaaccaacatataagatacataagtagacacggctgtataacacagaacaccactcaccatatcaaacactcattcacaaaaacaaaagtcgctaatcagctaccacaaaaacacatacttctacttccaaaacctcgaccaccgattatctgatccgaagaaaagagacgacagacaaacatgagaag

SEQ ID NO: 7590 - DNA, 144 bp, Homo sapiens
gctggggggacccggccctgccctgtggaggatggatggcaccgcccgcggattaggcctgtctcgggatgggaagcgtgggtacgttagtcgagggggctcgcggcgtgggccccccgtgcgggtgcgcaggtgacagaaaga

SEQ ID NO: 7591 - DNA, 880 bp, Homo sapiens
  misc_feature (1)...(880): n = A,T,C or G
ccaaaacggaaaatcttatcatgggttgcaaacccccgtggagtgataggttttttccctgcagatctcccttatggtcttttgtcccctgggcaaatcaaaaggaagatttttggagtgttttgggagccaaatcgaggaggttcccccaaatttggaagttaggaccaatacccaggggatttttggacccctttaacacaattaagagttgttatattgaccggtaattgataccaccagaacataagaaagttaacccatagtttatcttccaggggggtttctgtaattttctaaccacacatgatctaggtaaatataatgattagaaactttacaaaactttgtacttaaattacatttaattgtttgaaaaatcatatctcattggtgaaanaaatgtctagacctgcgtccagaaaaagtgtggatgaagaggctcttgcatgggccctgctaggagttgctgacctgcttgtccatgtcagggtggacaggctttgcagtgctaacccagcaagccttaagaagaaaacaaaaccacagacacatcatctggcacttaagaagagactgtgctccacgtatgtttattgcggcacttttcacaacagcaaagacttggaaccaacccaaatgtccaacccaaatgtttatagactggataaagaaaatgtggcacatcatggaatagtatgcagccacaaaaaggatgagctcatgtccttttcagggacatgggtgaagctggaaaccatcattctcagcaaactgacacaagaacagaaaaccaaacaccgcatgttctcactcataagtgggagttgaacaataaacacatggcctcgttggcctcagcggtggagctctgcggcca

SEQ ID NO: 7592 - DNA, 839 bp, Homo sapiens
ttggaaaaggcacccacggtaattaactgttttactaggtagagagggtaaagttcaaacccagtgaaaatcgacttctgtaacaacgtccccccatagtggtatttttccactcattatcaaaacaccctaagtacaatcccctggcaaacacgtggtttgtgattttagacacactagccaaataaaaccgggtcactgggactcggcgtgcaaaaaagatggaagagatccgcgaaaatgttttttcttggcaaatgataagcatttttcaaatcaaaggtgaagttcaaatggtttgtcccgcttgcatttgttttccacaaacgatactaatctctgcccgggtaaaagcctgtttgagaacaaaagcgtacaccggccgttgagaaagagcacgcctacccagggcggcgaacaaaaaagcccagcatgttggcaccatttgtcctatgttatttcccctatgtttcaatgtaaagaacaacttacagtgtgcctgcctctatgagtaatgcacattgtgctttcatggtgccagctccacacgcgtgcgatcacatgtctggttctaaacctgtgtaagcagcgctttgtcacctttcacatgctttggaagtatacacattcatgtttcatgttgcggtgcctgcgtatgtatctcagaaaagaagtcctaacaaccccgagagcattcttaaggggttaattattacttttcaatcaaaaggagcgcataaaacaactagaagtctacgacaggcgtgtgttcaatcatatatgaatatattgtacataatattaataaacacatggcctcgttggcctcagcggtggag

SEQ ID NO: 7593 - DNA, 543 bp, Homo sapiens
  misc_feature (1)...(543): n = A,T,C or G
gaatgaggttttttttcaagtgcgggcggcggcgcggcgggcctccggttccgggtaggttacgcggcggtcataagtcgtgagtggtgggcggattgcggtagatgggtgcgcaaataaatatgtctatagatccttgttgggggggacgctggacagacgggaatgcctcaggactggtgcggaggctagtcatctaccagactgccctaggnttgaggtgtgctaacttgttcttgtgttgggacaatagaggcgtgaagcctatccatgagcaaaatcccgtgatgttttggccctgtcggttttgtaatggagtttgcgcgcagcgacagaccggtcggttgctccgccgtcagtgtgcctccgtactggtcatgttcacataggcatttggcggtgactctagtcctttatatcgcgcacaggacccgataaggagccaggcacgtgcaagattcagaccgcagtttccactcaactccccctctacagagtgagtggacgnccagggttagaggtgtcgcgcgtaaggaccaactg

SEQ ID NO: 7594 - DNA, 804 bp, Homo sapiens
  misc_feature (1)...(804): n = A,T,C or G
cccctcccctcttcctttcccttatcccccccccgtccatcacccccccccatgctttttccagggcccccttctccccctctccttttttctctccccctccttttgtcccccnttttctttgctcttccctccccccccgcttgtcaaccattccccccgcttaactatctccccccccccccccctatcagtcgccccctcccccctttgcccggtcccttcaccattctcctccctgtttgccatgccagccccccccgtcctccctccccccccccttatccccagaagtactttattaccctcaccaccccctccgtccccctcgccatgccctgtcccccttgaatgtttattttgcctctccctatccccccccctttcctgtttttttcccctcatgccttccccaacccccttagcctgcataaagcccatctgccccctcacccctcagtatcagcccccataaagtatgactccatgtccttttcacgtacatgggcccagccgtacaccatcattcccagcttactgacacaaccccagacacccccccccgccatgttctcctccataagtgggagttgcccaatgacccccaccatgcacacagccaggggaacatcccccaccaggccctgtctgggggtgggggacaaggggagccatagcattaggacaaatacctaatgtacatgaggggttcatgggtgcagcaaaccaccacgtcatgtgtgtacacctatgcaacaaacccacactttctgcacatgtatcccaggacttcaaagtataata

SEQ ID NO: 7595 - DNA, 625 bp, Homo sapiens
actacggaaatgatgttaggcaaaaagcaaattcaagcaattttcttattcaagtacaaaatgggtcataaagcagcagcaataactcgctacatcaataatgcatttggcccaggaactgcaaacgaatgtacagtgcagtggtggtttaagaagttttgaaaaggaaatgagagtcttgaaaatgagtagcatggtggccagatattggaagttgacaatggccaattgagagcaatgattgaaggtgatcctgctacaacacaggaaggtgtggaagagctaactggggaccattcctcgacgattaagcatctgaaacaatgcgcaaaggcgaacgacgcgccataatccctctgtgctcagtgtaggttcatccgcaccgaggtttcatcatcccgcgcaacgcatgtcccctctgatgccgcagaggcgtctgcctgccgcatgtctgtgacgcccggagtaataactaccgtaaagccagcgtacgatgcacagatctgcagttgtcgcggcgcgcgaccgtagcccaccccgcgccctctccgtaacaattatcctaccgacctcattgtaggcgggtgttcagctacgctatgagaaacagctccatcccccctca

SEQ ID NO: 7596 - DNA, 871 bp, Homo sapiens
  misc_feature (1)...(871): n = A,T,C or G
ggtccctgggtctgagggtgggggggggcgggcgcccccccggtgtgcctccccccgggtccagtgccccccccccgtccccccatcccgggtggtgtcttggttttccagttcccacccgccgttcctgggccctccacccccccgggggcgtcccaccccccccccccggtcttggtgcccgtgccaactgtcccagcccggtgtccccccgggggtgtgttttttcagtccggttcccccacgtccccagcctccactagtgtggtcagggtgctgcccccgggttgtcacgtgtgtgtcccatgtcccccccccccaaagcttcaacgactgtctggagtcagtcctgcccaaggtacagcccacggccantgccggcccatgtgtgcccagtctggtccactggcgcccccgcatgccagtgaaaccacaacatgggccaccatgctgtgccccctgatgtcacgcatcggtgactgtacagcccgcagctggcattggcccatagtacgggtgcaattcttctccatgacaacaccccaccgtatgtcgcacaaccaacatgtccttgaatgaattggcccccgaagttttgtctcatctaccacatttacttgaccactcatcaaatgattaccacttcttcaagcatctcaaccactttcccgcagggaaaacgctcccacaactagcagcatgcagaaaacacactttcccagagttcatcgaatcccaaagcacagaattttaagccacaggaataaacacacttacttcttattgggaaaaatgtctcgattgtaatggttcctactttgattaataaagaactggcctcgttggcctcagcggtggagctctgcggccg

SEQ ID NO: 7597 - DNA, 417 bp, Homo sapiens
cacttttatgtatgtgtactaagactgagcctgtaagaacttgactgaaaagatttaacatggtgatgtgatagaatgccctctgacatgcatgactgatgcatatttatggtatggaatgaataagtacctttatggactggacacctttgagggcgccgagcttcttccctctaggtccagcccttgtggtttcccctatttcacaccgccacccaccccgcggcacaccctcttccacccttacctgccgttggcccacgttggctctttctcctagcaggagtagtgtaaaagatgaagcgcggagatgacgagaagttcctcttacgagcgccctgtcacagcagttgcggggacacgcctttatagccgcgggtgtggcgcgcggacacgtagcacagctacccccgcccg

SEQ ID NO: 7598 - DNA, 873 bp, Homo sapiens
cttaaaccccccaaatgttccccgcactggctgtgccccaaagggcccatttttccatggcaccccccccccatgtggaatcccaaatgtccttgaagaatgggcgggaagtttgtttcttcaccatatttcctgaccactccccaaggattcccattttcaggatttcaacccttttttgcaggaaaaaggtcccaccaccaccagtagcaggaaacacactttcccggagttcatcgaatcccaaagcgcagaatttttagctccaggaataaccaaacttattttttattgggaaaaatgtctcgattgtaatggttcctactttgattaataaagatgtgtttgagcctagttataataatttaaaattcacaatataaaaccgcaattatttttgcattaccccaagtccacgtggtttgactataggagagctagtccagccttgtatgttggtcccagatatataaaatattatgtctcttctataatgccatactttggaaatgtttttttctaaatatgacaacaccaggatctttaagggatttatccagtcacttgccagtgatagagtgagatcggtgagtttgattggtgtaaaccgattgcgccacttgtttggctggcagacaaattcattgttcagaagcagaatgtcctgattgaataagggatttttcagaggtagatgccctgagttcatagacttctagacaggcctctttacttttcttgcatattttaggacatttcgatttataacgattatcatctgtatgttagatataacaaggactttcagagatcgtattgatcacaatagactgatggcctcgttggcctcagcggtggagctgctcgggccag

SEQ ID NO: 7599 - DNA, 878 bp, Homo sapiens
  misc_feature (1)...(878): n = A,T,C or G
cttttggggactgnggatccaaacatggggtcttacacatattgtacaggctcaagcaatcctcccatctcatcgatccaagctggagtgcagctcactgcaacctccgcctcctgggctcaagggatattcacaccttagccttccaagtagctaggactacagctatttagtttggaaaaaatgatacataccctggattgaatgcctcaaaggtcacttaaactacagatacatctcattttcccgcaagtatagaagactggaaaacatagagatagcacagagaaaaatttatatatcctcatctgagattatatggatagatgatacagattatgatgttttcaggttcttgtatctgaaaagtcaactgtggctgacattctaactgtttgcaaatattctgaatcatcttctcctccaggcaatgtgaagtggcatttctctgtttcctttcaaattagatttggccataaaatgggatcataagtaatgcgaattagctagacacacattacataagagccagtgacgattatctgtatgctttcccatttggctacataaccaaattattcaagatagtgatgtttccatcaccctgagtgcaggagtgaagtcaatgctgataaaagatcccagtaacctgggggggggacgtaatgggagcttaaaaggactttggatatttgattttaagatttatgggtggttattattggaaatggattctaattataaaaaatttggccccagaaaggagggaggggttttcgtaaaaaaggcaaacccttccgttgggcttggatgacgggattcacagggcaagtcctcttaaaaagcgcaaaggaaatgaaccaacctttgggcgggga

SEQ ID NO: 7600 - DNA, 874 bp, Homo sapiens
agatatcaatacccctctccctcctttttaaacaggtccaaaccccctctttggggccacccaagaaaacccccgcctgaaactttttatctttccccctaaaaccagccactcaaatcttttagccccatgggttaaacagtaggagggtcaatttgtccccaaagggacccggcaatgactgaaaaaatgttgcatttcccactggtaccggaagccctggtatctaatgggtagaggccaggatcctcctacccagaaaaagccccaggcagcttgcaaaccaaagaattattagcccaaaatgccaatagggccaaggttagaacccttgggttaaatacgagcccaaggccataagttgaacctgttgactgcttggactggccctgattccttccctccactcaggagcccagtatgtatcacagcaacaaagctcagcaaaaatccatcatgaacaaaacaaaaacaactcaaagcatgtatttaaggtgttttatgagtatcatctgcatatatgacagcatgtcatcacgtgtggggtgtgactttaaaggaatgagcaataagataaagtacataaaatatccaagaaaataagtcttaattccatgcagtcatcccacaattgccagcccattatttacatgaggaaaatatcttatgagtgatgcataagttttcttgaactactgtggagcatagtttttgaactactgaatgaaaaactggcttataaactccctagaccagataatttaccaacttaaaaaaaaattacaaatagatgtatatggttaatatagaaggttacaaaatgaaaaataaaagcatggcctcgttggcctcagcggtggagctctgcggccag

SEQ ID NO: 7601 - DNA, 904 bp, Homo sapiens
gtcatagagaatgaacagtcagggatagtaatgaaatataaggagaagatatgaaatataaaagaattaacgaaaaaaaaaagtagaaggataaatattaaacaatataagtataatgagagacagaaaagaacaggagaaagagatggaagatataggtatctggagagcaaattgagtcacgcagtacagtggaatatgatagtgttagagggaggagacaagacgaggataaagtaacgagatatagaaaacaaacgaaaagaaggaagcatagataaaatagaagaaaaataagtatagacatacaaaagacaggtcagtggaaagagattagaaggtgtatataaataacagcaaatatagcgcagagttaagtattggaagaataacatgaaatctaatagaagtaaacaagagtaagaagacaagaaaaataaaaaaagagaaaaaaaagtgggagactgttgaaggggagagtgaagtgagctttaggtaaaagtcataagtaaaaatagaaaaggaatgaattgagagcaggagtatctaatagtagactaaggagcgagctaatgacaaacagcactacaaaaaggggttcaatagagagagagccgcagagaggaggaagctataaagacagtttcaataatagacaaggtgcaaggggttcatggaaaatctccttttacatccgactatattggttgtacagggagtatgaatggatgggtgagtgtggatcccacctctcagaggctgcttcctttggcaactactgtagatggaaaatgcatcctgcatgcagcctcccttggtgagtcagaaagcagtcctccatacacctggtcacatataacaagaaaacagctattaaactaaatagtagaaaaacaataataaa

SEQ ID NO: 7602 - DNA, 1043 bp, Homo sapiens
  misc_feature (1)...(1043): n = A,T,C or G
tgttatgctgtatactgtgttgggatgagaagtagggaggtcgccggaacgccgagggctacagatggcgacacacgaagtctagagagcatcgcctactaacactcgagggggcgcggtggtgcgagcgaaggtgggcgacgcactagcagcgcccggctggtcttatcacttaactgatgaagtggagtgagaataatatggaggcagcgaggagtgaatacgagtgaaggacagcctacgccgtggggggccgccggagagagtagaggaaganagagtgtctatgtgcagtaaaatgggcacttgcgcgtcgagcagtagagtgacgagtgcgggggaggcggaaaccgaaggagagtgtgagagggaagagcagagatgtagtgtgactagtgtagaggataagaaggtaagtaggacgatggtggagagagaaagcacgcggcggggcgaggggagcgtgcgcacgcagtgagcgcacagtagcggaatccgggtgaggctttctcgaagcctgtcagcccacacagcggactaacgccgtggggggggtggtgcgcacctcttgacactgaacacataagcaaggaagaggagggggggggccgataaaaatcggacacgattgtgtngcgtgtacattggggtttaagagaggtcttgcgctcattggtgttttggggcccctcccttcccgggagaaaaaccacgtccccaacactccccaaaaactncattcccttctggggtgtactgtgggctggttggcttggcgctgccggccggagcatctcagcacccaccacctgcagaccccaataggagtctacttgaaacgttatagctccggtcccatatagaaggngagttgaaggaaaacgattaaacaaacaacaaataaacacacaataccatcaaaaaaacctcaaataatacaccaaccncaaatcataccaaaaaagtactacttacatcacatattattnataancacaaaancaacaacacaaaaccaaccaaaactncaaaccccacactca

SEQ ID NO: 7603 - DNA, 283 bp, Homo sapiens
  misc_feature (1)...(283): n = A,T,C or G
tattggcttattatccatcccacgcttttttcacccacctgggcgctagttccatacaaggacctttattaatttcaggcctattactgacctagaatttaaaatagatacccaacactcttttctcacaacccattgttacacttttgggaagttataattctggggcctatttaaatatgcgtggctaaagaanacttccactataagagattatttttggggctgtttgagtaaatntctaaaaaacaactcaggcctttaccacgcttgaagacaggag

SEQ ID NO: 7604 - DNA, 431 bp, Homo sapiens
catgaacagagcgaccacgtccccgagagaaccggccagttgggctatgaagggaggccagggggggaggggccctcacattgcccagccccagcctgccgccagcgcagggcgcgtagaggggcagggtcagtaatgtccagactagagagaaatactgttgtagaccttgtatggtctgttttcctcttattttactaccccccccccactcagttagttctgaactcctcttgaataccatcacaagcccaccatggtactctccccccctctagctccttatagtgcgtgaactgtcctggagccagaaccgcatatcgaccccctcgtagccgcggcggccgccccgtacattcgctcctcccgtcaccactgcgccccgtaccacgcggccccgcagggggcgcagtgccggaatgcgtccgcat

SEQ ID NO: 7605 - DNA, 626 bp, Homo sapiens
  misc_feature (1)...(626): n = A,T,C or G
tggagaaatacaacaccagaaagnaacatgtttaagtttgtatgcaacattctgganagtcatttctaatgaagtgatatatttgtataaagccctgaagaaagctaaggaattagtcaagcattaattcagaggaagggcatgctatgtccaaggaaaaagttgtatgaaatgcctgacatgttaaaaaatttagaaagaagataaatgtgaagggaatatagttgataatttcaaaattttaatacagtgcaaaatattataagctcttgcaagtctttgtgaggacaattcgctgctgtacagattaacacattggaaggatacatcttataaatagactgttgaaaggcaatagaataatatctgtcaatgatgatgatgacttggtacaagatgataactaaaggtgaggtaaaaagtggtagggttttagatatatttagattttagattccagaaatttagatgcatggatttttagatgtatacactaagtatacagatttagatgttaaatatgtagatctaggtagatctctcacaagatttcttcatggattggggattaaatttgaaataaacagatggcctcgttggcctcagcggtggagctgctcgggccg

SEQ ID NO: 7606 - DNA, 637 bp, Homo sapiens
  misc_feature (1)...(637): n = A,T,C or G
cggtgggcctctactctacgtcgttcccaagcttgtggatctatgcacgacagcttgggcgtagtggtgaccgctcggtgcctggttggtgcgtgctgaattcgtaaagatagcggtcgcgtagctgcgccgcgagcgcggcgggcggcttgcgtgaccgacactcatagcctcgctttctgtgcgctctttctcccgagcctcctcaccggctctggtggtctgaggcaagagagtcatctcatttggtnaagtgggcaggcgcagtgtagtcccgcggggaggggacggtggcgtggtacaggtgggtgcggccggtagggtgacaagcgcagggtggggcgaagcgttacgcgacgcacggaatagtagtggcgtcctgcgtgccttgtgatcccatgttgccggatgtgggacgtcacgcaactagaacttacaacccgcgaatgttctaagccacacggcaactcagcgtctggtacagaacacgatctctccgaccgttgctcaggcgtccaaaggacggtcgttgcgtacgttcgctgcgaccaggtggcagtgacgggactccgccctgcctcgtcggtacctcgggcttcaatccaagccacggccacccgaggcagcggcgtccgcg

SEQ ID NO: 7607 - DNA, 549 bp, Homo sapiens
tgcctgagtccaaatgctgggtcaacaaaagcaagtctggttcaattccagctatgaaggggacattaacaccgtgctgtgggtcaagaaaaagacagattgtctgctactaataaattctcaaaacgccatttcctgagccaaacattgccaaaaattatatggtcatttactcatgtattcaaacgttaatatgcagaccacgtttggaagttgggacaggtcttggaagggaagaaagatgcccaggacacagcctttttgttcagggaactcttatttcaggtggggagattaagaaaaaaattcggaaggataaagtagaagggatttgaaggaggcttaaattgctccaaggggcctatttgggaagagattttttcttaaaactggacatttctatggaaagggggctttaagggggctggaaggcaacatttttagaggcatggtggaaaccgcatggtcctggatatggagagataatcacgggggcgtttattgaaaagtggtgggctatcggcattggggggggccctttcttatttg

SEQ ID NO: 7608 - DNA, 316 bp, Homo sapiens
gtgtgtgttgaggtattagcaggcacagtgcataacagggcaaaatccgagactcttttagcgaaacttcttttacgcgccccgctctcccgccggtcgccggtggtgtttggtgtctggtcgttcccccgcattttcgccgctccatagccgtcgttgggtggtctggtgtggtcagtgcggggtccccggtgctctctccgtcttgcggtccgtgttctcttcgctccgcccccagtttggttttttccccgttctccccagtgtcgcggtttgctggtggccccttactggtctcgatagtaagaaaaaaaaa

SEQ ID NO: 7609 - DNA, 1711 bp, Homo sapiens
  misc_feature (1)...(1711): n = A,T,C or G
cgtcgtgctgcgctgtctgacgtcggcattgatgcgtcttgctctgtctcnttctctcctgctcacatacatcacgctgtcgtctgtcttgtcgcggtactctcatgatgcttatatgagtcggtaggtctccgcttcgtgcagtagttagtgtatagctattcaattatactatatttctatgactcctcatacggaggcgttagtggttgccacagtntacatcgttggatctatgctgtagtcgatgatcgtatgtccttcnantctctacgctctgttctgcgcatgtgtcgcccanacactttgcacggatangcggcggtacngtacctcgagtgacatgtactctctacctaacgagtataatacctctatacctatacagtatctatgcggcaatntgatagtactgatctatgagatgcngctcagtaattattcgactatgtgtatcagtggcgcggctagtggtcggacagcagactggcgtgtgtgcgcatgtattcggtgttattctgagcgcgcaggcgtgcggcgcgcgactgtgtgactcatacgtctatcttgncggctgcgcagtcagtgcactcgctcgagntcgagacgcgcgtgtcaccgttcggcgtgtagaagcctctgttattcttgactgattcgtcgtagatggttgtctactgcattatacgagtgcgtntgttggatccgtctgggcgcgtctagcataatcgtagagttgaccagctgtctatcggtgaccgcaggtgatagctgtcgtttagtaggttatggtgttttcgtgcacntatcacttgactacgntgcgtcgtgtgttgatatatcgcttattattagagtgaatccatatatgtgcattgagatgagcgcgtctcacgagccgtgctacagtcgangaggtggcttcattgactggagtatatgagtncgctgttgtctagcggcntttcgcgctgtgtngctacgcgctcgacgtgaggtgtacacatacgtcancatatgagtatgtgtgcantaccggctacaactgctctaacaacgcactgcgtatatggtgtggatgtacgacactacgatcgatcgaactgtagnacgcatcgccacagctcggtgaccgcgacgcgtcggtcgcgctctcntngcgttggtgttgtcgggtggcgctccacgacgctgcgcctgacagccgtcgcagacacgcggacgaggtgcgtcgactctactatgngtgctttcancacgcgcgtctcttagtccacttacttgatctncgtatcactcctactctccagcnctgcccatacagatgcctccgttctnccantctgcnanctactgtctttatactcctagcatctctgatcgagctgttcgttgtgatgtgtagtcgatangtatattattcttagtgtaccatacccatacgtntagntgaggttgcgtcgactgcatgcgccgtgtgccactgtcgtgtcggctaacacgtgagtagctagctgcacgcctaggttgacacgagcgacgtcgtgactgtgcacttccacgctgttgtngatagttttgtgagcggtggtgccgattggctagcgactacctcgtgctctntctactccgcatcgtaatgcttcacgcgccgcaccgctntttcatcgtgtatgatgtgtgcttccgctctcgtnagagtgtagtgtgg

SEQ ID NO: 7610 - DNA, 848 bp, Homo sapiens
ctggatccaggtatggagctcctggcacagctctcctacagggactgcatccgatgcaccaatgtgcaaggaaaagatgcccctgcactaacagagatggggccacaaagatgacaacgatgttttcccatgaggagggagatcacgtcaacaacccctaggtgagcaaaactaggtaaaccggggtaacagaggcaaatattccaggtgctcggcccagacccagggaaaggaccctagggctgtacaataaattctgtttagagccccggaaggtctctgtcccaagcacactggctgcatcccctgctacctttggagaacatccttccacggtgagtcatggcccttggggagcctgtcttggtggtctttaattacccttagcacactagggagtcacaggaagggacacttccctgtatcttccacctcagggtcccctctttgattttcggggtctcaaggaattggtcattacaaggcataccaacctaagggaagagggaggtttttggctggtgttttatttgggggacagggcgtaattttatcatgaacaaggaaaattttgtaaaagatctttggaggataggctgttaggagtaggctaccaaaaaactgggattctgtttttgccttgttgattcttaaaactggaaagggtcctctagaaaatgttcaccatggagtaattttcgaagaggtgtagtgagattcaagggggaaccaagtttaacttttccccttttttggagttaaggtggtatgcgaaaattgtgtggttatttagaaattaatggattgttaatgttgaaagggatatgcgttaatcacttttggaattt

SEQ ID NO: 7611 - DNA, 497 bp, Homo sapiens
  misc_feature (1)...(497): n = A,T,C or G
ttnannncnttnnnnnnnnggatccagtatgtcccaggcaaggcaacctcctatgctgaaacacacatctctgcatcaaccttttctgcaaaagattcaatggttgctgcaaatgctgttaattcattcctttttatggctgagaagtattccatcgtatatatatacataccacagtttgtttattcactcattgattgatctaagacctgaaactataaaaattctcgaaaataacattggaaaaacctttctagacactggcttagacaagaatttcatgaccaaaaacccaaaagcaaatgcaataaaaacaaagataaatagctgggacctaattaaactgaagagttttgcatggcaaaaggaacaatcagcagagtaaacagacaacccacacagtgggagaaaatcttcacaatctatacatctgacaaaggactaatatccagaatctacaatggactcaaacaaatcagtaaccaaaaaaaaaaaaa

SEQ ID NO: 7612 - DNA, 834 bp, Homo sapiens
gatatcgcagacagctttccacatgatattcaatgaggtctatcgaaggtgcgattggtaatagagtttaccacatgctttagaaagacctgttattcattcgtgtctttgtcaacccgcttggtacttatgctcttgctacacgtgattgctatatcctaaccatagattctctcgtggaggtcgctatgtagcattctatcttactctcgccatctcatgcaatactgctgtttactattccatggatacagagtacgttgtactcgaagtgaagcattcgttagcgtggcgagcgaggtcagtcgagagtacgctcgttggtatctgcgacttatctttcgacataggtctcgtggacacatctacacagtgacgattgctagtttaactataatcgtaacgattatccttctcttataaagaacaggccctagagtcacgtaaccatagttgtgtagctattggcatagtaaaacgcttggcggtcgcgctcgtttatacgtagtgtctacatatttggttcataaccaatatcgtattcatccgcatcagtctaccgacatttacttttaataattcagcgattatatctgtaatatatatgtacgtattactcctatacattcctcgtctcatatcttgctggcagcatattactgtttttttaccctccgtcgactcttgttctatcatatatcaatcattgcatgatagactgctgtagaaataactatagattgctgtttatcgtttcgctcctacttttctaacctgattttctgacctaatgacagttatcgtttataatatatattttctaacattaataat

SEQ ID NO: 7613 - DNA, 1282 bp, Homo sapiens
  misc_feature (1)...(1282): n = A,T,C or G
ctatatgtacggatcagcgatacgcacgcgtacatgatgagtagctaggtcgaagccttgtagcatcgggccgacaacagtttaggacttctcctagtatgcagtcaatatcacaagtcatagacgtctcaactaccgagtaccactcgcgtcgtgagaatagtgatgtcgcactcgctgtatatacagtggcgctgtccgcgaccacgacttagacgcaagatcgttagaggtcgcgaggtagttgtcgagaacgcatagatgcagtgtaagttgcgtatgcgtcgcgatgcgcccgcgtagtacgtagagtgtatgttagacacacgtcatgaattaatacgcagcgcccggatacaacacccgacggtgttattatatacggccacttaatagcggtgatagctacacgcagtatatcatttagacgacggcgcggaccgatgtaataggctagctacagcgtcgactcgcggagagtgccgtatgtattaggggcggagcggcgccgtcgagtctaataagcactccgatccggtattcacataataagagcgatgaagacgtcgacgaaataatacagatcactcactcttctatgatatcgtaagtacaacgctagttccagtggcgtaaatcatgtgttagtcgagcggtagagaaggtaggggagtcgatacggcgcgcgatgtcgggcgtacggggaaaataagtggagtcgtatgttactgtctacgagaccaatctcgcgccctgctccgactaaactatatacgacactcgaattcctagcgcctcgcgctatggacgcgcgcatcggacgatacnacgccacgactgacacgtgttataatataggcgggtcatgaagacatagtatgtatgaggacgaggcgtacataacagggacgggatctcgcggaatggctgatactcattgagacgtcccatggcatatctacatctccgagctaagagattcgtttgaaagtagtaacctcataccgacgcagcggcatataggcgcggactacggattaagatgacgtgtccgagaatgatctattattttgatgatttgcgctgtatatgtcgtgcctacagacaggcacccgtagtgcgatgtcggatccgcgcttaacaaggtcgaaggggtgtgtctgctangcggacagagatatgatgacatgtacaactggatttgttctaattacgtatttatcacctcacgcgcgttactgagcgtggacacagccgtgagtgatggaggccgcacggaaat

SEQ ID NO: 7614 - DNA, 847 bp, Homo sapiens
  misc_feature (1)...(847): n = A,T,C or G
caatatgctagaatatcttctcacaaggtaactaataatttgatggatgacttaagaatttacntaggtagcaagatgccccatttctaaaataaataagttaatattaattaacaacctcccaaatcactcccatatcacatggtaggtgatgtggcttgctctgaggaagaagaatgatttagtcctttcaggacttccaatcctcttcgaagtccattgaagtccaggagaaaaacgcatccctctaatgttagctttgtgtcgcctcctggtgtttagatgctggactttccaaatttttcagtgagcaaaggggattaacggatggatgggagggagggagaaacagctctcctgaattcttcggctggatacaggaatgctgcctgcattttcctctggcattctccacagtgaaactactgtatggcccaaaacaaacatcaagtgaaccaagggtaatgggaaaatactgagtatactttctggcactacaaaaattaaatttggcacaatccctgaaaatcctgcagattgttcattttagtccaaacatgtttcacttgttcatttttttttggagtaaataagcaaatccaatagaattttgtcaatgatgatcattaccaagctattacccattatgctgataactgtatttttcattctgtgtgtattgaacatatttattcaaaagcacgtctgttgaatgtgctaaagactttgctccatttagacattcccagataaaggtgccctgtgattccaccccaggtgaaatcatactaggtaactttcccctaaacaaaagcattttgaacaccaataaaccatgatgcgtccg

SEQ ID NO: 7615 - DNA, 1554 bp, Homo sapiens
  misc_feature (1)...(1554): n = A,T,C or G
tgtgcagcgcatgtgnggatcgtccagtgcatctgacgcgctncgctcgntctctacgcatgtctcgtgtagcntcnacttcatcgcagccgcacngcagatgtatgtcnctccgacngctcgactctgatgctcgcgacgcattgcgtgtgctgcataagntatatnagcnctcgtantatcatacactctcntatgttacgctgtgtccatgcgtacatcccaacaggacatnctagatcgcgagctgcnatcagtgacatcgacgactgtgccggcgtacncagtgacgtcatgtgtgcggaactcgctgtcgactccgctgctctcgttcacgttatgtactgttcgctctacgcgcancgacgacgtcacgaatatcgtgntttacatgtatcgacaatgagcgncatagactgccacctggcgtcgacaagatccactaatgatgtgagcatgacagatctctgggctgggcagtgtntctgtacacgacacaccaccagctctcgtcatcctagtccacctcaatactcgtagcctaccactctaccgtgttgccacttacactcacactgcgagtcgtgagtcgaggatacgcgacgcgngtgggagatggccggccatgcactcgctcgaggctcatacggtggcgatgnctcgtcattacgaaggagtcgtcacacgcgacaccgagcagactctcagganacggactgccaacaaggaacgtcggaccgcggtcgtggcgggctgttacgagtagctcaggtgccagcgacggcgaccacaacacgactcaacgtcacacacaccaggagcgagatataggagtctgtgacgcttgcgattgttacttcagcgacgtgtgtgtcgttgccacgcagaaatctgtacgccgaacttcgcgcacgtcgcggcgtcgcgctataagaggctcgcgaaacagcaggaagcacgcgngacgcgatcagtagtggatgcgagagacgcactatacaccacgatgaactactaggtgtagatctcatcacacgctgtctagagtgcgaactgctcganccgcacaaccgcgtcatcgcatgttggtgtggtgtgatagctcnagttccagttgtgctcgcgtccacatctcactcccttatggtgctcagtgtctatatttctccacgatgctcacatactctatcgtagtcagcgtgacgaacttactccactgtgcgtcgtatcgcagtcgtagagaccacggtgcttctccctctagttctcgctgcgcacgtcgcccagcaccctgagaccgcagttctcgtcgcgagtagctaacgctgcatgcagcgtgccttagcgtctcgtagtgagagcaggtgtggctgcccgggctgtgtacgcgggacgacgccgccatctcgtttccggtgacgtgtaggctacagcgtgttgggtcggctggtgaaggccagccaagaagatagacttggctgggtgccgcgcaagtggtctagcctgtaatgacgcccgcccggcacgacccgctccgctgcactgcgccgtttg

SEQ ID NO: 7616 - DNA, 674 bp, Homo sapiens
agacccgaagaacgcttaatttttatgcgcagaggtgttcctgcggagttgatgttcataaatggtcacattacattagaaatctgcaaaatatatggcagcctaaacacggctccactaggtctttaggtctgcgtgctgaatgggatgcaatggagcttaacattgtgggtcgaatagtctgatgtaacaacagcctacacgcccgcgccttcagctgcagacagagttagttctacactacaagttacactatccgtatgcatggaggaggattacggaatcccccgaataacggagcaaggtagtacagctaggcaggtcgccgagaccagcaggggccgtgagggagagacgtggagggcaggcgaatggcgatattgggtgggggcgcgggtgcaaaatggcggcgggggctcgtaaagaaagacagaaacggcgaggggggagacgtcaaaaagcgggcgctgggaagacagagggcagtagatagacagcgcgacgagcgaatgagcgtcgccagacaaagggacgagtggctggatagaacaactgcgcgccgggctcattgagcccaggacgaacacgcaagcccagtagcaccaatagaggtgtggggctgcatagtgtaaaatacagtcaaggtggggtgaaatagcaccactaagaaacat

SEQ ID NO: 7617 - DNA, 826 bp, Homo sapiens
agccaatgggacgaacgcaagaaaaggagagagggtgtgagatgcagcttagatagagacagcgggatacgtagccgggcaaggtgagagaagattgtttgtcgagagactagactgcacggatttgcgacaaagacgggaaaagagtagtagaaagaaagaataacagtggggggcagataagccaggggctacggagggcgctggtgagaagagtggggtgtgaggtaaggcaagacaggggaaaagagaggggggtgggtgtgatgaagatcccaagactaagaaggtggaaggggagcataaagggaagtagaaataaaaaaaaaagaaaaagagggaagggtacaggagaggaagaggaggataacttgacaccggaggaaggtcaagtggtagagagggagacaaggagaagtagtaaagagaagaaggaaacgaaggttgtgaggctagatcgagcgaggagaaaaattgagggataagtgaaggtggtgaggatgagaccatgtaaagaaggtgataatgagtctagagaagaatgaaggaagaaggattagaataagtaggaacacacgtatagggaaaggggctggcggggaaagtggatagaacggggaatgggaagaaaagaagagaaaaggagacgagtgtgagggagggagaaacaaagcacataagggagaggagaggaaaagacgggagaaccctacactagtggtaggaacacatgagatgagagcgaagcagagcaagagaagagagaggtgtggcggaggaggacgagtggacatcaatatggataagaatagacaatggcatagcg

SEQ ID NO: 7618 - DNA, 413 bp, Homo sapiens
tcttcacattgtaaacatgagtagatagataattttatttcaagatatgagacaggttcttagtccgctttattctctttccttttgtcaactcgatttacggctgtgatgtgcttatgtttcccctttcatgttctagacatttgtatattatttcgtcttttatcttgtcgtcttttttacgatcgcagggacataccctttcattactctggtttgacgttggctggtgatagtccgccactttctcctttcatattatatgatatgtggtttccgtgtgctcatgcgtcctttttgtattggttttgttggttttctctgtttacttgttgttcttctgctaccacgttgaggatcttgttcttctgtacacttctagtctgtctggtgtgtttatatggcgacgaagg

SEQ ID NO: 7619 - DNA, 525 bp, Homo sapiens
ggatccagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgtatctctactcttaagagactcaggccaagaaacgtcttctaaatttccccatcttctaaacccaatccaagtggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcgtgtacaagatgaaggagaggcaacatccaaaatagttaagacatgatttccttgaatgtggcttgagaaatatggacacttaatactaccttgaaaataagaataaaagatga

SEQ ID NO: 7620 - DNA, 683 bp, Homo sapiens
ggcccatatagatgagtaaaatcgaggcctatctcagtcaggcgcccagtgggatttacatcggccattaaagaataagatggtttttattttgggggcccgttcttttgcatttatgtgaaaaaacttgagattatatccaacctttttacctacgcccaatcttccgatctggaatggtccaggactccccatgccgaactcccagcatccatagtctctttccagtagaaaaatgtgtgtccacataccttgattcgacactttgatttaactagagcaattcgtgcacccaggaccagcaatcatgtgcactaatgattccccagagtttagagcgctgcaagcaaatggcctcggtacgttcacaatcatgagatatctcatgagatacctcccgaacgatcaatggcacattgtgctatctgtgtgttagcactaatgtgtagtcgcgctagcattacgcatatcagcgcgcgacctgtggtgcctagctagaaagtaaggtgtctacttgctgcaagtatctgtcgtcgccctcatgctcgtacgtgctgacccctgttatcgggtgacagaagaccttcatccgcacgtgtcttatcaattaacgcgccgatgagcccgtccagcacatgaattaagtgtagtagacctccagctgcagagtccgccgtagttct

SEQ ID NO: 7621 - DNA, 885 bp, Homo sapiens
tatacaccaacctccgccgacgaaacacacatccgtccgctccccgcgcagcacgccggcaaacaccgaacatgccgagcggcagcagcggcggccacgctccactagcacaccaaaaatcctcacccacacaactgaggcgagggcgtaaccgataaatcccgcgcgcccagagcctaatcgcccaaccgtcaatcacacccatccggcgttccttcgcgtccgcgaacgatgtcacgtgtggcgctactaataacacgccgccgatatctcctcgtcttcaatacacgcatatgccagccaaagcgcgctccaccaatgccgcggaaacaaccatgacggtgccgcacaacaagataccagccaagaacgctggcaccaacagcgcctctatatacggacaccgccggactcacgcaagcacctgcacgccccgcacacaaccttaacacggcaacaggtccacaaggccccgacaacggccccagataccccgccgcgccatgtcccaatgcccccgcaagccactcggggaccgaacaagtcgcggtagacactaaccggcaccaccgcgaaacgacaaaagaggttaacaaggagaagacgcggacgcacatacttggctagcagcagtggcgagcctaacttccacatgtccctaccgtgtacaccaccgggatacagaggccgcgctccatgacgcgcagatgtcagccaccaccccccccccacctcacgaagccgcgccgctcatatgtacgataaacgggaaggcgaccttcaggtaatccagagcggtaaaaaaaaactaggcgccgcctaagtgtaaacaactcttggttgagtcagccagagcaaaaatctaggaagcggacacaccatcaa

SEQ ID NO: 7622 - DNA, 961 bp, Homo sapiens
  misc_feature (1)...(961): n = A,T,C or G
gctgnatggaacttaaggaccacagtcgtaaagcatggtccggataagacgcaagaagacctngncacactgtcacctacaagaagtggttatttctagctgaggagananntattagaaatatcaagatgtgtttactagaggaaccaaataatgcacgccagctggtaaaaatagcagccggtgatatagagaaacttctgagcaacatatcggaagcccgggagggagcttttggtttgtagtgggtttacaaaacaaggaaccccacagaaaaaggaatacccagcgcagcacgaggggagaagagggaccgttttttataggagcaaggcggtttctggaggcaacaacgcccgaagacacgggagctccaccgcaccgagaggcaaaaaaaggagggaatggaaacaaaacaaaaacgccaggggaaccgaagggaaaacgaaaactcacaaaacagcggactctgaaaagaataacgaaccagggtaaggggggtaaactagagggaagagaagagcgngggaaaaataggagcatgcgggaaatggaggaggaaatatgggggtgacggggcgagagggcggaccgcggggacgggaggggaaacagacagaaaagggacggcttaggggtgagggaatcacagagggggggggagggtgggaagaccaggaagagaaaaggagaatgggtggaggcgaataaaacagcggcggtgaggggagacatcacggagtggcgagagagcaagagggaggaagaggacacaggagagaatacaaaataagagggagagaagggtagtgtgcgaacactagtcacataggagcaaacagagaaacactaggagccatagagggttcggaccgcagaatgtggtgggggggtaagaaagacaactacggtccgtcgcacgtgggcgtcggggtatcgagaaagagagagagagagaaag

SEQ ID NO: 7623 - DNA, 1263 bp, Homo sapiens
  misc_feature (1)...(1263): n = A,T,C or G
cgtgaggtcacacagggatctaactagtatgtagactcatatataatgaatattacatatacgacgacagaacacgtgcggttctatcggcatcaaattgatcctgatatcttcttgtctacgcccggctattgttcaatctcggcgcgatcgtgagatatcgcatacactacgtgagtgtcgtgagggctatcgagacgggatatcacaatcattagcgcnacgaccgctctcagcatcggaatgagtagtgagtcagaagagggcgcgggagagcgcgtcgcgatatcagagatcgagccagcgtacagagtataggatcaagacggcgcacatatcaggacaccgcggagtataaagnaccacacaancaccaccactcgctanacaaccaacataggtgtacaccacanaggatgacccacacgccacatgcgagcgatacgtaaacagattgttatgagttacgtctgcaaagaggcggagcaacgacagatgaggactgaaggagcgaagatgcagacgcgagggacacaaccagtagcatcgacggacgagggaagcttgaaaaatcacactcaaggcggtgagcaacatacgcaatttgcaggtgagtctaaactgcggatccctgagtcatcgatccctgcagcggtcagttgaatacgtgtgtgcgagggtgtgatggggggtagagggcatgctacagcagcaaacgcacagatcgccgccacccaccagcgagagcagcggcttctactatttccgtactaaaacaggaaacacctaagatcaaagagaaaagccgaggcgacggtaagggagcgcattgagagacgcgacatcgctaaacatacaacgtcgataatacaccgaggagctcacaaaggtggcgcgacaaatgatcgggcacaacaacacagcgggcacgaggagactacgcgatcgtacgggcggggcagacctcggcaactggctacccgtctgcgtcgacatcgtataacaacacaagacagcgcgtcgcgagatgtccccccccggtccacatgcacatccactttcctgtatctagattacaacgagnggcgcggatagaaaaaggacacgccatctcgtatctctccaatcacgctcccccatccactaccggggcgcatcactatagcgtaagactccttttcctgtcactggtgatcagcgctgtggatgccagcacccccctgaccccccccccccccgtagccaacaaataaagtactcgcg

SEQ ID NO: 7624 - DNA, 208 bp, Homo sapiens
  misc_feature (1)...(208): n = A,T,C or G
aatacttactaaaagaagagggaggaaggagnnngnnnnccttctttgtggacagagagtccagnaggtaaaacctgttaacagtcactctacatcttctctcacctcaacccagcctctggaaatcacgagtctactttttgtcactatagatttgcctattctagactttcacataaaaaggatcatacactgaaaaaaaaaaaaa

SEQ ID NO: 7625 - DNA, 1129 bp, Homo sapiens
  misc_feature (1)...(1129): n = A,T,C or G
agaacacccatgggggaacacacaaaacgacagggttagggnagcactgaacaaangngacaccttttgggggnggaatcgngacaccaaaanggggaaaacgggggggacaacacacgcttaccgggggatgcaaanggcccccacggggggacggggcggacaccagacangnggggaggacaacacacagggacccaanggccccacagnggaacacaaaggacaggaaatgggacgggggacaacgggcctgcacacaccccaccgcaatgtgacactggacacccggactgggggacaacggaacacgtgggcacaggagtggtgagacacacctgggatngggccaggcacacacaggatgacaaaccaatgttggacacccccaaccgacgaccntgacgccgggtgcgggaccaacggaacggggatgaggaccagggggcccccccaccaccctaggcggaagctcgacccggtaacgcacgccccactacnacgctgcacggatgagaacaaaaaaaacaaaanaacaaacacatggaaaaacgacaaaaaaacaaacacataacggggtgggaaaccaacgtggacaacacaacagacacaacgnggcacngcaacacccggtggcgacggggccccgaccggcaccggggcaacgtgctgaacaccaccccacaacacaccacacgggtgggcggtggacggacacggcaaaccacggggcgtgtgcacgggctgccacacacacagccgggggcacacgggcccacacggggcgcgcgggggccccaccccacaggacaggggggacacgggaacaacgggccacgggngggcggcgcgacggcacgggggcgcggggggcgcacgggggggcacacgcgacacgggggacaccaacacaacccacgntgaacaacaacaaacgggggaacacgcccaacacaccgcgcctgctcgctgggactgacaccagcccaacaccaaacggaactgggaccacaggggaaacaacacacacgggcaaaaacagggggcaaaaacaaactgacacccaccgggacaggggaggaacgctgcccccnacaccgaccgcaacacaccggcaccggggacactg

SEQ ID NO: 7626 - DNA, 1355 bp, Homo sapiens
  misc_feature (1)...(1355): n = A,T,C or G
gagaaggaatagagagagggagagagaggcagaagaagagagaagagagaggggcgaaagagagggcgcccttggtaaagaangaccngaggggaggnnannaggccttggagagagggaaaacaacaaangngggggcaggaggagaaagagaaaggaaagacagcgagcaggaagaaatcttagcgngaagagaggaagacagaggcacgagcgaaagaagnagagagaagaaagagacgcagaaagggagcgagacaaagaaaaagagcgagagggagagaggaagggggaagggaaaacgggaaaagacggagaggggaggagggggaaggagggacaagagaaggagaggagggaagagaaaaaggaacggaaagaagaagaaggaggacaatatcggaggaggagagagaggcaagaaaggaaagagagaaaggagagaggaaagagaagagaggaaggacggggagaaagagaaggcagcaggaggaggagaaaaaagggagagaagagagagggaggccgaacaccgncgcgaaaagagagggagacgagcagagaagagcagagagagcggaaaggagacaaggaaagaagagaagaagagcagaggcagccagacagnaagagaaagaaggagagaagagaaggaaggagaaaggcggaggaagcacacagaagaagagcagaaacgacgcagagaagcgaaaaagaagacaagaggaggagagaaggaggaggagaaaagacagcagagaaaggagaaggagaacaacacgagcgcagagcagagnaacgaggagagagagaaagcaaagaaaagaagaagaggagagagagcggagagaagcaaaggagagggaaagaagaaggaagaggagagaagaagagaacgggcggaagnagaagaagaacgagagagcgcgaagagagaagggcgagaaggagggaggagaaaggacgcgaggagaggacagagggacgaagagagagggagaggaggagggagagaaggagagacgaaggcgaggagcgcgagagaacacaacaggacggacagacagaaggnacganaagagaaggacgacgacgccagaagagagagaacaccagaggagcgaggagaagagcnaacgcagcacggagcgagacgagagcaagccgaagagaagacgagagacgagagaaaagnagagcagagngaganaggangcggacganagaaggcaanaaacgcacgcgagcgcgcgggaggaaagagcgangcaagagacaggagcgaagaagagagagacanaacacagncgagagaaaagcgggagagnacgacgaggaggngagacgggagcncg

SEQ ID NO: 7627 - DNA, 1663 bp, Homo sapiens
  misc_feature (1)...(1663): n = A,T,C or G
ccaacactagactgtgcactgctcaccgctacagctgaacgtagtgtatacatgaggantgnagagggtgaagagggcctacgcgtgatggggcgacctnagacgacgctgagagangcagtctcccgtaggtagtaacgaattcacagggcaggtgtcgacgccgcgcgtgcggaccaccgaccgggacactgcagcgctacgaccgtcatctctgcaggcaccaccacttggcgaacggtgctcaccagcactcccnagctagtgcacgccatgtcacgtgtcgtctacanatcacgcgtagtgangcacataacgntgcgagatacgagagnctcatatagtatagggctccactgcgtatgtaatgaagtgggtcactatgacagcntaagtcgagcggatggtctgatctgttgcgtncgctgtcgncgctattcactacggagcagctcagtcgacacgcgcntcacacaccacatgacgatcatgctacttgtnccactgtgttcagatgaccgactgctcgccacagtgtcactcgtagatactncntcgtgagtaatagactnccacgtcgcccacttcgacgcacgcgtgcactgtcgtccnccgcacgcgcgcgtcatcgaggacgatnccacgancgcactctgactcgcgacggtcaaagaccnctgtgcatcgtcgtacatgcacgcctcgtgcgatgtcgtggccgcancntcatcgcaccattagcagcgcacgctatattgcctacactgtccgctgcgctcgacgcccctgagtctcgtgcccgacggcatctcacttcctgcagcgccagcctctattagatatgcnccgagacgatcacgccgctgtgtatcgncgcatgcaccgctccnctcgcacgcggacttgcatcactatgctngatgtctcgtcacgcgctcatcccgacttactcgttcagagaagtcacacacncatgcacgacttacagagctccgacacgtactgatacccgcagtgtgacaagtncgatgagtgtcatactggtatcgagtagagggtctcggagttcgatgagatgcgccgaatacatgcgtagaccgtgcgtgacgatgatgccgcgcgctacgtataccttgagacacggcgctatcagcagtagatagtagggncctagaacgacgagacgagttctccatcgtctcactcacactttgtcccactctcgcacacacggtcgagctacacacgtaggcntcgacctgcgtgatgcagcgnactacgtcatcgatacgtacgcgagccntatcatcatgtagacctagatgtgtatgacgtggtgtagacgtcccgcgatgtagtcgcngcaactgactntantgtatgcacggtagcgcgtctgttcgtgtgatctcagtctctacgcatgagcgtagctcngcgcacgtagctcncagataccactgcacgacgacgtgcgtagtctcacgattgccccgatccctgactgacgatatacgactgnagagtgacgtagtgcgtgtcantncacgatactcagcatatcacgcgtnactancngatgcatttctaaatcngccgtncntatgtatgtgtancgtacntcattgacgagatcacgtcngagtgtccaacntatcaaccg

SEQ ID NO: 7628 - DNA, 1786 bp, Homo sapiens
  misc_feature (1)...(1786): n = A,T,C or G
tacacattactccacttgctctataccaccattacagtacagctatccgtctcacatcctnctacacagctcgacctctattactancggctatagcaactcaacgagcagctacggactgtccacctcatctccgacttcgccgaagcgcaggatccaggacactagagaagtgcgaacaagtggatgtactagaacgtgcgcggatatatagtcgctctgcatcgtcgtaatacgagtactgnctccggtcacgagtaacgacatacgttctgactaataagtcgataggcttacgcataactcgagtccggtcggcagatgcttctatgctgagtacagcnacgatcattacgtgcgctatcgttgacgccccacaccgccactatacgcatgtgatatagttatcataatggatatgacangtcgtgattgtccggcacgcgtggtctgagacgcctcacacgcacagtgagtcatcgacctgacgaccactatcgtncnacgatatagtgacgcgtcgcacgagtcagcgcaattgtacgatgtctagatagtgcgctagtagtaattacatgtaggagtagatnagagatgcatatgtaaccgtcatacgctcacgtcgcgtcgccagcccgacgggcgctccacgaatcgtatacgctacaagcgaacacatcgtgtaatcttcagacagcgagcaaccgtcgtgtgtcacctcactgagaagatagtcacggacctcacctctgactantgcaggtcgtgagagcaacttaactgccgcacagcatgatatcgatcatcacgttacgtgcgctccgtatccttcataccttactcctcaacgaaagatagtcagagtcgttgatgctgtgtcatacgagtagcgagatgtcgctacgcgcgttccgacgtcgacatgatgtcgtcaatgacggagaaatagcatataagtgtatgtgacatctcgcagtgtaatgtcaccaggacaanatatcgatacgtagtttgtatgatgctcgnagccgtacacagtgancgctcgctctgacactgcacatgagacaactatacagcacgtggaatgacactaactgatatgacgcgtgatcacctcacactcnagagtgagtcgtaattagattatcagcgtgccaccgccacgcaccgactctatccnatatctacagcaactcgcaccactgataatggcttctactcattagacgacgtacantgcttgaggcgacgctgcatcntncatctacgtncacacatcatcatcatgntgacataactacatgcgtcgatactcgccctantagtctctctgactgatgatactgagtatgntctgaagcacgcaactancgtcgccacgcgattccacatcttcgcactatcggagattcccatcactatgacatctcgtanatntgtagtagagatgtgcgtgagagtgantacgagtanctatcatgcgtctagcactatatatgnatntnatcagtcgtgangctacagtcacacgtctacgacgacgtacgtaacntcgacnagactgtagaanactcantncatcacgagagtcacatacgcnagcgacgacagcgctcatacgtcgctactctacgtctagctacctatgctgatctagcgcacgttatgattcntcacgtngagactctgancnagatgatatactnatagtangatatganatnacaatcatcgacgctantgcanatngcctgtcaatgntgctgactcncagtacatactg

SEQ ID NO: 7629 - DNA, 1858 bp, Homo sapiens
  misc_feature (1)...(1858): n = A,T,C or G
acggtgatanactctgagacgntgctgcgcgctgcgtctcgtatactgtatgctagataactcgtcgacagagtaggtagctcggtacgttgatgcaccggtcggcgctggagtcgtgactggcgcgtgactctctcgctagngctnatctangctctcgccgtggcnancgtgtctctncccgctactgtacgcgctanctgctagancatcanccacntncaggtcatcagctcatatgatcattcgcngancgcatcngcgacgggtgctatcgaacagcgacantngcttcgcgccgncgcgccatctctgtggtatagtgcatctcctngngctcgngtcttgcgcatctactncaagcattctatcatcatgtgcgcgagtngtactgtatgctgacgtgtcgntngactcgacactgtantcatagtangcagtcgtgttgatctgatnagcgatcatcacaagctcgcgcggtgtcgcgactcagacgcgctgcgtgctnctcacacganctcncactatagcgcgtgtcgnttgntngctgncgntcgtgtgtctcggacgtatatctaagtgaggcgtcgcgactaaaacatcaactactgtcgcgcgctcgtncacacagtcgctctctgtcattcatgcgtncatcntctgctcctatgctgttagtcgcgtagtcagttccnctgacgttggggcacgacatacanatcacgttatctctcgcgtacgtcgtgcgcanctgcnagtcgtcattcgcgtgtctcatngtgcgcatggtcatcgtgngtgccgagtcctncgacgtttgccgcacatnactcgcgatgatagatcaataggacgcttgctcacagatcacggcgttctgngacgtanagngcgcgctatgacgcgcgcccgagancgctgcagtatcgagtgtcatcgtatctantgagacgtnggtcggacgtgttgtcgtgcgcacatnatagctgttantaagcaatagcaacacatagctccgctcgagacgtgcgcacgtgnancgtatcagtctaaatgagcggcgcntacgcggtgcgagcactactcggtcgctacggctcacgtcgtctgcngctctaccatggtcgttgtgcgcatcagagagtgacgtataatcgatcgncgctnttgctcactctctgcgcggccgnactcgnctntntcagtcatacatacagnctgtctatcgtcgtctgcgagagacagctatatgacatactccatgcatacntcctgaacacacgatggtggcagtctncatgtgatgatcgacacacgccgctgcggcngcgctactttgtcgcacgatgcctacgcgtggtcggtccactcgcgcgctactcgagttggtaacgctcgtcggtcgtccgactgtactacagatgattatgttacncgattcgcgattgtgcacgcgcgttcctctaaacatcatagtgatgggaatcgtgngagtcgctgtggtatcgtactctgcctatatatggactgtgacgcgagtatataattgtctacgagcgttgtctctgtctatactgtcgcggcgcgctgatcgtccgtcgtcgctcgtatcccgcgacgccgcgtgaggagtgaatacggctgatcgctgncgcgtgtaattccatcgtggttctccgtctgtgcgccacgtgacgccaccgaggcgttgcagcgtgtgcgcgtaggtagcgaatacgcgcgcggtgcgtacgcggtgtatcatacacgtgcgaatggccgctcaatccggtgccgtgcggcggtcctcgtcgcggcgacatagtggaatcgaatagctgagactcgcgggcggcag

SEQ ID NO: 7630 - DNA, 1171 bp, Homo sapiens
  misc_feature (1)...(1171): n = A,T,C or G
tgaagacgcagttagacggttcctcgctaacttagcatgccgccctaccatcgcagcacgtatatataggtgaattgccagggcaaggcgtgagagatcatacacgtcttatgtcggaagattattctgtatcttgctccgctatatntataacttaatcatgttcatagacttagtaattgcctctgtactgatacttattcttaatgatgctaagttgtgacagcttgctatacatgatactgtactatagtatgttatacactgagtcgtagagaatgtaatctgtgataagcgtgagagagaatatatgtgatagaatagatgaagacaacgagcgctgtgtactaatatagtggnttcgaanacgggtattatcaacatgatgagatatgtgtatcaatattgatgacgtacacggatagagtataactgtccagtaactaatgtacagtatcttgaggattaactaacagcgagatggatgtggtgatgtagagaggcacaactgtcgtgggtgacactatactatanttctgtgcgcagcaattctgtgtagcctgtgactgtatngctcagtgactggagtgtattgacaggtatngtgcactcgactgtcgtngtgaggnactgacnctagtcacgcgtgagacgctatcagtgactgactgtaactgctcgaggagtgcagacgtcatctcgcctgtatggagacatgtcaatctgtgagactatgatcgctagtagactagtctagagagtngaggtgcaaaggacagtngnagatagttagtgctgtatggggtgngtcgtacgacatgtntnagcgcaatgatangcacgaggtcggctgcacgcacaacagttgcagtatagcgcgatctgttggacagctacgaatacgattgtgctaagcactggtcgntagcgacagatgtagcgctcgcgtcggtagtatgatgcgacatggtggagacgangcgtagaggtgactactcatcatagatggtgatacagncgtgatcgtacacaacggtcggtcctctctagatagcaacatagatgggatggtgtgcgaacagagtacttgagtatntatgtggcgaataactatagcacgactcgtcggtgggctatgagacaacaacagggactcgcagagcacacacag

SEQ ID NO: 7631 - DNA, 1515 bp, Homo sapiens
  misc_feature (1)...(1515): n = A,T,C or G
gcagcgcacacgcgcagcgcagagggagcgtgaggcgagaagaaaagagaaaaagaaaaggncctcngtctggangnaatgtgacacnnaaaaaggtccttacacgcaggggaggaaacccgcgngggcagaggagcgaggagaagaaggaagagacgagagaagcccagctctaaaccagacggacggcgccaagagaggccgagcaacgaccgaaacgacgcaacgccacgcaccgacaaggaccgcacgcgcaacacaacgcgaccgcagcacgagcccgaccgcgcgacagagccgggcgacgacngaccacggcccacggcggcacgcgcgaagacgaagcacacgcaccgccgcagccagaccacaacacagcgcacaaccgcgacgccacaagcgagccaacgacgacggcgaaccggacgaacgaggagcgcacccgcaccgaaaaagaggagcaagagagacaagccnaacaacaagagcnacaacacccggcacgccacgacaggacacccagagaggcgacgggccaacaacgccgaacgcgacgacaccacaccacaccagcgcaagaagccgccaacgaagacgacgccgcaggggccgacgcggcgccacgacccgaancgaggnagagncacaccnacgcncggaacgcagacacagcacggcncagcgagacaagnagaccacaacgcaacgcgagacgagcancacacagccacaccacaccacaagcncagccgagcacacggacgacgcgcgcgaagccgagagagacanagaaacgcagacacacgagaacgcacacaggaacacagcacaacacanacacccgaacgcacgcgacngcagcacggacgagcagcacagacacgcaacacccacacacgcacgcacgaagcgaagaccgagcgcaagggacgcgggancacgcgcgcacagccgcgcgagacacgcgcacaacgccgcacagcgagacaagcggcgcggacgacgacaacacgcacgaccacacacgacccgcaccgacgaggcgcacggacgaggggcgagcgaacacacgcagcggaagggagagaacagcaacgcggcgagcgcagcgcacgacacgcgacggaacagcacgcacggacagcgacagngcggcacgcggaggaacgggagagacgaagcgaacggaggcacgacgcgcggcgagacaggcgagcgagacgagacgcgacancgcgccggccgcgagcacgacgcacacagngccacacgcggccacggccgagngacgacgagncacgcaccgaccagcgccgggccgcggaacaagcagaagaacgcncnacccagcacagcaccacagcagccgcggcagccgagagncgcgccagaccgcgggccgccaccacgccggacacagcggccggagacaccganacagaccgcgcacgcgcnaacgcacgcgcaaagcgcgcgcaccggcgccaggccgcgcgcgagcgcgcgcacacacgg

SEQ ID NO: 7632 - DNA, 1281 bp, Homo sapiens
  misc_feature (1)...(1281): n = A,T,C or G
ggttctctcacgctngaccngagggaacgcaggangctcnagnaggggcacaaccaanggagaggataagcaaccggnnnccgaggcagggggcnncgaccagattttggcacccaaggggcgtggcaggcgcagactcccagtaggacggcacggcgtcgacgcggcctaccgagcagagagaagcacgcacgaacaaccgcaggcgccggcacaagnaaccgcggccgcgcagcgcatcaccagagcgagcgagcgtagcagcgcagcagagggcacgacacccggcatacgcaccgaacgagacgagcaacaggaaacgacaggcaccacgcagaaccgacgccactatcctcctttaacggagggaagcgggcgcgaaaacgagacaggacgaagcaganagaccaccgcccacgagccggacagccagacgccagcgagcagcgagggacggatctgaaggaacgaaagctctcggacccgcgcacgcacccgaccagcgcacccacgaacgcaatagacacacacggacgagaacaccggggaagagcgaacgacgcacaccgcaagaagacagcagacgaagagagacgcacacagaagcgacacgacagagaagcagagacaagcaacacagacacggagcgcacgagacgcgccgaaacacgcacgcaaaagagcgcagccagaacgaacgacgcagacgaggcgggaaggcgcaaccgtcgaccgcatgagaggaggacacggagcgaacggcaacgcggcacctcgaggcaganaacagagcacacacacaaagcaactcgagaagagcagggaagcgcgcaacagcagcccgagcagagacgcagtcgacgacgcgaggagnccagcacgaaacgagcagaccgcacggagaatgaggaccagaggcggaagagacagaggaggaggcagagcaacagaaggaggacgaagcagcaangacacacatacactagtcaccgaancagcgccgaccaccgacgcaccggcgaccacaccagaacccgacgacaccacacgagacgacgccgaacgagaacaacaacaggcgagacgancaaggaaggccgggacaccggagacagaccaacgaggcgcagagaggagacagaagagaaagaaaagagagggagagaagacggcgagaagcgccccgacactagagcccgacaggcaaaacaaaccacacacccagagcaacagacaagacaggganacacagacaacgatgagaagaagagacgcgacacg

SEQ ID NO: 7633 - DNA, 832 bp, Homo sapiens
gaactctccatgctctaaataacagcctccggcttgtgttgccgagaaaaatagatcctctgtgtttaaggtacaattggtcagttattatttaatgcagccaaaagtcatttttatctaacatgttacttgatctgtaagcggctaaatgcataagcttaataggaagaatcgtccacccccgcaatcctcctgcaggtggagaaatgatgtcagcactatagagatcttgggtggcagagatctccatcctggccaccagacgcgtgccactgatgtagaacagcttgtcagatcatttgacgtttagtactgattttataacacagggcttatatgggtaaggcactattctagtcatagtctgcaaagtgtttagccagctgtttggaatgggacgttcacaagtctgattctgcccagatgtaagataaggattggaatttaaagacatacaagtaacttctctggaaattcacgtgccaacctatatatgaccacatatattcatctagatgttcgttatctccctagagtcaatgaaatgttcccgcattcatctctagtgcaagatttcctctgtatctatagataaaaagattaatgttattaaaacaaatatttttggtaacctcaacttctcatatgttttgaaagtcaaatgcatattattgtcccctcctttatgtaacagtacacagttcaggttgtgagtgtcaatgatttgcatcctcgattcgcctcatgccatttctaaggagcccatacagccacacccccccaatatccatgccctccaatagtacatcatgaataaaaccggatgagaccg

SEQ ID NO: 7634 - DNA, 594 bp, Homo sapiens
ttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaagagaatgcttatttgcaaggtgaatccgctgtatttaattgtggcagataactgtatgttggctcactcaacacccctttccaaattctttctccttggtctttctctgctacaaaggctggaagatctcaattccctgatccccccagggaaactgtgtggcacagttttggccatgcttgaaaagattctgcaggaaggatttccttcccaaaggaagacaaaagactttgatgtaactccttctcttattcctgctgagaactaaatttcttggaacctaagaccaagttattggtaaaatgttcactgagtaacatgggcaggttgttagactccggaactttcatagcttaattactgctcaaattttgtataa

SEQ ID NO: 7635 - DNA, 1608 bp, Homo sapiens
  misc_feature (1)...(1608): n = A,T,C or G
ccgctaagtgcgtnngtancngctgtactgcccatgtcacggctgatgtctgtgctctgctgctagttctcntgngatgtcgtgatnctgctgcatcgtatgcttgctactcacgacgcgtgcatgncgcactatcanccntactactnacgactgcgtctgcgactgngacgtctgactctntgcntgtgcctagtcntcgcgcgcgcgtcgtgcgtgcgacgtggatctctgtgcatcactctcgtatgctantntcttgctctcgnggtngttctggtgctctgccgtcggctcgtcgcgctgcgtgcgtcggcgtactgctcagtgtctcttgtactacttgcgcttcngattnctatctattantacncgtgtnctactgtgttactngtcatgnatctctgtcatggctgncgcgctggcggctgcgactctcntcgtctctgntgctgncagcgcgtatgtcatctcgatctcagtcgcgtctacgctcgccncacgttcgtggatgtgngcgtactcgctgtcgcgcgtcgcgcctcttgtcgagtggtggtgtcatgagtcgcgcgcgtnggcgcgacgctgcggcatatgcagactcgcctatgtgggcgcntgactgcttcgtgttgctgcgtgcggctggtcgcttctgtcgctanggcnctcgcctctnccattagatggtgaagtcagatctgcctccgttcacgctccggctcaacatagcctgcgtgcgnctccgagattgtactcgggcgtctttctcatccgtgtctctctaggctgtggttactgagaagctcgtgtctgtcgcgcacctatgccgtgctccgtcttgtcgcgcgtactcgtcgcgcgtctcgcctatactggcgtcccagtgcgtctcgcgggcgggtggtgtggtntgaggtaggttcgtgtgtgctngtgtctgcgagcggcaggtgtgaggatacttgtgtngnttgtgcgtgtgttntcgtattatacgtttacnggctgcgcgtcccctcatnatatcttcgcggttggcacggtggtgctagtgngagngtagctactctgctgttggtgccgtgattgctcgtgtggggctgagctgctgtcgtatntctctcttcgtgtnncctctctccgcgcactgttgctcctttgttctcgttattgttatatatcgtcgctagttactactttcttgttcttcttntttctaaccacannncgctagagtgctgttccgggtgtgctacggttggcgttcgccggtcgttttgtcgcgcttggcttgattcgctctcgctctctcgtgaatatccgcccgaagtgtttngcgttacttgcttggtccttagtcggacattcgcacttccttttcccgaggaggcgaccgctccgccgcgctcccatttagaaggcgcccggcgctcgccttcgnnctccttctcctctctnnnnnntttctttgtnctctctctttaaactctttcttcttcttttttcttctttcttaaagctttttttctcttnnnttnntatcccatccaactcattcaaaattcctctccctcttacatcaaatnnttatacatcctaacc

SEQ ID NO: 7636 - DNA, 1083 bp, Homo sapiens
  misc_feature (1)...(1083): n = A,T,C or G
ctctnttagtcctctcgcgtcntcgccgcgcattgcggtgttcgctctccttcgcgcgcgccgccgtgcgtgtatccgttccgtcatcgcggctcgtttcgttgatgcctccttctcggttccctgtcattcgcctctgactcgcctgtgggtcggtgccgcgggggtgctgtctgtgtgctgcatggagtgctgtggtgttgtgggtggtgtgcctccgctgcgctgatctcggcgccgccgtcctggtgtcgtgtgtgtgctggtgtcgggtctcgcgtggcgcggcgtggcgctgtctgtgtcttctgttgtcctctctgcttctcttttcttgtggggctcgcgtcgctcgccttgctctccggtgtcgctgcctccttcgcgccctctctgcgttgtcttcctccccgccctctcgccgcctcgtttgtccctctggtgtatgggtgtcttatctgttcttcgtgccccgtcgtggnggcgcgggcgtgtgcccggtccgtggtcgcnccgcgccgcgcggcggcgcccggcgccgcgcgcgcccgcggctgcgtcgtgcgcgttcgtgctgcggcggnggcgctggctggcgggcgtcctgctgccncgggtccctcgccgtctccctgctgcggggctgcggggggcgcgctctcgtcgggtgtgcctctggcgggggcgcggctctcggtgcggnnnttctgctgcgcgcccctcgcccgctcgcgctcttcctcgttccggcgcgcgccccgcctcctcgttcctcttcggctgggcggtggcntnctggtggttggtctgcggtgttcgggtggnggcttgctgtgtcctctcttcggtgncggccgcgtgggggtcttctctccttgtcgccgcggcgccgtgccggcttctcttgcgcgcgtcgttgtgttgnggnngccgggtaaactcttctcttttcttttttccttctccctcttgtgcccgtctcttcttttttagagctttttttttttttttttttttaaggttttttttttttttcttctctttttcccctttctctcccccccctttactcaacccccctcc

SEQ ID NO: 7637 - DNA, 456 bp, Homo sapiens
cgtgaggcggcgcgtgtaataagcgataccggaggatacgaatttgcatacaatagcgggaggcaaataaagtgcatgcgggcgtatgaaaaacgaattacgcaagagtagaatagatagtggggaaataaatggggcgtagggcgcgctacaaatggggaaagagtagggggggccgtaggtaaatttgagggggaattggtaagggaggagggggtctatttgtaacgggatttcgatagattggagtttttttcgtggggcatctagttattgcattcacatgggtgtaaccgctggattagtgcatcggatccagctccaggatctatacaaggtgcgataatgggtggtgcattctgctaatcgaagggtctacgcgaggccaatgtaagtctcaccgtcattcagttgcaccgaaaattcggaatatagcattctgcggaaaggcagaat

SEQ ID NO: 7638 - DNA, 354 bp, Homo sapiens
aagaaacttttgttgaaccagcttgttaagatagttaccaggacaggcctggcgcggtggttcaggcctgtaatcccactactttgggaggccgaggtgggcagatcacttgaggtcaggagttcgagaccagtctggccaacatggtgaaacctcatctgtactaaaaatacaaaaattagccaggagtggtggcaggtgcctgtaatcccagctactcgggaagctgaggcaggagaatcacttgaacctaggaggcggaggttgcagtgagcccagatcgcaccactgcactgcagcttgggggacaagagcgagactgcatctcagaaaataaaaaacagatgctgtcgt

SEQ ID NO: 7639 - DNA, 670 bp, Homo sapiens
aattgcgaattcactgaagagagaccagttgactctcaagaaatacaagtttgaactgcaggatccacttacacactgactttctctgcctctgcctctcctgagcaagcaagcccctcatcactctctgcctactcaacctgaagatgacgagaatgaggacctttatatcatgatccacttctactcaataaataaatttttgttttctacctattgaaagagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagacataaaagccagccgaccagcagatggacagcagaacaatgaggcagagaaagggagaagaggaggaacatctgaacactgagaggatttcagctaggggtggtcagagagggatccggccgctgggcagcccaactccaggagagggtcaccttcccactccatccacccattctggctccccgtccatcctgctgaaagccacctaccaacattcaataaaacccagatgcgtgcg

SEQ ID NO: 7640 - DNA, 108 bp, Homo sapiens
tgaggccaacgaggccacgtttttatttcacttattatttattttatcttccaatttcctcttgccagactcccatccaaagagtcatagcagccttcttccaccctg

SEQ ID NO: 7641 - DNA, 1308 bp, Homo sapiens
  misc_feature (1)...(1308): n = A,T,C or G
gagtccttagagtgtttcgctctcgtgtgatcacttctagcctcgatattaatacaaatagtcatatcaattaataaatttactatagcttactaaaaattgatagtttgcggctatacggtgattagatcgcctacctttgtgaggaggtccccatggtgtgcaatggcgcgggacgaagcggcgtataatacacgggatccactctgccgagtagcgccgtgcacgcggctacaatcatgcgatgaagtgattgcttgaccctagaattccactagctgagccagcagggagccaactagtcctcgctcgcacctatatcaacaactgtactatcgccgccccctccataaacaataactccgcggcgggggggggtaagttactaataaataccttacggcgctgtcttccacgggatcctgcaagcgtgccagtgtatgcgcaaagcacagtgggaccgcgtatcattcctgtcggaaccacacacaggctaatattagacgcgacanaacatgacgggcatatggctgcgataagcctggactcataaacgacgtgacgacaataagcgtgagagcgatcagtgcagctacggtgataatagacgagcgtcactcatccaaatacgtcatatatggcgcgctcgctacgggtcggtgattctttatatctggtgtgtatgtgtagtgtagtagtacctgtttcgtgccgactcatacatatgtaggtctccgacggcacgccagtatcgtcgtgatctctccatccagcgccctgcattatctcatctcgcgagcgtagcgcatcatgacgacncatctgcacactactcacatcngagtgcggcagcatcgtcgacaggctgatcgtgagctatacaccagatcgtctgtgatcgcgtgcacgcatgatcactctatttactggcacaccttccactgcgcagtcggttgatacaccatgcgatcttacgggcgaacacctatatcagcgagtgtaacgcntntcgtctctctgattcgtatatctgtctatctatatgtataatcactcagttcgtctggactatcgcgtactgtgtgttcacatactaccgtaatgatgtagatattgtctgttctcgactctactccgaccactacgacgtgctggtttcgctggcggcgcgtacgactttcatctcctacgcgctggcggtccgcgacatcgtccaacgaatattagcgtgcgcgactaattgcagacagtccaggcggcnggatcacttcgatatcacagactactctacatcgactgcgcacaact

SEQ ID NO: 7642 - DNA, 672 bp, Homo sapiens
  misc_feature (1)...(672): n = A,T,C or G
actgacagaattgactgttaggaaaaacagcaagtacacgcagactggtcgtactacgacgcaccacacaggnccatatttttctttctcagagggcgcggttgaggtaaatagctgcttgtgggcccatttaatctgcccacgaatgtccagggctgccgctggggttaatatgtggagacaatgagctggtgagggccgagcgccgcggcggcgggggaggctcgtgtctccacaggcgcagggggtcggggagagcaaatgggggggcggccgggcccccgcgggggggcgcgaggcgagggggccgacggcccggcgggcacgcgccacggccacggacgctgggacgctctaacgtattaacaatacgttatggtaataaaagtgagcgatgtgtgcgcgtcgcatccgcgtgggttagttagcccgcgaccggccgctcggtcagcccgttacccctgccagcgtgaggcaagaagcgtgggcgggatggtgccgaatcggcgcaatgggggcggcccccgggcgaggagtctggggcggcggggccgcgagcggcncaggaagcgcgtccaggcggcgccaagcgcttaggtgagccggaggggggtcacctgcgccgcaggcggcgggtaccgcgagcacagcgcgcaccccagacaacgatca

SEQ ID NO: 7643 - DNA, 822 bp, Homo sapiens
gatattacggcctcgaacatgtaatcagatttgtcggtagctattacggactgtaaataccataacatagagaatatttatagagccgttagttgagggttgacctatgaaaaattctttgctcttatggaccaccaagtgattgtttagtggtttggcgattcatgcgattaaaaggttggtcaactgcttattagaaggtcctccaattcaatttgtggaccgtgaatttttggagaggtttcagactggatatattgggattcaggaagcaaaacccttaaatgaaggcttaagattcagcctcgaagaaaagatttttccgtggccttcccctgccgtcctatatataagtcccattctcccccaaagctagacatggaaattagaatccttcttccccaaggtgggttacagaaaacagaatcccttttccccaaagccagccagaaaacctaaaaatatttttctaactttccctgtaccttgctgtgtaaaaactggtcataaaaatttatctgacctaccttgtttgactgtaggtcataagacccccccactcaagagaggttcagatctacactcagaggaaaaagtgcatgttcagagaggccaagaacaatctggacagacaggccttgctgggtttccccactcagcatattagcattagatcatacacatttcgttcaattatatttctacatggatgtctgtattttgttgaacctaagcataaaaatggacaattttccctgtatgtttgggtcttcattctgaagacttctatgtgtatacattaaataaatttggatgcgtgcg

SEQ ID NO: 7644 - DNA, 236 bp, Homo sapiens
tgaggccaacgaggccagggatttattatgagtagagaatttttaaaaatagcttaattgagatataattcatataccataaaatttacccacttatagtgtacaaagctgggcattatagtgtacaaagctggttccatggcttccatccatctctcctgctgtggtcacttgaggtgggaggatcctttagcccaggagtccagcctgggcaacatagtgagatactgtctctg

SEQ ID NO: 7645 - DNA, 516 bp, Homo sapiens
  misc_feature (1)...(516): n = A,T,C or G
cgaagagaacgacacttttaccaaagcacactagatcggattaatgtcaaatacgaatgacactaatgtctaaatacaaaaaaacagcgtaaccgatccgaaaaaaagagtactttaaggaatcattttctttatttatcatagcactcatagaatttaaacaattgccatataacatagatgacggataaaaagataatcactgactaaataatatggaacacaaatagtgaatttcaccgcgttcgtttgttattcttgctatactaccacatatttacatgaacctaatgtgtcatattttctactattaacacaccgggaataggggaagcgagactaaaagacgcagagggtatacaaaagaaacacgtgagatcattcatttcgcacactatccgtcatcatcactcgtcacataaaaaaaaagatttgtgtcggctagataaattgattcagtcagctcctaccatttatactcataaaccccactgtacatacctatcaccttnnnnt

SEQ ID NO: 7646 - DNA, 1024 bp, Homo sapiens
  misc_feature (1)...(1024): n = A,T,C or G
catttagtacagatggttgtncttagcacatatatttgggactacagtcacacaattttttgttgaacatgataagtatggatacggtcaggttgccagttttcgcgatatattttatatctcgatatatggttagaacgaagatttataaaattgtgatatgtggggttaagatgcgtgtgtaatgtagtgtttttttacgagttgttatatctagagatttatttattgttataataaaaatgataaataaacgatggtacgataattgtttaatgtattttagggtagggtgtatcagtaatttggtattattgagtagattgacaaggttgtggtgtgtggataaacaaattttgtgattgctataggcgtttgtattttactagttataatattgtgctttgtttgatcactaccggttattatacagtattgagtctcggtattgttgttaataacattaatagtaactttatagatgatgtttatcgcgtctatttattaatgaaaaagatattataaggataaatagtataattatatatcaatattttatattggtggtgtgatgggttcatgaaaacagtatggtaatattctattctttagttagtacttttatataaattaacgttggtatttactcttcagtttgtgtgtgtggttgtgttatatatgatttcatatgtgtgaatgtcgatgtgggccgtctatttggtgttttttagtgataagttgtgctttatataacagagttatacaacaaggatgaataatcttttcattttttgtttaatgttttatattgcgcatttgcatttttattattctttttttatgattcagtttataataagcgtgtgtatcattttcagtaaaatttgaaatattatgtctaaagtcaggttattttcaagggttatatgtgagttgttttatgtttctatctccccagaaagctagcaaatggtaattcatatcgtggtgatatagaatgtggtatacgtaaattattaaaaat

SEQ ID NO: 7647 - DNA, 819 bp, Homo sapiens
cccagttatccgtcgcccccagtaatcacatagagaacggaaaaaataacaacagagaatcaatcatcacccaaaacacaaacacgagttgagctttccaaatttcgtgaaccccgtatacagcctttgcagtagcagataacgttgctgcaaccaacaggaccaaggcaacgaagcaagcacgagtatcatcaatcaccctctaaaaggaaacggccccaaaactccaccgttgaggccacccagccaaggaattattttcccagtttgcaaaacagactagcaagataatacaacaagggtcatattatttcccaacagtaaataaagttttaaagaatcattaattagtgggcgttattaataatgcctccaatagtcactaatgcagtgatttatgtaagacagtataaagaactgaaaacggctgctgaaaacggcccttctaacccacacaactatccggtcttcctacagtcaatttcataaagtggtaatgacttaacaatagttcggtttatagaatgttagttattattgatcttgtgctgcaaattagtagccacaggttaatctatgactccaaagtaaatcaagcttttaatttcacaggaccagcacatatctaaattaagactgctatcgtaaccacattctagttcacaatcactaaaacaaccctcattttagaatagacaatagaagttagtttaaaggaaaagggaagggtaagctttgatacatttgtttggagtttcagcagggaatctcttctttctcttttttgtttgtagcatcttgggactaagagtactaccg

SEQ ID NO: 7648 - DNA, 1325 bp, Homo sapiens
  misc_feature (1)...(1325): n = A,T,C or G
gttacatctaatatttcactacatgagaactacctaccagttcctgattgataattctaccttatctatttcaacccaacatacttattttagatctcgttcacattgtcacctagagtttacactccaaccaccaacttatattgctttatattttgcactttaatgtcacctaatctctcccagatctattcgcccatcttgtgtgcttcgctataccaggcacccgtttatacttcttcactttatactccacaactacttataatccaatgcgtttcttacgcacagcagcgccccttcaattcacaacccatacattagcaacccactcctccttgctacatttcaactcctctctttttacctatcattttcttcccattccagcacacgcttccacatgcgagaccaccgtctatgataacatcattaaccactatccctgtttgcttttcccacgtagcttccctacgtattccctaatatacctttcgcttttctatttttatacatatattgccctcaattatctctgcctcgctcacctccctcatcctcgctcgccctattatacaagttcctgtcctgcaagtataacgntcattaggagtgggtgtctctacatgtccatctctctatcngcccacttcgccatccagtcacatccatcacccaccgtatctctcccactaatattatcccctatgcactctactctgtatgccatctatgtatatnccanaatatctcacctgtatttgcttgtatcgttnattctcatcatatacacaatactatacatacctacgctcgacaacacacatncgctgaccgcagtcagtgcgcagtatnaatagagactntacacaatccactatnttaggagccgcttcgttccctaagatactattgtagcgagaaccagctcatagcacacagagagacacaagaataatagcaactcgaatatacaccacgacacactatgacatatagagtatacgatagtcaatacgcctctcagcagacatgagagtgtccaggatatgaaatgtacatagagactgatacgagagacaagtgtatgtanctatcctctccactcttgagcattgatatntntcaaacactatctatgattgtatgaattcttctactacaatacatctgcttcttcttacttgtacagcgcacgggaccctccaggatcactcgtatcattgcggttgatctcatnagatcttagatcgtcttatgtattgntatgtgntagcgtgcgctaagagacagtagagagcagtgtgagtntcgctatattgttg

SEQ ID NO: 7649 - DNA, 912 bp, Homo sapiens
  misc_feature (1)...(912): n = A,T,C or G
cttttctcctcctcctctcactcngtcagctttgattatgttaaagnnngacttgtttttatttatttagtanacttannnnnnaaaagaaatttcaactcatgttggccctgngnnagctnncgtctctccctcgctcctcgctaanggnnnccatacctcacctctctgnaaaggnnnnttcctggcactttntgaccctctcaccactctnnnnacctttgcctacattatactagcatnnnnnnnaggctggnnnnnnnnaatttnnnnnnnnnnnnnngaggggananaagnnantaannnnannggtnngagagaaagtgaataatggactttnnncgcgcccctccactgctacgacggatactaggttcatagtcgaaaactagccggcaagcgcgaggcaaacttttatgtgacgtggtatataatatgtatcaaatgtatgatttcttaactttgaacaaaaccaagcggctctcaccggctgtgttatccgtaatttagaggagccatgcgcatggagtccttgacagcttgtgattaattctattctcaaccctaaatgggctgggagactcatctattgtaaacttggtgcgtactactatagaggtaaggtttgtccccccagtgtagaagtcagtggcccgagttcgagcttattccagcttcgacttataggggcctagcgatctgcctacatcagctttttgagtagtgagaccacaggcgtgcactaccatgcccacattattttttattttttgtagagatgaggtctccagcctcagcctcccagagtgggggattaacaggtaggtccaccaacaattggtaccacttgacgataacacctccagagccggccgcatctctataactcataataatgtcggtgtgccgacc

SEQ ID NO: 7650 - DNA, 532 bp, Homo sapiens
ggcgagtaatctagtgtggtgttgtggagacggttgtgtgcgggccacgcaccgtgatgtagtgcgatccgcgttgttgtcgcgccacttcgccctgatccaaatacttttatatccgcaacctcacgtattgtctttgtttgctcctgttcactgcaccttgctccgcatggccatgtttttgttttcattttcatcatccccagattttgattttattatgtagtgttacctacgacagtttttatatatctatagaccagtttttgtggttttgtttttacacgcacaccaccgattacccgaatgaaaatataaatttatatgtgtatgtgtagctactaacgtttctgtgttttcaaatacacccctagttgagacacggtaatttgtttaagttttccatgtaaattaaaaaaaacagcgggggggggggtataagaataaaaaatagaccagagtggtattaatggattgtcgtttttacctatacagcatgtttcaacttttgtagttataacaacgcacccgg

SEQ ID NO: 7651 - DNA, 973 bp, Homo sapiens
cgttataatccactccaaatattattaaaccataatagcaccatatatccaacgggcatataacaaaatattataactaatatataattacattaaaatatcttatctaacctcagataaatatttaattacatatttatgtaacttctctaaaataaatataaatacattatatgactttattaattatctatgtttctttagtcaaagaagaatcataataataatctgcgtctcactttatattcgtatcaaatagtttttacatagtcacacttattaattactatttattaataatacaatttgtagaaatataaataataattcaacaaaaaattaattatctgtacattaatttaaaatatagctctaaactataatatctcatatatactgtgtaaaatataataaattatttatacaaaaatatccctatctcatctattaatattaattcaagagtgatatataatcccaaaaaataccataatatataaaaactttaatttacatatataggatacagaactgcaataaaaatatatcctaaataatatgactttcagtatccatgaattataaggttttttactgaatcattaaaatgttaattcaatatatccttttacaatttccttggatctaagacaaaaggtcttatctcagttcatcaaaaatgtattttccatagaaccttaaaacaatcataaaaatatgcatttgagtacacagtatctctaaacggcttttagtgcattaatcatgtatttatttgtttaagaagttcccaacatagctgttggctctatacccaaggtcctgtgtctgttttgctcaccaaatgtatctcaaatatctaagggaatatcaagcacaaattagcctcccagtaaaatttgcttaatgcaaaaagcaggcagcgtccgtttaattaaatatatttatacatattaaatatcttcactataat

SEQ ID NO: 7652 - DNA, 451 bp, Homo sapiens
  misc_feature (1)...(451): n = A,T,C or G
cggaacccggcgcaacgagacaagaacataccaacccaatcgcaagcgcacacgcgcaaaactaaatattcatcaacacacaaaataagcgcaaaagaaacagtgaaacgtacgggggagggagaggaaacaaggctcaagatcaacaccgcacaagaccgataggtcaccaatatacaacaaaccggcgaaacaaaagtagaacacacaaaccataacatgataaaagaaagccgccaagaaaaagataaacagacataacgagataaagaaattagaaataaacaaaacattctacagtacacaccacacaaaacccaacacacccggccgcccccccccacgcacgaaaataaaaaaaaaaaagcgcggggtgggtataatatatttctaactccaccccacacccccccccttaaatantaatattactctttaataaacacataac

SEQ ID NO: 7653 - DNA, 652 bp, Homo sapiens
cctgaccagaatgccaattccctaaagagagaacagttcactctcaagaaaacaaggtttgactggcatgggtccactacacaactgactttctctgcatctgcctcccctgagacagcaagaccctcatcactttctgcctactcaacaggaagatgacgaggatgaggacctttatatcatgatccacttctactcaataaataagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaggaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaaccagaatgcgtgcg

SEQ ID NO: 7654 - DNA, 700 bp, Homo sapiens
ggtatatcagagtttgtttgttaccctattatttctcttccgtacttacacctcattaattatgttatatacatccttattcttctttttatgattattacaattttttcgttttttcgcgaatctgtgtcgatcaccggtccctccgttttctttgcgttatccaatctcaaattacgttttatactcttttatttatgtcgaatatattccaacttctaaacttttcgccgtcatgccttgtgtagtgtttcaccctttgcgatttatcttaattttccttttttttatttatacaaactacttctcaatccgtttgttttattgttctttctctctgctatttaccttgcacgttttttttttttccctctgatattttaaatatttatagggggcgggggtggtgttatttttatttacctttcaaataactttatatcatattatttgatatatgcacaattttagaatatattatgttcgcgattttttaatttcttattgtctatttttggggagcgtttctctcttcttttttttttaaaaaaagcacccccttctttaatttaatttatatctccctccccccaaccacgcaacaaaaaataaggatggggaaaaatattattatcccccccccccacaaaaaagaaggggggggtcttttccccctgtcccccggaaaaaaaaaaaaaaa

SEQ ID NO: 7655 - DNA, 898 bp, Homo sapiens
  misc_feature (1)...(898): n = A,T,C or G
tttcatgggtagcgtagaatcggtgatactgctatctccagaaagcatgccggcagatgaacctataacaaattgatcctgtcagcaagggcacagggcacttgtactgcacaagacgcacactctcgtaatggcaccgcatccgggtgttttaaccagcacccaccccgcggggcgggggatcatggttcgccaactttcgttgagggaaacatcagcaaaaaggcgtaatttgtccccggcaccggtatcactccccagaaggggggagaggggaaaatccacactgggtaccgcgcgcagccggccaacttattaggggctgcccgcctcctcgggggtgcggagactttggagagtagggagtactccacggacgtggtaacaaccacaacaggtgtgttaaaacagggggggtgaaaattgtggaagaaagtctcgtttgcccccccccccggggggcctccaaccggggggtacagtttaaagagggggccccttttttttttatctttgggcggggggagggggcaacaaagggtgtgccaaaaatttttcagaactcccccaattttggggggttccccctccaaccagggggggggttccccccgcccaagagcgagagagaggacaatttttgttttttttttaaaaaaaaaaaatgttttttgggggcgggggtttttgagggggggtttttttaaaaagaaaaattttttttttaaaaaacccccacgggcgaaaatttttgaaaaaaaatttgcgcaaaaaaagccccccccccacttgttttggtacaaaaaaaaaaaagaagaaaaaagaaagcaacaacataagagctgatgcggccggtnantaaattatcaatgaatcagtgggggcaggtggcgttgaa

SEQ ID NO: 7656 - DNA, 892 bp, Homo sapiens
  misc_feature (1)...(892): n = A,T,C or G
cgtccacccgatgataattttctttcactgttatccacccatcgcggcgtgtccctacctcccccgctccgttggtacgacacgttaatatttattgttttccctcctccacccctttattatattatctgttacacaccactaaatgttggtgctcccctacgcaagtgaagccgcccccctatttctccttttcttttttcccattccccgttccccccttaccgttgtttgcccccgtgcccattgtcgtccccctcctgcctagaccgtttttctctttcnttttgggggccccccccctttttggtagaaaacacaccccccctaagaaaaaagaaaacccccccgccccccnnnaattntngaaaaaaaggggggggggggggatttttttactccccccctaaaagaatgggggggggggtggtttttttttgggtanaggnnnnnnnttttttnnnnnnnnnnnnnnnntttttnntttttttttttttttttttttttttttttttttttttttttttttttttttttttnnntaggtcacaatgaaatggaattttattttgtacaaatggaaaagatttatcataaatatatagaccaatatataacattgaagaacaagaagcagaaaggaaacaatgctcttgcataaagatcaattcgctttgctgctgttggaataacaggtttcgcagggggaggcttcttgttgttcttagcctgagatttcccaagtccgttgttaacttcaatgggttttccatagcagtcataattggatagttcaaaatctcttggtaagcttccaacaatgctgaagtcattagatctcagatcagacttagaagtacaaacttttttgcatctggtctcaccaaccctg

SEQ ID NO: 7657 - DNA, 298 bp, Homo sapiens
attaacagtgtacaaatataagcataggcccttatcatgcccgacaacaaccctactcaaagacaatgtaaatatattgaattaatttccacagccattgcgtatcttctaatgtgtgttattctttactgaatctgtatgcgttaattaggactcaattaagtccatcctccagactgtatcgatgatcctcagcaaatacactatctcgcttatcactcgtattataagatcgatccatcacaccgcccacaaggcactcggtgactgtaatcggctatagtcatcttgcggacct

SEQ ID NO: 7658 - DNA, 107 bp, Homo sapiens
tgaggccaacgaggccaagtttttatttcacttattatttattttatcttccaatttcctcttgccagactcccatccaaagagtcatagcagccttcttccacctg

SEQ ID NO: 7659 - DNA, 895 bp, Homo sapiens
  misc_feature (1)...(895): n = A,T,C or G
gatatataatggattttcattgtattgttgttgattagatgtgtgaatactataagatgtatatgagaatggtaatgaattagtagaaatatttaaggtgcaaataaattagttgatttgtgttaattgtgaagtgttttaataagaataatatataagaaaattataaatattaataaaaatgtatagtatataagaggttgtatgtttaatattagattgaagttataggttgtgatctaataggaattagttgtgagtaataagtttattattgatataggaaaaataataaaaatattaaaagtgaggttaataaaagaagaaaaaaaaaanaattaatggagttattgagtgtgggagtagtaaatatataaatataggtgggggggggggttttttttnntnntttttttntttttnnttttttttttttttntttttttttttttttnnttntttttttattnttttttttttttttttttntntttttnntttnnnnnnnnnnnnnnnnttttttttttttnnnttnnttttttttttttttttttttttttttttttttttttttttttttttttttttagatttttccttatgtttaattaagtctaattaaacaatgctgacatcttcttggcacctgtggtgcaatgatgttaaatatttaatgcttgtgaaggattaggctacacttctaatctatagctaacaatctgttccctctctggagtattttttatttagttctgcttttgtataatgagttacatttcaaaggagattgttaaaaacttcagcaccgatgggccacgttgttgcccagcggattggaaggagaggcgccatgccacgccactcctatctgggccagtcctcggtggtgtttcct

SEQ ID NO: 7660 - DNA, 276 bp, Homo sapiens
  misc_feature (1)...(276): n = A,T,C or G
gtctttatgcgagttcaaaactatagagatgtaaaataaaattcgcacagagcctatacatatatcatgcataaggagaaaagatataagaataggctcgaatgcctggtaaatacaagataaanctctggaaacacaaacagagggatacatagactgaatagcgatgacactttcgccaatccgggtaaaatacaccttgttgggtgtatagtaacactatgaactggttttctacctgaccaaaaatacatctataaccaccccgccccncnt

SEQ ID NO: 7661 - DNA, 212 bp, Homo sapiens
catccaggtcgaattcgtgatccagtggtatttcagggacataatgattccttcgggtttgcttagtactagctctatataaggtctacggttgattctaaattgtgttgtcgacgaagtccagctttacgttactaactaactctgtcttggtagtcctcaagagttagttattaaaaagtcctaagctttctgaaggtattaaagcggct

SEQ ID NO: 7662 - DNA, 714 bp, Homo sapiens
aatgtaggacagcaccatctgaatatgatttacaagttggtttgcgttgcattaggccaatcatgccgcaccctgccagggttatttgttatttttccgaaggtctacatcgttgaaggaagcactgtatgagcatcattgtaagaaacactgtagagtgagataaagtaataggtaactaaacagaaaataaggttagatatatgggttggcttatgcgcgtttggacgtcttatatgggtagatatagtgtcgtcttgggttcgagtccgctgcatacatactcacctcctggctcctcccgacaatttgaatattcgaccggggaaatagataaataataataattgaggatgtagtggattgtgagatagaaaaatagacaatgaattctttctttcttcgcagtataatgaaaaaaaagcgggcacatttgtccagggggcaaggggcatatttctcaagcgtattaaaaaagagcattttgggctcagtcaaatatgggttttaagagaacataaacccgaaccgggtagagttctttctgtaatcccctgaaaggaggtcaataagagagggctgttagccgggttcaacctgttgtgtaaaatcggagcggcggatccatttaattgggttggcctataatcccgaaataactggtggccgctgttaaatcccgcaggctataaataaattgggcttcaccggaag

SEQ ID NO: 7663 - DNA, 1035 bp, Homo sapiens
cagtatctgcaacggggggaccacccactataaattcggcgcacacccccatgtggggttccgtcacctttatgcccacccgggcacgacggggcgtaaatggcaccgggcggcgtagcgaacaaagagaccacaagataaccgcacgcaagcaactccccccagtgtgtatgacagccgacgaccaaacggggtggccgaagttgaacttgaacctcgagagaagcggtttcgtacagtccgggggcggtcaaccccgttggtatccgcccggaccgggggggttccccctcccacattttttatccccgccgtaccaaacccccccgcgccaccgcactttgagacccgccgttttatcccgcctttgaaaccacctgtgtcgctcgagtcccgcgcctgtgcggggtgaccgggtggcccaccccaattcgttagtgtccctccccacgtagagtggcgtcacgtccgtttacgcgtagctcgttgtatcactagacggccgttctcgacacgaccaatcggtgcggaagtctgatcccgatatgatggaacaatcagtaacccaatcgaacagctgacccaagctagcaatagggggggtggggataggtgcgtccggagctcggtcgctctcacaaacgcgtctttgccctgtgcgatccgggagacgcctgggtacaatccggcggtcatagattcccatgtacaagtccacaaagcgtggatctttgaggtgtagcgtgtccggcggtcccctgagtgaccagcatcgcccgcctgcagcgttgacgagagcactaagtgatgtggtggatgaggtgagtacaggaatagtattacatgcgataaaattactattagatagtaacagagccggtcctgcattgaatacatgggtttgcagtcagatgtatatttatcctgagaacgtgccaaaagtatcggtgaacgctaggggtcgacactgtgctctgctggaggtacgcagtgctcctgtgcgtgcccgcgccttgtgtcacctctctagccact

SEQ ID NO: 7664 - DNA, 177 bp, Homo sapiens
cgtagtaattacaattgcaacgagcgtgttgacatgaagatcagaatcgcaccataccaatacctacaacttagtctctaatctcagaatcatttcgtctaatcaaaatgttgtcaataccggataccccccaaatatcccaccgcctcattacaaacctcacataaaccacccggg

SEQ ID NO: 7665 - DNA, 1412 bp, Homo sapiens
  misc_feature (1)...(1412): n = A,T,C or G
gtgggagatgtagtgtctgagtgatatagtataacgatagacagatatatatatagagcgtgangtcgagcttatcgtantactntntcgtggctcgcgccacgtacgacggtcgtgatcantcantcttactcanaccacatctatcaatacacacactcgttagcacgtgnanagagtgctcacatcntccactctatcttctctttctgtcncncgtgcgacattactcacgtacctctctatcatttagttacacacataattctctagagtaaatccccttgncatcgtcatacatctataatagtgtcgtactatgttgattagcataccacctgtgcctcgatatgtgcggtcagcgatagagtgtgtcgcgtgcgcgtgggtagtcggagtggcactcgtttgcgttatatatctctgctctcgtgtcttgtctacgctgtgcatgccgctgacgtcggtgtgctcagtagaagagtaagaggcgctgcagaatggagtgnatagacagtacgtgggggtgaggatatcgcatacacgataagatactgatatggcattacgatgatgatgagcaacgggaaatggtaataggagatgtatanggtagatatgaggagacggtatgttgtgagcggcgatggagagtcactgtttggggagcgtggtgcggtgtgggtgtggagcgctgctaagtgcgtcgtagtcgctctacgtcttattatcggtagcgcgtcagatagcatttgtcgtgtgaagcagacttgatcatccccgaacagacgctgcgcgggtactctcgacgcggctgttgattggtgtcngagggttagttttcatactagtctgtgttactctagttagtcgttatctcgttgtctctacgtcgttaatgggtgtggcagttaaagctaatatcactgtcttgtagtctcgtagaagttttgtgcgggtatttatttatttttaatactatatgcatacttctgtcgtccgttagtgccggcgtgtgcacatgaacactataggatcggcctgctttgtagtgttagcaggcaaacggtagatggatggatggtgtgacgtcgcgatatataacactgagaacgacgatgagtcgcggacattatagcgcggctccgtcatgcacctacttatatgtactctatcatctctgttcaaggtnttatctccttaaatgatggccgggacgtggcgagggacggagggctatctatagggggagatgcctagcaagggtggcgtcgcccacttacgtgtccgctttgtgagggtgtatgggtgggcgagattggtagagtttatttacttactcgcgaacttgagtatcgcgcgtgactcttgtgcgtgttgttagtggatggaggacatcgtgcgtgttattg

SEQ ID NO: 7666 - DNA, 848 bp, Homo sapiens
tctagtatctcggcttgagttacaccccattattacagtccgtgtctaaaggttgggacgagtatgccaatgcctaaaccccattaccttcttgcaagtgccaacaaggggtaaaagtgaaatgtttgtgcaatcgaatccaaggttcaattcaagaaggaaagcaaaaaacccgtccaagttatctgataccaaattacgaaagtggtcccccatcccccccagtataaaaagattattagcatgggtgcaaaaagaaaatggtttgccgctggaagtatcaagagaagttaaaagcaatagaaccaaatgactatccaggaaaggtctcagaagaaattgaagacatcatcaaaaagggggaaacacaaactctttagaacataacagaatatatctaagggtattctatgtgctaatataaaatatttttcacacttgagaacagggatctgggggatctccacgtttgatccgttttcagcagtgctctgaaggagtatcttacttgggtgattccttgtttctagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtagatcggccg

SEQ ID NO: 7667 - DNA, 860 bp, Homo sapiens
aacgatatcccctttgaggagtcaaacgtttcccaccgaacgccaagccagcaatcaatagcaggatcagaattaccccataaaggaaaggccgagaagtcctctgcttagccaacaagccaaggtttaattgtggaattattatatgcccaatcaaaacccttcattggtccaaagacacaatctacattattcaaggacaagaaccagcttgtgaattcaatgctgacactttatttcttgtaattaaactgttacttttatttcacctatttaatcctataaacagggaaagaaaataaaacatatggagtaaactacaggatattgtggtctattccatgttttggtattttaggctgctcgcagtgagcgtacagttcttaaagtttgtatccgaagtgtattaaaaaataaattcattagctaaggaatattaacaagttggctatatatttaggtaggaatcttctttattttcttgttttgcagaaagcaacagcccacaattgcctgcattttctttcctcttcaaaaccacttctgctccaaagaccatgaacctgaactgaagaaacgactccttcctgctggggtgagataattcagtctccatgatgtcttaatcctgggcctcccttaattgacttctaactgtgctgaactgtggctgctaggagttgcaatgtggatcgcaatttacaaggcactggaatcgtttcttgtcttcaaattagtcctgagctgtacctgacattagaagggaacccgaggagctacttccaatgagtgctgctctctgatgatgtcttcattttgcttttctgcagaagatgagtggtgcctccttcgattcccac

SEQ ID NO: 7668 - DNA, 1189 bp, Homo sapiens
  misc_feature (1)...(1189): n = A,T,C or G
aagaccagaggagagcaaggaagaagagcctaggggggcgacgcggggcccgnagccgcgcgcgggaccgaggagaagcctcagggggnngcggggcgacgccgccgggggaggggggcggcgnaagcgcgcgccccgcgcggccagcgccccggccgcgcccgcgcgccccggggaagggcggggcggggcgcccagcggcgcccggagggcgccgcccgcgccgcagagggnngggagagagggnagaggggnagagaggcccggcggcgggcgagagaccaaccccggacgcgaacggggggcgcgcgcgccgcggggcggggcggccgggcgggggncgccgcggagccaaaggcggcgcgcccgcggcgggngccgcggnnnccgcggggcgcccgacgcgcnggcgcagcgcggggcgcgccgccgggcgcgcgcgggcgcccgccccgcgcnaccccgcacccgggacgcagccgagcggccgcccggcccgcggccacgcccgcccggccggccgccgcggcgccgcggaccgccggggcggngccggcggcggcgcgcgcgcggcgcgcgggcccggccgccacaccgcgcggccgcggccgccgggccgggcccgcccgccgccccggcgcgccggcggcacgcaccgcgcggcggcgccacgggcagnggccgcgncaacacaaaacacggcaggacggaagagcgcacgcgccggcgcgcgccgaggggcgccgcgcggcccgcgcacgcccgcgggcgcagcgcgcgcacgcggcgcggcccacggcgcgccgggcaccgcccaccacgcgcaccgccctccgccaccgccgcgcgcgcgcccccgagcncgcccgcgcgcccggcgcgcggtcccgccgcgcgcgcgccacgcgccacgcggcgcgcgtcgcccgggcacacggccgacgcgcgcggcggcncgcgaccggcgcgcgcgcgcaccgngcgcccgaccgacgcccgcaggnacngcgcgacgcgacgacgcgcgccgtccgcacgcgcggcgcccgccgccgcggaggccgccgcgcgcggcccacgcggccggtcgccgccgcgcgggacgcgacgcccggcggacggcggcggcgcggcgcgcgcgggcgcgcggaggagcgcggcgcgagagggcgnacgcaccgcgcgcggg

SEQ ID NO: 7669 - DNA, 847 bp, Homo sapiens
tttggagttgcgaggcagtgattttatccacattgggtaatctgaaagtgatccttcctcagttaaccttggagaagacccaagcctgtttgcccgttttaatacaaccttggcaagaacccaagtaaggcatgttaaacctgatccccaacaaactgtaagataatcccatgtgtgttgtttcaagcctcaaagtgtgtggtaatttgttacacagcaatggttagctaacacaaatacctagacagctgttaaagcattatttttggatgtgtctgtgagggtgtttttgaaggagattggcatgtaagtcagtgacctctgtgggcaagagctgccctcaatgtaggtgggcaccatccaatgttgttttgttgtatttaggggcccagataaaacaaaaaggcagaggaaaggtgaattcactctctctctcctgaagctggggtacttttatctcttgcccttggacatcagaactccaggttctctggcctttggactctgggacttgcaccagctcccggcttctcaggacttcagcctcagattgagagtcactccattaactttcctggtttaaaagcctttatacttggactgagaaacaccgacagcttccctgggcttccaacttgcagatgacctatcacaggacttctcagcctccataattgcatgagccaattctcctaataagtcccctttcacatatctatttatctacatacgtatatcctactggttctgtctttctcaggaaccctgaccaatatagtatgtatctctaaaagataaggacatcaaaaaatattaccgcgtctaaaactaaagtgagatgcgactg

SEQ ID NO: 7670 - DNA, 903 bp, Homo sapiens
cccctctccttttttttccccttttttctcccctccctttgttttcctttttttccctcccctctcttcttctttttttcccccctcttttttttgtttttcctttccccccttattcccccccctttttttttttttttcctcttccctttttttttttttttttttttttccccctttgtttttttcccccccctttttttttgttttttccctctcccccccttttttctttttcccatttcctttttttttctttttttcccccccactttcttttttttttctgtccccccaccttttttcccttttttgtcattctttgttactgtttttttcacaccatcacccattggtttgtgcctttttttttttccccccatccccaccctatttttttcctcctttccactttttcccttttctaccttattcacccttctttcccgtttagtttcccccttttcctcattacaatacatatttctccttaccccgtccatcccacatttttgacgtcgccacgttgttctcatgtcacacatacatttcattccaaccttagactacaaagcctcctacagtgtaccaaccaccatttatgcacttaatgaacaagcctttgctccttttactttgggagcaagaagtaccacactattattatttgcaaacgagttttactctcactttcaataatgagaatctcccaggcttacaaggttcttgaaactcaggtgaacatttggtccttaagctgtggtaaattccagttgttgttttttctccttctgttactggtgaaggagggccttgacgatgagtcctccaggttcttggcattttgaacaaagaatggactaaagcatgaataggttaaccaaggattatatgaaaggagcg

SEQ ID NO: 7671 - DNA, 1765 bp, Homo sapiens
  misc_feature (1)...(1765): n = A,T,C or G
cggtatgggcacccgatgatgagccgcgcagtggagatggactcggagaagaccgaccaagaccacgaatggacgctcncnagcaggagagaaaagncacacagaggagaagaagtcttctcccgtnggccgatagaaccctcccgagttatcaatctcagcagagccaaacgcgagtgcacaganacgcactcagagagagaacttantgtagcctcgagattgagcccntagacatcgctcgnacgaggagcccgatccgagataggaccacggcgcaggtcgagggcgacgcacgacgcagagatatgtncgtgcgtagcagcatcagcgtcgagcgacgttgcgctatctccgntatagatattacagagccgcgcgggtagggttcacgacacagatacaattgatatacgctgccagtggaagaagtcgcgcgccgcgctgctattgatccacagcacgcaccaccgagagcggtgagagacggcactcggcgtggtagtaactccataaaggaccgcacgaaagaacganangaccatgcagcggagatgcgaaaactcagatgaatggcagtaggaagccatcaaactcgccgatactacaccggnccaccacgactcagacacgcgaggcgcgcagaccgccgtacgaggaacgcgaaagaatatatgcagagatgttcgcactcggcgctatcatatgagatatcaatcgttgtatgtgatgatgaacacgccgtcacgcggcgtcaacactagaagacgatagatgtggtgcatgtatcgcaccgcgcagagatagctgaccaccgtacgcgcgacggctgaaatagtaccgcaggcgcgnacacctccgctagcgctntcgtatggatacgcgtcacacgtcaccagcccngtntcgacgntgacctgtacgaacatgcgcgcgtctacntnctacgactctggtnatagtagacacacacnanacacacatgagagcacacgcngcgtacgacaccagcnagatgatttagatactgagagatgtacgactacaagcgtcgcgatgcgcgcgagacacgagaacgcatagagcggcgatgtcngnacgaccangcgttctcgatccgacgagcgagcttcgctgtgttcgcgcgtgtgtcatcaaccgtgatcgcacatcacatcaacaccaacggactgntgctcgaggctgcgagaccacacagcgtaggagacgcgctagacggacacaacagtgagaggtgtagcgcgtgtgtctctagtggccgacgctcgtgagcgttcacttgcgagtacgcgatgatacgaccacacgcatcatgcgtgagnagcgcgagntcgaatnagcggatgcgcgagtgcgatactngtagcaacacgtacatcncgccatganatctaagcacacaatgactacgtagcatatagancntgaggcgcgcagtcgcggagatgagtggcanacanacgaactgttgcgtgagncacacggacgtgagcagtcangcgtcctanacagcaagaggnacgtgancgtagcacgcagcttacacgtatagtgtgtagaccangactganangagatcagacancngcaccgcgagacgtgccgcgatatntagattanacacagcgatacaagaacactagacatagtgtgttctatggagagttcgcgcgtacatcgactgtgcacacgacctactcatcnatacacaggccgcgtaatgtcagacgcacgcccagctccg

SEQ ID NO: 7672 - DNA, 1134 bp, Homo sapiens
  misc_feature (1)...(1134): n = A,T,C or G
acccccctatcaatcatatttaaatctcgnnnnngnnnntntgggaaagccccatataccctataacaattcacctggctctttttcccgtatctttggaaaattccccaaacccctgttttacaccaccggtgtgggggtttcctaaaataaacacaaaaccccacaaaacacctatttaaccccaaatctttccttaatttctctttctatttcaatatctctcttaaaatcccccacatcacccccccacactgctattaaatctttctttcttttctaaacttctataaaaatcacatccccctacccaaggtgggggtattaaaacccctataatatccccccnacacccaaaacaaaaactaatatcataacaccaccctctctcttaatataaaaccttcattatttagaactcccactctggaattctaccataacactacaccaaaccccttcatttttttaacaccaatttaaatccccttcccacaatccttataaaaaaaaaacaaaatacatcccatccttactaactctcaccacaaaccaaaaaccagatatattaactctcctcatacataaaattttactaaattaatcttatcatctacatatcaaacctataaaaaacacatccctatatattaaaacattttattattttatatccacaaataatttcatatatttcaatatattattaataacccacatctaatttctccttctttacttacaccaaagacatttcacactctcaccttactctcttttactccaatctcatcgcttcaaccacacacatatctaccatactcctacatctaacgtttaatctatatattatatacaacacaaattcaaattaaacttcacacacacttcgatattctcacctcacatctaacaaactacactaatacagacacaatacctatctctccttctaataacactacttactcataataaccgacacacacacatatcactccttcctcttncgctctaccgcattcactaacacatcttctattcataacttacctcacatagaatatcctcactacatatatccaactacaacattattaactacacatgcaacaactaatacctcatgacacc

SEQ ID NO: 7673 - DNA, 135 bp, Homo sapiens
agaggtagatggcttcattgttttccggttaagcccatttgaaaattaaatttcgaaaaacttccatttacaaataaataaaagggcgaaaatttttctaacacctgtgaaaagaagggaaaaaaaaaaaaaaaa

SEQ ID NO: 7674 - DNA, 243 bp, Homo sapiens
tgaggccaacgaggccaaccttttatttgtgtcttctcagctttggcaggacaccgtcacaccacatgtgctttccagggcttgtcttatttatgtgtcttctctctttgcagttagttggtctacaatcaaaaacaatattcccatggttatagacaggaggagccctcttccatccgccgctgcctctatgaaattccagcatcatttttctggttttcattggaaacaaagccactaaga

SEQ ID NO: 7675 - DNA, 1036 bp, Homo sapiens
tgtcctccttttttttgttttccccgttttctgttacatttcgtcaacaaacggaatacacgttgtccgcagagatatgatgagtgtactgccgaccccgggttttcccttttgcgctccagtttgttcccccctatcgtatcccttttgtttatcctcccgccacccccattgtcgtttttatttctttttttccgtcccccggttcccctgcgctgttttttgtgcgtttcccagtgttccccctcacccgttcccttgtctccgtttttgtctgtcgctttttttttatatgcattatgtacccggtggccatgtccctctcccccctttcgccccccgcctatttgttttgtgttccccgcttcctgttttattatcaaatactcggcggggcgggctgcgcatttgtttccaatctccccacttccactcccctttcccccatatttattatattatttggtaccaccccccagacattatactaatttccccctttgtgtttattctatgttgtgtcccaactttggtcgtgtgttgggtcctaacatcaccaccgggggtcgagtggtcggaaaccatgggaaacacgtgaaccgacttacatgtatatgtgtgctgtgcaatatataccacccgttctcgactgggttcgttattgtactccccattcgctttgcacgcggtggcgctcattaatctggtcccgggcgctatgtgtgtgtgatgatgttgacggctctcgcggctcttttcttgattcggttattctaaaacaatatcatgctgccaatgtattgcacatctcacttgtatttgtgctgttcgcgtggccgcctgcgccactactataacaagaactcacccaaggccaattcgctacttttcgtcgtatttctacctgtaagtggggatatgtagtgggagagctcagaatcacaccctttgtccttacaacccccgatcgccggcaacagagaaacctccactttgtttgatggctgagtgatcggtgtcgccagagtgcctcacg

SEQ ID NO: 7676 - DNA, 761 bp, Homo sapiens
tttcttcgttagacgtgttgttctatttattggttcgatattttgggctgtatatatctattattgtgatccatcatgtattatactatgcgtttttggatcaccactctttgttctggtctggtatacgctaatttctttttttatgtgtaggtgggttgttatttggtaatgtggtatgaaaagtaatgggccgcttacaaggataaggggggctgggtctttttttggattggtgttgcggtcataattcgcgcgaagcggcactcgaaattaatggctcgcacgctgtaggtaaattcgttcctttggggagaggggatgttaggtgttaatatgttttatttgtgttctttctctctacaatgattaaatgaaggggtggtgtaatttttatatttggtcatttagagtgtactgggtttttttagaataaagttagctatcttgaggggggggcacacaacatctggtgggggcgggtggattgtcaatttctttttttataatggggggggttttttttttgggtggaaaaaataaaaaaaatttggccgccaccatttttttttttcttttggggatggttttttttggggtagagggggtgttttttttttttcttttttcctcaaagtgttttttttttttttttttaaaaaaaaaatttttttttttgtgcccccccgttcccacccttttttttttttgggggggggggggcctttcccccccccaaatatttttttgttgtttttttt

SEQ ID NO: 7677 - DNA, 865 bp, Homo sapiens
cgtacaacaacgtttcgttgttccaattttcccccccacccaccccattggggtatccctgatttgggataccgtatccgccttgagtactataccgttcccgaaccgaacgccgaggccaggagtcatgagcagggtcatgattaaccttcataaaggaagggccgaaagttccacgttgaggcccaagaggcccaaatttattttcccgttttgaaggctggaagtccaaaatgaagtgccacaagattctgttcttggtagggccttctggtgggttgcagacagctgccatcactctgtgtgctcacatgacctctttgtgtgcatgctgacagagagagctctcatttcgcttcctctttttataaggacactaatcccatcataaaggctccacccttgtgatctagtctaaacctaattacctcccaatggtcccatctccagatactatcatactagggattgaggcttcaacatatgagtttgaggagggcacagataatcagcccataatggctggttagagaataaattagtacaatcacttggaggagatctgcagagctgtttattcaacagtttcactcctagatgaattctctagagaaatactcaaactttttatatgtgtcttctcagctttggcaggacaccgtcacaccacatgtgctttccagggcttgtcttatttatgtgtcttctctctttgcagttagttggtctacaatcaaaaacaatattcccatggttatagacaggaggagccctcttccatccgccgctgcctctatgaaattccagcatcatttttctggttttcatttggaaacaaagccactgaagagtattttaagagtct

SEQ ID NO: 7678 - DNA, 805 bp, Homo sapiens
  misc_feature (1)...(805): n = A,T,C or G
atatatttttgtctcacnaacccccccattttattaaattactacaaaagatgtgtgtttcttctatcactttggtcttttgggtcgcatttcgttttttttatatcccactcgcaattggccccccccaatataatatccatgggtggacccccttttctttgtgttggcgcccgtttgttttgtccaccccctgaggcgggaataccctccctcgtgggccttcctttgtttttgtagggggttatttttttctttgtggtggttggcgcagagttattttttttttttatcttcttccccccccggcgggcccggtagaaacataaaaaagggttttttttttttttattagagactgaacaccataggtttttttttttatttcccccaaacaagacttttttttatttttagggggggggtttttttgggaggtttttttttttttttcccccccccccccggggttttttttttttggagggcccccctgaaaaaaacccccccgcctgtttggggttttttttttagggaaattttataaaaggtttttttttttccccccccactcccccaaaaatatgatttttttttttccccccaaaaaaagggccccccccacccaaaaatttttttgccccccgggggggggcggttttttttcccccccggtttggtttttcccaaaaatacccctccccaaaaaaaggggggggggctccccctttccggggataaaaaggttttccccaatttttttttttggggaaaaaaaacccaaaaaaagccccttttttttttt

SEQ ID NO: 7679 - DNA, 993 bp, Homo sapiens
  misc_feature (1)...(993): n = A,T,C or G
cttccccccattttttttttccgtttgctccccccctttttgcgtttttggcccggttacgtttcccccccttcgcccaggggtttgtatttcactaaccagcctacctgttatgatgttagatgcgatggtgtcattcagccccggctccgttcgatctttggtctaaacacttgcgggcttgttcgcatgtatggaaatttaggcgcatagccggcagtgcgttttactatttatatcgttgtcacgctttctgtaccatgcaaacttatgtcttccggtttttcacgcgatcctgctcagtgatgcgaattgggggccatgcttggcacatatgtgactcaactgtctagtatcacagttaacggtagattattcttaactaaactaacatagtatatgcgcgcttttatttcatctactgcagacaggcgatctcgttctcttgctcggtacggcgctcgcatcgtcgacgaccggcctcgtagattatactatctccctgtcnatctcctgtcgcggccgccgggttatgccgcacgtcgggcccatgataacgctttctttgccttccttggagacctggcatttgctaatttctgatgcgtgagctaagcatttgcaccctacttgtttatggctcgtgcattagtgatagcgaaagttcttgtctaatacacttgacgaattcagacttcggccgctcgctgtgtcgtactggatcgctgcgttgagcgctgacgccattcccagagtgtggtgagtcaatgatgtacgatgtcatcgagcgtgtcgcgcagtgtgttagtagcggtgtctgatgtgactacgcgcgccgtcgatgaggccgncgctctggtgttatgtttgtatagctacatctctatcgtcatngagcgcaattattctctacctgaacgtacgccgatgacagcgctnagtgtagttcacgtagtgatatcacgcgcgtgaggagtgactataacagtctat

SEQ ID NO: 7680 - DNA, 906 bp, Homo sapiens
  misc_feature (1)...(906): n = A,T,C or G
taaaanactanaanaaananaaanatccannaanatgttggtgctgttgatatcaantcacaaagtgtagactcagccagcgaaagcccatacgcttctaatacattttgacctccccgtgctaatcgtccagtgacctacatatacggaaaagatatatgtgtaagtaacatatacactgcatacaaacgacggatattgagtggtggggacgacggggatcaagtagagatatataaattaatagttcttcgaatacaggagtctgctgtgcgacggcctcctacacgagcacagcgggattagactatatcaagtttgtggtaagaggaaatagtggtatataataatggattgcgaatatatataatatttaaaatatgaaatagtacaagaacaatcttatgtaaccgctcttatttgtgtaggagaagacaaaacaaaatgagatctcgtgctatgtcataatgctcacggggttcgtgttctcttctgttagagggaacattcggaaataaaggtaaagcggtttattgaaatttttttggacgcgtactaggagatatcgaaatatcctattactgaagctctctattctgtaggagggttttttctatcccttcccctcttaaatttctttttaaataaactctttcatagtgtgggtaaactttttgtatacttcaaattaccatttgttttcaaaccaaatttatgaaagggaagggagaaacacataagaatacacttaaatctataaaaaaaaactagtaagaacagcaggatatactgtttcctacacttgtttcactagaccaaccagaatgacttctgtagaattttgctgatatgtcctgagttgctttacatcagcactgggttgagtcacgtaattcaggcaagtgg

SEQ ID NO: 7681 - DNA, 1597 bp, Homo sapiens
  misc_feature (1)...(1597): n = A,T,C or G
ctaagacactgcacaacgcacgcgtggtgcgaccaagtgcacgtaggtaatagtagatgcgcattgcgtacaagcatcactacttgctttctgtgagcctcacgcacactcagcgagactgtcatgaacggatcgggtcgcggcattgctctgtacccgactgtatgtgactatatgtcgcgcacgtagtgttgtcgcattccttcatgtctgaatacataaacatgatctgtcgtgcgtcnggcggggccgacacacaatacgctacgcatccatatccgatcgtcgtgcagtcgtcgcaccatcgtgcgggtcgtgacnaggtgaagcagctgacatcgacatgaactgattatataatgagccataataacctcacgcgacgcctagcgaccatataagccgcatcgactgacgctgtgggggcgtagtgccaccagtatgagaaggagaggagaccaccgcaggtatcaaacacgagtatgtagatgacatacgctcatctaacatatagaagagagatatagtacgctcgatcgcgcgggacaggcatgtgagtatntggagacgacaatgacgagcagaatatattaacagaccaacacgcgagttaactaagatgcgaagaagaggatgtcgacgcggttagtcgactccacaccatctacgatgtatcgtacgagatgctcacacancncgattatcggcggctgacgagtactacacgtatcccatacgcgaacaactacacagcagtgacgaccgcgcgagcttatatgcgggacgtgactacgaagacgaatatgcgcacggcaggtagcggactgcgccgctacnaatcgataaacacaagtctactgtgagacgagagcgaccctctgcgagcgacactaggtcatgtatgatcatgcgcgaccgagtcgctacactgaatcgccggagtgccnacatctctcacattgctgagtcgtcgatgtagcggtccgatacgctgaatatctcnangtcgaacgacgtgagcacatctcgacanatcatgccgcgagatcggcgcagacggagnatcgcgaagcgcggaagacagctgctaatgcgcgtactacgatgtcgtcggtcctcaccntgttgtatcatatcgtacgtctngactaacacgatacagcaacgtgtaggtagagtacgaggacacagcgcgattacacagcgaaggtagaattacgatgcagcacnagcgacgagtgagancncatcaatagacgtctacacaagacttgtacgtaagnacgagatcatagacgggcgatgaatggtggcgcgtgtcatctacgtaacgtggaaacaatagatgtcggcgatgataatatcgccacaccggacaggacacctactacttgtatgtgaggcgaaaagaatcaataactcgatgtgtgttagatagatatgagattagagttcatccagaggtttggtttgtngcctgcggcttgcgcatgacgattgtgaatagacaaccctatgctaagtgtgaagtgaccgcagtgcgagtggactcgcgagtagcttaccagtaactagtcactgtgtcgagtgcagagag

SEQ ID NO: 7682 - DNA, 874 bp, Homo sapiens
  misc_feature (1)...(874): n = A,T,C or G
cgtcttactttcattctgttttttcttttctcgctttatctactaagcaaacatctttttatcccgcctctaactccttcaacatatacgtcttaacacagttcttcctgtccccccatccctcgctgggggccacccacctttaagacaaatgtacaccccccctggttatcgacgatggccgcggttgttttacaatttccctcccccacagcatagctaatgaaactaccagtatttccccgttgaaatatttatatatttagaccacgtttttttgttcgttccgcgtgtgtatagttaacacgatgttattaagtactcttatactccctcttttttctattgtcaaaatataaccggggggggggggattcgatgtaaccttttcacccaccgcttttttccaaatnaannnggggggtttcccccccttttttggaagaaactctacccccccccaaagaaagaaaaaaacccccccccccccgaacaccccggtccgcgggttattttgaaggggttttttattttcccccccccaaaaaaaaggggggcgagaggtcccccctgtggggcaaaaagagcgggtattttttttttttttttttttttttttttttttttttccttttttttatttttttttttttttttttttcgtaaataagtaattttacttttcattgaagaaatagttcatataagcattacataaaataattacattttaatatgcaatcataatatgcgtgtggacaactcattaaaagaagagaattatgtacaaattcaggttatttccaagggtgagaggtgagttgtttcatgcttctaactccccagaaagcaatgcaaatggaaaaaacaatct

SEQ ID NO: 7683 - DNA, 818 bp, Homo sapiens
tttcttatttccctcgtatcagggtcacccataatatttcattatcatccctaagttagaccctattttacagttgatatcacgtagacttgggacaatttaatagcttaatacgtactttgtttacaagttatctcacgcttattatgtaacctgcatcccttttcctaaaatatttgattatttgatttaccccttttccataaggtagtctatgatattgggcagaaataattaagacaaatgtcacattttcctataaaggatgatgtggaatcttgagtatttcattaatagagcgtgtaagtcacccatagtattaaaaatataaacatgtattatttcatgtacatcttccataaacatgctatgatatcatcagttaatggggatattgaagcacagtgagttaatgagagagtaactatttgtccaaatggaaacttgttctatgcattttttaaaataaaaatgttttaatctcctgtctttcattcattactaataatggataaagaacaatgatttccttttgctcgttcatgactgtatcattattcatatttcatttaaagtacaaaatatttgcatgtttaaattatgttcctttattggttttaatattgtaaattatttgctaagccaggattcctaatgtgcaataaaattttgtgaaatataattgtaaaatacaacaaccccttcatttgctaataactatacttgagacaggcactcttgagaatgcaagcttaaaacttttaagaatttctattcatttttttctggttacacaggagagtttgtagtcatgtata

SEQ ID NO: 7684 - DNA, 1329 bp, Homo sapiens
  misc_feature (1)...(1329): n = A,T,C or G
cacccatctccgcgctacgcgtgtgtcgtcccgtcccgagatagacacgcgtctatgttgacacgcctatggcgcgacactgtcggggacagggacacgataacagcgaatccgcggtggtggtagtccanaccgtatgatgactacgtgacgcgcgcggtgggacgcgcccagcatgaccatcggagaagatgaacaccctacacgatccatgcgcgcgcganaagcagtgctctatatctagcgctgataaatcaacagtaagtgcggctgaagcgagtactggtagacagcactacgtctcgcgaagtacacaaactgcgatcaactatacgcacggtcgggagatctcctcccctacgtacgatcacgcgttggggcgccgggtcatatactcaacgctgtgcgtacgagtctgcgggaggcaacgcgtctcgtcgacggacacgatcacttcacaccggcggtgttgcgggcgtacgagacgattagcaaacgtgctaacacgcatgacgcgtccagcatctgagttggtacgagaaacatctgaagagaacccctaccctggcagagaatcacagacaacatatggtcaatcggaggatgtctttgcatacagcaacggggcagncgcggagcggattgagaggggttgaaggacccggacgagtcaggagttggccgcggtcgcgtcccaccaataacaatctgggccgtcctgcgcgggcaaaggaatatgaagtcacaacgccacgttgacttgcccacgcgcagcgaggacggctgggtctcgcgcggccgattgcggtcgcgattctgcgtatatcatcgcatcacctcgctgcgtttgctcgagccgcttcgtgtgtagtaagagggggaatgaggtgacgttaatactctgtaggacgcgtagcgtgtcacgcatcggtgcgcgcatcgacgacagcaaactgacggccgatgtcagacgtcaggcacgaacgacggtccagtaggcgaagataacgagcgagagtcacgtaccagcagttcgaagtacagcgagcgaaggaatncggaacagatcaccgatgcgtacggcgcgtagagttgtaggcgaatacacgttagcggcgtcagtgctagcgtaggtgtacgcaacgacataatcactgctctttcgtcctacgtgatgctgtttcagtgtgtcgtggcgatcggcgtcgctggactctccccgcgagcagagacgcggcacggcancgtatggctacccacgtaacgaatacctgcgcggggagccgtcgtgatcgtcctgacgacatagtaacacgaacagagcagtca

SEQ ID NO: 7685 - DNA, 396 bp, Homo sapiens
catcgtatctatgaagaaagtggctgaaatgctctggctagaggatggtctccactgtgtaaaagcttcccaggcagctgcagtcttaaaacaattgtctgcagaatgctcaacgtgaccctctgcttcctggagtttcttcaggtacaaatacctcagacaccagaaagtgtgttcccaaaccgcttctcatgaaccattgaatattcaaaagagagctaaatttcaagcctactatataaaagcgtatccctgtaacacatgtgccataatacataacttctacttttgtcagtccttaccatctacctctctgaattttcatgaatttcaatttcacaagggtaattgttttacatatacaggcagtagcatacaataaaatcgatacaagcg

SEQ ID NO: 7686 - DNA, 1825 bp, Homo sapiens
  misc_feature (1)...(1825): n = A,T,C or G
attataacttaggcgcactccacactcgcataccacgtatatcacttgtaagtttacttactttgggcaggngaaacaatcaaggtgtcgggcttcttctttgtcgcgatacaactaccaacagtagatacgagtcatgtacgaatgattattcaacgaagaactcatcacgtactcattacattggtatatatgatataagctttgcacgtcctctcttttacgtctgcgtttatatatcacacttctgtctgcttcatctaaataatagtatgcaggttcgcacatacagaactaacagtgggtatgtggtgagtacgagcactaatcaagagactatcgccctaggctacatcccaacccagtgtgacggatccaccacggaacacacccatctgtaccgaactcttagtgtatacaccgtagangacgnagactnntcgagtaagnactaccaccattgagccgcgctctcaattactatataatcaggctcgaacacactctacagagcagcacagtacgcggccacgaacagcgacgacaagagacggagagacacacacaccgagccgcgtccacagcctgtgcaagccaatatcacttctacaactcacaggatgcatgcctagagatcgacgcgattgcacctaccgaccgctgctcaccacactcaccaacaacaaacgcaccattgcgtagtttgcgctccctctacaccactcccactcaaaccatgtgagggtactacctcactagtnacactgtagtaactaattgggatgcgcgtngtngatagacgatagtgtggatactacacaactacttgactatcnagttatccacgangaacaacagatntgagctcgatataagatattcatcgatcacacgngtccttgtctgtagccactcactncngtgtcgtcngtgtggatctacctcgtcccgcgantcactctccacaacagctgctgcngtgttggtgctcgacgcacgcaagacacntagatctctgactgtctgtagtnatcgatatatgacagcnaatcgagcgnagtatacaaancaacatatgtnttatcaccactactgagcaagnagtncctgntgctgctcagtgtactntgngcntcagataatcactcgancatctacaacatacgactagtacatgtgctgtgtcgcaacacagtntggcgtagcagcatcacatntgtcgtgtngcatctactgtactacatcatacantncttncacacaagcgactcatgctgtantgctgataactgntntggtctacnacgacattcgcagatnatctanaccntctcatctgcgatttaaacacgccatgagttgtactaccttctagtcactcgtctactatannttncacntcccacacacacntanatanctaatgaatcgctcantagtgtatnagttatcattngtgcntcntccatcantccacatacaatcatcacaactacntcatagcacntcatcatactgntgtatcntntgtttctgcattgntgtgtctgntcgacgtcacttaaactcacaaccatcatcantatcatcacactcatatattcatatgctcactatggtntngtgtctatgtgntgctgtaantacatctacacacacacatgcttatgtcaccatcacgatcgcgctatcatatccacagcagtncngcactcgacatcagaactcacgtcgagaatcataaatatatatacacagtgattaganatactatatagtacgtgtngctaantcctcangctagactgcagctcgataaaaccac

SEQ ID NO: 7687 - DNA, 788 bp, Homo sapiens
caccctttttgtggttttattttggccatggttttcggaaagagagaagatgaacattgggagaatgcaaatgtagcagtgactcttctactgtgcagaggagggcctctccctagcgggtggaagagcaatgacatgggcttttaaacctcgatccctgagtgacttcacggagaagagctgcatcatgaccctgacctgggtggaggtgacacaataaaaaacaaataaggatcctcaagctgcatgaaactgagaataaatattgttaatcaagcttgctacactggaggcatctgccaattaaagcagtttaaatttaatcgaaggatctatcaaagagaagggtgtataaaagtttctgtaaaggaaatacaacccgcgaaagaaagtgtgcatgatgaagctgcagagggcaattggtttatatagggggaatgggctgatgttttctatggaaacccatgcttgtgtttctaaacgaggggattggtcatcgggaatttcatgtcttaatgggaatcaaaccagggattttggcctaggagatgatttgtgagggcctctctacttgtgtttggatcttattactttctatcagtctttaaggcccgtggggttatggcttcggaatgtgcgcggagctgtaactgacctcggccctcgagacaggacctgagctatagagaagaatcccgggtcagtaaaataaaattcggcatatgggtatgatgcgtctaatctaattcttaggccgttgtggatgccacacatttaatgctgtggcc

SEQ ID NO: 7688 - DNA, 995 bp, Homo sapiens
  misc_feature (1)...(995): n = A,T,C or G
tcaatgtctggaactgnagctctcttaaccatancacccgcgtacactgacgcctttttttagagagtttttatttattcgcctctgtgtatttcttgagagtagagtaatagtgaacatttgtggtagaatagtcaatagtctattactgactctttctaccttgtgctcagagagcggtcttctccctagtatgggaggagcatcgtatataccttggcctattttacatctatcatcttcttttttgatctatcacgagatccatactcatcaattatcaccctttttctctggtgtgggcgtctaaccctactataacttatacaatacgtcattctttcttttttattttccacccgagtatttttttattattttaccctcgctcttattttcctttatattatgttctctaactattatataaagtaatctagatatcaataagtacctaaagttatcgtattatctccctcatatttcctctcttttccatgaaatatcatatcgtacccttataatactaattgtactactttcatccatcattttttcatatgtttgtttcctattccaattgttttttttacccttacccttattactattataactcgccgccgcgaatttcgacaccacgctcgttgaatagattatttatttgctatttcgtccagtttacattttgtttagtctcgtcgatatttttttctatcccacctatatatattttttttaatattatcacccatttttatttatttttactcttcgaattaatacttgtaactgaatgcgtttccgttcacaagtgtgtattatttgtatatataactttttattttaccacccttgcgcctacttatatattccaccgtatatcctactttcatatcttctctgtgttcatgctcattttttctgtatttttattttttttgttatcccactagaccgcaatatcccacttatattaatctttattatattgt

SEQ ID NO: 7689 - DNA, 1562 bp, Homo sapiens
  misc_feature (1)...(1562): n = A,T,C or G
cagcgccgcctctctctgcgccagtcatccacgtgtgtgtatcggtgcgcgttaattgccttagcgtaggagaactacccacgtcgcgttatctttcatatacggcaccatcttgcatctgcatgcgtgtttagtagtggctgtcacatatttcatctccgtcggcttatctaatactacgctggtaacgtcgaccccagcgcgtcggtaaagccgacgatatacgatcagctagtagaatagagtagaccgtatcgccgtctacatcttacgatgtcgcctcacgtccgtaagcctctactgacgcagtgcgtctatgtgttattacctctatgaactgcagctagtatcatgaccatagtgctgacttagatcatcatntgttgatcncacgctcttgcacgatttgctncatgaaagtacaccacaccgcggagagctactccgtatgttcgtcgtcagtgcgttagaattgccaccgcgcgggaacttgacgctcgtcattagttctaattcatgagacgacactattatgtccgccgcgcaanacacaacgaccatatatacatcaccacgcacagctccagccctgcgctacgcgccgcgttagcgcatctacgacgttgcgaacgcacaatacggcctgcgacgctagnactgacacatgcgacgaaccgtcattatgtatcgcgcgngtcatacggacagacgctgactatctatactgtgagntatatgccagtctacgccgatgantcaagngagtatcgtcgtcagctagctgagccggacttgtctacgattacgcggtgactgactagagtanactgttacaatcgatgtcgaacgacctacatctctcatacttacacagataagtcgcgtgccgtagatcagacacagtgctatcgtaatctcgccgagcgtacagaccctctagtaacgctgtactgcaccagtgtgactcacgcatctgcatatccgtccatcgagncgtatcgatcgctctncatatgcagcgtcgnccgcgacacatantnantatatgatataatctcntncagctccatgctcgagagcgccagcgacgagtgaataccgatctgctctaaccgcgtccacgctcctcaccatacactcacgtcagcgaaggcttaatggctcgctgctatatatgatctcatctgatctcatgcgcatgatcgtctgactgatgtgcgtcacgagacagcgagcgtcgcaccccgacgcgacgcgtattctgtgtagatatgatatatgttatgtactcttnantccatacgactcgttacanagtatcgtatcttctcacgctatatctctctacacctacgctctagctcatnactcagtgagctgtcgantctcgtagatgtcgattattcgtcacgtcgagagcgcactccactaatnatatagntgtatgtattacatgaatgtcgncaacgatatgcgacgacatcacgtctnagactcgctgatagtagtttacccatncgtcganctatcgntcgcgacgcccgacatgcatatgtcgtang

SEQ ID NO: 7690 - DNA, 813 bp, Homo sapiens
ttagagttcccatgtattgaagtaaaaaagtaatttcttgtcccttattacaaattcatctattagcattattcctccaattttctccttacaatagttcaatgttttcagcataaaaccataaaataaccttgatttgtttcttcttcttgtacaattcacgtgtgaaaggttatggcacttttccaagaaacatcctgtgagtgtgtttctcaattagccagttaatttattcttaccccagtgtcgccataggggcaactctaatatcatcctctttccggagccaatagttcttaggcagagcctacatgctcttatattcctcctttctttctttctttttttatttgatgttctttggctgtcctgtgggagagtttgtaaagcaaattgatgtcatactctagtctctgcagtttctcctagttgtatctttttataagatctgtgcattgatgactttcttttttattattccaaatagagatttactgtagaaaataccataactgccttcccctgtattttggtgtcatgtactcttattttctattttcaaatgttgaatatcaaaagaagagggtgatgcagaatcaaaagagtatgccttaggtggtggttttgcaatgcttggaataaaaagaaaatgagctacagtgcttaattctaattaagaagggatccttaactttccctcatataagaataataggtttctgataatgtagaattttttgaatcattggtgtttaaaatagagaaaatgtaagtagcattatgacagttttgaataaaatcatgatctgaccg

SEQ ID NO: 7691 - DNA, 805 bp, Homo sapiens
aaccccacctaaagggaatcggccgccaccgcctttattccaacagtttccaacttatgcccccgagcctctctctatgaaccaccgccaccaacgtctatgcggttcccttaacccccgacagaaatgaagccctgggtaaattttggggatagtactgagtgggcggtctacaaggccaaaaatcccagaggctggcgccccgcgctccccacccctggagcaggcgagatggaagcctcccaaaggccccaatagccaccgggggctggcatatctccctaggctgtccaaatcggggcctcccaaagcgtgaaaaaaatgccctttctcttaggtgaaggcctcccccacaccggagtggactctccctttcgctccgacccacccgtgaatccctttggataatacgcttctctccatccctgggcgacctcttttttcttgagaaaggtttcttctttagaatgcggagcacaccttttcctgtcagaaaccatagcaggcgctcgctcctctggagcgccccacgggacgccctcccaaccacccatggctctgtcccacgccacatcttagaaaattcaaagctgccgcacacgaacacacagccttctcctataccacgccgccgcggtgtttgattagaacagcaggacacacgtcgctgttcgttgtttgttgtccgatcaaatgacgatggctctcttctcaccttatgatcaagttctcccccccgtcccaattatgagagaaaggatgtccctcccctatcccaccaccccccctatcacgcatcgtgacc

SEQ ID NO: 7692 - DNA, 307 bp, Homo sapiens
ccttttcagattgcagcctctaaatgccattaaccactaaaatgaaccaaggctgcctgggaaaaatagcgaattccaggtctagagcaggaaatgtgccatcttgtcacgccagacagcaaaggaaccatcaaggccaccgggtctgtgacaaaaggactcagaagacagcctggagagactcctactgaccaaaaataggacaatgtgagccttaataaagataataattgcaaagaattgaaaaataacaactatgctcaaatccatgagtataaatgatagtaaaataaaggtagatcgcacg

SEQ ID NO: 7693 - DNA, 1654 bp, Homo sapiens
  misc_feature (1)...(1654): n = A,T,C or G
atttgtgtcaggtgctagaccctaagaagaggagacagcggggcgggggaggattttcttgcgccgaacatggggcgatgtgcggttttttgagggagaagtgccctccgagacgtggggcgcgccggcgccgtgcctggaagagtgccgcatctgacagattgactaagtaggctagcgtggtcacagattctttgtgggaatgccttgacgaggaagtacaactcatacatgaagaatttattatagccacattaataaactaagtaatgaaggcgaggatagtatgggagttcccgtgtgtaaagcagtaatggagccaagacgtgagaaagacaagcgaccgcatggcgtggcggattgagtgtgtgcgactatgattctatgtatcgatagtttcgtcatgatatatttctctatgtttcggtgatgtgtcggtgcgccggctccctctgtgtcgcgncngtggctcgcgtcgcgtatctgcggcgcggcgtgctcaccgacntacagcacctcaccccatacaatgtcattcgcgatcgagacagcacacatactaacagcggcacgtaagtgtacagtgatacactanagttcccgtgaccagctctgacgntaactgtgtntntctcacgctacgtntcgagnctaatcgcgacgacgttggtgagngncgacagtangtcatagatgtctagacagtcgtgagctcgagcgtgtcgtggtcangtatagagagtagagatgacaantganaganggagtagagtgtgactacaacgatgcacaagcngcgacntatgagntgtcgtantatgtgactcgcacatgatcggatgcgtatgtagtgctcncngcatcactgtcgcattgtacagctacatctcgacatcgcggcacacgttcgacgctcgcgaggtagtgtggtcgagcaggcctgagcgagctgcctcgcacgtcgcgtctangtgtctctttctagcgcactgcatgagtgctgttctcgantactgtgtagtattctatcacgagtgaccgtgattantagagtgatgtgagatccgtatgctactctcgacgcgatttcgcactgctcacgcactctcgatatacgctctcgccgcgcacttcaaccgaacgagcgcctgccggcccgcagcatagtggttgtgtgccctgtacacacgctcngnagcgcatctccgtcncagcgcgcgtagcgcagcgatcagtatancagtntgctgcaccgcatgctatgatacntacgatagacgagcgactanatatcgcgagctagnggatgtgcatatgattactacgttcatacagaatatagtatacaacgatcgcgcgcgacacgtcacaccacgctctctctttcgcatctcatcgtgtaggagcgcgatgagatgtgtgttatatccgactaaatatagtatacgacgatgangcaccnacgagtgagncagtcaacacnacacacatanaacttgctatgacacgcacncntncagtagagtagngagagnagtatcgagcagaggcaactgcgtctgatgtaacagagagacgaccgtgntcgnagtgatatgnctgcccgcatgcagctacctatcactctataacgagcgctagtgcgtgtcgctac

SEQ ID NO: 7694 - DNA, 1299 bp, Homo sapiens
  misc_feature (1)...(1299): n = A,T,C or G
acatagtcgtcgcagacttgacctcttcctctaaatattactcacaccgcgttaccagctgtcgnctctgggacngtccctccgtnnctgttgtctagaataagacgttgctgtattatctgagagtagagagcgtttacaccactgcgtggcggcgccgcaggtagcgcttgcgnataggataacgccgccggacgaccgctaccgctccgaccgcgcgcttntantagtatttatatatcacgccagnngaagaccctagacgcgagtcagcggagagagagcgcgcctgagcgcgtcgagatcaggttgactctgcttcgccactcttgctttcttgcagtcctccgcgactcgctccttgtgttatttgactatcgtctatggtgtgaggaagccgtaggtgttgtgtcttttatatctgcttcggtctccagggtcagaggtntttcaagttgttatatataaccagtagcgacaggtagatttatgttatattttatctctcgaggtcctatttgtgcacaagttttttgtgttttctgctcttcgggatcgtcgctcgcttatctgatcctcgacttcgttatctacgatgcggtatgcttgagtgctatagtgctgccaggtaacaccatcttctatatntcttatgctatattgttatggtacacggtatcgatttggatgttcctatctctcttccatatcggcggttgttatttcttgctcttcgattcactcgtgtcctctctgctctctnctatttattctctctggtactctattnatacttctgctgatcgattcctgcgtttcctatagtttccctctcgctataagcggcgnagtnnattataccgcttttatatctctcatcagatatatgcatgagggagattaggcagtcaanggaagagcagacnctgttgtatantgtctcattagcgtctccgcgcgcgncagtgcgtgtctcatcactatattcgtaccgtgcgcgatgtagttgtattatggttattggcaatgtcctgtgacgcgtcactagccgtatcactncgcgctcgccgcgagtgtgcttgatgtccgcttctgtcatgatgtgtgtgtgtcttccggttcgcgctcgcttatcgtgttgattgctgctgtgcgtgtatgttctcattatagttcgcgtgttttgtcggcgagcgtgacagtcgctgtgatcgtgtcgttcttgtgtttcttatcaccgctgcacggccgcgccatattgtctggcagttgttcatgaaggtgatggcacctctcgtg

SEQ ID NO: 7695 - DNA, 1531 bp, Homo sapiens
  misc_feature (1)...(1531): n = A,T,C or G
gtgcgtgtggttaataggtaccatacacggtacgcaaagacgcaggccgagcgcagcggacgaggccctcgtgtgagggagagaccttaggacagaaaggagagaggctcttcgaggagtagnangtatacacccgagtgctagtgggcgacaacgacgcgctcgacaggaaacgttctcatattgagggatgcgttttctcgaagagcatagtaggcaggcgagtatgaatgtcaatgataatcgctacggtatatacatatcggcggtgtggagacaatacgtaggatggtagaactcaacgatgtggtgttgtcgttagagtgcagaagggcgtgtgaatgcagagcacacagacgatattcacaagcgctaccttttacagagaacaataanactatggtagtatantctgtcagtggatacnagagcgtgcgacatgntgtatggnatggtgtgtcgttggttgcgttattataggcgggacaactccactggatagtgagtatttgaagcacgtgcttgtcagagattggtgtcgattgacatcacacagaactactagttcgagacagaacgtgacgaattgagatggtggttcagctggtgtgacacgtctacggcgctgcacccaactccggcatgacttagagagagcgacactcgctctctatcacagcatctcgtgccgcgagcgcgactacctattctacacgtctgttgttgtacgcgtcttgcgctcgtcccactcttcgacgagttgtgagtacacgatacatttatattgataaatgatagatgacaggtgtaagtggacgagatcactgcaacancaaacgtcgaatcacaacgantagcatcnagttgaggtaggcgatgacacaacacttggtgggcggcggcaactaatccgaagtgtatgctgatcggagacacctatcctcttacatctagagtgcggtttgaggagatcaccttacgtatggtgacgtgatatattggggcatacgttttcatacactaaatgtataattaaatactgtcatcagtgagattagttcttgtagaaccctagcacactacaaggagcgagtactcgtagacctacgatgtgtcatacatgtcaatccacacgctagtgtgtcacacgacacccacggctgagggtagcagcgactcgcaaccaaatctcttattcttcgttctgngttataagtacagtgtctgttagactcacgcggatacaccatnactccaccttcttatcgctgtacgtggttctacggttatagcggtgagtcgaaggagagtaatatatgtatatgtggacgtatntataatgtgaggtgaggtgagttaacacaactattgtcacctcaatggtcatcggacgtgtggtgcgtgtgggcagacagccacagacggacatcgtattgtgtgtcttagcgctatcggtgtactctccgttagattaacgctggttgtgaataacaatacatgtacaacgatgctgagccgtcgagcactactg

SEQ ID NO: 7696 - DNA, 2189 bp, Homo sapiens
  misc_feature (1)...(2189): n = A,T,C or G
ccagagatacctactacgcgcgcgacggcgacacccggcagagagctggcgtgncggcgggagacnagaaggaaggaggcatagctagtgtagggacgggcaactctgagancgagcgagtagggagagctgtatctctatcgcgcgagtgtcagtatagcccacananatgcnacacgcgcggcgagcatagagtcangcntgtgagncntactagngcctcgctgcgctgcgcaccgcacgcacgcgctcatgctcgcatagcagctctattgtaggcggcgaaggaagatcacagnaactgcagagngnggcgtagngaaccagcgggtactgnagacgcngacaatcgcgacgacacatcgctgacgtgacgttctcacanctctagcactgtatactagtgactctgcngcagtatgacacggagcagcgtgtcgagactnagccgaatgactaggagactactgtcgtgntcaggcgaccgtgcgacnacgtngntcgacgcncacgancnagagtatngtgtagagtcacgtctccgncagtcgtatgatcgtaggctgcggcgcgtgcangtactataacggtgtgtgtagtgacactgtantagactgcatgggangtgtcancccgacagcgctatgtcgatgcattcgacagtctcgcnactgagagccgantccaggtgtcnacagagcanaggacagcganacgtgnagggngangcctgcgcatgnctanctgactactgatangnagnaggagcactggtagaganagtcgagcgtctacgacgtcagtcgcgctcgctgcctccgacgctggcgtcntcactgctgcgcgcgngaagnncgctacanttangtctcagcagcagcaacatnctatcgacgataaatgtcgcgtntgcntatacactgcaaagagacaanctacgaaantgtgcatgaagactgtgantgtatngntgagcgtcgccnactgcgatgcgcgcgcactactgtgtagtatatacttcgctcgtacgcatcatgnctgtatatgatatgtgacatggctgtagtntgagatatagtgagaaacactgacacactcgatgatggtagtgcacgnantatgngacacgcgcancgngacgaggatgntngngntcgntnacgcgtcggaccgtctgcgactcgtncgngtgcgctctgcctgcactctcatctagtagtctgagcangacnacngntcacatacagagttacgctcagacactcatcgacggtgtgaagcncacgtcgcgctgacgcgcgtacatcatggcgtcggtacanggtggacatgatagcgagacactgacacaactgagctagtgcgcacccacaagcgctcgtacgacgcagacgagctacgtacnancagttagtcgtangacttagtgtntctaaancactactantatatacacactgtatnatagcagctcggataggncgagtgctgatcgtantatgagatagtcgcatcgcgtaatcgtganatgcntaatagtagcactgcagacanacactatcgcagtcagatgtgatgacgctgcacgngtctcacancacgactcgtgagcacacatcactaatcacctagngcgacagtaagtcgcgtcagtgtgtgtgatgcgtagtnacccggtgcgaagcgacacggactgaccgatcancagcacgaaatngncgtagtganatcagatgtctacgtaggtntcggagganggcctggtngntgactagtagtgaactgagcgatacgcagcatcagatcngntcacagtcatgtgcgtcgtgnactagcagncgntgaggcgatgangctgtgatcggtcgccatacactacncgnacagtacactgcacgcagcgcgnctncactgacgacgntcngcgcacnatgnacntgcgncgancgtcngncgnatngtgtgtcctatgagtangtgcancattgatcggcggagaccatganctgatntgactcgaatcatgcatacagncncgacgantcgtgagctcgacagctatacgactgctgcagtcacctacagtagacagatctgatgnatncgcagtatcagatatgngatcgacgactgcgcgnngtcgncgcgctacntgantcagctcgtctagttcncgcactatactatcg

SEQ ID NO: 7697 - DNA, 1908 bp, Homo sapiens
  misc_feature (1)...(1908): n = A,T,C or G
agtgtctgtgttgtgttataatgcttaacgccctgctccgcctggggngtgttcttancaaccgtggactcactcgcactactctcatgtggatgctttatactagcctacgcgcaatattcctgtgcgtatctcgacgtctcacatagtcgtccgagcgtatgactgcgggggagattgaccttcatatctccagtgtcatgaaacgcgggagagcccgagcggtgtaataattaggaagtgtaactcgcaatattgcgagtacttcaccaaagacagagcatacggagtgagtgacatagacatatccgttgcttcgtaccataccctcagttctgagtagacgaacgtgtgctgtgaggatgacagtacgctccgagcgtagacttacggacctactgaggactgttgctcatacacctattgtagagcactttcgtattagagaagagaactgcgcaagtcaacactcgaggaggtagacagctgcgagtctatgagcggtnagtgacagcacggtcataggcgactggcgtgaggtgcgttcatncgctatggagcagttgagtgatgtttagtgagctatcgccgaattgacaccagcgtagcncgacatacgtcagtgatagactacaatgatgattataggttgttgtagtttggtagccgtcgtcgtctagagtgtgtatgtggagttgagagtaagatattgagcattcgaagctatagntggtgctgcagtgtagtagtagntgatatggagagtttgtacgtcagtgtggtgcgatgncngntgcagctatccgatcgtgacggcgtggttgaatccgctggcagcttgctgcanctgtngctgcgtactccgagtactgcatcgatcgtgacnatcacgatacgcgtgtacgcggaactgacaaccangacgatgagagcgangtcgcgcgacggtcatncagtacagtatgngtatcgatgtagtcggtctagcaatgagntgtgtagcatgcaatctanacancagcacgagtcnacgagcatacacngcgacgngtgagtagctagtgtcgatngngnaggtattgngnagtagcacgcggcactgacgactcatatcatcacgtctacntctngcnagtgctcagacgctagattgtgganacgtgacgcgatgatgtactatcgacangtcagtgatgatgagtnacgtagtgctatactacncgactgcatgatagctgatcgtactgatntatatgnagcatgtnatgagcagctatagcgtagntangtacgacagaggatagactgattggtgctgtgatgatagatnatgtatccgtcgatgtagctgacgtaactgatcggtctacgatcaagtantgnatcagntactagatcagatggtcnctgaagtgnctntcgtcatcatgcgtgtgtacgcacgagtcgatgaagnncactagtcacgcagcagtagtagcactgnagntacgtcatcngctgngcatcagcgagncagccgtagacgcagcagcgcgtacgngatggcgganagcatgcttngctgnganangtagntactgngttcngttactcagtgtatcagtnatntacatgatgancangtcatgatatgtgttgacgnctnatgncacntcatcgtcngcantancatcanctctgctgctgacgtcagtacgtgangtnatnatcagcgccgacatcagtcgncatctttcngtctgacgtgntacgacgatctgntantcactacaatcctanctactncacgatcatcgtgatantcagncagtagtcgtantagtgatgtcgtntgangcanggtctttgangctacngttgtnngtacgnatancnnaggatgtacgacgtagtcagcatctactg

SEQ ID NO: 7698 - DNA, 1332 bp, Homo sapiens
  misc_feature (1)...(1332): n = A,T,C or G
gccttcgcctcgcacaccgcacctctccttaaatccatctcacacgcctcccagctcccgtgacacaactagactcccacaatgagagccaaatcgctctcctatcctccatncctccaaaaataacgcgcgccctctcgcccttacgaagacttgtcctcggggatgatgtccggcagggctattctgccacccacgcctcagacatttaggaggaggcaagtcaatccttccacactctcttactcgctacgacatgctcttcactcaactcccgcatctcacatcatccgcgcgactcgcctcaccgcccattctacacacgctcatcaccaattctctataccccctcatccaccagacgatcttctgcaccctaccactcactctccaatgtcgtgaaccatcccactcactaatctctcacccattttcatccataattactccctcatcagcaccacacagctcatcctcactatcacatacacatcggacgcgactgcgtcaatacctcttaccacgacacgccactcaanccaacacgcaccgcagttaccgacacagccctancaccagcgctcccacacgactctccttcatatctatctcctactactccccatctacactagtcacacgccctacgcctccactctatccgcccctcgtccaaccactatatagccacgcgcgcgctcccttctacgtctctaccacacatcttatattttcactctcaccacaccaccacgctaccgcctatcgctccctcacccattaccactatcctnctcttcatatatctgctctcttctatcgcaacaccccaccnactacccattcactatcncatcgcctcgctccacaccacacacacctacacacatcctcctcctatancactcccgcgacaactccttacctccacaatactaattatcctcacacgccacactcnccacactcccgctaagttctcacactaccacccatcatatcctacctcattaaccctataaacacctaccactgtacaactcccacactacctcagacactaccgccgccgcgcacatcactgtccaccacttgcaccacacctcctcgcgacaacaatctctctctcctctcacactctccgctctccccacaccaccacaccaccaccgcaccacatcaatagcagactcccgccacttcatcccgtcctcctctaccacgaccacaacacacttccntacaccctacctcagcgtctctacccgcaccttcacgctctatcatcaccacactctcgaggccacgcacaacaactacaccacaccatcg

SEQ ID NO: 7699 - DNA, 1551 bp, Homo sapiens
  misc_feature (1)...(1551): n = A,T,C or G
ctgcttgtgcgttgttatagcgatcgccatgtcctggcngtggttgtgcggagtagtggactctgatgatgagctagacacagtntgatgtaagtggacgaatgtgtggaacggatggatgatccatcgagcgaccgcgcaccntcgtgaatcgtctnctgagcagtcatcgtagacgccatcgtcgcatgacatnagagtcgtcgagtagttcaccacactactccctgcacaggatcaattgtccgatattactacanttgtctcgtgttatatctcaacgtgtgtctgatgaacgtgatgtctatgcagtgtctggtgcagcaacgataccacaccccactactcgactctcacatacactactacagcagctcgtcgcactgcgcacgagcgactgcaaantaaggtcgatgtgaattagatggtgcantgggcagtagagcagcgcgccaggagtgctacactatggaacagctcccgcgaacgcctcgccgaatcacgtctagcacgatcaccncgtagtcgctacacnatcacaccaagtgcaacacgcgcgtcgctcgtcggcgtgcgcctcaccgactcacacactaatcaacggtcacttgtggcgagcgcctcgtcctccgcacacgcacntcgtgtcatacattcgacgacagcttctaagctanttagtaagctgatcgctcgcggcgactcatctctctacatagtttatgtcctctncaatgtcttaccgatacgaatattatgtcatgatggtaatgatcatatagttgaagtatccatgatctgattatcatcttcaatgacgtgtcaccgtggtatgtattgtnagatatcactgctacacangcgagtcgcgtactcactctctctgcgngtgtagtgagaatcatgcacccaccaatactatcacctggtntngtgcggcgtgaagtatgttctattatcatgtctatatatagtctggaggacatctggtcgtagacacacacgngtgtcgacaacacgcgcatgcagtgtgcgcgnagtgcagcagagcacactcccatctatcagaacgaccggtgctcacgctgcgctacgcccacgtctccgtgctcgcactacatcgtgttacatcatctctgttggtgtgtgcaatgagtaacacacgtctacatctttgctcacgntcgccctacacacagtgagcattattacnagataacncagcacgctacgactgatcagtctatatanacagatagncgagttggacgtgtgtagcntgtgangntacctgcacactagatcagccacagaggatcgggcagcatcgacggcgagcgacgcggccgaaccaccactctccggcaccacnactcccgactgnacactcgacgcggatgatatgacacggcaacaactacacacacgtgggatcagtctgtctgctcttcacgtgctcgcgtacggaatcacgactcggttacaatatacacacggtcagtgtattactactcgcgaggaacgaggtatgtaggtgctcatcgacaccat

SEQ ID NO: 7700 - DNA, 1221 bp, Homo sapiens
  misc_feature (1)...(1221): n = A,T,C or G
cgttttggtggtatgtcaacttatggggtgagcggggcagcgagagagcccttcttggggtaaactcgcggcaaccagaccgcttatcagggcagcaacctacgcgtagcacttgcttgtagaatgcgagggatgagagccggtatttttatgggcaaaggagggaatctctcacagacacgtggtgagttacacatctcggggtcgatacaatagtggaggaaagacactaggaggcgtgggcacacaaacaaagatggggtggggcgacgacgaaaaaggacaaacgtacgccaccaccgggggcgacgacacggcaatacaatgaaactttgtgttgttattactctttttattgagagtaaatactttttttttaggaatagacaggggcaaatggacaggcacaaccgtggaaaaatgggaccacaaggagaaaaaacaacatggaacatgcgggggacactgcacaaacaacatggggtggtagtgggttacggcgacaaacaccagnggggaaaaaccacaaaaaaggcaaactggttgtgggacgctcaacccacacacaccgggtgggatccacaatcaacggtaattgtgtgcggaggggtgggatgtggagaaaacaaacgagagaaaactaggggaacagtggggtggggtggcgacagaacggaggggggacaacaaggagtggggggacaagccaaccacaccacaaatgtggtgagtttagttgtcttatctatgtgttatggttgtattacagagggacacaacgtgggaaagaacaagggggtgtgtgggggggagggagcaaaacaaaaccaacacacctgggtctacggggggggctctcggtggtgccgctgcatactaagtacaaagtggtgggtgtcagtgacataactaaacacaagcgcgggcgtgcaacgctgggaaccaaacctcgcacgcggcttgcatccctcggtgtggggcgaggtcggcgctgcgggtgccatcgaacataacaatttgttagtctgctgcagtcccttcgctgtatgctggaagatacaaacacacgtggtaactcaaatatgtcgactttgtgatgtggtggtggaacacaacaacaacggggaaaaagtggggacgaaccatggcggcggaaatagggggttaaaaataaactaggatacatataataccggggcaatggacgcggaggaacacaac

SEQ ID NO: 7701 - DNA, 1861 bp, Homo sapiens
  misc_feature (1)...(1861): n = A,T,C or G
cactgttagctgcangcgcgtcagctaacccctcgacagagaggcgtagagtgctgagcgaagacgancctcgcngntgtgtgnaaccgatggtggcgcgngagaccgcttttgagaatganagggtataacgctcacgattgcatcgctggcngtcggcgagcgtagtagcactcacgtaaagtaaangtgagctggcgtatctattacattgcttcgtctagatagatgtgtgattgtgagtctnctcggatcngnatgtgtcagctggtatagtgcacatatgatctatcgatgttatcacgatatcatagatgatcatgtntcgatcacntgcattntctgctctgttctcatctcgcgtagtatgacttntcgagntagactacgtnatgcatgctgcgtctgctgcgtacgtgtatcagttctacgctctnctgtntccgtactcgactactacctgcgcagcancagcagcaggctcgcacagactgcanacgcngtcacagtacacaagatncagtctcatangtaggtagctgagtagantatgagtcagtctacnacgtcgacagntagatactatattgtcagnactaccttaagctgngtagtcgacatgcgcagacagcgacaactaggtacagagcggcagtctagacnagcnatcgcgcatacgcgactagcggcnctacgcgagtangaacgactacggcagcaatacatancagcaccnaacntatgagcacactcngactacatcaaatnntctagctaaacncactancgagttgagtgatagntgatgttcgtgtcgcgctactactataacccgagctgcnntctctgagtagnagatgcatggatgatcactgagngcgcgcgtatgtgcatgtgcgtcacgaactcactcatatcctcgacagcgcctctctgctgtgtgatagtctcgcgactctgntactagcaatgctcgatcatnagtgctaacgtatctgatttctgcttgatgatcgntgactcatgaacacacgcattgtctangcgtgcaacgtcgcacagcgcanaccgtacgtantacnacgatacttgtcnccacgtacgtaccgcgcgtcancntatgcgtgcacatacactgactatcacaactctctgantacacagttcgcgcatcttgttcgctacactcataccacgtcatcacatagtacatatgatatacataanatactagatactgtattgtactacantaactttagagatagtacacgtatattgaacgcatgatcgatataaatgacaatcatctanctaccgctatggagtatatgtcataccgcacgactgctgttgctgctatgaatgatatatgatatataatacctaatcatacactactattatagcatcgtgacgcgtgagtcctatatagtgatcactcagacatactgaagacatgtatntatgttaagaccgcacagtagctgatcggatttaacgtagtgatctgcggaccgtgatgcngctgcagcgtcggcgtagagtctgctagtgattctgcatatgtgagtgatactgatcgngtatctaccntatatactattcctgaccgcattacgtatcacgaaagaattctggatctagaatctatcgcgcgatatcnagcgcgaacacgtctgcntctcggaggacgngcttgttgtcgattcaacgccacggctgctgctattgtgtctccgctgctcgtgctgtggctcgagacgacgcgagagagctgtattgtcgcatatctgatactatcgtgtgtgcatcctctgcagaatcgaaatggcacagcgttaccagtcgcactcctacg

SEQ ID NO: 7702 - DNA, 1237 bp, Homo sapiens
  misc_feature (1)...(1237): n = A,T,C or G
gtggtgtgagttaatcgcctagagaggcggagaggaggggactcgagtgggaacatggcaagtgtgactttcggggatagaccttataggtgatttgtgtgagagttcagaaagtggaggttggagaggaggtggagatgtaaaaattgatttattagcttttgagataatagataagtcggtaaaaaacatacgacggggganacatgaatagaatgtgtgagacgttgtactaagacataatcgctaagaatgggagtctatcgtccatgggagataacgacggtcaaaccagtaacactgtggggttaatattccgggtnttgggttaccaaaactgtattgcacacngtatctccggtggcattaatggagggcaccgcgagtgagcaagtggagaatcgcaagaatcctcaaaacaatagcaacaagcgtagcatagaaaatatgaacactatgttagtttgattgtntctattatcatcaacaaatgtgtgtacttacgactccatgttatggacattgtgtgtttgttctacgcttgccccataacacactgtgtgatcataaataataactntataaataggggagtggagtgggcagatgtgaaatacaaaataacatagcaacatttcacaggcgtaatgggtcttccagcaacgtggtgggtacatctcccgtggatgtagagatgcaacgctatacggtcgcatgggagggataggtgtagaacaaatactcaataaataatttgatgtattgttatgttacattagtgttaccacattcctggtggcttgatgtatttctgttcaatcatcatatcttgtaatatgtgatgatatatgtgcaataatacagtagacaagttaagacgtaagttacgagactgtaggtgtaagactacacaacacaacagtgtgcgtgctaggacacgtgttatacatgtaacataaagattatcgtcgctgttatatgtgttttatgttgagagattgtgtgtgggtatggtcaaccagcatgtncacggatgctaagatatacgagttttattgattctaaaatacgtcngcacatcacaacgtagcagcgatgtgaagagtgtggtgtcaataactatacttagtcacatatgttggatagaaatatgttgtggtcaacagtggtgtgtaaaataaaagagatgtttatactaaaacaccgcgcggatatatatgtagtgtggtaaaaataa

SEQ ID NO: 7703 - DNA, 1161 bp, Homo sapiens
  misc_feature (1)...(1161): n = A,T,C or G
ggtgttgttagaatcacacgggggggcggggcggaaaacctcagtgggaactcaggagggagctggcgggaagaactcgactgcctaagcttgtgtgggtcgcaggggggtttgagggcagtggggggggctcatacacagtggtgtcatttcgtgtgtttcatggggtataacatatggggggtaactgtgggatagtggacttgaacacaancgactcacttggctataccaacactgaaaactgtgtggaaataggggcactgggggtggcgtatctgtgggtgggtgtggaacaacattgtgttttatgtacatcaaanggacatatgtgttcaccattactcgcacacatgtgcacattactgtggaatactacgttagtgatcgtgggaacacacaacatgcatctatgttgtctctgtggtggggtcctatgtgctgatcggcggtacttgctactaaaatacctctgtgtttgtgcatcactccctaccacatacacgtgttatcattatatccacatgtaatatatgtggatgtgtgggttgctactacttagtcgatcatacaacacacccatccgctgggtgggagaaatacacaccagtgtggttgatatatcatctagttttgtgtcatggatctaccaacaccagacaatctgggtggatgggcgatacatatacaatgttctctatggtgtggaacattttgtctcactatagtgtattaactactatagaggtgtgagggttgtataatattgattatatnattggtgtttgttttacttgttgtactatcctattcattactacctggtttgtttgttatcatgtgtattgtcacatataccacttcacctttgttgtgtgtgagtggttcattatctgtcgtgagcgatacttactctatcttctctaattctgttgggcattggtatgtggaatggatgtgcgtgtaaaacacaagtgggtgggtggcgacataaaatctgtatatgtgggtctaatcttgtgaantaatttatataaaatatgttttgtgtgtgaaacaaatatcaattatacattngtactaactcttcttgcttatctgcgttgttatatatactagtgttatttatatacggtgtgatggttgtcgcgtggccacaag

SEQ ID NO: 7704 - DNA, 845 bp, Homo sapiens
  misc_feature (1)...(845): n = A,T,C or G
tatgttccaaagctagtttacccnaatggtaaaaattcagaggtattacaagcgtgatctgattcttcatctcaataaaactggggactgcttgtncagcaagtagaaaatggataaagataacatcatgaatgcatgtttctccccctcttaactttatctccctcctgaagtgactccagcaatcagataagtaattagcagagtatgtttacaaatcgctgtgaaggatgagttgggaaacagaggctgaatatacagtatccccaaaagggaaatgttcataggtagtataaggtttttgagaaggcaggccatgatgtcattcaaagtatagacaaactcagtaaatactggtgattatgacatacctatttgttctccatccgaaatgcaaaaattaaaaagtctgattgtatcccagtatttgtgaaggtgtggggaaatgggcaccttaatatttacatgaatgcaaattggtggacaattttgtgttactaaactttaacctatcatacttctttatctgaccattatctttctaagcctttccaggtacacactcatgtacttgcacaaagatgcctgttttgtattgtttgaagcagaaaaaaattaaatgatactttaatgtccatcaactgaaaaatagctaaatggatcataatatgtcaaaactatgggctatatactgtatttaaaataataaaatgaatctacatatgttgacatgaaaatgtctataggatgtattgtttcagtgaaaaaaagcaaattgtagaaccatatgtgaatataactttagtaaagaaacaataaataataaaaaaaaaaaaaaaaaaaaa

SEQ ID NO: 7705 - DNA, 988 bp, Homo sapiens
ttgctatgttacacccccgtctgcgtccggcgaccctttcggtccgttatgataggtcccttatggcgcattgggttgtactcttttttgtctgttgctggtggggtggtttctgggggagcacaaggggataacgggttccctagggggttcattgtggtactataaatggctgtactacagcccactgtgcacaatcaggcatagtgtagtgagtttgggtggtcgtttagctacacatgggcaaagacaaagacaagggaacaaggaacgacccaggggcaaaggggcaagcgcacgggaggcgggagggacaaaaacaacaacaaaaaatagtgatggatgggcggggcgacgccgatgtgcggggactcgtccaccatacacacccactctgtttgccatcacctccacactggaccttgtggtactctacctactctcctgtgacacaactgtggcgtggttggtgtgctgtctattgttaccaatccaccttactactaagactggtggggatagccacaaccggggggtgacacagccctcatgtctgtactcgtgtacggctacatcgactcgttggtgtcggcgaggtaaacaccacactgggctgtgttgggatgtcttgtagaaacaaatagtgcaacaactgggcgtgggtggtgtatcttcatcatatcctttgtctggtcaacgtcacctccactgctcgtggggtttggcaaacgggtgggacacaacatcacctcatagtggggcgtgtgcatactcatggtcccccaccatcatatcttcatcttcttgtatatgattgggtggggactgacatataaactggcattgctttacatcgcgtgtagtggcactactatggtattccaacgtttaactgggcggtgttcaaactcccccgacattcttgtgtgcgcacgcgttggcactgcaactaaacgggtatcatgcggacggtgagcatgtgtcacga

SEQ ID NO: 7706 - DNA, 103 bp, Homo sapiens
ggatgcagggactggatttaccatttcaccccaaataacttaaaaactggacaatttttcctaaaaaggtttcaaacattgaatatgggaaacagggaacatt

SEQ ID NO: 7707 - DNA, 901 bp, Homo sapiens
aattctatacgtatacaataataatattagaataacatagagtggataacaaatagacgtgtagagaatgatgaatgagcgaaatagcagtcaacaattagaattaaaatatgatgtagagaggattgagtgaagggcttatgaaaccatgttttataatttatcaaaaaataaaaaataacatatatgttctagtatagaagtgagagaaaaataataataaacaacagcagtgggtctggagaggtagattgaatagaaagtaggaaatggaagaaaaataaggaatcatatctgtaataaatgtcaacaatagtataaataataggagaaaaaagcatataaagtggtcagcagcgataaatcgtacgaaatttagtaatgactacaaataaaaatagaacaaaacaagaaaatggagaaatacttactagaaacagtgtggagagtagtgaacttcagagttagttgggtctctcccaatcttcgcaagagcttgctggtagtacagaaatttcacaacttccttaggttataagtcatctgtacatatagggagctccagatatctgcagggactgttcttgaggatttcactgaatactgatcagtacttgtgtgtaaagaaatgacctgagatgagggaaagaattaccccaaagaattggaggaaacaattcacagagatcacaaagaaatggaaatgatgtccatgcctatcagaattatgggtgaaaaactcaaaattcacagggaaataggtggagtattgagaagagtttggcttcaactgtgagcctaaacttagccctaaacttaacactgtactggtcaaagtctaataaagtcgtatgcgacaagccaatctcacttcaactcggcaagataaaaagaaaagaaa

SEQ ID NO: 7708 - DNA, 1558 bp, Homo sapiens
  misc_feature (1)...(1558): n = A,T,C or G
ctatatctcnacatctgtacgaccactccgccatgtcggacgtggagagctgggtagcgacgatgtgcacttgagtagtgggagagacccttgggatgggtgatgagtacgcttttgtgcgtatagtattacacacctgtgtgtgcgcatcaacaaatcgtgtagaatgagtagtgacactccaatgagtccgtgtggtctatgcgtgcacacgtattgtatgataacgctacaccacatccgctgcgtngctgatcacacaaaattgagtggaatacacaatcaatagtgtcgtcttcacaactaaacctcgtgtctgtgactacattcagtgtcactatatggtggcagtgacagacacgacacatctataacgctaccatctcgcgatcagactaacctaccaggcgtgactacagcgccgcggtcgcgctctgagccgctcttagcgtgtgtgtatattctcatacggttttgtcggtcatacaccagacacgtgtcgtacatatgtgaacagactgtgtaacnctggggcggcaccgcgcgagtgccgtcgaggtggtcgngcactgntgtgaaatggacgtcgggcagccagcgcacgtgatgacaaggcttccagcacacacacgatatgatatatatagcggtccagtcctttcgagcacactgttgtccgcccacaccgcgtccacatagcactcgtatagtgttgcgcactccgctcggcgtccacgactctccntgagttgtacatcactcctccacgttttatcatagagcagcgtgtgcaggctgctatggtctggtgatataaattagtatatctagttgtcgagactntgtgttggtttgtgtctacactcacatcgtgttgtgtatcgcactccaccatcgtctcngttgacactcgnacacagcagcatgctcgcaacatatgtgttgtctggtgcgcgtctatctacatacaacatcgcgatattgttgtgttatgctatctacttccgacattcaccatcgatgctcgctctcaccgtatgccntgtgctcgtggttgtctcgcatacaccgtaaccattctctgcgctatcatcttgtgtgacgctgttagtacgctcgagcacatagtcacacgctgagcgtgtntgtgctccacaatgtgtggttcctctctcgcacaccacactcacttatgctgtnactcctcgtgcttcgctactatactcttctatctatatcaatccacanctataacaccacanttctaattctattctcaacatccgctctcgttgttgtctgtcatatatctcactccttgagtgtctgtgcattgcatatacttgtcgttgttcgtgtgctgctccacctcactcgtgtcacaccatccacctcccacaacactgagggtagtgtgcggagaacacatcagcncntantgtgacaatgatgatgtcctaagacgttttcatgcgcttctgacgtgcgcttctcgcacgagatantatgtgatcgcatgtagtcgacgcgcatgatntgttgtggcgcgctccgnagt

SEQ ID NO: 7709 - DNA, 1758 bp, Homo sapiens
  misc_feature (1)...(1758): n = A,T,C or G
ctagctttattcgtagctagtcatatacacgctccacagttctctatcatatattacctgcgcgagaacanacgatacctaatgtatagggagaatcaccactactgacatgatgnggtcgacgctcatcgnagntagtggtactcacacaccctcatgcacgtagtcgtgctgaatcgcgtaacntctcgantcncatcgatagcagatagtccgagctcaccgactcagagacgcgctactgtagacgtagttgatatcaatcatctcatatagtacctctcgttcgtccatactagtgctgtcgttgacgattgccgccactctaggtgtcgtgggacaccctcacgctgctctcgtcgtgctcgaacgcaccgtctgactacagntcagcgtactcactctgtcgctcccgtgcgacgcctcaacatcactcatctagtatcgtatacttcgtactactcactngtgtgtcagtnacgaatcgtatagacantgactcactagagtgatgtgtatagtatattntagtcaatcacgttatatcatataagcaaantacgacgtcgtnactgtgactaactngataccacacggcatgacacgcactcgcnntgtgggagcacaacggttggcgcactcactacggtgcagctgtcacatatcgggtggnatggctggcgcgctgcgtatttgcgccntcatcacccatacacaaggtcgttccacatcacatcatcacatacactagtagatagcgcgacatntcatatctctgagtctctcacgagagctcgaacggctcgcgacaacacctccncgctacatcaacattaatnctctngctcatcacgtagagcgccgtgtgtgccgcactactactctgactcgtacttcggcatcantcgatacaatataactacatacatcatatcataatatctcgcgagngacgtgaactatgatgcgagtagcacttcaacatcccatctgtggactagcactacttccgcacgcatacgtgncgagtagcangactccacatcatcatnagagaatgctggcaagcncgctgctacatatagagcgacatctcgttcgttactctcgccacatactactatatatctctcagtcaagcnttctgcgtggaccatatatagtgtgangtatctacattcgtatcggtatncacacattataatcgcgcgtctatatcatataacactgtacacactcntcgcatgtagtaagatgacattagtatagatgtttaacgcgcggtngnggataacatatacgagtggcgtnttgtgtgtatgaacagtanttactgtgtatgatgtgtcatgtaattatgagtattagcacaccacttatgtgcgtcaatgatcagtattatcgctgagcgagcctactgctgcacataactcatatattaatggacgtcgatgtatngttacatcaccgtggttgcgacttcacactngtcgctaccgactgctctgaaacatactcngcgatgacgcgtgtccgcgtcggagcagtatgtgtacaagtagtcataatcttgactatgctacctcgatcgcttcgctcatctctgagagacgtgcgtnggctatgtgcgtgtcgattacataatcagttgtacaaataagctgcgtgcgagcgcaatacgtcgtatcgagtacgctatagctgtgggannggtggcgcggaacacacgacgcaaacatcctaaatcttagtcatgga

SEQ ID NO: 7710 - DNA, 1871 bp, Homo sapiens
  misc_feature (1)...(1871): n = A,T,C or G
cgctccggttactagacaccatcagccaccactagtcgggtggtgttgagggtgggtgggaatcacactatttgtgtggtggattaacacagctcgaggccgcgtctaggctgttataatctgttatggaattaccgccgcgtcgtgttgattactctgtcgtgtcaggcactgtagatcgcgcatagcgctgtcagtggtcttctcgantntctacgcgtcgtgctgtgtgtgcgagtctgacactccgctgatgtggtcgcatagcttccaacttgctcagtgactctgctcctctacgtcgcgnggcgagctaaccattactacatttcgcggttgtcatgtatctagttgatggctgtcaaatactgcgctctcacagcatacatccagcacacntggcacacgatcactacaggtgggcgtactacantacantgncactcgtatacttacatctnagtgcgtgtgcncnatgntgtctgctacactaggngtcgcgactgctcgctgcgtatgaggcagncacgatcacactcantggtccatcacatatgcntcatatgtggtggggacacanagagnatcacanatatgacganacatacacactgtagtgtatatanacanacngagagcacntgctaactctaacgtgcngngagcatcatcaacggcagagacaatatngcagacaagctggantgtgccgctgcgcgagcgcagactcacgtatacatcncaaccacatcnctacatacatgtacctttngcatactggcagcantcgntcgatcacacttcactngttgcgtcgtcgcatctggcgacctcatacacacacagcgcaaatntgttgtcgtgctagcaacacgcactcgagccactacggcgctctggngntgatatccacaacacagcactctcntgacacncactacgntcgtcntgtgcgcgcgtgtctgatctatctgctatgtggtgtgttgatagagtgcaaancaatccntcgacgangcacatggtgtgtgtgggtgagtcgtcaattcgacacangtggctggtgtgtacacacntcatatctacacgtatgtgtgtaattggtgttacgtngtcacactacgtcaacagtgtcgcgtgcgtcgccgtgtcggacaataccacanatgtgagcgtctgtctgtcgtgctcggacatctgagagaatacatagttgtggacacacacgatggtgagggtgcgcggcggggaagcgtcataagcacaacatacactgtgggacgatcgtgtcatctatatagaacacctncatataacaacataatcatagtgngtgcgtgtggaccacacagcgtgcgctgggtatgaatacacacatactatcacatgtgggtgntccgtcgngtcgtgactcacatctcagcgangtntgtgggntacanagcaatgatagacgcgatacagacgaatcatantatatgtgtcgtagatgtgtcatatcgctcgcgtgcatatgctgcgatttcgcagtgntgntgctatnactntctagctgatgnagtacataccgatatanagcntantcatgtgcgtatcngtcntgctctgcgctctcgtcatgactntagtcgttanccantcacaactattatgagtacatacatctgtgcgcagagtagtgtgagtgagtacnttactcacatacacagtatntgtgtcacncggtcgggtctgtgtggcgcgcgcggagcagaacncggtgtcgngatagtgcgacatgaggtangatcantacagcatgatgtggtagtcactnatcacantngtggtagatgctgctcncacncgtacttgtgttctccccacacctt

SEQ ID NO: 7711 - DNA, 1789 bp, Homo sapiens
  misc_feature (1)...(1789): n = A,T,C or G
gagggatggagagtgcaggacaccaccacactcgtacagccaggcggagagcagtggcggngagacgatgagcagctttagntagtgggaggaaaacagcagaggaggagtggagcagagtgctcncgcgcgtagaccacgacaaaccacacgcactgtgggtcgntgattatatgtcgttgtagcattctactgtgtagttcatcangcgnatgttctctattgagcagtcagntagtggatagtgtgtctgttccgctatgacgatctatatgtagtcatgtcatgagtgagaccagtgatgtgtgtggcagtgagtgactatccagtagtaacagngcnacagcgtacacttcatgtatcagctgggtcgagggncgcagtaactggtagtacgacagtagactcgaagcatacgatgcatcatgagagcacngtgtgtggctacagcanagcacacagccngaagaccaatatngngngtgttgagatacngttgtgtgcacacgncgaagacaactgtagacggtggncnagctaaatctaactcggcatacacatacatcantgattgtnattatctatgcacatatntnactacacacagtacatgtggagatgattcangngagtcatcaacacaacttgtgtngagntcagcatngagtgactctcagatgctacgtcggtgcgacgccgtgagntcgtaccacacacactgacacgacagagacataanctatntgttttatggtatngcatactgtngctgttgagtgcatctacgtgtgtgcgagcacctgacgcgtatatagagatacanctacgaataatatgtagtgcacgagcgcgtctctgcctccccnctgcgtccgcttntgtgcatctcatcctgcantgnctcatttactcacatncgacatatgatcatgcatctntggngtgantgtaatnactgtgtatccatgacatagctaantcanatcgagtacacacggcangtagtgatgngagtagtagcgtgcgtccatccgctctgacgtgtcgatgcgggctacatanttctcgtcattacncgtgtgtgtgatgcgctctgntggncgacacattatgctcatggtntctccggctgttgacttgtcatatctatattantatcacgtattttgtactcttgtgatcgtgctacacgatatatagtgtatgagatcacgctagtatgacgtgcagtcgttgtgtgtagtacatcgatancgcgtgaccattgtngaagcntaatatatatctacggtcataatgntgcacactctatcagnatagtgttgntgtgtgtactagaacatatatatatatatgtgttnctcactatacantctgttgtgtgtgagctgagtgacaacgaatcactagtgngncgcatcgcgcggcgtctcgcacacncacatctctgtatcactntgtctctgtgtcgcgtcgactgtgcgtcgcattgcgactgccgccggcgtgcgcagcatacttcaccacagtatgattactctcgatccttaacttatagtctgtcactgncgtntcatacacatncntgcagataagtgcagatagtaatatgtctcctatatcacgtatcacacacgcctagcctgactattagtcctggagtatctggngtggtngcggtatctcacgtgtgngatngtacatagttgtctgacacacacgtacgttgntgtatagatatcacttcgactcacacngtgggacacgtgctacagcagctaactcggtc

SEQ ID NO: 7712 - DNA, 1114 bp, Homo sapiens
  misc_feature (1)...(1114): n = A,T,C or G
ctttttcgctaccaccggcgggcggttggggggggggccttcgtgggggaacagggcgtggggggtctttaccggggggggtgccgatgcccatgagtattgcagggacagaggaatgtcccagctccatgagagtgcgatagtgcagcgcgaagagcagatcagcgccgcggaggccagagtgatattgacgccctgacaatgtacaggttggaagaactgtcataacgacagcatggacccactggcgcatatgcgcaccgactacgggctggcgatgatggcgcgggacttgggtgcataaccctggaaaacgagcggggtattattttactgttatgaatgggggttaggcgatacctgtgtgaagattctggcgtccgtgtgggcgagggggggacaaacacacattcagctagtcgtgtcagcgtggggaacggcggcgcacttgggcggcgggctgtcaccagaagacgtctaacgccaacgtcggcacgtgcccacgtttgacgcacgcgcccgtgcgtcgtgttgcgccgcagcatcgcataatagtgagctatgacataacaccgagcacgcatctaaattgatcactagcgacaagcacgcgccccggcgccacgtaccacgctggggcccgactcaccggtacctatagccgcagcgcgagtaacgatagaaacttaaaagtagaacggatatgtacgctgaatcgcctgctcccgtccatgccgtgctcacggcaccgctagggttcgtgagccactagaccacgtaaaagtcgccacaacacagttggtggggcccctcacttcgacccgcacaatctcctcttgtcggttactcttgacaacaatacatggtgcgcgcggctagcagagaacgaaagtaacagatttaagcagaaaaataattgctacgtcgctttgcacaaaacaatactatacgatcgaggcgacgcggtcctgagacatgatggtattataggcgcaggtgaaaataaatacacccatcgtatacactggatntggtggagtgctacacgcgggggaactgtgaggaaaagtggggcgggcggctatggagtaacggcacttccaggtcgactctc

SEQ ID NO: 7713 - DNA, 1356 bp, Homo sapiens
  misc_feature (1)...(1356): n = A,T,C or G
ataaacacgcaagagatagtactcggcaaaacgacgggcccgtgctagacgagggaccttctttcactaagagagtcctgctaccgccttcggcttttacaatatgggatagtaggtacagttttgcagacagaatgattcgcccagctacactctctggctaggtgtgtgtacacaacccatccacgtgtcggcgagagggttaaagccgcgcaatatacccggagggcgaggatagcggcgcgaagacagtgtagaagacccgacgcaggtccaacaacatgccaacttaccacacgttagcacacatccgccgcccttgatatacatcgatacggttggtggccgccgtaacaagcgcgtaccacgcggcgccacacttaatttacacagtactgttgccgagagctcacgattaacaagtgtgtggtagggcgaggccgttgtaagagctgggtcggtgcaggacacattcgagccgtgggtcagaggcgcacagagtatggagacgcgtaaaaaccgacgagtattatacgtgagagcggtgcatagcgaagtgatatgattagacttgcacaccgtcccgcgtctccggatgtcttcccacctctcaacacgntaccgactagaactactggtagaatgggaaagctgtagtcgatcggaggcatactcaatcccctctctctgtgtggcatctctacgcaacctgggcgatctccccaacctccgtaacacggtaccggtcaacgttcattcagttataagtacgtggatggcgggatacacgtactaactttcgacattgtccgggggacacgtttgtgtcacatcgaaatgtagctctactatgtgagcggagtggtagattctatgactaagtcatgtgcgatgtggacatgagactcacactcgtatgctgtgcatcagaccacccacgggatgcggcatgcacacctgtctcagtgctgagcacctgaaccatacaattggagcgtcgcggtgctcgacagtcatcccacatgacacatccccgcactctcacgcgaacaccgatcgcgcgactgaggatcaaggcgatacgatactgcgcgagtatcaatacacgcggtcgcgtcgccgcgtaactatactgtagcgttatcgttggcggataaggcggtgcgtatagagtgagagtcggcaagtctatcgtgatatantgttgagagtatgagaacgatcagagttcgtaacgtggcgcgctctgccgcgtcgatctaagccggtgaagtccgtctatgactaggtacgactagttcgtagtgtagtagagtgtgcggcgacggtgagcatagtcgatgtgctcacattcat

SEQ ID NO: 7714 - DNA, 974 bp, Homo sapiens
  misc_feature (1)...(974): n = A,T,C or G
aaatctcacacgaaactgcaacaaagaaatagaaatgacaatccatatcctcatctaaaaataacacatataattgaaataactgaacccgaaacacacacacagttaacacgtagactattcgtatcttgtatcgaatgaccgaagatagtgagggtggataaatacactcacacgagtacacttgacgcaatatcatttataaaaatatcagaccattatcgactcaaatagagtntaaaacccgttaacaagatacttaactacaatcgagattgaaaaacacacattatgcgactatctgaatcaatgatcacctcacaagacagcgattaaataaacatcgatttaaggctaaagctatcgtctacccaggtgacggaagattataactataataaaagtactcttatccaggtaccttacataataaattggttgacgaaacaaatttatatctgatcaccaattataaatcttcattctccacacatgcagtggtaatgagtacttcatctaataatcccatatgcaatggttgcggatggccatgattaagatctactcacgcagatatcaccttttatcacacatctgtcagattggtgcttgttctctctttctcttcacaggacccttcattttttagggagtctcaatatagcttgggtttctcttgcattcattgatcaagagaaaaacacctagaagtggcatgggtagaaattttatgtcagaccctctatcttcactctcaaagtcacccataactgttctacatgttgcttttcttcacaaagctttacattaaaatcaaatgaataagcccaaatatttgctaaaatattctataaatactcttttacctaacatggccaaataatagtatcctttggttaatataaaaaatgcaataaagcaagtatcccacaagcgccccccccccttctccctcaaacgaaaaatatagcact

SEQ ID NO: 7715 - DNA, 1499 bp, Homo sapiens
  misc_feature (1)...(1499): n = A,T,C or G
atccatcgttgcctctctcctcctggttntctccgtaccgtggcgcggcgtgcgtcgtgctcctgncgcgtggcgtcgtgtcgctgcgtctgcgcgtcgcggcgtgcgcgcgcgccgtccgtcgggccgcctcgcgtcgttcgtgatcgctctgtactctgcgtctctctccttgctctccccgcttctcgttagccgccgtccgccgcggcgtgtgcgcttgtgcgtgtcgtgtcgttgatgtctccgcnccgcctgcgtcgagtagagtgcgctgngtgtgtgtcgtggtcctctcgccgtgtctcactatcgtctctcgctccgctcggtgcgtctccgcctcgtccgcgtcgcgtgtgcgtgctcgttggtgttgtcgtgtgtgggcggcgagatcgtggttcgcgcgtgcgtgtgctgntcttgtgtctgtctngcgtcgcttctcgtggcggttgcgcgtgtgtctgcgtgtgtcggcgagcgtgctgtgcgtgncnccgtgtgctcgacgtggtgctcgtcgtgntgcggctcgtgtgtgtgtgtcgtggtcgggtggtccgcgggtgtcgcggctgcgtcgtgcctctgtntctgntgtgatgtctcttctgccgcttcccgtcggtggtcgtcggtgggcggtggtgcgtgcgtgcgctgctgngtgctgttgtgtctctgtgttctgngccgccgtgctgcgcttgcgtgctgtncgctctgtctttgttggtgtgtggggcctctcggggtctcgtggtttgtgcgctgtcgcgtggctctggtgcgcttcctgcgctcccctccctcttccccctgttcgtgtcgcgccccggcggtgtgccgttccctcctngttctgtgtcggcgcggccgctctcgntcttctcgggtcggcgctgcgtgcgtcactgtnctctctggtcctcgtccctgctcgcgccngcctcggctcgtncctctcccgtctctcccgtgcccgcgannnnncgntttgtgtctgtgtgtgtgcgtgtttcgcggtgtgtggcgcttcttgtgtctgctcgcgggcgcgttctcccgtgtgttgttgtcgtggtcnccttcgttctcgtcttgtggtctgtccggtgtcgctgtgtggggtcgctgtcgcgcgctgggcggtgaccgtgtcttttactctctctccttgtgtcttttttnnttctcctcctcgcgctgtgtgtgtgttgtgtggtgtgtgcgtcggctggcgtggtgcgcgccgctccggtcggctccggtcatgccccgcgcccagcatatnccttttcgtgaagtgtccgtctctctccttcctccgtctctcccncccctcttgtnntgcccctccccgccggcncccgtagagcttttttttctcttttgtttttccttttttaagattcttttcattttctttcctccctcccctcttctacgttttttatancctgnttanccccctattcctccccctgcttact

SEQ ID NO: 7716 - DNA, 1478 bp, Homo sapiens
  misc_feature (1)...(1478): n = A,T,C or G
gagacagtactcacagactcaacggccatactacacagctcccgtcacgccaacgagtacctgcgtcagcgacgccgcgacgcacgcctcgacgccgccaacagcgcagcccgntacaagtagatcgtcacacacgagcatcatctcgcgcacacgacacatgaagntatggcagacggaggagacggtgtgtgattatgtcgatctctcgtctccaagtactgatgtagatatccgacaactatcgcgatgcacatctgagtacaactaacacagacacaataatgactgagcgcgtatcatatagacgatcagatcactatacgtcgcgacgacnatcgtcactttcatatagacgtgcgcacgctcgtcacanatagaanctatacagcacgacgcatcacgtgcacagctcgacgcgctgtgctcgaaggtgtactgcgtcactntcacagctntcgantcgcatagagctcatgtctcncgactccacaagtgcacgtctgacccagcacccgatcgctcccttcacatctcaatgtcgacccactgtatcgancgcgcgtctgtcattncgttgattgaccacaccacactatcagacatcgtagcacggtcgtgcaaacactgaagccgagacgacagacgtcaaagtaaaacagagcgatcagcgcgcgtccacccggccacgatggcactccgtcactttcctcctctgtatacatctgttgataccgaggttatggacatgatagcacgacattgaggactaagttctcatcgngcatgatgtntatcgtatattagtaagcgtgccgtcggtaccgtactgagctaacatgtcgactctgcgacctagcatgtcgtntgcgagtgatgagaccgcgactagcgacgaagacacagtcgatcgcagngagtcacgtcgacgagtgggtgacctatgagcacgacatcgatgtctgcgtaagcgctccagcccagttcgcgcatacctatatgacgacgaggatatgtaatactacacatacatctaaacagctccgcgatgcgnagtgttgaacanacagacgatagacgagtgcatgcatgagnatcgtgtgaaagcacgtccgagaggcgcggagtccgacgctacgctgacagccatgcacgtcgcgctgatgcganctctaccgatgaaggtcggacaggtgtcgcgngcacgtcgatcagcgacgatctgttatgggcacgcgcactnagtatctgtgcgctgcagaccgttcacgcgcgagatacacgaaactgtaaacttgagaccgtagctaccagctctgatggtgtcttgtagagcagcgtataatcggaacctgtcgacatgacgccatactatctatagcaccggagtcgatgcagcatgatacgacgacgcctatccatgagacagctactagttgtgcgtcgtggccgacatgctgcttacntcgcggaccntt

SEQ ID NO: 7717 - DNA, 1223 bp, Homo sapiens
  misc_feature (1)...(1223): n = A,T,C or G
agcacgctgggggaacgcggtgtcgggagtggggagcctgggcaatgaatgaagcgcgcctacaccaggaagcagacctgncttgtgggagacacacacaaagagagccttttaccacgaaccacgaaagagacaaacntgcaaaccaccgagcgaacaacacaaaggagcgcgtggctcccatcactnacatctccctctcaatcactaatacattcctcgcgccnaacatcacaccaccgcaatgacatagacaccacccccgcgccggtagtgtgagacgttccccagatagtgcgcgcatagatccctcgtcgcccagcgtatactcccacgcatgcatcgatcaagacttngcgtaccacgcacgcctccacacatgacgggtgcgtcgagcagaagcgtccgttcgcgaccggagtgccggctagccagaatgatcgccgaggccacgtgccccggccaccgcgtcgcagccgccgccgctcagacataacagcgccccccggtagagagcaccagagaagntcggccagagaagagggtcccgaggagaggngccggtagagagcatagcgcccctcctaaggacccgataggagccacaacaggggagccggggaccacgaacacgagaatcagttccgtgccagcggaagcgggagtagtggcgatcgatatctgcagagcggggggcgtagcttagcaggagtaggccaggggcgtgacagaaggaagaacaggcggagcgggcggagggggaggaatcgattcgaagcgccggaatgaggcgagcgattcagcgacgatagcgggtctaagccgtagcataagagcgtagcgcggatatagaatagcgcggcagcggagtcgcgacggaccggcagggatagtcggcggatagaagccggagatcgataccgagccggtggagcgcgaattagcgagatcggagagtactcgggattgaggtagcggatatagagcgccgagaggagtaggagcgcagcatccgaggcgcgcgtgcccgctatcgcgacgttagatcgacagaataggtagatagcgcggcagcgagcagaggatgacgaggnaagccgggcggcgaccgagggagaggagaagagggatcccgaagaagtgggagcgaacgagaacggcgggtggaggaaagtggccaggtagagtagccgaaggatgcgagggcacggacggagggancg

SEQ ID NO: 7718 - DNA, 561 bp, Homo sapiens
  misc_feature (1)...(561): n = A,T,C or G
taacgtctcctaactcgctacgccgctccacacatccgacgtttcccgtatgacaacatgtctcttttgtgccgactacccacggcgaatatcgcgcgtcttcgcttcacacccacacccaccccacgggggcgacacaccaantaagaacatgggggacaaccagaaacacatttnggatgacacctacctttgtgcgccgggtccatcattagtcgcgggctacaacattcttgggcgctgcaatcaatatatcgtaagtatcgtacgatcacctagtacgcgtcattccaaccacatgtcgcttgaaccaatttatcggcggcaagccacaagcgcgagcaccgcggtcatgcgacatccaatagttggacacaaagacggtcacggaggcgggcacggtatttgtcctataacagatcttgtagtcggaaaacgtcgcacttgggggtaagacgtggaggaggagatgggattcaacgcataggccgcgcgccacgtctaaagcactacaacatacgtacaggaataaccgagggtcgggtgtacacagcgcaaaat

SEQ ID NO: 7719 - DNA, 502 bp, Homo sapiens
ctcattttttaccctctttatctttttttgtccctgatatatttctttgtacctaattttttttctccatatagccaattccagttttttttttccgataagggttttttccatcaattttgtcttagtctcaagagtttttttattgtcctcggttcagttttcttttctgggtcctttgtaagtgcgttggtagctagtaatatcaccacaggccagttgcggtggctcacacctgtaatcccagcactttggtaggccaaggagggcggatcgtaaggtcagaagatcctggcttacacgggttaaaccctgtctctattaaaaatacaaataattagccgggcgtggtggcgggcgcctgtagtcccagctattagggaggctgaggcaggagaatggcatgaacccaggaggcagagcttgcagtgagccgagattgcaccaccacactccagcctgggcgacagagcgagactccatctcaaaaaaaaaaaaaaaa

SEQ ID NO: 7720 - DNA, 1921 bp, Homo sapiens
  misc_feature (1)...(1921): n = A,T,C or G
aggaatgactaagtaaagagacnaacacactgctctgacantgcgatgcgcagngtcgtcgacgcggcggccagtagacgacgcgctcctactgctcagcgggagacgacctctcggngngcngagtcacgaagcactcttatatagcatagacggagagatcactctgttggantaacgcatagtcactcgacaggtgtagcganagatcaatcgaagacgattagagccgcgcgtgtctccagcagatgatnagcatggtatagtaacaacatagtagctatgagtggagatcgcgatgcatcactaacgtttaatctacacttatacacntgatcaatctagaacacgngattgtcgnatatcatctagttctaagacgagcnacagtggatgcgacgcagcacgcgtgcgcgcgccattaccgaccttcgcgtcatatncataccatctcgtctaacatgcacatccgcctgcgcgatcaagtagctgtgcataactggtggacatgtcgacgtatggtagttgatatgaagtgagagaagcacacacagcctggtgtggagctcagatactgacatacacagantcagacagtcgagcggtatagacgagcgcaaggacagcnagagagaacaccacatatgcgacaccacatagacaagcgtgcagcacagctgagcacgcgcagcaactgaataanacaaacagactanacatagctatnatgagagactccgcacagcggaggacacacacagtctngatganacgtanccgcggcgcgcacactgaaatacatgacgagatagtagctaggtgagatgcaatcagcnangtacgcatcacgcgagtgacactagtcgatgtacacntatcancnacatnctagcatagatatacacattntactgtgtaactgtcagctgtntgaggacaagtaagcagagcgcgatatcgagtagactgctctcacgacatatacgcagcgcagaatagantcgtaganatactgctctgacatgcgatcagctgttantagtgatagaaacgcantgtagcagcaagatgcagactggagacatcacagctgacagtgatcgtatccaagtgcgctcgcaggtcacgtcgatctagtctctcagcgcatcgtgatgcaatatgtcgacgagagcgcgcctgctngcgcttgctcacgaccgtatgattatagtcgcgtagttcagccatgntggagtgagccgtcgatgatcataagatgacacgcgctatatgctggtcatctatcctctgacactatccacagcgtgtgatacgagtnagttnccatcgtgtactatatagatgtgtgtgcgtcgatgcgtcagacgtgagtggngtgtgatgagcactaagcgacgntacgtcgtgngtcgcgtgtgnggcgagcgtgcgacaaaatatgctacgtnagagtgcactcgcagcatcnacancagctncaaactctcgcgcacatgatgagatctatgagtggtcatactgcngnctagagncatcacacaggacgagacaacgatcgagagtgctgggcgagtagcgccgactcgcnagtagtcagctgtgtacagnagactcngctgncgcacgagcgagcgctagagncagtacngtcgtgcgtgcactcccacgagtcgtcgagtttgagcagcgagcagangagatgntcagcatangaagcagcgaagnagnatgaacgatcgcatgatgaatatcgtggtatgcnactgtgatgcatgctagtccagcgcagcgacgtgctcgatatatcgtgacgtcgagacaaattcagacgggatngcntcagcgtgaagntangatganantggtggtcaagncgcatgacgaatgtcgtcgatcttgagtgcgagacgtatcactg

SEQ ID NO: 7721 - DNA, 1297 bp, Homo sapiens
  misc_feature (1)...(1297): n = A,T,C or G
accccacacacagacccaattcagaccgcccgccgggggggaacctttttgttaaccccccgcccggggnccttgngnggnagaaaccncccccccnananangaaagagagagaggaggagggggcttttagagagggggagaaaaaaccccctccacgcgcgcagggagcgacggacgagccacgagcgcaacacgaacgccgcgagccagcgcacaacgacgggcagagcacacacaagaaagacccaggacaccacaaactattaccaagcgccgggacgcacggcaaccggagcgcgcagacgcccagagaacgcgcaccacagnaggcggaaccttcctcccatataagacaccaacgacgcccagcagcgaggcgcgcaaaacgcgatcaagacacgcggcggcccacgggggacacacaccccacgaacacgacgcggccggcaccgtccgagcgaagcgcacaccacagccgagaccgccagcacacagacagcaaagcaaaccccccaacgccagccaaccacgcgtcgtaggngaacaacacacacgacccacgaacgcacaggagcgtgccgcgtcggaccgaagacacgaaagaggcgagaagagagagcgccaccgacacgncggacagggaggagacgcgccacaagcgcggatccgcgcaagagcagcgacacangagaccgaggccgacgagcctacgagacaacaaccgggcgcaagtcgcagggacgcagtagcacgagcgaaacagacgcgcaggcacacgaggaggacacgaaagaggagcagacacggagcagagacagcgaggngaggagagagcacaacgagacacacaccaaacgagcacagtggacacaaaccaagcgaaccacacaaagacaatagcagagagggcgagcccaccacacggncgccacacaacaaccaccaacacgaaccgcgncagcgngcggccgcaccnacacaatctgtgtacactagacgcacgtcngacacacaccactaaataggacacgcacgacagcgaaccaaacgcaccgccacacaacagcgagcagccgctgacgcaagtcacaaggagaccagcaccctacgcaccaggcgctgacaccnagacacagcacaccgncgctcgacggacgcacacacaacaccgccaaccagcgcctggctcggagcacgcacagcacacgacgcgccgcccacacagcacacgcaccaggagcggagacgctagcaagcgcgagcaggcgagccgcgggagcgactcacacaccag

SEQ ID NO: 7722 - DNA, 2257 bp, Homo sapiens
  misc_feature (1)...(2257): n = A,T,C or G
agaaaaacacagaaaagcaatacgagcacgaggagaagaggccacagcgcgtanctcanncagtaaaccgccccnncncncgccncnnnnnnnnnnncggggnngcctttcgngnaganaggggngngaaccnnnagagnaggagnnagagagagaagcgcccttttgaggaganaggggngngnnanangaagaccccngngnggnacganggangnaggagaananngnagagangagaanngganacnnacaagaaagacagacggaggangtcctattnagagagaagagagganaggagacgagacacaancacacagccccnacgagacnacacagcgnnaaaaanagcacgncgcgcgagcgacgacgcgcgcgaaaccgcagccgccgaccgacgcgcgacgacacgaagaaagacaaanacggagaagnaggaggagggngaggancagacagngnagcggcngcgcgcgcgcgacggcaggannanagacagnanaacgncgagcacagcagacngaaaagaganggnncgcgcncgcaccagacgaganaaacagggacaaaaaaagcagccangcagacgacgcgacgcgnacnaggcnggannagnngagcaggcacanncgcgaaggcacnagcananangcaaagaangcagcngacaagcagagnangangaancnnagngcngnnacgagncagnagcacggcgcgnacaggccnnggcatgtctgtttgtgtgtgctnagtagtagaganagagaagngnacgannagnanngcgnagncgncncgcngccngacgaacnangnncaacnanncagcnncacgnanngcnangacagcanagnagcagacnagncacncgacaagnancaagaagcacgcgacggaggcacggcaacgagcganacangagcgacnacaggaaagnagacgcgacagagancaagagnagagagagagagacgcggagagcngagcgaacagaganacgagangcgcangncgnacgancaacacangncgcaaagancagacngcaaagaacgcgnacagagagngcagagagcgcgcaacagagagacnanacgaganannagacgancgaacancagcaggaagacacgacgagagacacgccgncgcngaggncgagaggaacgaaagcngngcngacacagaaagaagngacgncgggcaagcgacacgncangaganaagacgcgcacgacnnanancgagagagacgcgagagacgcgaagncgcggnnagagagaccagaaagngaaannggngancagccaccagacgcaacgagagagnaganancgagaacgnagcgcaagnacagannagaaagnganancagcagagagngaagncaggngangaanagagagagaaccgcgncgcaacgagacgcgagancagagccacganagancaanangacagaagangcagacacngnanancgagagcncacacaccaaaccngggaaaganagacngaacacnnnanaanncangncggacgcaganaaanananagcggacganggnagacgaangaannagnaagacganagnaganacagncgcacagaagaacgacncncagcgnagancagcagagagnagaaagangagcacaacacacccacagacaacnnagncnaggcacagaaanngaaggaagacaagangaaanagaanagngaacagcagcacagagagacgacccncnagaacaancggngaagnnaagcnancacgcgccncagaaactatagcgacatgagaagcaganngangngatatngatacgagcncaggcacgcgcacacagacgnangatnnagagatgatcatagacgagggagcatganagagcgangcagcntgtgangtanatgagaaagcatcgacacagcacgcagnaggatantaagagagatacgagaccgtgaacgcgtacgcgagcagcaagtcggacgagncagcgagaganagctgtgacgagacatgcgagcagcgcgcgcaagtacgcaggtacgagagcgncgacgctgcacatacggagngaggatgcaccgacgagcagacgtgtcgacgncgtcgngnagctacgagagagngcacgnaggggacangcatangcgagcaggacggagaggactgaggacganganagagcgtatgacacgcagngngtggcgcgtacaaaaagtaacgacgcgngg

SEQ ID NO: 7723 - DNA, 1346 bp, Homo sapiens
  misc_feature (1)...(1346): n = A,T,C or G
gcgcgcgcacaggccaacagcacacacgaggtagacgagaagacagaagacgaagacggaacttagtcggaggaaaacagcgaaaggggaaactgtgtacacgcggggagaaaacagggagcgagcggggcaagcgggagaggagcgcgaggagagggcgagggagaaacgggcaaaccacgagacgcagagagagagaagcgaaaacggagacagggacgcgcgcggacgcaagaggcacacagaagacgaagcagcagaagagcagcgcgaggagacgggaagcgagaagaacacgagaggacnagcacgaagcgangagagcgagggcgagacgcgcacgaggaaggatagaagccgaggacgagcgacagcgcaccgacgcagaacggagaggccacgaaagacgattacacggacgcgcgcagagcggagacgtagagagagagaggcaggaacaagatcagccataaaagaaagggacaccccagcggcgcaacaattatataaggcgcggaccgaagaaggagcacactagaaaactgaaccggcgcgccagaaggtgtgtagagcgaggaagaggcgacgcgacggagtaggatcccgacttaatgagtttgatcgccagcagcgcagtagatcgaagtaccgggcctggagaagcagagaggggacgacaacgcagagaagaataacgcagagaaatcgcancaggccaggaataatcgcaacagcaaatccaccgcagcgaggcgaggtgcgagcagcaaagcagaagcggacgtagcaccgaagcacgaggcggcgggaggagaactatagcggcgaagagacgtgagaacacaggcgaacgacccagatgatatcgcacacggacacatagtagacgagcggacaacaagacangagcagcagtacccggcgcgccccgacgggtaggctaacgatcggagataaagtaaccgagaaccgccgcagatgcaccgatgatagcgggaccggaggcggatagtcgctcgaaggaaaggcaaccagccggcagagagcgngagagaagaagaactngcacaccgatcaagaacggcaggttgggtagaacgagcgacaaagacgacgggaggaccaagaagaaagcaggaggagagagattggagagcgcagaaggcatcacgtgatacccacccactcgacgcgcgcgggaagagagacggccgaggaggctcgtcacacatagaagacgccaggaacgaggcggcgggagagagatatagaggtagggagtctgagtaccacccccgccccgcacagtgacacacgagctagacgagagccctataagggacagt

SEQ ID NO: 7724 - DNA, 1206 bp, Homo sapiens
  misc_feature (1)...(1206): n = A,T,C or G
cagtattatacgatgtgtgctggagactggaagcggagaaganggagggagagaggaggctaagtgtgggaaacgnacgcctgctgaaggncctcgcagcggctaacaaccaaagtgaagtggaccacaggacgtagagtggggcagacggtgtgagatatttnagacgagctgtccacgacggtccatctgagggtgacaatcgagcaaggcaccacggcggggcccgcacaggacaacacatgaaacacgacgcgtgagaancgagtggagatgcgcacgagagcgagcaggagaggagaagcggcgaacgaggcggcgcctgagaaacgatagcgacgagtacggtgcgagcgatcggatcgcgcacactgcacgagccagaccagctggcgagtcagcgctatcgtcaaagaatagaaactatgcacgatgaacaggatgtggcagcgagagcagaaaatataacgcccgcgtggagtagcagtgaataacattagcgaccccaggtgatggtgcggccgctctcgcggagctaacgcaacattatagcgcgcgagaacggagggtggtatatggtaagcaggagactaacgacgcacgcacagagagggatgcagtgggcgagaacaagtgccgatccacataataccgcggcgtagatccgtacgcacgagccgcgagacgcggtgcgaccgagcactaacaatatgaaagagcgttgaaccagttacgccctgccacgctgtcgacatagagtattgcgacactaccacaaactagtggatgacttgagacagcaggtgcgcgaccgaatatcgagacggcgcggagccacgcgtcgtatatagtacccaccctcgccgaggccgccggtaaatgacataagaagtattggtgatgactagacgatgactagagaacgtgagagtagtcacacagtagccgcatgtagcagaacgcnagagatacgcgggtggcacgtaggagaccacgcgccacctagagatgaaaatagtgtaatgcaagaggatcggtacatgctacgagtcctcaaaccgtcgacaccggcgccactagtgtatcttcgcaggagggacgtggcgagatgtatgatnaagatattataaacgactcgagacgcggcgagtancgacgacggcgcagcctatgaccgaagcataatgacgcgacaaaanatagcgg

SEQ ID NO: 7725 - DNA, 827 bp, Homo sapiens
agaatatgcactatgaagatgctacctgagcagtataatatgatagcaacagtgagtgactgggactaaacttttatctatgttaactatgccagagtgtattctcggtaccacgaagaatacaggggaggcaccgtagatattctcacacgctatcaagaacatacacaagaaaatgatgtggaaacttagggtgtcaaatgagggaagtatcctagaacaggcctataggataattcactttgtcatgaatcagggcacgtcgcctacaacttatggttttagcacatatgacccgttctaattcttgaccgagggtaaaaaaaggtcacttggcaacccaaattcacatattttgtggtcaaggagactggtatataaagtagggcttctctgaattaagacccctcaaccttccaataaggaggatctgattccctcactatggtgagaacttaatgctggtcaaactctctgtggtcaaagagccactatgtacaaatctgtctgctagtttcgtgtgggcgtgtgctggggtaagaggagtaattctctgaagagcactcctcagccagaatggaggctctcttcgcttaatcgtcataatagagtaaaatgaacttctctttacaaaaacatagataaccagaaagttaaaatttaaaaaaaagttctccttgacaattaggaaatcgttgaggccctgccagaccgtccgcatgccatccagaccgtccgcatgccatccaaacctccgcatcaatgaaagggtaggttagctcccatatcatccttacgtgctttctgtatcacttgaatctaaaaac

SEQ ID NO: 7726 - DNA, 1414 bp, Homo sapiens
  misc_feature (1)...(1414): n = A,T,C or G
ggcgacggaggagaagaacgcagaaggggaaggaggagcggggggcggggtttgtaagaagacgggggggcgaggaggtttgggagaagagaaccacgcccnaanaggagggagagagggagggggggagcggagatttaagagggggaggaggcgaaacccacgagggaagggcaggggcaaggaagcgaaaaggcaagggggaacgagaaggggagggaacaagagggagaagggacagacaaagaacggcagaccgggagggaagaaaaacaaaaaaaacgaggggaaagaggggcaaggagaacggggggagcacaacggggaagagaaggggaaaagaatttttttttaaaaggggaaaaggcgaaacaaagaggggcgagagacagagaggaacgaggcgagggaggcagagcggaagaacaaacacagangcacggcgagacaacgncagagcaacagggcagangcgacgcagangagaaaagaggagcagcgacggagacgacgcggggagcaacaacgccgaggagagagacacgcgcggccgagacgacgagagagggagggacgaagaggacagaggacggcagaccacgcgacacaaacagagaggagaacaacagancgggacgaagagaccgagagaggacgacgagcgagagactgccgcgacgacgcgatggcggacgcggggagcgatgaaccagcaacagacgcgcggaggcagagacagcaaacgagaggtggcgcgcagcgcagagcggacaacgagagaaacagacgagatgggcggaggcgacgaacaagaaaagaacggcgacagcagaggggccaccgggtggacagaagagagacgcagaggaccacagaggagcagaggaggnagtacgagnagacacacgacgagcagaacatgggcggcgacacggaggagacacaaagcgcaccaggtacagagacatcatacatacgtggcgagtnagacgtgcaagaggaaggcggcagagaganaacgacagagaagcgacgcgcgaagcgnaggnacggcagaacagtagagcggcgggtgagacggagcgagagaggcgagacncaccaganagagaggagacatgtgaagacgcgagaagaggagagaggtgggccggagacgacagtcggagcgggcgagcgagacgcacgagaacgacggagacacgagcagcgcgatgccaagccggtcggagcatcacgacacagagagcagagaaagagagggaggaggagtgaacaantaagaacgagnggagagagcgggtgaaggtgaggagcgaggacaaagaaggaggggaacaaggaggacgacaagacgcgcgcgcggagagcacaggaagaggcgagcgggaagcgagcaagagggagaaagaat

SEQ ID NO: 7727 - DNA, 1921 bp, Homo sapiens
  misc_feature (1)...(1921): n = A,T,C or G
atcgtgtcgatctgcgtctatntctacaactaaccaccaacaatatactatcactgactactcangcctcgcnatatcgaactcctatctcgagcgactgcgatcatactcacgatgacgacttcgtctctccnattcttccgacgggcggtcgcactgagtgtcgcgagagcgnggccgcaccactgacaagtagaaacagctgagatcgtcgcaatcaagtatgactacatactctngtcctagtaaactacnccactcgtacagtcactgcgcgacgatccggagtgcntgcgacgntacgtactaccgtgcacngtgcgacaagcngnggtactgtaacgctcatcncntcatcntgagtagtattgnagcgtcgttganctgtgtagnggagacattcattttatcttcgtctttcggtgagtgagctcacgcnatccatcgttctgatactactcacacaccgtctctctcgaatctttgtatctgcgngacgatcctatactactccgcctatccgtatgattcatatcattcgtattcactcagagtgtgcgtatcgcagcagacattggcacacancatctgtgtactcngtcggatcgtcgtgcatntctatagtgctctatccactctacgctgtctagtcgctngccgcgtctctcactcaccatatgcacactctactncccgtcaagtgactaccagnagatgcagtacagcacacgcgtnttatctgaatatctcccgcatctgtgggtgcgtcggtacgcaccagcgttgtcgtcgaatgaccaagntatggtgactatgatgtaatgatatttatatgatagatgtggaacanatagataacatagagagagantgtatacacgtggnacacagcgcggtggatgctanatatcgcacgagtttggcacacatcgggcaccggtatctgttcacactgagcgtctgactgcgtctaaatatatgtcgactntnnttgtatatatactcatcacactacacgcatatctcatctcagagtgttctagtagagatgataacgtgtgtatgttagtcgacggcacgtgtgggcagacacnatacacccntgcgcgtntggctctgtgtctgcncgcactactcgcctcctatacatcacgttangagcaactacagtatccgtattctactactgaccggcgcacagtcacactagcgatatacgctcgtcgtgcgcagacacaacatgacgccagctgttgcgtgaaacacacgtgctcgctcgttctactangtgcgactcgtgagtntnattgtgggtcatatatgagattanttanattataatgtgtacgtntgcagtgcgcgttgcgactccgngacgcatcctacccgcatctctacntntctanantgtagatcacacacctacctgtgacagcgactacacagtctcncgcgcgcaaacactgtacagacacatctactgactgaggtagctacaagctcgtgtatagcttgctngcgtgtcgtgtatctatagatactacgtgttntcgacacacttaacacgcgtgngccgtgagcgagacgtacgcnagcaactataacaagagcgttcatcatcgctctacgacgttgtgctcgtngatcatgtatatgcacgaccgatgagnagacgactagcatgcnttngtacctacatcactacntactnatgtatcacgtgatcagtcnagtgtgtacagtacacactcacgggagangtaccgatcatnancgagtgaggcagatgtcagtcgtggtgatgcatcacacacaagcatgtaatcaacattgacggggtcagcggctnatggagttagtcacagcagtacagacaantgtgaacgagcatcgacgcgtgtgatcgcagagacatactaat

SEQ ID NO: 7728 - DNA, 845 bp, Homo sapiens
acagtctcgaactgtagtcgccagcctttattatattagccgccggaaaggaaggatctcttaataaacatcgtggtgcctgaaatcatataggggccgatcatgtgtgaaccggccataacacacaatcactgcctgaaattaaacacagagtttaaatgtttaattggcctggccattttcatggaattgaaaaggttgcttcccgtgcttataagattgtcccccacctcaatttgtggactgtaatgttctgggagtagtttcagattggataatcttggggctcagaaagtaatacccctaaaatgaaggcttcagaatcagcctcgaagaaaaatttttccctgaccttcccctgccctcctatctataagttccattctcccccaaagctagacatggaaattagaatctttcttccccaaggtgggttacagaaaacagaatcccttttccccaaagccagccagaaaacctaaaaatatttttctaactttccctctaccttgctgtgtgaaaactggtcataaaaatttatctgacctaccttgtttgactgtaggtcataagaccctcccactcaagagaggttcagatctacactcagaggaaaaagtgcgtgttcagagaggccaagaacaatctggacagacaggccttgctgggtttccccactcagcatattagcattagatcatacacattttgttcaattatatttctacatggatgtccatattttgttgaaccgaagcataaaaatggacaattttccctgtatgtttgggtcttcattctgaagacttctatgtgtatatattaaataaatttggatgcggccg

SEQ ID NO: 7729 - DNA, 1551 bp, Homo sapiens
  misc_feature (1)...(1551): n = A,T,C or G
tagtgtagtgctgtgtagtctgcgatcgtgtgcgctttcgcgtcgttctaatctctctagtcgtcagcatcgctantcctgttagctntcgtcgtccacaacactgtctcgtgacgaccacatctggtggcagtgggctgcgcgcgtattgttgggactatactacggcgcgccagcatccgacgcagagacgtggttgtaatcgctgacgactatccctactcttctcactcgcncgctcgcgcattacactacgcatatcatactccatggcgtacttcgttggatgtgcagacgtccagagacgaactatcgtctctgagcgctgcatggctgtgtctatattacacactacatgtgcgtgtgtatacctcgtatcctctaactgacactaatagctcttattcgcatccatgagattcagtagtactcacacactcctctcacactggctcacaagaccttagagatatctatgtgtggctgtgttctcaggctcgcactcggtgtgtcgacgttatgtcgctcgcgctgtgtcgcacactcaagtggtggtgtcgagtggcctatctatctcattcatttctctcgtcacaacccacaaaccaggagctgcgcgcggccatcgagggcccgcgcgaggcgtgcgcgccgccacacttactaaaccagttcagtgttagaaatatgaggtattttatacattaataatgctactaatagactaaatatcagcgacggagtgtagatacttgtgacttctcataattggcatacatatgcgctcggcttntttatcctgtagacgtcactatattagagttccttcattgcgctcaatattatcaagacacgccgttgatgcgtgagagtactatgttggtgcgttattctctgcgcaattaattctaatgtgtgtgatagtatgcttgagtcacgagttccatctctttgcctctaaagagactgtctccgtgtcgttgagcgcgcgcgtgcngactatagtcatttctccnttcatctctctacttctctggcgtcntgctactttgcgacctgacgcatccgtactgaccgccctcgttgcacataaagcgtcgagacgactagtcagngaacatgatgattatttgtacgactctagtatgtcgataacatctgtgatgcagtatctgagtgcacatgtgatgtgttactagtttcgcgacactgtggaggtcgtcgcgactgcncttagatgattgcatttatactatggtagaagagtgactgtccatctatctcttnnttatagtgacctacgcagcgccccntcacaacactcatgatgtccnctcgttctcaatacatncatcgtgatttgctcttactacgtatagtcactagctccgttggtctccatcgatgttgttcggtctacgcagtaaatctgaggctggtcgaacttagcgtcataatagaacattgtggtacctcttactgactctacttctccgcctcttctactgtangtcggatggtggtaacagtgcgggtgtgcgatagataatg

SEQ ID NO: 7730 - DNA, 1138 bp, Homo sapiens
  misc_feature (1)...(1138): n = A,T,C or G
cgttgtcgccgtcctctgtgtagcggcgtcagacgtggtgggagtgctgttgtcggtggtttctgcgtcgggtttgtcgttgagggtgggcgcgtccggctgtgcttctctgcctcgcctccctcctcggcggtgggctctgtccggtgcgtggccgcggcgcggggtcgggcgcggtcgcgggtgtggcgtgcaccgggcgcggcggcgcgtgcggtgtgggcgaggtctcggcgctgtacggcgcgtcggcgcggtggtggggttgtggtggtgttggtgtgtcgcgcgggtgcctgctgcggtgcggctgggacgcgtccgtgcgtggtgccggtcctgcctgcgtctcatggcgcgtgcggtgtggtgtgcgtggtggtttgttttgttgcggtccggagggccgtggggcggtccggtggtgtggttcggctcgcaccgcgcctccttagtcagggtgtgtgcggtgccgtgatgcgagtcgtcttgtggtgtgtgtcttggcacctcgtcgcggttcctgctgccgtcgcggcacgtgctgcggcactccctctggttggtgtgttggatgtagcggttggtcatgggtagttcttttgtttntttttttttctgtcgcgcttgtgtggtgcccggggctcgtgccgctcactggcagggcttggcggcgccctcatcggggcgttctccccnncgccccctgccctttcctcgttgtttggtgctcctctctcgcgtgtgttnnggtgtgggtgggtcggggcgggggggtgcgtctatctgggcggtttcgtgctgccgtcgtgccaccggcccgcgcccccgcgctctccgtcggtggggggtcgggccgggggcgtgggttcgtcggccgcgccgtgggccgcccgggcgacggcgctggggtgtggcggcgggggggggtggcgcgtgcgggcggcgcccgtgtggtgggttgtatgtggatggtgtgcttcttagatccctctgctccgttntggcttctcctcccccagaagtttgtttcctttgtctctcctttttgaggttttcttctttcttctcattatttactnttttctttttactncttcctttcctctcctccctctatattttttctctctctttc

SEQ ID NO: 7731 - DNA, 859 bp, Homo sapiens
attcaacacattgggatacgatccaggtatgttagaaaagcacgtttacaaagaccaatggacctgtatgaacattctccaaattctatttacttcaagcatgtttggtattgagttctacctttctgtagaatattttccttaaaacaattccaaatgttgagaatagagaattgaggtgcatagtgaaaatttaaataatgctgtgttctatactgtgcttattaggctttacttctaatcatttacctgtctctagagccgtgctttccgatacagcaaacaagccacatgttgctcctgaatacttaagatctagtctgaattgagatcagcagtaagtgtaaaatacacatgaaatttcaaagattaaatatgaaaaagattatgtaaaaattatactttaatatgaaaacataatactctgggtatattgggttaaatatattactaaaatttatttcacctgttacttgttactttttttaaagtggctactagaaatttttaaattataggttactcgctttggtggctcacattatatttctgttgaactgagctggtctagaagccttgatgatgtttactaaacactgagagttcttgtactcctttgcagtatttttctcatgaaatctctcaattcctcaatgtagttatcagatgtaccccagaatctgaattttcaggaagtgttggaggccttgatgtggctctggaatggatacattttagaaggcgcccaaagaaagcttcatgattataactgatcatcagaattatgtggagaaagcattataatttatttatgattccctctacagaaatgttgattcaataaatggggatgcgtccg

SEQ ID NO: 7732 - DNA, 1134 bp, Homo sapiens
  misc_feature (1)...(1134): n = A,T,C or G
aggtttgtgcggttaactgttatttcataccccccccatccaagggcttgaaggggtacaacggcacgacactttggggtggcgttggcaggtgctatatgtggtactgcataacatcgcacttgggttataaaataggaatcatgtgtgagttacaacagcggagaggatccgctgcccctaccacgtaccttggggcgatgtggataaactcccctcgtgtgtccctctacgctccctttaacatgttatgactgtcattagtgatacacatccatggtgtcattctaattcatatgtgttatgtcgtactcaaatactatgtggtgatgggggattatcaatacagcgggggggggggaggctctaactccaaccctcacatcaacaaagtagacaacggagacaacacacctagtaggcgagcggcctcacgggagaccatcatggttgacgtaatccctcccagtgttatggtacgactctgtaaaacgtgctagtgaatggggaacacaccacatactcaccacgcgccatagggcccctgacgcgcatacaaatggtttactcacacacacatcaacacatggaaggtcctcactgcttacattgcaagttcacaaaaccccnccatgggggtggtggcgagcagtgcatctgcaaacaagactccgaacccgcgtggaaagcacacacatcgagactgaaaactgtaagtatgcccaatccgatgagtaaccaagcaacttgcgtggctacaatccaaccctcgcaggtcagtgttcggtagggcggagcaccctgccacccttcatcaccatacaacaaaggtaggacacgcacggtgcgcactatctcgctcgtcgggatataacactcatcacacggcgtggacacacatccnttgttaattcaacgacggtccgcgtaccgattctcacaaattacgatacccgcactagctgctggtgtatgtctactgtctttgacactctgccaccaacatctgctgcgcagtctcctgtacttcacacgggcggcgccncaatgagacggagatagggcgaccccatcaccatcattggtgcatattgatatcagcgtacctgtctccatcgaagtgcgacacaaaat

SEQ ID NO: 7733 - DNA, 1324 bp, Homo sapiens
  misc_feature (1)...(1324): n = A,T,C or G
aaaggaaggaggacaagacgagaaaaaagaacagaaagcaaggggagggcctcgagagtaggaccacggggcggggggccttaaggagacgcgcaaacccgagggcgagagcgcagggagccggaacagggaggagggagagaggagcctttcaaaagagcgcggcgaaggcagggcccggagagcgagacacgagcagagcggagcgacagacacaaggacacacacacaccggacacgacgcgccggaggcgccgcggcacaagaaaaacagaagaaagggnggaaaaaacaaaaaaaaacaagcaagcacacgaaaggcgagcgacgccgacggcgacagggcagagcaagcaggagcccaacagagcgcaacacacgcacacagcaccagcagaagacacaccagacggaaacagcgaacaacagcgacgacaacaagagaagcagaggcgagaccacacaagaggaacgcgcgccacgcncccccgacacggagcacgccgacgaccacncccaagacgacacgcggacgaggnggagaacaaagcgacgcgacaaccagaccgcgggcaaagacagcagaagagacacacaaaanagaagcaacaacaaaacccaagagacacgacacaaaggcaccgcgagcgaacacccacacccacgaagaacccgcgaggagacggaangaggcgcgaacgagacagaggagcgacacacacacaaacaacaaaacgaaacgaacagggagggcaaaagagcacggaagaacaaagagcaggaggacgcacaacaccgggggagaaccagcgcccacgccacacacgccgcaccagagcgcgcccagacacagcgaaacggagaacagagacgaagggcgcgcacaagaccacacaagaccgcggaacgagaggagaagacaggagcgcggaggaaggacaaaagaacacaccacacacaangaaaggcagcaccggagagcgagacgaccagaacagagaacaacagagacgaggagcgggagacgcaaacagagaagaggagagcaggaacacaagaaagacacgagaagggggaagcatagggccacagcaaacaaaagccgatagacagacacgaaaaagacacagcaggcgacgcacgaaaagaacaggaagaacaaacaaaaagagaacacaagaaacagcaagaggacgacgcaacaaaggaagacacaaccacacaacacagccgcggaaagaagaacacaagaaacacagggcaaaagaaggacggaagagagggggacgacgagaaagagcgcacagacgccacacagagagcg

SEQ ID NO: 7734 - DNA, 1075 bp, Homo sapiens
  misc_feature (1)...(1075): n = A,T,C or G
ttcttgtgtaaccgcaaaacacaggagccgaagcggttatggggaacgaccgcggaggattcacgggtttaaacgttagggacaattggccttgtcacaaggtggtcgtctttatactcgtgggttctggtcccgcgtacccacaagggggggacaacgggcacaggaaaaaagagcaggagattatactctttgcgtcgcggtgggccgtcgtatttataagacaaatacactgtgctgctattctttatttaatttgaatccttcaccgttgacttgtacaatctggccacaccatatttgtttccgcgggggggatagacaaatggtaggagagatgttagagcaaatggcagttataacactattagagtctagctttacagtgcctcctcccgcggcgacgcgccggataacagagacgataaccaacgtcgctctattcgcatcgagtggggttgacagatgatcttcgttgtgtaaacctctatatcactcccttcccgtcgcgcgggcactagttaagtgaaaaaatcactcacacaccggtgacatggtgcggccggtgttgtgaacacactcctcnctgtagccacgccacatatatacacgctcacattagtcattggtgtctccttccacgcacgaggcccccaacgagtgtgagcttgttccagtgaatctgatgcgagcagcacagtatcagccgacgtgccggattgatggatatcttctcccgtggagtggcagaaccgtcgccgtggccgggcagaggactatgctgtttgtaaagttacattttcttccactacagcctcagtgtgtgtcgcaactaatctcgtgtgacctcgctttcgctcgagccattgcgccgatcttctcttcttctatactcattatctatctctcctttactctctgagttttctctcactgctttattttctgcacgccattggttggctacaccgcgccgcttcatagcactgtcgactgctgtctgcttcacatatccacgctaaatccatgctctacctgatttatacgccacctctgggtcactggatacgatgtt

SEQ ID NO: 7735 - DNA, 1057 bp, Homo sapiens
  misc_feature (1)...(1057): n = A,T,C or G
agaccaggggcgcgcacggcaagggaaccaacacaaaaaggggcctcattgggaactaaanggggaagcctgnggagggggaacccgaggccgagggagacacacagggagggggaaggggtttccacgccgcggcgggggacaccacggacagccagacgggccggcggccaccgccncggcaaggcgggcgggcagccacggggaaccagggggggcccagcaccccaaaacggcgcgcgaagngggaccgcacacacgaccgagagaacgccaggacggacgccggccccaagagaccaaggcgcggcgcacccgcacaacaggaggggggggccagacaagaccgacgaccaaaggggggcacagaaaccaacacgcgacgacaccagggccaaaagggcacccggggcaaggcgcagggcagggcgaacgaggccgaaagagcaaaaaagaggggaacacacacagacccaacgggcggcgggacaaaagcgggaaacgacggggcgcgggggggccccacacggggccgcaaaaccaaccgggggggcggcggacccgacaggggcaacacggggcggggcggatcgcgggggcggccggggcaacaccacgccccagcccgggcggggcaccacgcacccaagggaggacggggggaacacaacaaacgcggggggaccaccacaagcgaggggggagaacaacaccccacaccaaggggggggcaccccgcaagggcacccacacacccacaccagcatgggggggggaccagaccccagatgggacacctactcaggggcggcccggccaggccgccatcgagggaccaacaaacacaagaccaacgggacaccacacaacacacaacctgcggggggccggcgggacgccgcgcacccaggggcccagcacacgccaacggccacacccaccacaacaggggcacgaccccggggggaggacgcgctgggcgcggcgacaacgcagcacccggcggagcggggcgcgggggaacaccgtcaacagggaacaccggaacccagggggg

SEQ ID NO: 7736 - DNA, 1794 bp, Homo sapiens
  misc_feature (1)...(1794): n = A,T,C or G
tactgagctacagtgacgacctcagctcgcacgtggagcaggtctaggtcgagccacacgcagaacaagcgaangacgcggtggacgtagcggaccagagacatgngaggcacaagaaagatgggcgntttctggngtgcgaggaaacagacgcacaccacgtctcagatacacgcgaggaacgctgtgactgataaccaggagaagatctnttgtgaagatatggtagacttatagatagtggtgatgtggcacgcctgagagcatcgtcaattagggctcgtacgagattatacgccgctcagcgctcactagntctgtacgcactcgagcagctgtcgagtcattatgaggcgngcagcatgcgtcagctgtgatntactgtgtcgtggtcgcgtgtggaggctgtggatgagcgcgtagtgccacgacagctactttgctntgcacgcctgtcactacgcgangatgacgaanactntgatgactgcgtatatagcagctggtgatgtctggtagtgtacgtgcgcgtcacttaggagagcgcgtctacacgcgcagntacttcntcatcacttcagtgtacganttcgaggtgttgtatgtgaggagtctacttacgaatgtaggantantagcagatcgacacctccacacctgacgtactctccttctcantcgaacgcaccagaggctgcaggcgcgcgcgaccgatcngaccagtagccgctcgcgctcaccnagcgtgtgatgccacgccacgcctccgtttggagagtcatgtatcncaactatgatcacactntataactagcatagtacacacatgtggctgggtacactagatcacatantctgacaacacgccacgactgcgncgctgtcgcgatcacgatctcactatgtcgtggtactcgcaatcgctgtgtatcagaattgtcgtgtatagtcatagcgctatctgtgtgttccagacgacgaccagcacacctggctcgantntgcggcgtgtcgtggtgcaagtacatacatctngtcgttacactcaactgcgatgtacgcctgcgctgtctagacgtggcgcgtagggtgtgatgcgcggtgcttctagattagacgatacgtgcgctcatcgtgaggtgaggtcatagactacacatgcattatattcgtagtgatgtaggagttgcntgctgtgccgcggcgcgatgatancattcactctctgcgtcggttatactctgatgcntctgtcgtntgactgaagagcgagacagtaccgactctcgaatctgctcatctcgcgcgtacagcgtacttcgtncgtctggttcgtnttncactacatcgaagagctacggagtggtgggtgctacgcantgacacctaattactctcggtgtgcnatacactcctccntgcgatgtgcggagacgatctaccggagctgcgagcagactcggtatcgagantgtgtaagatacgagcgagacgtacgnactctccgagacaacgaggtgctgtagtcgacatgctactagntatgctgcgcggatccgtgtgtctactccgatcgtgacgatccncagacgacgttctctcacagacgtctattatctgtctcatgttgagaggagatctacgatcgtgcacacgctcgttgtgtctagagtaggagagtgcgcgcgatacnagtagctantcaatgaactaagatatgctggtagcggctgatgnagtgtgagtaatacgacgtagtcnactagtgtcggtaactngccggcgtcgtgtatg

SEQ ID NO: 7737 - DNA, 773 bp, Homo sapiens
  misc_feature (1)...(773): n = A,T,C or G
cagtgaaggccgtcaacgtaggataccttgcgccgagcgaataaagggatctagagtgatgaccacggagggggcgtttggggggggcagccaagagtgacagaacttacacatgtcgggtggtaaggttacggtcggccacagccacatcctgcacgcccgcgcagggacacgaagtaactccctcgaggggagtagtcgtgagtggcccactaacagtggaaggcaaggaaattcacccccccccccgcgcgagatcacaccgcggggtcccggggtagtaccagcactcacccctgggtcttcataccgaaagaaaaatagggataggcgcaaggaagaaggggaggggcaagaggcaaagagaaacaacgggcaccaatacgccggcgaaaggaaaccgggcccaacacgagagcggaacaaactaaatagggtggcgggggggggggaagaaaagaaaagggagaccctaccggttgctcgcccaaatagggtggagtcccgctggaaagagaaaacccccgggggcccgtgagcaccctgccacggatgggggccacgcccacgtgaaccaaacgcggcgtaatggacacgggaaaatgattaggcagggaccacgacaaaacaaataggaggggggtactagtaaaatngtaaaaacaaacaagctgtgtgcgggaaagggccacaaacagtcatgggggggacacgtgacaatgtgaaaagtgggggcgggtggggacccgcgaccgggagcactggcaggggtg

SEQ ID NO: 7738 - DNA, 1273 bp, Homo sapiens
  misc_feature (1)...(1273): n = A,T,C or G
ctcgccctacccgtagtaacctaganagatnacgtnatntnacgcttttnnngngnggnggnnnnaacccggcgcggacggtatacgtacacgccacagcacacaaagagagaatgagtgagaaccctctctctaatagagacgcaggcgcagccgctcgtgcacatatacgatcaaaggtacggaggtcgacacgaaatctcagcaccatacgcatcgatatttggatagtagtggactctctaataatttctcattcacgtcagggcgactcacttcaccccacaccacagtacctcagagctgcgagaagtgttacacacgggtagctgccgcgatcaatatgacttcaggtacgcatccccgacgcgcactactctacttctttgtcacagcgctacaagagagctntctttcataccacccacaaaacctcacagggcacccccgccgcgtgcgcccgcgcctactcctccaccgcctcgctcccacacctcggcctaacgacggtgcgccacgctgatgaatgcgcgccaagcggacctacacataacaatgtgggtagcctatacgttaaatataaacttgtgaacatctaacacattgcacataccctgctggatgggacgacccaacaactcgagcgcccgctctctcgaagccgcggctacacatgtggctcgaaacaaactcgaggcaggtgtcgcggacatggactcggaccacatgctgcctggccattcgcgtggctggcatgcgctacaccccactaaccgctcgcagcgacgtgcgccccatgggacccactaagtatggacggcttgacaaaccacaagatgcgttcacaccatacacactgtgcgtgggcaacaacaaagacacaaccactttggtgtgtatttgatggaataaacataacatcgctaaggacaagaaatgtgggggctcacatacgctctacaatggtacacaaacacacatgtggaagttagtgcccgcgtgtcgccgcacgtcaactctaatatcaagacgacacgggcgagcacaaaaacaaaataccaaangccgcgtgcgtccggtcactctctctcaccaacggccgccacacacctctacacancctcacactgcaccgtctaccttctttgtcactcacaccntcgtggacgctatgagagtgttaatgcgtcgcgaacacacagcgctacaaggtggagcagacagtgctggtgacatatcaaaacataaaatacacacgcgcacacaggaatag

SEQ ID NO: 7739 - DNA, 1439 bp, Homo sapiens
  misc_feature (1)...(1439): n = A,T,C or G
acgtatacagcggtgcatgagccatacacantgattaggagagactcgagtatggtatgcggcctgatacgtgagcgcgctgtagtgtgtgccaagacgctggatcgcgacgtggcatacgctaggatatcagtattccttacggtttgtcatgtttcactctacgttggtagtattcaatataagtgtgacgcaggatgcgtctactctttcacatcactctcgcgtcacactaccgtagctgcgtccgagtctgtctacacgtgacgtgcgtcagtatacatccgcgctttgatgcgtagcacgatatggcgcgctattatgtctacttcgtgccactatactcatcgtaagatgcgccacgtcggcgcggtagtgtaagacttgtcgctatgcgcgctcccctcgttcatgctaaaggtaatactagctgtatgtttatgtcggactncgagcgccgagcgctgacgtccnaccctgttcaaattctgcatagcacacagcgatcctgcgcaagcttgttctcttgacgtgtgtgtgtctaatattgagtactgtctgattaggtatccgngcgagcgtgagtgcatgacgggngatgaatcggaattgtggatctataagctagngattcctctctagtattatgagttcgcgtgttcgcttgtgctgacnattggtgtgtcggcagacggtcttgacgtcgaagaatctcttttgatctcgtccatactcttgttcccgntgcgcttcgcagtacagtcatctctcacgttagccatgcggcggagtcctatattctcggcgtggcgcgcggcttgcgccgggcaatagacagacgtacaagctatcgttactatcacactgcgtgtgactgcntgaatagttaattgcatatgacgctacactcgactgtgagcattcggcgtatatcatactcacctncactcacgccgntgagttactgaagacacacgtagcacgaccgatgctngttatgtctacacttcgcgtcacgtagtctcacactctatcgtatcacgtatcagcgattgtggttgtgatgttgtaaactggcatatatcgtctatgtactactgcggaccttacgtctactgcagtcagaagtcggcgacgagcgtacgnataggttgatggaaagcgacggcgatgttgactacgtacagagttaatgtanatgantgtagtcaacagaggntggtgtagattactgaataatagatgtancacaagtacgncgatctcgacagacgcgtantctgcntgcatgacgaanttatacagtgtcgtacactcggnacacggtgattggtgctagtatagcgtcttnanttgatacgactcatcaccgctcgncngtcatgtatacttctgatcatctaccatagtgatagacacgacgtcactatgattggtgt

SEQ ID NO: 7740 - DNA, 1414 bp, Homo sapiens
  misc_feature (1)...(1414): n = A,T,C or G
actgactattggtgctctcacagctgtgattgtatgcgagacaactatcaccacccactttgtatgtgtgctacatcacgtgggacatacctcgtcgagtctactctggagggacgtcgcgcgggtttggcgatcccgtctgcgaataaccaactatatatggtgtcattatgtgagtactacatatagttgtgtngtctcgtctgtcattatatatcctttagctngttctgtggtcttgcacaccagcgacngtatatttgggtgatgtggctgggtcaatttactcctacattatggtgcaccaatcaacaaaccaacaaatgtcgttgcgtatgagtgctgctacacggcactggcgtgcatctctgcgctgcgcgttggttctactgcgacatacactgtgcctctatgaatgttaattcagatagtatttgtcaaccaaactgttgactgatctgttctcctcccttctaccgctgtctaccgcaagcatccggctcacacctctggcgtaatcagtgtgacatatcggtggtggctgtccgtgtgtcgatctgggtgtgtgtgttatcactattcgataatcttaattgtggacattatacatcactataacccaacatgtggtactggagctacacacacaaacgatgatacantgtctcncgtgggtttcttagtctaccgacacactcctgacgtcgaaacaacatcacaatattatatcataatgagcgtgattgtgtctgtcttttatctacgtgctggtagttgatggtacacacgatgttggcgtggtgtgtgtcgtggcactacagagttacacacactgcatcattataccttggtcacgtatcttgcgttccactantcatacatgtcttgtcgagctcaccacnatgcaatgctgcgtgtacagacgctaacgtctaaacctgctcgcggccgtacacgcactcgcgtcttcacatcaccaacgatgangttggttccttctcgcggatcatacttcgctcgcgagtcgccagcgctactcgcaccgcggagatgcgactcactgactctcactatactggagtnaccctgtcactgctggtacgtgtctctcacgcgttgtgttagtgctttgtattctgtgtataatacatcctcgctgtgggccgactatctgtaacgacccactatgtgcgtcgtcctgagtttgtgctctgtagacacatattcgaccattacacactactctcccactcctctcgttgctctctcatatctgtctgctcactacactccctcgtataccgtggtgtcgcagactgcgagtcaactacatcctagtactacatgtcgcgcgccgcgctgttgcgcacctctacacacactacatatagcagcacgcgtcacacacatactg

SEQ ID NO: 7741 - DNA, 872 bp, Homo sapiens
  misc_feature (1)...(872): n = A,T,C or G
taccacatgccactatcacatctacgaactttccgaaagactcatgcactggctgcaatctggcagatatcaccaatcttaatcagcgaaaaaagtccaaagaaggccatagaaaattcaaacatttccagataaatacgaggatctgcagtatgacactgtacaatctccatgaaaaaagtatcagccttatgcaaaaagaatataaggttacgaggtggtcaacaactgtatgtattcattgtgtaggtttacaacacataattttaaactgaaattttccccaactaggattgaattaaacggcttatttactgtcttcaacatggtaattatacatctgttttccaataatgcagaaagattttattgagtatagatacccttccacaaaatttattttttcctataatgaaagatgtttcctagacacttttgcaaccaggcagagcattgtgattcagctctgctcaatgggttttggataaaagtgatgcatcctcttctcaagtctggcacacaaaccccccctgtatatcttccagctgtctctgccttcattgtgcaggctgtccttggccaaggacatctagaaaattatgtgttgaagacagcagaatttccattagtcagagtaattctgctggactatcatacattgcattaataaaataccaagttatagcatgtaactaaaaataacaaaatttttggataggctatttgtatatgtttcgtatgaattaacattttctttaaaaatatatcagcagttttccctggttcaggatggtgattttctatctgatattacaacattccctacttatatgaaaatatataaacctaataaaccnaattatgccgcaaag

SEQ ID NO: 7742 - DNA, 1307 bp, Homo sapiens
  misc_feature (1)...(1307): n = A,T,C or G
gctgctcgtgtgcgtccctcttcttctcgcgtggccgctcgcgtgcctcgtgcgtcttcccctctccgtgtcttgttctttcgtcntattgccgtcgccgtcgcgctgctgcggcagtgtgcggcgcgtgcgcgcttgtgtgtcggtgtgcctgtcgcgcgttgctcctctgtgttgtgtctactcgtgcgtcgtgctgtgcttgtccggccttctgcctcgtccttcggtgtcgcttgctgttcgactcgtgccgtgcgcgccgccgcgctgcggtgcgctttccgctccggtctcctctgctgctctgccncccgcgcgcggcgtgtgtcgtcgtcgtggtctcgtctncggtgtgtgtggnacactccgcttttgtgtctcgcgttgntctgttctcccgctctcgctgttcttctcgcgctcgctctcgcgctctctnctctctctgtgctctctctcggtgtctgcgtcctcagttgtcgctggtttctgcttgtgttctctccgcttcttcactgctgtctttctccttgcgcctcgttcgctggtgcgtcgcgtgtccgtgtttcgggttctggcgcgcccttgcgtgccgctcttgtcgcgctccgtgggtgttgtgtgtggtggggtggtgttctgttggcgtggctgtggcgtctctctgtgtttctatgtgctgtcgcgtcgtctcttctcgcgtccttgcgcgctcgcccgtcgtgcctcgtggcggcggcgcgggtgcggtgtggcgggtctggttgtgccgcggggggcgcgcgtcgcgtctctctgcgcggttggtgcgcccgcggccgttgccctccttgtggtgtcttgtttgcgggctctggtcgtgttctttttgtgggccttgggtggcgctgtggggggtcgggcgtgttctcgttgtgtcgccgccctcttctctgctctgcttnnccnctctncccgcgcgcggctctctccngtttgtgctcgtggctggtgggggggtggcgggcgtgtgcccgtngtctttggggcgggtcggcgtccccttgtttttcttcgtgcgcgctttgtgttctgcggcgctgtgttgttccctgtgcggtgggccgcctgcggtctttncttcagatttctgggtctgctcccgtcgcccccccccctcctgcgcgtccgccgccccccgccnccccaggggcttttttcttttttttgtctcttcctttttagggttttttttttctcttttttgtttttcttactctctttcccctactctcccccnttnaatatntcttctcctcccccct

SEQ ID NO: 7743 - DNA, 251 bp, Homo sapiens
ccctggtacgtgatgttccccaccctgtgtccaagtgttcgaaatgaggagatttattatgaaaattggctcacacaattatggaggccttcaagaagtcccacaatatcggccgggcgcggtggctcacacctgtaatcccagcactttgggaggccaaggcgggcggatcacctgagttcaagagttccagaccagcctggccaacatggtgaaaccttgtctctactaaaaatacaaaaaaaaaaaaa

SEQ ID NO: 7744 - DNA, 1204 bp, Homo sapiens
atgtagtgtcgaagagcactcggctgatgaggtaaagacgatgtttttgacgtacagataatatgtgctttcgattttatttacacccctctcatctttaagtaccacttcaaatgtttttctcccttacccccttcaaccaccctcacccatcacggattgcccgccgagtatcctctggtacccgttccgcctccacaccccctccgtccgagacgtcccaaagattaattaatgttctattcattagggttacgcagtcggcgccccgagatgtcggaggccgtttctttttcccactcccttccgaccaacctatctatcatcactaagatcacactatccgcaactttcacttatttacgtgtcaccggccatgtgcgaggtcttacatagtctcctcatccactagtgatagaaagcgaatagtatgatatcatacagcacagaggcgttattaaatatagaagcagcacaaagaagccaacgcgggttcatagataactggcgtatcgtccaaatgaccgactgtcgtccaggccgatgtgtcagcgcgcacttagctccaactactaaactagtacctaacggtacttgtcaatgtcgtaccacgagcgattatcgagcccgcattggtagtaatttgtagaggggacaacgctcgacacggtgtcctagtctgcgcgctgcactcccaccacagttattatccctcctctccgtctccttacttgtcacgatctcagattcctacttcctcacttctccatatcccgcatgacggatgtgcgaatagagtgccgcctctttctcttcgttagtgtggatgcgtcacctcgactgatactcgcatcgcgcacgccctctagaatctcctcgcggcgcggaacgaacgacggtgagtcagtgatgtgttggttcaatcacgagtaaattagactgactcagtatgtgtgactgtcagtggcgtagggttaggttcgtggtgtcagtgcacatggatttacatggcaggatttaccagtaccacttcagctagtcggaggctgagtaggatgttcagactatctttcagtctggaaatgacagcccggcttggctgggcgcgcgcctgacgacacgcctactatataatctagctgatgtcccccatagcacattctatgaacataagaataacatgcttatgtaaccttagctcggc

SEQ ID NO: 7745 - DNA, 744 bp, Homo sapiens
caaagccaggcgacttagcgaggaacagaaacccaccccagctaaagggaagccgcacgcagggcttctaacacaaaaggcgacacagaagcacaacgcgctcgaagggaccaccgcacacggccagacgccggcaggcgcagacaaccaacgggagggggccctcccccacaagcagacgaacaccagacaacccacgggacaaggcaacaaagacaccgccgaaaggccacacaaaacgggcagcaactggcccaccaacccccagccaaaaatggtggccgggaagcccggccacaaataaaggacaggacggggtggctgaacaaagacggcaagaacaacaagagcacgcggcccagaagacagcacgggcaagggaggaacaacccaggccccgagacacacgcggcaaacgaaaaaaacgcaaagagggggccacaaagaaacccccaacgggaagggagacaacggcacaaccagcagcaaggaaagggggacggaggccccaaaaaaaccgaccggaacaacagagcaacacgggacaaacaaacacacaggcgcgcgcagaccactaagcggggggaaggacatgaagggacaaacaaagacccgcaaaacccacgaccaaacaaacgccaggggcagggtaaacaccacacaaagcgggaccaccgcggggcaaccaaaaaccgaaacccacaaccacaaagcaagaggcccagcgacagagaacgaggcaag

SEQ ID NO: 7746 - DNA, 181 bp, Homo sapiens
tttttttaattgctcccctaggaaagtacagacaactatagacaggaaacaaagtagagaatagaactgaggcgcttttgaagtcttggcgtcatgtcatgaagtgacatctgtatgattgaaataaaccagacctgctactcgtgctgtgaacccctcaagttaccttaataaagcgaga

SEQ ID NO: 7747 - DNA, 865 bp, Homo sapiens
  misc_feature (1)...(865): n = A,T,C or G
ttcatttttttgcctgccgccagtaaaagtggcctttgccttccccgtttgccaagattggaggcctcccaagccaggcagaactagaggtccctntaccttctttttttttattaattgcccagtctgggttagttcttatcaaagggtaagaagggactcatacagcgggattttttttttttttttttttttttagatgaagtctggtttggtttgtcacccaggctggagtgcactggcaggatctcggctcagtgcaacctctgcctcccgggttcaagccattttcttgcntcagcctccntcagcctctngagtagctgggattacaggcacatgccatcaggcccagctaattatttgtgttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatngagtgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacagaattcaaatgtgagtcaatgcaacttggagaatttcgttaatgccggntagggnaatggctagtatcacaagtc

SEQ ID NO: 7748 - DNA, 337 bp, Homo sapiens
acctgcattgagctgcggtgctgatgtttctcctagtagcatggttttcggtataaaaatatgcaaaaaagtgacgtgaggaatatttgaaccaaggatttaaccttcaaaatatcaggaatgggaaaggaggcagctaagaagatggagaaggatatactggggaaataagtcataaggatttgcctttcagttaaaaaactttccctgaagcagctattagagaaaagcaacttattataattctgaaaatttttccttcttgatgttctatctctatgcagatgtcatctcctcttgtattcagtagaaaaaaaataaatcagtatcgcaaagc

SEQ ID NO: 7749 - DNA, 894 bp, Homo sapiens
  misc_feature (1)...(894): n = A,T,C or G
cggcattcgaaagtaaagcagaatgttactccatcgcagctttataacgttgtacttggtgcaaagtggggatggaaatgcatctttaaaagattacgcttgactgtgaaatggccatttcatagtactagcaggagtgttaatattatagcgctcaatatcatttagaagaatggacatcgggagttcagcgcaatgaaacaaagccctagttacatcaggatgtgttccccctacaaggacatagccaggccaaagaactgaggataataagaatcagggagctttcgcaaaaatagagtttttattgggacctttataatttccgatagggacaaagagtcaatggtaaattatcagcgttagagttgtcgttcgaagaacagtggtatgatcaatagactgtggatgccttgcaacttgtcttagggtttgtatttgccgaaatggagccaattctctccaaacccactgcagtcaataatgtgccgcaaaaatgatgtttctgttcctgacccataagctttgtttcggagagttattaacacagaagcccaagctgctgttttcttgtagacaatcgggttgtcctgattcaaatttatgcatagaaattgaatctcattagcgtggacttatactgtatagaccaagcatgtaaataattgaaaccttccagggctatattaaatcttcaactgattttaaaagcagtttatcttgatattttactttatttcttaatcccattcgacacagttgatttttcctccagttaatcttttcattgtgtttatacattgagatagttcagtctgttcaattttaataaaaaggtgaccgagcaggctctctctttttttttatanattaactgaaccatataagactata

SEQ ID NO: 7750 - DNA, 1469 bp, Homo sapiens
  misc_feature (1)...(1469): n = A,T,C or G
catatacgacagaggcagcgtgaatacactgagcgtcgcacngctcgtctggcncgttctactgacgctaggtcgcaagcgtctgacgcgtgcgcagacaccgactgtactaaccgcgactacgggacacgtgctacacgcgcggaccacgcgagcgcgatcgaccgagatatcacacgccgataacganatcgcacgtgatcatgcgcacgtgtgagcgcacaatctgcgacgacgtacgtcacacanatatcgcacggancgagactgacgtggataggtatggcatgactacggcgtacggtagacgccggagcgagaggacganagtgtnagtgcttgctagcgcatgtgtgcactcgacatacgacaacagtgcacggctacaaacagaggatgtgagcgcgatgtgaactaagaagtatatacganaaagtacgcgcaaccacactacacagtgacgagacaacgtacangtgacgcgcanttgatntcattagaacttacacatccgagcgcttaaccactcgcatcgancnaacgacgaagacacacatccgaggtcatcgactcgtaatctgtacgcataacgtgctggcgctgtcgcctcgatgcgagatcgacagcaccgcacagagagcgcgacgctgngggatgaggcgaggagtgtagtgaaganagacnaacgagaagataacagcacaggacacaactcgcacgaacgtcttgttagtgtgacgtggcgtctctcttaatcgtactagccacgtgcgctcgccgncgctctcagcgncgcttcactctctgtgcggcctatctcactcattattggtcaccatccggctcgcgtccacgtgtgagcatcacacgacaattatgataacaatntcttatntnctcaccaccncgctacttgacacctaccctctacacgctatgctgcactgcancnaaccntcttctcataccactattattatntccactcttcttagncctcacatcctctctatgtgacacgtttcaacttnntgatgtntaatattcatatcttngnagtgnttattntcgtgctttggtattntatntncatatatcacttcagtactntactgcacttacagaaacacactaatacctctaatctatattaacacacccatacttccacactctaccactctccaccttgcgcatccacttattacactatctactcttcaanacacatttatacaactaatatnatctattttcttataacactataacacacctccccctcactntccanncccaanacanaataagatatatatantatananaacacaatatatacataatatatatattatataanatatatatancatatatacanactacatatagagananaataanagtattatataaaaaatatatataaangatatatatacacacacgcttatggaatgctcgtc

SEQ ID NO: 7751 - DNA, 805 bp, Homo sapiens
cggcgagttaataagttgcgaaaaagagcatcctacaattagccgcggcaggcatataaaccaaaaaaaacacctcgaaaccacatgcataccattgtcggtaccaaaaggcgattataaatgttaaaaccaccgatgtggtaggctcacaccaaagggacacatataatctgtggtaagaatgcaattagtcagcccggtggaaaacagtcaaagatttttccaggaactttaaacagggctccattcgccctaccaatcccaatgctgcgtatatacccaaagaaaaataagtcattcttccaaaaagacacatgcattcatatgttcattgccacactatttataaagcaaagaacatggaatcaactcgtgcccatcaattgtagattggataaagaaaatgtggtacaaatgcaccatggaatactacacaaccataaaaaaagaatgaaatcatattctttggagaaacatggatgcaggtggaggtcataattttaagtggactaatgaaggaacagaaaaccaaatatggtatgttctcacttacaagtgggaactaaacaatgagcacacatggatgcaaataagggaacaacagacactgcagactgctacagggtagaaggtaaaagtggggaatgagttgaaaaactacctatctggtattgtactcactacctgcttgatgggatccataccccaagcctcagcatcatgaaatattcccatgtaacaaacctgcacatctacccccgtatctaaaataaaagttgagaataaataaattggtatcggcaag

SEQ ID NO: 7752 - DNA, 862 bp, Homo sapiens
atggtcatacaagagtgatcagagaccagctcattgcaacattgttgccggggaccgaggtggttgaaaaccttccacggccgagcgcacacacggcgtgggtgacgcgcccgacaccagtcgtgacactggtacctcgtagaggtggagcgctgtagagtcagatcgagcttacttggaactatatatcggcgttatatttacgcactattatgtagggatcctgcgattatcaactgcagtacgaagtaatatctcaaattgttaccgcagagcagtaagtatcaaatgattatcatacccttcgctacgcgtgtacatttgtaaccccagtgtggattgttcaatgctccatggaaggtttttagcaaagaggtcctgcatggcttgtatattaccaaggcatctcatgtaatgcaagatagtggcatgaacatgtattggctcatactgtggttaggcagtcttcgcagtgtatacagggaatgtgctcgcaataacccgttcctccagtcaacgttttcaagaatgaaagttcatcctgctgcttttcattgcaaagaatagtgaagttagatcgctgtaattactatgccctgtttgtcctctctcatttctctcccctaaacctggttcctatcattgctgtgtgggatctccatttataaggaagctcaaaatgcaaacattgatgcatttcttttattatattataacatctaatttagaatttacttaaaattgttataaaatctgttggacaatgccagaagatatagcgatactcgcaataaatcaataaagaagcattcgcaaagactttcatatgcagtgcgtagtgccgaaatccgggatcagtaat

SEQ ID NO: 7753 - DNA, 539 bp, Homo sapiens
tcaaccagccaaccaaccaaccaccgacagcaaacacctgcaaaactgttcttatgttatcagataaaggagcattgtatgctgatgaatatttggactgaggagttggttcaaatcccagctgtgccacttacacctgcagtactttggttaagtcagttaacctccctatacttcagttttatgatctggaaaatgaaggattatagaattcatgccacataaagtagttatgataattaactttgttaatatggataagcacttgctttgtatagagtaagcaaaaaaaaatgccttttattggtgtttcttggactctatcagtgtgtcactttgaatctccaatgacttaccacgagtgtttccagaaaaacaccttttgctttctaagagaaattctggtgccagatgctcaggggatactgggtttatattattaaaaatgttttcatcctagaaatggatttggaaaatgtggacggctggtattattatctcgcattaagggctaaaatactggaataaacgaaagatgc

SEQ ID NO: 7754 - DNA, 1337 bp, Homo sapiens
  misc_feature (1)...(1337): n = A,T,C or G
ctgtgtagtggtggtcctgttatccttattgttgcggtgtctggcattctttctctcggtcgtttatggtcctctgtgtgtgtacgtggggtgtcgctgctctgatgtgcggtggtggtgtgtggtttgtcggctttgctctgtgttgcttctgccattattcagtgcatcagcgttggtgtggctgttggtgtcttatctggtgtctctgttgtctcttctgtgtgtcgtctgtcgtgcctcacgctggtccgtcgtcagggttatttgtgtttgtgtttgctgctgtgttctatcgcagtcctctctatctctgtgtcgctgcgtggcgctgctagttctgtgttgctgtcgtaagcggtgcgtggtggtgcgtnttatgttgtcttgtctgtgtgttgcgcggggggtgtgtcgtgtcttgtttgcgctgtgcgacttggtcgtggttgtgtgtgtctgggtgcgatgtttgtgtgcggttgtactctctgtctgttctgcgttgctcgtctggctcgctataatctgttggcttttctactagtctagtgttgtgttgtgtgttctntcgcgctctcgtgtctctggtctatctttgctcctacttgggtgttcttggtgttcttagttgattgtggtgcgtttggctgttcttttatggttttgtatctcttcttggttttgctgcgcgtttcntcgctggggttggtgtgcttcgttgttcgtgcgtggcgtgtatgtggtagtaagtcttccttctccgtgcgttcttgttgcgtttctctgctctcgttgcctcttcgctctgtgcgtgttgttgcttctctctggcggttggttctttgtgttttgtgtgtcgtctgtcgctgcgtcgatcggtgttgttagtcctccctccttcgtgtgaaaaagaaatgtctcttttgttctggtgttttccggttgtctctcttttacttctctggtggtttgtgtgttctgcgttctcttcgtcgtctctttcgttgtcttgctcttctcgtgcggtcgttngcgtgtggtgngttgtggtgtgcgtttgtgttgtttttggtgttgtgtgttgtgggtgtgttgcgtgttngcggtgtgtcttcgtggtgtgttctctccccgcttccgctccgtctgttttgtctgtaacgtttgtgtgtttcncgtttcttcntgtggtgtttctcctgtgtggctgttgggtttttcttcctctttttcacnntttttnnttanactgtacgcgccgctgaaaacctttttttcttttctngttgtgtgtcttctttttgttttggcccttccgttgtgttttgtgcttt

SEQ ID NO: 7755 - DNA, 1211 bp, Homo sapiens
  misc_feature (1)...(1211): n = A,T,C or G
ctcccgcattgtggtgtgtccttcgcttctctcctgtctcgtgggccgtctcctgcgctgggggtggtgcgggggcgtcggcctccttcttcgtgccgtgctgtgctgttcttccgctcgccctcgcggcgggggccccctgcttcgctctcgcccggtcgtgggtttttgccgggttgctggggcgcggtggtcggtttccggcctttctccgtacgcgtgctgtgctctctggcgacggcgcngctcttgtggcgccggcgcgcgtttcgcctctctcgngcttcgtgcggagcggcgcgccgagtcggtggctggtgcgtccgtgtgcttgtggggtctgtctcgntctgtcgcgcctcgttcggtgcggcgctgaccggtctacgcgcgtctcgcggtgncggctgctggagtcgtctctcgtcaggatngcgcgtcgcttgctctttctgtgtcgtccgctcgcatgtgtgcgtcgctcggcggcatctctgtcttctctcctggcgcgctgcgccctcgtgtggcggttcgcctctggtcgttttggtggcgtcctgtgatcgtccctcggtcgcggtcgtcgcgtggtggggtggctcgctgtggtggggcgccctcccctctgtggggcgggcggcgcgcgcgcggcccctgcggcgtttccgtcgcggggggcgtggctcttctcgcgccgcgcgtgcgggtgtgggcggtttctggacgtcgtggtgtcggcgtcggcggtgcgcttcggcgtgtgtcttcgtgctgctgcggcggcggtcgtncgcgtctggcgtcgcccgcccgtccgtcgcgctcgctgtgcggttctgttcctttgcgtggcgtgttgtttctctcctcgtgcgtggtgtatcggcgtgcttgcggtcctgcggttgctcgtcgccgtcgcgcggggtgttctggggttgtgttttcccttctgtcgtccgcgtccttggctcctgcccgcctcttttcggtgctcttcctcgcctcgccggtcgtccttcgcgtcctgttcctttgcccgtnccgcctcgctgcgggctttgctctttgtctgtcggttgttggtctctggcgtctcgggttgttggtgcggttttcccccctggaaggttgtttttgtttttctttcacgttttcgttggtgtgtgtggttcgtcgcggctcggggtgtgtgccgtgtgtgcgcg

SEQ ID NO: 7756 - DNA, 694 bp, Homo sapiens
aggcctcagttcttctacccatgggcctctccacagagctgcttgagtatcctcagacgtggtggctggctttacccaggggaagaagaaagacaaaaaagtccagaaaccagcagcagcagggtctgtgccgcctttatgagctgtaacactcaccgcgaaggtctgcagcttcactcctgaagccagccagaccacgaatccgccagaaggaagaaactctgaacatgtccgaacatcggaaggaacaaactccagatacaccatctttaagaactgtaacactcaccgcgagggtccacggcttcattcttgaagtcagcgagaccgagagcccaccaattctggacacacttcgagtagtgtggttggagaaggtccttgggagaagacaacatcacacctgaaataagagagattagaaggagccagtgataacagaccctggaagaagggaattcaggacagagggagcagaaggctctaacgtggaaacaagaaggccagagtacccagagcaaaatgggaaggggattcctaatcaggaagggatcatatggtggttgtcactgagagcattcattggacgcctccccatgttctacaaaatttgacttaagaattaaaacaaattatttctctggctttggcttaaaacgggtttaaataacccgattccaatgataaccgcggg

SEQ ID NO: 7757 - DNA, 839 bp, Homo sapiens
  misc_feature (1)...(839): n = A,T,C or G
ataaaggagggagcgtacatgggaaatagtcaatatctgcctccaatttgcagctcaagatttccaagagtgctcctggcacaaagtatgaacagcagactcgaaattaaaaatggtcttgataatcggatgatggacagaagccagcatcctgcaccagatacaactggctatataagagggaaatgctgaactgactgagggagctctgagaactgcgcatgattcgcattgttaccctggactgtgaaacgatgcaacgggcggcttgcatttgtggtgggaaaaagtgaacacccagtcgtcctgttgcctgttagtgtggattaatatggaaacaatctgtggaggcgcgccgtgcacatccgttatgtcgggtgtcatggatggatggcgagagggtgtgaacgagtgggacgagatcgcgtggggaatggagggaataaccgtggaaataacgatgtgacctgagtaacccgactgtgggtctcgagccggtttgtatggggcgggtgggttgggggtctgagatgtgtgcccaggggcgtgagtgggttggtgatgggctggcgggtgaaggttctgcaggaaggaatcccatcgtagttgacacaaatgaggggcggcactcccccgagagggtggggggaaacaaagaagtggggggaggtgaggggggccggaaatactagcggggatggccgtattggttgatcgatatgggtgcggaaggaaggggtgagtngggagcgcggctgcgaccagacggccaaaccggtggtggccagacaccggtagtgaggtccggaatgggtagcgggtgccacggatacgggggg

SEQ ID NO: 7758 - DNA, 281 bp, Homo sapiens
gagggcctctgggcgcgttgcgggggcccacctggctgctatcggaaacccccgcgcctttttgtcttgtgcgatccggggcctctgtttcgtcttcacgccggtggtctcttacgggggaggggggcggtcttaaagagctgatctgggacacgcccccgtgtggcgctgacgcgtggtcctggtgggggaatttagggcgagagtgacgcgggtataaacgtgtgtacgcacgtggtaggcgggtggggaaccggtgcgcggaaagggtagaagggggg

SEQ ID NO: 7759 - DNA, 1440 bp, Homo sapiens
  misc_feature (1)...(1440): n = A,T,C or G
cgctcgtcgcgtgctctgttcttactcancctctacgtgctgatggtagacgtgaactacttgaggcagatctacnagcgtctatctcatcaagatgtggtggtgttactcganacgtggtgatgctagagtgataacttcaatatctccgtgtttcgtctctttggcgttggtgctttactatgcntgatgtgagcatctcagtggagtggctgatagtgaatgacgatgttcgacaagcatcatntgattataaaagtgaggagaggtgagaaagatgtgtcatgtgataatattcctcacaactaattctgattcgcgacaatataactatctaataaggacagctcacatatataacgatcatagtggttaaacgtggaggcggaggtgggtgactagaacatgtacagaaatgtaatgtcatcctggacgcgttccgtagaacacacttgcgcgaagcatagccgtacacaagaatgagacgtatgtacgatgactattcaatgagcactcagtgagaatatctatatcgtatagtcgacgagtgaagtatagcagatacgcgangagcagtaaaacattaacaataagacggcgctctgctgtgcgcgagctctccgcgcggatngagacgacgttgtcacgcttggtgtgtaacaacatcgtatcgactctcagatgctagtgtcgagagtcactatgcgtgtgtgacagtgcggacttattatgatgatgccatcgcatcgtcctctcatactacatctgcgagatatgatgcgtcacattgagtatgtctatgagcgcgcatcttatgtgcgagagtnttgtcgtggtgcggtgattcatgcactatagtgatgtatggaagagtcttgggtgcatacggtcggaatatggtgactgagatgaggagattacgatcgtgcgcgttggtaaggatcaggatggctagtgctgttgagcgcggtattgagaaggaaactaagtataatcgtctaaaactctgatcagaatcacatcacgtnacgatgccgctgtaatagaggctggattgtgacatcattaaaatacataactctcaaaagtgtgtgctgagagagttatctcggaaggtgtgtgagcgtgcattttcggatcggatagtgaaagggagtactaagcactgtagtcttattagcatgtgggaagatgaggcggaaataagtatatttatacatggataataatgtgtctagcgcaacaaatgtgataaatgtagtaacgcatttactagcgatcgaaattccttgttcatgtgaacgctcaggaatacgggagtatataacggaataagattagtagtctgacgtgtgtgctccgaggaaccggtgctattgtgtcagtagtctccgacagaagactagtggtcggtgatattcgttgagcgtcgctctactg

SEQ ID NO: 7760 - DNA, 1389 bp, Homo sapiens
  misc_feature (1)...(1389): n = A,T,C or G
gtgtctgtgcgcgggttgttggcgtcgcgtggcggtgtctgtgtgatcgtctgtggttcctctgcttntctcgttgtttttgctgtgcgtcgtttcgcgttctgtgctttctgcttgcgtgtttgctgcattcgtctctgctatcttntcttcgtgtcctcctggtcgctcttctgtagggctctgtcgctgctctcttgtgccgtgtctgcgctgttggcgtctgtctagcgcgtcggtgtcgcgcccgttcgcgtctgtgtctgtgggtttcggcgttgtctcgtcgtggcttgtctgtggtgtcgtgnttcgcgtgtattggtnggcgtgccgtcgtggcctttcgtnttgtcggtgtnttatgctcttcgtcgcgtcttcagtgcggttctgtcgtagtgcgcggcgggcggcgtttgaggtgtccgtcgttctcgtcgttttccgtcgggcggtgnggtcttgtcctgggttctgcagtgtcgtttgttctcgtttgtcgccatgtgccgtcttctggcgtgggtcttgctgtcgtcggccgtggcttttgctggctcgggcttcgttcgccacgttggttccgctgtgtttgtggtgtctggttattggtctcggcgtgtgtcttcgctgcgtcgcctcggctggctctgggtgggtcgttgtctcgtccctgtgcggtgcttgcttcgtgtgggcggtgtgcctgtggcgctttctctcgctgtgtttttgtccgggtgtgctgtgttttctgtgtgcggtgctggtgggcggtgcgcgtccgtggttgtccgcgtgatgcgctccgcgtgctcgtgcgctgtgatcgtccggtgggttctncgtccgtgagccgcgcttccgccctgccgtcgcgtgccgctgctgatgtcgctcttgtgtgggtgccgtgcgtgttccgttcttgtttctgttccttgcgcgggtgatagcgtggtgtttggttggccctttccngctctgtggctgnctgggtgccggcttgcggtctctcggcttctcgtcgtgtcctggttctgccgcgttcgtgtcgtgggcgtgcgctcttgcccgcgctctgctgtgtctgtgctgccctgtcctggtgccgtcttgctcgttgctcttctgntccctctcgctgccttctgtgntgtgtgtccttttgcttgtngcgcgtgggccgtgcgcgtggtgtttcgtcgngcggtgcngcggttggcgtctttgtggttggttggtttttgttcctcgctgntgtgaaggcgtggtgtttgtgntgtgtttttctcccgtcggcagcggttttgtngtttttcntgttcttctctgtgcgttgtgcgcggtctcgcacggttggtcgtacctcgtgtgtttgggtgc

SEQ ID NO: 7761 - DNA, 722 bp, Homo sapiens
tcacagctaaatggagaacgccgcctcggcttttatcacatcattcttaaacttgaacgagtgggggttttttaacaccggtcacattgaaaacggcaccggtaaaggccttaatggaaaggtgcactgcgaaaatgcctgcggagcctagccgtataacctacctggcgctttctgagaaagacacctggtggggtcgcccaggatgttatacctccctagaaagattccccggaggtgttacagcgcttatagataccccgggctcaaaacagtgccccaaaaaatcccaaggttggccaattaggggcaatttaatttcttctccccatatgtggggtgcccccggaacagtcccctatttcttaaaaaaataggcgatgtttccagcgaggaacctgcatttttgtgagaagaagctttgaaatggacccccatccgggcttttttcaaggcgtctttttggacaaccgagtttacctgcccgggggtgaatgccccactccaacctacctggaatttttttatggaaaaacgtccttgccccccccaagtcctttctcattcccccttaggtaaaagtaaagtgccaggctcttgcccgttcccttaatttccggaagaccattgccatgtgtctcggtgtgtgtgattgatagaacccaatgcctaaagttctaaccgttgtattataccttgccaccccccataatgcggaatat

SEQ ID NO: 7762 - DNA, 1698 bp, Homo sapiens
  misc_feature (1)...(1698): n = A,T,C or G
cttctctcgcgtacganttctcntcgcngatgcgcggtcgtntgttcgtctctgcgcgnntgcgtgcgatctgatngcctctcgccttcgcngcgctgatctgtatctgtcgtgtcnctngcntgcgatcgcagtctgctgtcgagtgtgtgcatctcntctctcagcgtatagactctcntgcgtcgcgatgcangggtcgtcgtngtcgtcatccgtgtcgtctcttcntctcgtnctnttgctggcgtccgctgcgggncgcatctgtctntgatgtngtgtggtgtgagtcgacgtcgccgtcgtcgctgtgctgacgtatgtgtcgtgtgtgtgtgctcagcggtcggtctntgcgtcgctgttctacgtctgcgcgctgtagtacgcatcattcatagtaagngcangtagcgtctntacgtcctctgcgttcgcacccgctcgtcttcgcgacngctcgtcntctctccgtcactctgtctncngcgtgcgtcgatgcatcgacgctgcatgctctctcncactctcgtgcgcgtcaggcgcgcgggtgggtcantctgtctcatctccantcggagctctgtgttctcgccttgctntcttgtcgctctgtntgtgatgctgtcgtactctcttttatgtgtcggcgtgtgngctcgttgtgtgctcgcntnagngcgcgtgcgntgctagctgatcgagcgtgtgtggcacntatcagcttgtgggctggtctgctngtgtgtatctggtctgtgcgtgttcgcgtgctgcagctgctctcgtagtggctctctctgctctggtgntgtgagttgtagtcgtgcngggntcgttgtgctgctcgcagtnttctgcgcagctgtctctgctgctacgtcagcggctctctgccgncgctcggtaggtcgctctgcgcgatcaacttcgcaggccctgtgctgtgtggcggcctggttgtgagtgtgtgtgtgctncgtgtcgagcgcgcggtgagttcgtctactcggtctcgctagtgcgctcgccctgtcgtgcgtgtggcgcgtttgcatgctctcctattcgtccngtgctcatcgtggtgggcactagctgcgtcgtcctgtcgtcgcgctctctntggcgcttgcgctcgccgtagtgtggctctgttgtcttcctgtgcggtgctcggtcgtcttgtcattcttcgtgtcttagcggctatgacgatcgcgtncgcttctccctcgcctcgcccccctgtcggcggctggcgtgcgtgcgtgttgttgtctcgttgttctacctggcgtcgtggtgttgttggcgtgtttcttttgtggtctctgtgtctgtttatcttgtgggcgtgccactgcgtggtcggcccgggtctttcgtcgttcctcttccttggtggcgtactggttgtggctcctgttcttgtctttcggttgctggtcgctgggcggtgggcggctccccctcggttggctttgcggtgcttgnccttgcttgtgtggtgtgtgctccgtggcgcgttcgggcttcgccgcgtcctgggtgtctgtcctgttcgtctcttaaacctttcttcnctgtctctctgtgtctctctgnggcgtgagngtccttcctctttctctcctcgtccgtctgctgttgtgctgttacgtntagtttgctggtgttatgcggtgcgtcgcg

SEQ ID NO: 7763 - DNA, 1140 bp, Homo sapiens
  misc_feature (1)...(1140): n = A,T,C or G
gccgcgggccggcggggcgcgcgctcgcaccgcggccccgcagcgcacctcgcgtgggcggccgcgtctcgtgccgccttgggtctgcctgcgcgtcgccgtggtggtcttctcctctcgtngctgcctctcgtgcgcgttgcgaggcgccgctcgcttgctgcttgtgcggtggtgcggcccttcgtctctggcgcgtgctggggctgccgtgcctcggcgtccgtgcgtcgcggggggcttgtgctcttcgggctgttcgcctcgtgncggtgcgcgttgtggccgtcgctggggcgctgggccctccttgtgccggtgtctgccgtctttgcgtnttggcttcgtctctgcgtcggcgtcgccgctccggcgttgcgcgtcgctggtccctccgtgccgccggcgtggtctggggcgtgttctccgttgcgcgctggtcgtgtggtccgccgttctctggtttgtccccttctgtgtgggtgtgccgggctcgcctctcccggctgctcttgtttcgcgcccctggcggggtctcggtngccctgtcgggtgtttgttgggtggttttggcggtccgtccgccgggggcggggcctggtggtctgtgcttcgctgggggccgcctttttggcgcgtgcgtgggggctcttctggtgcctcggccggccgtgggtgcgctggtctctcggggtctttgtccgcgttgtgcgttggccttgcccttttcgctcgctctgggtgctctgctcgtgcctcgtgctttggtggggtgcggctgtcgtctggtcgcgctctggcgcgcgtcccgtgcggtggtctggcctcgtcgcgggctcgttccgcgcgcgtgctctttcttcgtctggcgcggttgtgcttgtgtcctgctgtccgtcgtgtctcctcgtgttgtccgcgtctttctttctggtctcgtgtggcgcgtctgttctttgtggtcgtgtgcgtttctgttgctgcgggcgtgtcgtgcgttttgcgttcctggctcggccgtctgcgtttgggggtttttcctccctcttgagggctttctgttnttgtttccccctcgcagggctttgtttcttgtccttcgcttgctttcttcgctctcccctggtcttgtgtgttggc

SEQ ID NO: 7764 - DNA, 966 bp, Homo sapiens
  misc_feature (1)...(966): n = A,T,C or G
cggggccgcgcgtcgccgggtgcccgggctcctgctttcccttgctcccgtgcgcctccttctttgcctcccccgccctcgctccgcgcgccccctcctgctcgtttccgttccccttttctctgcccttcccgtcttgtttgcccgcgccgcgtgcggcgccccctctccccccctctcgttttttttgcttgttctatcctccgccgtcttccttcccgcgctgcccccccctgtgggctcgtggccgcccggtgcccgcccgcttgctgctccccctccctctcccgccgcccgtctgcgtcccctccccgttcgtcccctccttttgttgcccgccccctcccctccgcctccgtgttccctcgcctgtccgctgggtggttctctgcggcctgccgctccgccccggggcgccctcgcctcctcgcgcccctcggcgtttgcctccggtccggttctccgtcttattttcttcccgctcgcctttctccccccttcttggcgcgcttcctcgcggggcctgttggcgtcccgggcgctctccggggtggttgccgccttctctctcgggggcttctttctcccgcactgttcggccgcgccctcttcccccgcgcggttgcgttccttcctccgttctggcttttttgtgcgctcgaaaaaaaggcctcccccctgttgcgcccttctcgtgtgnttctcgtgcgtcgcttcgtttttttttctctcgcctgttggggtggggcggcttctttcccatcttccttggcccctcttcctgctccctctctctctgctctccgcctctctggtgttgtttgcctccccgggcccgccgcacgcctttgtggctttcgtgggtgccgtcttcctttgtttcccccaacgaggttttgttctttacaaaaaaaaccggcttgtcgtcttccgcgccttcctccgcttgtcgcgtcgtctcctcgt

SEQ ID NO: 7765 - DNA, 794 bp, Homo sapiens
ggatgatagggaggaagcatatgagccaccagatgaagtatctgcttggcacccggcagagtaagatcaacacaaggaacatttggaagagcttttgaagaagccaaaaagggaatggtgtctggacccaggcaataactggatttcaaggaaggaaaaaaatcttcagaagaacatggattttcccccctggtagttagttgtctctcccatatccagaaataacttgaacacgttagacggggcccctgtgcatagtgtcctcccaggaaaacgccaagattctccaagacgctttcatatcctaagccctgttctgtttgttcttgtgtagtaaattggcaaatttggcagtacagaagacatctctaacctgatgtcacaaagaatcatgtctggcccatacaaagtattctaactaaccatgtaagccactagaatgttaaactaatgctctggcactgaggtgggtatcttgagcatttgtgactttacagtttattatctgtattggttagaatatatatgaacatatgctaatatcacattaatgaattctgtaaaaggttattttaaaaaaatctgtatttagaaaaatacctataccaaaactgctaatagtggaattagtaataaaggtgtgagaaattttgttttttatatttcatatggtttgaaattgtttttacaatacatatgacttttgtgactacagacaaaacttgaagacattgtgtgtgtgtgtgtgtgaagccattcttgcattactctaaatagatacctgagacagggat

SEQ ID NO: 7766 - DNA, 1765 bp, Homo sapiens
  misc_feature (1)...(1765): n = A,T,C or G
agctatcgatgtctggggctgtgtgcgatgactgcgtaggtgccgatgcngnctccggcgatcgcgacgctngtacagatcatacgtcaccgcgacgcacatcgtgatgtcacgctcgtgtcgtcttgtctctcgcgctcgctggaagctgnctacggcanaccnctctagtatgaggtgctgctcgcgcgggcgtngngacggaagcgacgtgcagtgtatttgccatganactagcgcatcgcatcgtgatcaccatctactacgctgtcgcgaccccgtagctactcgtgatagcgcgacttacttctgactctgactntatatacgcatcgcaatgatctccgaagaatgtgataactatanatgacgtgtgtctcagtgcaggatttcctcatctcctccatatcatctaatngtgngcgatactgcaggnacgtcatatagaacgataactgcagaccagcaagacgagtcatacgtatatgacgacgttacagaagtcctcaaagtatatgacgtgtgcagacctaagcatacgcaatattctcccactgattgtccgttggcttagtcatgatggattttctagtgcatgacacagtagacatatacgcaagagtgttcgcactagctgtcnctagcgtntnctcntgctaacctccacntatatctgatctgcacaatagcacatatgtggtgcgctactgagttgacacgtggtagaactanaccgagagagagagtgcggngtgtaggtccataacatggatctgactggataatatnatatatgtatatacgcaggctatgagagtgttacncctgccagctgtgtacacgatctatagcgctactcgnagtctaactgatgntcgcattnccacactcacttcacgtctcacacgcgctcgcagtgtgcggacttnactgtcggtgaagcgagacgcgacgctcctctcgctcctcatagtcggcggtcacgagaacgtggcatgatgatgtgtcatctcgagtgtctagagtctattcatttagtacagagacagttatgttctctagtatcgctgtccatcgctctcctatctatctaatntgtctacgttgttatgcgctgatacgattccgtctatgatctcgcagctacaacgacgtgtatatatccagtcgttcgaccgcgtagatatcgttcgtgagtctatcgcttgtgatatcgttgaggagatagtactcgcatgcggatgatatcgtcgttactatgcgtgataatcatgatgacgtagaatacgctgtcgcgatgtgtgttcatgntatagcagagatgctagcaagtctctacatcgtcatcgtntgactcacgcctatcactctgtangacacgatcagcatacatgaacgatatgcgtgtgagtaggccgcattatgantatatcggccncgccgccgacgnagaccgacgtcgctctactataatgactgctgtnatgtatngatagctgacgcgcgactcatgcntcgtgtntctctactatagngtctnactatacactcatgcgtagtacacntgctgcacgtgtcgagtacatatatatatgaatataggcgctcgcatacctactcgatgtgatgaagcagcattncnaatcacgctctgtcactantgtaagacttgnacgtacgcgcatctgcgtcgtcgtaganntcgacatacgctctactgcgatagcgacgtgtgacccatagttactcgccgatcagtgtatag

SEQ ID NO: 7767 - DNA, 1402 bp, Homo sapiens
  misc_feature (1)...(1402): n = A,T,C or G
ttaaattactctcacccgcgtactagcgtaagcagctaccacgctcgattactacaggntatgaacgatatagttcagaaacgcntatatgatctcntattgcacgagcctcccgccagtattcgcgtttaacccctcacggcgcgatccgttcgccgcagatgccagttagaagtatatgctttgtgatatagttgcgttctctagtcctctcacgcgcgatgtatctctctcttcctgtagctgcgagctttcgaccgtatatatagtatagccatcccgcgctcgtccactcgctgtctcggcggttgattgtcgccgatcgngttattgtatctcgattcgcatgctccgcttatctggttctcattttttatgtctatatcctcgtcgctacgccgtgccggctttctcggttatctattacgctccctttccgcttctgttctattcttcccgcgactccgttcngctccaatcatattttttgctctctgtcctgatttcntagctgccgctctcactatattacgttttttcattattcttgtttccgtctctcgncttcgtcctcgatgttttatgtggttcctgctcgctgattatcttgctctttgtacaacatccccagctatttcttcgccgcngcgctcatattgcgcgttcattgtctctgagtctgctccngcncctctctctggtcagtatccatctctttctatctctatatacgttgacagactctacccatagctccgtccggcttgcctgtatgttcattatcctcctcgctttcgctccgtgtatcacttactctgctgtgatcttgttcgtgtgacatacacactatcgagatgctntctgtatctattttctctntttcctgctactctgcttactctcttactatctaatactttcctcatatgtaacgctctatagcncgccctcgttctctttcttctatcgtcgctcatctctcctctctgttattgttcttattattcactgatgatcccgtatctccgctatatcattgattctaatgtcctcagtatatgtcctctctattattttattgctccgccgctctatcgcgtgtctatttgttctgcgacgttctccgcgccgtttctacttcctccacccttcgccattattactcacgtttcgcgctctgttcatcttccagtcgcgtgagcnttttctgcacatcgtcgtctgtcgactccctcatgctgtccgcgttctccgattctccntcactgcttctcccgttattctgccacgcgtcgctcgcctgcgctgttctgcattttcgtttgcgctgttcgccgcgttatattgtactctactcactcctcacgatggctacgtctcgatactcattcatctactcccg

SEQ ID NO: 7768 - DNA, 784 bp, Homo sapiens
agcagtacctgaatacaggtaactgatagacaccttcttactgaggctatagatgcatgcgctcatgattgtgctgatggcaagcagcttaaagaggacacacctgtgcgactcttgctcttagaccacaagctggaatactatgacccaacatatgactcatctgtgaccgggaactaccaaatgaaaatgattcttctgcctaagcctaccaactttatgagaaactcggctatgcctggcaggctgaacccttgtaatacctgcactcttcgggtggtgctataatagtccttaataacatgctttatgcctactggaaggcatttaactgttacatatgcagaaataactgaaacacggggtacgactcaactgcacttaggaagacctcagaaaaaccccaaaatgctcctaaacaattccatatactacacactgagcgtctttaatatagtaaaggagagctcaaattttgttaaaccagctgacttttgtaagctgatggaacatagactcatatttgctcaacacgggccttgttactaaaccagttaacgctgtaacttctaactaatgctgtgaaccccaagatgcatctcttgagcctcccacactttacagaggatgattttattcggatataccacttatttgcgcttgctaaattcacatacattgataatcgaggcctttgtactacgacatttttttataaaaaaatacttattacctgctcgattgaaacgcattttgttttaagagaaaaaatttgtttttaagt

SEQ ID NO: 7769 - DNA, 1216 bp, Homo sapiens
  misc_feature (1)...(1216): n = A,T,C or G
agctgtcagtgggcgatcatacgaaatggaacacaccacgagaggggggtatgggatcgcacgtagagggagggtggcgttttgagggcggntggcgtgaggacgcgtgtggtttaagcaagaaccacggcggcttgcatcacgtcccgtgcagatgcaaccaaagcaacagcggaccacgcatgcgagataacaagccgtaaaagacgatcgctatatattttaggctgcgtgagctataatagtctaaggggaaggaggcatatattatatcgatagtagagaatgtacgtgattggcatcagaggtaaaatacgatctccggtagcaacacgactagtgaagatctggggcattgagcaaaggagcccatcagcgttgaccctcaatcactcccccatccacccaaatctccaccccttgccttcatgcgcaccccgaagctccacacgttactaatgtattttcctacgcgtaaaattgtagtgactagacaaagtcgctcctgttcggagcacctccaccacaaaccggggcagactcgagaacgcaccgatggatatagagaaaaaaacattatgtcgctacgagcggagtctagaaatggtatgtgaatactattcgcgtgttgtttgtttcctcgactcttaacaagaacagtgagtgactaatgtcggtaaacggtaatcagaagaaactagatatcaagtagagaatgctgtgaagcatatagcagacaccagctactggtctcgtagaccagcgcgttcagctgccgtttgatgatgtccgctttacagtagatagtgcgtactgcctcgctgctgacantacgtcgattagcgtgtccgtacagctcacgcatctacgtatctcatagcgcacgactgcgagnacgaagtctcnaccgtgcgctagcatgcgnagaggctcgagatntataactcgagcagcgcgcgtgtcgtgcagcgcacgaacataacatcatgtgtcgtatgcgctagtgaagacgtcgtatagtataggctatcngctcacacnacctgtctaagctcagacttnactcggcgtactcgattttctcatcacatggtgttggtgtgctgacgacatgtatattagaganctcactacatggcaacatagtagcgtgtgagccgatgtgtcaggatctacacgagatgtgtgatgagtcgccgcgcaccacctacttcag

SEQ ID NO: 7770 - DNA, 981 bp, Homo sapiens
  misc_feature (1)...(981): n = A,T,C or G
tcccctgctcctcgtgcttcgatctctctatccttgcccctcgagtttctcccttctttatcatgtctctctctgtccgtcttcggcggttgcgtgtgcggggtgccgtctgcgtctaaatccaccccgccgctgccccgtctgcgcctctctgctgactgtgttgtttctcctgctcgctagcctgtggccgtctggctcagccacgtggccccgcccttttgtctttgcgatctgcagcctctgacatacgaggtggcgagagtctgccgatccctctcctctaacctgctgccctctcacatttgttcactcaagcggtttccgcgcgtggtcgagttcgttgctttgcgtactactccgttgatgcaccaatcggctcgttttcccgtattgcgcccccggcccggggtcgcgccccgcgcgtacccccccctctgcccgcggtgccgttccttttgttggcgcccgtgggggtggcggttagcgcggggtagatggggtgtgtctttatctactgtattgctttcttttgtctttattttcaattgtttcggcctccgcctctctgggggtgtttgtctgggtcggtgcgcggcgcgaggcccgcggccgctctcccctctcggctctncgggagaggggtgtgggggtggttcagaggcaggggtgtaccgttgcatttgaaaggaatcccgctggcgctctcgtcggccctccacgcgcccgcccgggcctctcccctgcctgctgcggcccaccgggccgccccatctccttcgttacgtcccctcccgccacccatcactccgtgccatacgtcatctcagtgcacgggggtctgcccctcttcgagaaggccttaggtgggaggcctcccttgagaagcccctaggcctggcgcccaagaagtgatnaaactactattgcccacaccctccctccctctccacgtttttttctattctccctctcgactct

SEQ ID NO: 7771 - DNA, 1053 bp, Homo sapiens
  misc_feature (1)...(1053): n = A,T,C or G
cgtctccggcgcgatgttgtttacgctgantttatatagttagcgtgcggcgcgagtgattatctatatacttggcagtaggactgcttcttcaactaatctcaaatttatactagggacgcctagttctcgtcggcagaggcgttgtgtttgttgcgaatcgccgctcatatatgactgggtggcgggatgtgtccacctagctattataaataaatctcatgcttgaacgtgatatatcgacgcgttattatagatatatacgggtcgtagtagtatgatagggttcttgaaaggtaggaacttgatttgttcgcggcggcgttaagagggaacgtaaggcggcaatatttttggttcgcctcgggcgaatctgtggactgggtggcaaaacttcaccgtgtttgatgttgggatcgaaatagggctgagtgcgtgcgatcataaatgtagaaatagatagagagacggcgcgaggggaggcggggttgaggtatttaggcgccgttaacggtaaggtgatgccggcgactcaccgaccattgcaatgtagacgaagtgcacgttatctggggtagtgttctctgtggcgggcgttacgagaatcggcctgttattgccccgattgtgcgttcgtgaggtaggtgggtgcgcgtgtgatgcatggatgaatgagtggataatgtcagaacgttcctttcatctattcagccgaccgcgagggctgcgatgggtgattggcgagtcgattcgtgtggtaattaggcgctccggtttttctcgcgcttttagaagtgcagattgtttgcattctgagtcgccccgccgttgctggtgtacgcgacccattagacgattccgccgttcatcattatcccgacgtcgtaggtgccgttacggatttaataatcagagggcgctgcatcagtatagcagagattatcggcggagtttatcggtgctgatgtgagtattggccgacataacagggtaggcgtattgaatgtgttagtgatagtatgcgcttatgtatagatatgtagcgtatatatg

SEQ ID NO: 7772 - DNA, 981 bp, Homo sapiens
catcccaactatacgtgagttctcaccccacgctacttacaagtaaattgaatgaaaatgagaagcatacaaaccaactcatcccatccacacacgcgctttccctctggatccatgtttattcatacgcccgcccaaagaggacaatagttccaccaccatcagtgccccctctccaaacatcaacgagtcagaattaacacactacaaccctgtactccccaccgcaattcatccttttgatgtcacacacgaggggtaaccaaggacgaccccttgtcaatccccactgtctaagctgcatttacacacactcaccgtaaatacattatctatgggcaagtatccaagcgtatatttccttcctgcttcatatatacatacatatcatgctcactactgttcgtacacgagaaaggtaaaaaatgtggccgagttgactgtaccacccgggtcccctcagccaaacgaccatctaggcgcgcgtgtggggggtgcagtaattccgtgtttaatttttagatgcatcacaagttacccccgcgttctcgctcccccgtgtctgcggggtgggcgaccccaaccatttgtcccccccgtagcttgtatgtcgaaaggcacaccgacgggagtaaaaacatagtaatccaagtacgtatgaatatctacggatagatggtatgggaccaccgcaaacgtaagtgtatatttatactagtcgcggcaaaacgggacccccaggtacgtaggtacatatggacgcacctatgtgatgaccaataaatcaatatacaatttagttgcggaggcggggcgccaccaaatatatcacccctccccgctcatctctccccctcaaacacgttcacacaccagctacgccccatgtcaatacccggaccgctgaatctagccactaccacccgttgttccatagcaaaaactatcaaaggcctccaaaataaagcaggatgcgagctg

SEQ ID NO: 7773 - DNA, 1096 bp, Homo sapiens
  misc_feature (1)...(1096): n = A,T,C or G
cttgcctccttcgttgctcttctcttgttttgtcacgtcctatctttcatcccgtccctccttccccgcgtcgctnttttttctccttttcctcttctctctgtcgcactccccctgctgtcgcccgttccccctctccccttgctgtcttgtctccccgngttcctcgggtctcggctgtgctgtcggtgtcttgtgtttgtcttctnttgggtttctctcttccttcgtcgggttgcgctagtgtgtgtgttcccctctctggcgtcttcctttctcgtgtgtctctcgcggctcctcgcctccgttctccttctctctccctctttccttctgctgccttcgctttcgtgctgttcttctgctagcctccctccttctgctccttttggtgccgccccgtcgtttctttttcgttcttgtctcctctgcgctggatctcttgtttccttcttgtgtctttggttctcccctttcgtgcgggtgcctctcggtccgtcggcggcggttgtgttttccgcgctcctgtgggcgcccccccttcgtcgtctctgtctctcttttcttcnttggttggtcctctcttccttcttttcttctgccctctcgcgtggtgttgcttcgtggcgcgtgcttctttgttttgttcgtgttcttctctcttcttcgttttctgtctcggtcttcttctcttcgccgcgcccctttcgcgccctcctccgctctcctgtgctctcttctcccctggtgtgttctcttctctcggtctgcttgcggtttttctgccgcttctaaaaaaatgccccctccctgcccccggccccctcgtgtcgcctccttgtctctccctttttgtctctgttttccgctcccgcgcgggggggcgcttcgggctcgctctctcctctcctattcggttcctcccctcttccccttgcgtctctccctgttctctctttcttttttgtgtgcctctgactcgtgtctctttctctctctctctttttcgcgttttttccctcaaaaagtttttgtgtttccagatagcgaacggctcctcttttttcctcctccctccctgttctctcgttcttcg

SEQ ID NO: 7774 - DNA, 1534 bp, Homo sapiens
  misc_feature (1)...(1534): n = A,T,C or G
tgatcaagtgtccgtaatttatcaaggtgtatacgcccgccgaaccaggggcgtccttgttggaaactcangcccagggcgggcgctcctgacgggaagcgcacccggcggcagccaaccgcgcacacagtcaggagagatagcagtgagtagacggactattattagaacacggatcgccncacagcctcgaccgcctagcgcgactgtaggtagtcggaaccggacacggcgacacaagaaccaacgagtatcccagccnacgaagagcgagatgatcccgtcgatcgtcagagattagagcctgctactagcgcacatgcgagtatctcgcagagctcgagagatacangagatcagtagatagagtcagtaacacagatacaccnaagcattcggtgataatgatgacgcgaggagacgtagagatgttagatataatccgacctgccatncgatacgtcacagcggcggccgcagcagcatatagctcagcaagaaagtggagaagcagcgacgagagtcaatcgagggcgacgactacagagtcatgcgcgtgctccgcgaccgcaccgtgacgagatcagcacgctctctgtaatcgtcagctatctggatcgagggagtaatcggatggtcagtgcgagagccagacccancactactgatcagacgnccggtacaacgtcgtcgtgatncacatagaacgcagtcaacaccgacgccattagaatagctcatagagcagacacatgcacgatactcacaacatacatggatccccgctatcacgctatcccgaacacacgccatataaacagaacatgttatagtcaacacacacaggtacgcgcgatctgtagtatacggcatttgatcataagatgatcacgcagtctattgcgagacagccgatccacaccatcctcaacacctctccacacgcgtacaagacggttncgcgacagctcacacacacaacagtgttctgacactctccataccctacacaccatcacttcatccacctgctcacaacagctacgtctatcgtgtagtaacctataatgcgatatacgatgaangnatcacgtgtagagagaatactgtatatgctactactgataatacatatatatagtaagtctcgacgccgcactgtcgactccacaccatcaccagtactcgacgccactacgcacgcccactagacgctcgcaaactcagaacaacgaactagtacaacgtataaacttcactcatccagccgcgcacgcctgccatcttaaacacacacacaccaagcgaccgctacaaacctcatatgctaactgcggttancgcgtgtactgtcagtgcgacacgtcctacgtgttatcagacacatatatgatatacgtagctagcccgtccctctgcgcatacgagactatatatacacgcatactgataacatatatttgtctgtcgcggctcgcgtatgtgntacgcatatgtgctatnagctgcaatccatgatcaccagcgtcagatt

SEQ ID NO: 7775 - DNA, 1314 bp, Homo sapiens
  misc_feature (1)...(1314): n = A,T,C or G
cagatccgagatgatatggtagaatataaagtgaatttgatctcggcggagcctagtgggcgaacggcggcgctggagagtcttagaatggtttattagaccccgcgtagattccgcgcccagctgcatgatattccactttccgccttcgaaattttgttgctaggaggggtggcacaaggggaaatatgaaacttacgctcgcatgtgacgcaacagaatacgatataaatatttaatctgaatacatcgccacactattgcagatgtatttgctagatccaaccgatccatcaatcgcggcgccggaatgatatccacgacatgtgacggaatttataatatccgccgcccggcgtataactggttgacgcccaatacctggtaccataagtgatcaaatggagacaccactacaacattataatagaattgagaggacgtacataacatggagaagcgcatagtcttgaattatactcccagggacgagcgactaatagtgattacatactaacacgactattccgttttgacacgcaaactcaccgcgaaagggcagctggtagcgttctcgtagtgagttcgtaggggctgcatgaaaggtcatgcattaccgctanttcgccatcaacgagagattggccggtatcgctatnagaggagtgacttcggcgattcgccgcaggatatcttctaagtaattagagtgcggaggtagtacgcgcgcactccacgagcgatgccgcgatgcgaagtatctgcccggccaattctattctcgagcgaacgacatgatagcagcgccgccgtcggcaggnagntattgatatgtcaccagcccgatgtatcatgtattccccgcgagtgtcgagtctctgtgatcgtgcatgttacncacgcgccgccgcgcgctagtcttcgagctatagtatatctctgcgcacgcgcagatatgtaacgagagcgtcngtcacacacgctacgatgagcgtcgtagtgtagtatcacgcgatataancacgtgtacgacatacatcgccggacatancgtgagatacagtntatcataggcancgtacgcagcacgtcacgcacgagctgtggtatcgcgacgcgnctactttcgtcgacnncgcagcgantantagttagtntagcacgcncgatatattgagtcatantactncgcgcgacgatncgcagngncgtncgtagacgtgcgagtgntacggagtagagggagntgtctgcgagtganacatgcagcctacacgtatagcaatggcgtatgtgagagacagcagangntag

SEQ ID NO: 7776 - DNA, 1369 bp, Homo sapiens
  misc_feature (1)...(1369): n = A,T,C or G
atacgctcgctgatctccggtcctctgtcggatgctggacgaaggcagggcaggcagtgctttagtctgggtagacggactgctgctcgtatatctattcactcgcctgacagcacaatacgtgtgcctccataccgataggagtgttcgctactcagcaccgtttctttattggacgtttgcgcacagtagtccccgcgcngagcgatagcgcgaggtacagcgtagtcctaaaccgcggacgaacacatcaccaggtcgagaaatacacatgttagcggaatgcgtctgctactcttgttcgtgtctgtgtctacagcggatgacacgatcactcgagtgagccagactgtatcgcatcatagcagcccgctacctcatgcacgcgcacgcgatagatgaataatgataggcctctgacattcagtgatactcaataggatggagtatgtagtaggcagcgcggcaggatcaggaagccgcacgtggagctccggtcgagcggtncgcagtatcaaaggtggctgagtaagcactgccgtcgtacctacaaactatcaagcactgaatagtgcaaggncgcaacgtcggcggtcagtacagcagcacctgaatgcgccacagatccggagtgtgcagaaatatcgacacgcaaaccgccacgatcgagcgacgcctccggcccgcgctagaggcgaccgtcaacttcggcgcgtagcatggtacatatcgngattcaatctacattaagtagagttcatcgaggggcctgtgtgcaccggcaacaggnacatattcacgtctctcgccgctcccgcatgtacggctcatgcggcggcgctgacaacaggcacgcgtatttgcataagcgagtgctgcgagagtgtgagtgtgtacatacgccgatacgtcgacgcacnggcaattagtgattatnaggtgcgatgcggcgcacctcgccacatatattgcacgtgcgtgacgggttcgccgcgatatgacggtcgtgcatagattgttcgcgcatggcgatcgccgtaagacgaaagccgatatcggatatgccgtagtntagtaaggtacattcgcgcctcgacgtacgccgcgctgtccgacagtgttgtgtngtccagcgccgcatgatggaccgagtataagatcgacgatcgaatggcnaatgtaatcagcggtccggaacggcgcgagtcgagataccgaggacgcagatgcggcgatagcggacgcacgtcgtgcgagttgctgttgtgcaagttatatccgcatcatcataatgcgttactgtntgtgtgccggcgcgttcccggagatgtgcgagcgcatgctcgaccacgggcagttatatacgcat

SEQ ID NO: 7777 - DNA, 1464 bp, Homo sapiens
  misc_feature (1)...(1464): n = A,T,C or G
acacacacacaaacacacgcccgacccacgcaccccacagacggagagagggagagaggagggcgcttactanaggagaaacgcccgcgcccagagangcttcanaagaaagagaaacacccacaccaccgaacaggaagacagacgcgcaggagaagagcagacagagaaacccacacnagacacgcgnacagacggggagggcgcggcgcgcgacggcagcagcaccaaagaacanacacgcccgacgcgccgacacgcccaacacgtgcgacgaccacccagccgngaancagagcgcggagcagacagcacgcacagagcacgcgagcggccgcgggaccagngcacncgcgcagacacacgnagacagcgaccancgcgcgccaccagcgacaaggcgcgagcgaggcacacgaccgacgcacagagacagaccagagcngcganagacagcgccacaacagcgcatcggcccgcagcactcgctcacacccacagcgatccacgcgggcgcgggcggnacgtcgacacgacacacgcgccacagccgagcgacagncagcacganggaagacaaagaagagacatagcacaggagcaacggcgcgtgagcgagcagagcgagagcgcacgagacaaacgagagcaangagcgaccagacacaacgcacaatgacgacagcgcgaacgcactacagnacacagacgagaggatagagcgacgacgcgcagaccacacgcaccacaggcactacnacgaccacacgcgcgagacacacgagagcacacgcacnacgcagagagcaccgcagaacacgcacgaccagagcagagccgcacgagcagcgccagccgacgccgagcacacaacacacactacaaggacgagtcacgacgacgcgcaagacagcgacgacacgacgcacgacgaacgagggcgcgtgcaggacgcaccgatccagaagcaacccagagcgaccgagcgcagcgcacgacacaacgaacaggcgacggccacgcacggagccacgacgacgaagagaacgcacgagcgacagccaccaaaccagcgaccaaccaccgcaccgcgaccgacatgccccgcgaccggcgaccgcgccgcacgagagggagtagcgggaccagccagcaaccggcacacggcaccaacacccacgaaccaacacggacccgcgcgccacgcacaccncaagaaacacgacaacagctacgacgccagagaggacgccaaccgccgcgcagacancaacaggcagcacacgccgcgcgagacacgnagacagagccacgcccgcgaagaagaggaccggacgcgcagcccgcgacgccacgacaccagagagcatcccgcnccacacgagagataacgagagcgcgcgaacaccgccgacacaaacactaacaccgcccaccgcgcacgtcggaagtacgagacggccg

SEQ ID NO: 7778 - DNA, 944 bp, Homo sapiens
  misc_feature (1)...(944): n = A,T,C or G
ctgcccgtttgtcagtgcccggggtctcattttagtcccgaccgggtttgacattcccccccctgcccactcccggtgccttcgtacggtgcccgtgtgtttcatttccccccccgggcccccccccaataagttgagttttttagtttgtgtgtccctccccgtttttgccggttgccgtcgcccctggtacgtgagagtccccattgccctccgacgtttctctcccctgcctccccctgtccccttgtatgtccccatgttgttcctttttttttgtccgcttctttcccatcgtgcacggtgttctacagcagtccagggtggtggttgtatatcggcccgtgcgcaccacaccgctgtgcactagcgctacgtccaattggggtttcgagcgctcccttttgcgtctttatgccgttaactttcctattcacccccttttggcgcacaatagtgatggttggtcagagcgtgtgctctccgttcttcgtacccctcatccccggcgacatttccacacggcggagtctatctacgccgaatggagatccggcatatgcgtaccactcccccagattggcgaccgtattgccgggcactcgtcataagagaaccaccctgtttgttgtgcctcgcatgttgcgcgagcanaggcgccctactcactatatgcgtctatcttaacgaccttgccgtggcggggcgggatatataactattactatctccccaactcgccctctctccctctccctcctgagctcgacatgactcatcattccagtccatctgcctcagctcgacgggtctcgccgtggaaacgtcgctcgcttccctcgccgtcctgccctctcgcccttcggttttctcgctangaaggtgttataatctagaatagcgagcggtttttttttcgtataaagaaggttggatcatcgccc

SEQ ID NO: 7779 - DNA, 1405 bp, Homo sapiens
  misc_feature (1)...(1405): n = A,T,C or G
ttggtcttctnatcgttttggtcgatgcttgctattcctgtcgtgngcgtcacntcatatcatcctcactgctcagttaatgtgntcgatacaatangagaataccattcgtctttgtggctgctgcgctgatagttgtctcacctctttgacgtactgtcacttcctatctccntcgcctcactaccgtgtcgcacaaacatatcgcactacggcattcgctgctggcgccncacctcacactattactacggtttactaaatgttatacgtagtgtagacacgttatctctcctttcggncgcatctcactaccatcttcgtgcnttctctacagttcgctntcagcctgcaggcgcgcgtaatgggtggcgctcctgatcgtgttttatgttgctctgctctttccctccgcacccgcttcgtctctctccgccgcgcggcagcgtgactcctactcagtagtgtcctcttgcttcctttactcctatctcacactactctgcgcgtttggttctcacgcaatgtgtgatcatcgcgactgttccattattatcgcttcttctccacttgttcgccatgtcattcgggtgtcgcacacctgcctccttcgttccaatctgtccgatcgcagtcctcgcccgtcgtcctccctatgacattagtagtatatatgtgtgtttaccattttctatcccgtcacgcttcatagctgtcggtcgtacgtattgcgtgggttcggttgggttgttcctggatgctactaagtggcgcttgatctagtatgtcagagacctctctcgtgtgagatttcaaagtatatcgtcgtcgtcagtccctttcggacgtctcgcgccgctcggtctgttaagtgacgctctgcatcatggatcgggtgtnatactttcacgggccgtgaggtctcctgtggtcacatatgttacttttgttccccgccctattccgctgtgcatggcgtgccgtttttacatctcgttatatttcgcaagcatcggggcgggcgacgggtataatcaaagacatacacatacncgctcacctncctccgcatgtagtgcantcgtgcttgatagcgtcgncgaccgcatcgtcctctctcnctgttcattcttttctcgcgcgtcntctcaatctttgttctactatcgcgattagatcttgtngcccgtggacctctcctctagtgcgttcgtcattcaaaccgtctgctgctgncntgccttcgtactcttctcgctcatattaaacctcgtttgngcgtnttctcagctactcacatnatnagcanacancaccctggttctctcgctcctacatatatacatactgctagntcnattatatgtcngtctngtntgccgttagtcgtgtactctgtccgcat

SEQ ID NO: 7780 - DNA, 774 bp, Homo sapiens
  misc_feature (1)...(774): n = A,T,C or G
agggcgtgagcgaggataaatatgagcggtgagcgggtgactataggtcatacatgggcgaatacgatatcgacacgtgtccgaaggagaaatacgcttagcaggattgactggggggctaagcagtagtgaaaaggggcggggtgagattcttcgtgtttttgcgcatggtcttaagacagactgaatggtcaggaaacgtcggaccgctgcgcgcagcgtcttctatccccaatattatgcttgcgaaacgcctataagaaggtcactggaactagtgaaaggtggtagatccagggtcttgtgcgagcaggaaggccctgtaaggggaagatggttggatcaaggcggggtgttaagcgtacgagtttggaaaataagcggcgggcgttatcttacttaccccccgcaacaaatttaacacttggcaacttttacaagacacacaacagcaacagggaaaacaaacacatcaatcaaccgaagaggcaaaaaagaagtacagcattttctaggtatgcctggatggagcctctaagacctaacaggatgtctgaaattccagggaagtggcctgtnatttgtcagtaaacaaataggaggataatccagctttgttgtgttttctgattggcatggttttgaactatttcctacttgtagttgcagccaaaaaaacaggagatgaattcccatgttctaggactttgtgttcctttccaattcaaactgcaataagaaataaaaatggttaggcttcccagtgtgtagatt

SEQ ID NO: 7781 - DNA, 1329 bp, Homo sapiens
  misc_feature (1)...(1329): n = A,T,C or G
cttcgttctgtattctcgtctgctcatctcgttctctgctgcgcgcntcggtcttttgtgcgatcgtctctctctcgcgtgctgcttccttgtcgtgtggcggggcgtggtgtgtcgctgtgtctatgccttgtttgtgtgtgacctttctgtgtttgtccgctctctgtcttgtgctccgtgcgtgcggcgngttctcggtggtgcacgtcgctctctgcgctgtgttgtttgtgctctggcctcgtcgccagaggcgcgacgctccgctctctctttgtggtnttgttcggtgcgtgtgcgtgcggnttgtgtccgctcctcctgggtctctgcgcgccgtcgttgcgtgttcgtaggtgtcgcgccgcacgcgcnctccccgtcgcttctctgccggtgtgtgtcctgtcttcttctcgctaaccactctcctccgtcggtttctcttcntgtgtcntcctcgtgcgccctcctcgcgacgcgcgcgcgcatgtgcnntatcncgtccgcccccgtgtntccgttcgttgtcgtctccccgttgtgtgctttctgttgtgcgtgctgcgctgcgcgctccgaggtcctggtccttacgtgtcgatgtcctcttggtcgatcgcttctcttgttgtcctcttgtgttcttgtgctgtcacggcctgtccgtccctctcgtgctctgtcctgctctcgcagcgctgtgtccgcggtgcgtgtctccctggtcgtgtgcacggcggcgcgcgtgttgatgtctcgttcgcggtggggatgttgtcgtttgtttctgcccctctctcctcgcttcccttctcgctcgcgcgggcgcgtattgtggtgcctccgtcttgcgcggccgaccgtncgcggccctgcttcctctcttctgnntttncttgtcncgtttnnttctttagaagaacttcttttcttctttttttttcctgtttttcggtgnatctntgcacttctcatcttgttctcccccggtcgcgcgcggcgctgccgttgccgtccgcgcttgtnctgctgtatcttcctccgtcccgttgtatttagtgtctggttgtgttcgcttttctgcgaggtgccggttgttctagtttgagccactcgcgcttttctcgtgtgcgcgcttccccagcgtgctgtgcgcgctttggtggcggtggcgcgggcgcggcggnnccggcgtttctaaacccgccnacacgatttgtgcacgcgtnagttntccgcgccaacganttttttttttcttttctctctcttctttctnttnnttcttntcttcnnnnnnnnnccccctccccccctaccccc

SEQ ID NO: 7782 - DNA, 1277 bp, Homo sapiens
  misc_feature (1)...(1277): n = A,T,C or G
ccgccttactcatccctctactcacgccctgttacttcacatcacatatctctcctcttttccacgctctaactctaacgtcatctttctcctctcctcacgtcgtctctactgatcaccgcgacaatttaacaactgcaaaccactggacggttgcggaatccgaaagcgcgtcgcgctgtgctccgcccttctgagtatcgatccatcttgtgcgacacaactcccgcccgacaccgatcttctccctctcgtcgtattgcatgcggtgatgttatccacctcttgttctgctcacatatacactcccacatgtntcctttcacacaacgttgtctaccgtgcggtttgtcgcccgttgcctcactagctctactgtgcatgcgataggaggcgtgaagtccaacgctctatatgtcccgcgacgaacaaccaccgaccccacgtattgtcacgccccccccagtatttctacccacaccgcccctaacttgaatacnctttcctcccgtccatcacccctttttgtttgaccctcccgtccaacgtggccacctatggtacgattcgacgccccgctgtcgaagcaagatcattccagaatcttatgctctccacctcccgctacactctcgtgctaatattgtgtgatttgcataccgtatcgggatgagcgcaacccctcctgtggggtcccatcgtttgtcgtcagtgtagtgctgtgcctctgtctggcatcacattactctatgcttattatcctcccnatattgactagccgcccagcactctgtcccaccacccacatactcactcatgttattcgtgaaactccatagncgggtcggtcagggaagtacttgttantacacgtgctcgatatggttctgnccgtagattgcgagataaatgtgaagcgatagatagttcacagcctatttataaagcacgccgtatcgtcggggcgggctgcatcaacaccaaaccttacactctaattgcgtcagcaaacaatttcaaatattcacattatctacatgattgtcggatccacaactcagatgcatgtgatacattagcgacttcatccgaatgctactcgccccgcgagcaattccgtcgtcccttaccgtcttcgcgtctgctcgttcctcgttcttctgaccgatacacacgttnataaaatatatgtagattaatagtctctgtcacgcgaaacaccggtccgcgtactacatccgggacccaacaactctggtgccatacgtacgactcat

SEQ ID NO: 7783 - DNA, 1099 bp, Homo sapiens
  misc_feature (1)...(1099): n = A,T,C or G
ccccgttccccccgcctccccctttgcccacaccctcgtgtcggcggttggcccgcgcgccccacctcccctgtctttctctgcctttgttttgttgcccccttcacccccctgccccgtttttccccggccaccccccgtgtggtttgctcccttccttttttttatttttgtttgttccccccaccctcccccccccgtgtgttttgtttgtaccccngtttgcccccgttccgttatttgcccccgttccggcggccggtgttccttgtcgtttgcgcccgtcgtttggggtttttcctgttgtgtccctgtgagccccacgtcgcgtgtnttgtcccaccccttgtcccccccccacgccggtggccgccctaccagtccgtcgtgtgnttccccccatgtggttgttcccctgttcgccctcccccattccccatgttgccccctgtttgtgtgtggtggtgtggttccccacctccttggagcacattgttgtccccggtccctgccctttcccctgtcacacacccctggtgtagccgttttccccctctctgcgtttgcggtgtgtactgcccgccgccgttcccccactcttgggtggtctctgtggccgtcgcgggtgtcgtctctctctagtgtggccgacccccccttgggtctcaccaccctcatgttgattccccgctagttcttgagggggcccatggctcctgctgggtggtcgcccgcgaccgccgccaaaaaaaatggttctcttgtgtctcttgtgcattgcgtggtcaggtgctccatggctcctactgccaccattcggtaattcatggtggttctgtgggtgggttggttctaatcacaatcacataatattatttcgtgcgtcctcctgtcccctcgaccactcccagtccgtctactatgttgtctcaacggactttcccggtcgtctcgcaaaaatcgcgcgggctcgccggcgggtcgcggccgcggcgggttgttcccccaaancaaaggtggcgacattaacaaaaaaaaaaaacgttgtcgggggttctttgtgctgtgtgtgcccttccctgcctcgtcgttccggcgt

SEQ ID NO: 7784 - DNA, 930 bp, Homo sapiens
  misc_feature (1)...(930): n = A,T,C or G
aggagggggccgccccctcttataatttttctactgtnnagcacaccaccccccggcgggtgagtggttattatgtttttaanaaacaaaaaacaaagagactatctagttattttattgttaatataaaaaagaagtatggtttttcgaagatatttttcttcttccccccnnnnnctcgcctcctctaaagagaagggagnaatatnnatgaaggtgatattattttgggagcccgccctgtctgtnnnncccctctgcgctctctctcatnctttnnnnnnnnnggcccttttcattnaaaattnnnnnnnnnntnnnaaaggggtggggnacaaaggggggggggtggggtgagggggaaccccccctccccaccccgggggaggataatgatgggaacaaaattttctctccctccttggcgccgaaaatacacccattgttcccccagggggttcttttttttttctcagaaggccaatataaaagtccccccctaaaaaaacccaaaattttttaaagttaattttaaaaatggggttttggaaaaaataaaaaaatatttccggccattcccctcccagnnnnngnntttgnctttaagaattggcctangtnananagngnanacgtgttagaaagtctggggaggggacctcatgatttatttaccgcgcagtcatgatttaccacgcaatcacggtttagtcttgttgtcctgtcataattaatagtatcctctttcacatacaaaagcgtctcaatttgaacattaaactatacggtcattgtagataatgacacaaatgatagcatctctgttgaaagtaaattgtttattaatgttgcagtaccttcatttctttgtttcggtttaatgaaatagattttttacattataagataaataaactagtatctgcaagc

SEQ ID NO: 7785 - DNA, 635 bp, Homo sapiens
  misc_feature (1)...(635): n = A,T,C or G
ggggggnanaaaccccccccnanntttnnnnnnnnttttgggggccccngggggggttttttccccccnnccngggggaacccttttttnctnccaaaaaggggnaaggggggttttntttttnnnttaaaaaaaaagggnngttggggttcncaaaggggnttgggaactccaaaannagggttntttcccncctgttaagcgaaaggagaattggtttttgggncagacntttttggaaaagacntttaatttttttcnaaaganttaatgggcaccccccccaggaaagggtgtttgatttatgaaagacaatttagaaagattctacaagttngttactttgaattttcttttaaatggaccagtaagcaaagtagcttcatcaagaagagttatcaatatcataatgtggatttgaatttctattttcatagaactttttcttatttgtaccctggtttctcttaaatcttaacttctatcagtgantaaactgagaaattcacattaatcatgnaaggccnattaattggatgnaaaaattttctcattcagaaatgctcaataaatgaaaaagttttcccctaaaaataaaancagatcggaagtntccaannnnnnnnaacnnnnna

SEQ ID NO: 7786 - DNA, 1502 bp, Homo sapiens
  misc_feature (1)...(1502): n = A,T,C or G
catcctaccgtcgntctgttgtgatgctgtcgatatacacatgtcttgacaattcgactcactgctcaatcgtactgccgtgtaacttctgtgtcgcatctatgtttagatanatgcacgacatgtacgctcggtatatctcacacanacacgncgctacaatgaccgcacggcagaacatataaccaancgctacacttacgatcgctgatgtgatancgaatgtctgcatcgccactcatcgagcgcctatcatcgcatctcgtgtcaacactctcatngtacgcgatgatgatatctgtcagatcgacagttaccgnctcacacacnacnccccctcncaccacgctcacaacattgtctgattgtgtggtccccacaactcgtgtctagatatagatttaagtatatatccatgcatggcatcgcagtatgcgacccagctgtcgtcatgcgtcacgngccgcgcgttagccctccactatgcagcacccatataacgccacatcacngcacccacacagnggagcaggaagttcctccactctcgtatggatgtgtactccgtcactcgtacacaccatctgactcgtaatgtagtattgtgatcgcgtcgtcaccctgtgcaatatcgctctcacacacgcgctacacacactatagtatacagatgtccgcgcaccgtgtcgtgacagcggtgtgtgtgctgtgccgcactccgtcacaacactagacccgcagtattgtgtcacgtgaccgatcccgcgtgatagcgtgcntctaancgntaatatacatccacgtgatatgtactaccataccgcacactctatcgcgcattcagccggccccgtcgctgcctcgtggaacagcggtacatgctcgagtcgcgcctcttgctgcattcccatcgcgttgccaccctcacagacccgctgcatcatcgtccggtcgccgctccttctcacaaatactgcgtctacatgagtgtgacgcgcacgacgacgtcgtgcgcaaccgcgcgagagatatctgcgcttctatacgcatacacgtattgtcgtgaactcgtcagacgtccgttatcggggggacgaagatgtgactgtgtaantcggttagtntcggcacctctcgccactataccgatcagcacaacttcagcatactacagtatatctgcttgatcattgtccatctgcgcgcgcgcgcgcggcgcgcgaacaatctgaccagtatactaatctcgccaccaccaccgcgtccaatatccttcgtcgacgacggctcnctcatctactatgcttgtgataaacgtgctcctgactccgacatcggccgcgcgtatacgctcatgcaagaccagacgctcgcccaccatattctacaccgccgtcccgtgattcntgtaataaaaagatgtgactcgatcatagcaacaaaaaaaaacgcgctcccgagcatcgcgcgaatacattcagctctatccctcgctcccgctc

SEQ ID NO: 7787 - DNA, 1199 bp, Homo sapiens
  misc_feature (1)...(1199): n = A,T,C or G
aagataatcggcagacttatccctagtgtcaaccgcgagttcacgcagactttatggagagccgagtaacccgtcctctcatttcttgctcgtgtatctccacatgatttctgattgtagttgtgangcggagtgctctctctatatgtacgaaatcgcccatacgaccgcgtgtctttccgttcagttatctcgcgtacgagttaccacgtattctcacatagcgaatctaaggaccgtgtcgtatgttttctctcttcatgtatcacgtaggataaatagtttattactgggaatcacgggtgtattgtattatactcctcgtttctctgcgcttcgtgattctctttcatcttgctccccttgcagttcctggttcgtcatattactcacacgctacgcatttgcggattaagtcaagcgcactgtatcattgcctcctcgatacgtaaatacatttcgtcgtgccgcgcgttggttcccatttctctgtcttttctaatgtaaattctacctattataatcaattagaaactaatttacgactcattaacactgctgatatcgcgcggtttcacaacgactagataacgagtttgagtttgtggcacggaaccgtccgtcgaccggtgtcatatttactcccacatcgtcattcgtccgttgcagcttgagaacgaaaatatcacagttcagcttagagtattggtcgggtacgcctcgtatacattcatctaattctactagtgctgtagtctccggcgccacacatcgatactatgaggtagtgttaaatgtacctcttggtgggagtatccacggatacagagtatatcttataatatcttcatatgtatgctacatcataatacttcgtgatcacatatgtatgcacgcagtctcacttcctggacacctcaactgtctaacttgcttctccttgtttgggcttctcaacctaggtgtatctccgctccccgctcgctccttctcatcttatctcgtccgctgctccccacatttattataattactcgatctcccattatgatcatccactctctctcgtagctgattactatagaactagctcgctgcgtctttattcctagtgtgaatctcttccttttacatgcgtatgtaagtactaaatagcataagaggacgatgacgtttcagagccgtgtgcgtgctgtagg

SEQ ID NO: 7788 - DNA, 1117 bp, Homo sapiens
  misc_feature (1)...(1117): n = A,T,C or G
atcatctcttatcctcttactatctcttactctcttcttatctcacactcctcatcaactccnctancttctctctcaactgtatcacactctttggttccttcacctctctcatcgtccccttcgtgtactctctcatcatctgtaccacgtacttcttcctctctatactctacttatcatcaactatcgctctactactcctcactcaaattgttcttgttctcttctctnctcacatctcctcactccattttatctttctttccatcccctctgtttttatttccttctcactcttacctccccacaacattttcctcatacccacttcccttcctttctctctccctattcttctattaatctatctctcacccctctcccttctcctcaactccatgtctttacactacaaccatcattcaacatttgttcttctctctactcctcctcctccactttactatatcctcatatttttcatcttttttctctcccttttttcatttatttttacacacttttcgtaaactccattacacatacattcttctgaacttatctttctacccttcctcttcactctctacctcaacctntactatctcctatcacttcttcttttcccttaacactcatctcttctaacttatttcttctaactatcttttcttattatattaacacacactctttcaacattatacaatttacaaatattataatacgtatgctacttcctctaatctaccaatcaaccccttntgtacctatcacatacttttttcaacaccagacacaccacacccctctcctgaccacccccttcccttcctcctcactatctcactctcttttttttctacataacatatctttacatcaacacattgtcctttttaacttatatttttttcacattaaatagccactctgccctacacaaataatcaatatgctattatctgttccatcatatcaccatctccaccaccacatacctttctaccttctcttacttattttattacttctcttgtctttcccccttctcccacactcttcacttttcttctctttttttcaccatactcattactcactatctcttctt

SEQ ID NO: 7789 - DNA, 913 bp, Homo sapiens
  misc_feature (1)...(913): n = A,T,C or G
cccaaccgcgtgctgcgggcgtggctcgccaactaagcaaaacattttgtgagaatacgaaaggggactacagctatagtgctatcagcgtgtgatgcgttacatcactataaatgaaatcgctatacaaaaaacgatcttatgtaactcggagctcagaatattgtgtcggggagataatggtaaagttgcgtacaataagggtttggattaagtagcaagatctcaataatatgcgatcatcctttggtataaaatcaacaaacccagaaatcgaatgaaaacaataacccgtcatctgttttgaatgattgcatgaatcatagcgaaaggatgcgcttagtatgatggcagaacacacgatgccggaaagacgtaacaaactaagagagcgtcccggtataacacttaaaagcaaactacaactcaaggtatcctttgtcaaccatctattcaaagtcgacttactcacatatactttagcctattgaatatcagcgtaatcttacagacgcattccgggaatcttccatttcgggagtcataaaggtgcaaaaagcagcagagccgactcgaaacacctaacaacgcatttggcgtaggaactactaacgaaactgaccaaaaaccacaccacaatgcagtggtggttcaagaagttttgcaaaggagactcaaaaatgaggtacatcattggcctgccatcagaagttgacaaatgaccaattgagagcaatcattgaagttgatcgtcttacagctaagtgagaagctgccaaagaactcaacattgaccattctacggtcgtttggcatttgaagcaaattggaaagttgaaaaagctctaataaatgtggcacgcgacacgtccnctcctcctcccctaacgtctttgtggtaccgccactacga

SEQ ID NO: 7790 - DNA, 900 bp, Homo sapiens
agaaatatgtttgaagtttgacgtaaatactatgttaaaatacagatagagagagggtatagattaatctataactcaataacaagtaggtggatacgagataggcttacgcggcgcgagtaggagagatgggagtggcggtgcttggacgatgggttagtgaagatgtagattatagatcgaaagatggcgagtgtgattcgtgtagaagaatagataggtgtactgtgaagaacgatgattagatgaaattagttatgatacatcgtaaatttgagtagcgacagtaacacgaaaacaagaacgaaaatccaacacggagagtaaaatacgtgaatatgttaataaacacacatataataatataatgtaaacaaaatcgtacatgatagcagcgcctcgtgaacggtagtggtgggtaacatgtgaataagtagcatagacggggggaggcgctcgtcgtcactggggctgaaactcgtttcgggccgacgacgaacacgtaaagatgagccggtaggataatataggtgggcattacgcctcgtataattaaataaaaatcgatatatacctaaatttaaagcgagagagaaaagaggagtgataaagagaaagaatactaaatgaataaaaaaaaaagtcacgattggagaatggttacgatgaggtcgctttgtggatgggcgaagggagatgggaaggacgtgatggtgcacaagaacaatatattgtgtgatttccctggctcggtgatatgatggaagaagaaaagagaaggtacatgaaatagattgagcaaagtcacataacaaaatattctttgtttttaataatagatatataaatataattaataaacaaatattataattatctctcaaattcccccacatttcc

SEQ ID NO: 7791 - DNA, 508 bp, Homo sapiens
acaatagacaaaatggagtaggcaatctagccgctggaacaaatacgcacactcagcacaaaacgcggaaagagatcccgaacgccgcacgcttcaacccatgtggcaacgcaacgatccttacacaaatcgccaatccacaacgggcggattaatagctctgcccccgtaagtagatttctcccttgcaaaaggccgaccgacaatgaacgcactgtgaaacaccacctcaaccactcaactaccacgcaatttatagtctataacatacctatatctagaagcgataaaggaaaaacaccagaacaagataagcatacatacatataataccatcctcccactacacacacacgcgctgacagctcccacatcaataacccacagccgccgctcaccctattgaagactaacgtaaacgacgggacgacttactatcgcgccccagtggacacgagaggcggcaaaacccatgccccccgaaatccaaatttatcacctacacccc

SEQ ID NO: 7792 - DNA, 2157 bp, Homo sapiens
  misc_feature (1)...(2157): n = A,T,C or G
tgtgaccacgaccttcggcgcctcgcgtttctcgcgctggtgggacctggtcgattatgtgagctgcgaacgattagataatactatgctctccacacagcagaactcacgcggacactacgcgtgcaatacaccactccttagctgctaccacgtattgactcatcgtaacaacatatgcgaacgacatattgtgcgtgatatgtatgcatcgccgcgtgcgtgtgtagactagttgtgtatctgtagggatgtgcataataaagtcggtggcagtcaccgccgacgtncaagttaatgacgctnacgtagtggagtgtatgcgacgctccatgacaacaatcgtgcacacatacgactcgacgagcactgctacgggacacgtgacatacagtacacaagagcgactgacggtcaccgcagatacgcttgctcgctcgtgtgtgagtacgtncgngaccgcgatgacgcagagagcatcatcgctgttgctcgtantgacgcggcananacnattnattcgatggcacacgctgctcagcagacgatgntcgcgcngatacgtgnacgcgacgactagcgtagcgatcactgtactcctgtagtgtatagnatcgatgcagcnctcggcgcgtgctgcntacgagtcgaactncagngncagtgcagagngcgcggctcgatgncagagcacgcacgctnctacacttatataccgcantgngatatacngnatnaccgtcttagctgtcacgacgtaatcactatnctcgaangtcagttngnananantcattgcgctatcgacaactatacagtctcatctctcactcgcgctgtcgctcggtntgatgtactctgagcgcgacgtagcnaggtangcgacagacagatcatnagctntnctagtgctgactgacantcgangatgaatactcatntgngctcgtngnacctacacgaactgctcaacgntcgactcatcatctaactcgtgtgatcnactacntcatacangcacgactcaatnacgtcgatcgnacgacgagtaccngtatgacactctagtatctgntcatcgtagtcgnaccatcnatgntgatnaccancncaactcttcactactnctgatgtcgatgatcgctntctgattngacngncgcgcgagcccgacgctctacgatcagatantcgtcgtacatacngaacatgaccgtcacncgtcagnatgatctcgcgtnagcacgtcgactactacatcatatacactgctgaccacacgaanccagcatctgtgacgncntactcganatttaccncaaccatcacagtctactnctgcgcgtnatcgcttcgtctcntactcgctgangttgccgatgntcttntactcgtcntngnagntcgtagtcagctgagcgctagatgtgatccatcgntcgtgtcgtcgatctnatcgntcgnataatgtgntcgcantctatagacgagtcagctactcacagctatcatacgatcgtatgagngtcgtcgnacgagcagcgagacgactncgatancantacacntcntcacanctcntcgacgacactgncacncaacgagtcatntnagacacgtcaccgtnatncgtacgtgtagtgtntgctgtngtctacgaccgtgacgtcacatgntgatctgtcgtatcggagngagtgtcgtcgtagngtangctgctcgtctctgcgtncantancgcagctactanagcatangatggntcgtcacgtcgagactcctgacnactgccactgtcgctgtnaggtcgctanngtgatgactctacnagtatcgaacaaggactagangcngntcgtactctactattgntncgagctgagtcgtgctcgtcgttgntcgtagtatganacaactgatncatgcgacnctacgcgcngcnnatcgtcgacnnctgcgntacgacgcatccgtatcagatgancncatgntccgcagcanaagcatnatattgnacnntgcncttcgcgaagntccganctgcgtcgctgangcatcatctaccgtagtaccagtacatcggntgacncgtcacnntcggntgntatgantacgacgcngcngtcngnngnatcagcacatcaatactnatatact

SEQ ID NO: 7793 - DNA, 1135 bp, Homo sapiens
  misc_feature (1)...(1135): n = A,T,C or G
gttgggtcggagttatacggtaaaataggacggcggagaagcgggtcgtgtggaaacaaacgggaggacgttaggggggggaaccggcgcggagcgaccagagcgaggacgggcgcaagctttttgggagtaaggagcgccggcgacgatccacccgagcgctcgtccgacaccgcgttaccaatatttacgccgatcttcgtctatacagcgcttgtcgctcacaccagcaaataagtcagtccgtgccactagtcggcgccgcgctacatgcacaacgagacagacgtgtaccaccgcgagtctcggctacgtgttcgttcttgagtgcgatcctagctctaggccacagaacggtggcctgagcgactcaaatacatcgtgatggtcaataccaacagcngacgaacacatgacgcagaggtgacaaaacgggggggtgggccctcctgcctgctcgagcaacgtgaaacttacaaataaagaagattgtgacggaacagcaatatgcctcgcctgcaagcggggccctgtccgacacgtacccaattcggtttggacggatgcgcgtcacgatcagcgatctcggatgcaagtgagacaccaaagtagagcgcgtgagtgacagaagcgcggaagagaacctcccgacagtatgttgtgtgaagaatgggggcgcacgcgccgataactgagtcgctctgtctcgagctccttacatatcgctgcgtgaaaaaaaaaaatgtgtgttgtagatacagtccatttgacctggttggtacgatggggtaaacgagtaggttcgagaatacttcggaacggcacaaagaaatattttgacatgcgtgggttcgcgtgtgaccacacctaagagtgctggtcttactgattgtaaaacgtgtggagacataagatattgcgcgagagtctggcggtgtatctatctaaacagtgttcttcagaaaacagtgaaacacctcaacccaaacggctacccctgagcaactccgcggaagtcagaaagtttgtggaccggcgggtgttaagtagtcgccgggaacggctggtacgaacagagtagccgggagccgcttacgcacagcgcacccggcgatacacgccgagaagaaagaaa

SEQ ID NO: 7794 - DNA, 1213 bp, Homo sapiens
  misc_feature (1)...(1213): n = A,T,C or G
atgttgttgctatttttggctttgtttccaatctctcctttggtttgtattatgtgtgtctctctttcactctatggttggcgttggggtcggtgccactatcggccatcacctaaaccttgtatctgtggcatatcttcctgttccgctgttggggcatcacaccgagagggggaccggcatgacatccactatgtgatttgtgtggtgtgtgcggtactttctctcactgtggggctaactctacacacaccacatactgcttcgggcgcggtgcattgtcctccggctgtactgttgcttccgtggtggtgtttggctggaactgtgtatccgtggttggtccgggtgatttggctaaatctcattttatctcatctcttgggttatgtttatctctctgtgcctactgacttcctggacaactgggcctgctcgtgtgtggtgtatgtggtttattcataactacaccatggggccatttcattgatctcacctatttgtggtgggatactatcaggtggtcnggtggggggagtttgggtgacactacacaatggcacttcacctatcctattgggagagtgatggtgtctcactacttgtggtacatcattctgggtcggttacgggtgggtgggtcacaatttacaaacaacatcaccactaacatggcatcgggacccncatgtacccatcttnggtggtgtatgtggtggaaccacctctcctcttggtgggggcgactattactaccaggtgtgggcgtacactccgaccaacacatatccatattggtgtggacctactttcctcatttgtgcctcttcctcctctctccacgacacctggtggtggcacnacgaccacatcacctgtggactacaacaccaactgtgtcntgtctggtcacttgtgtgtgactgggtgtggntcaacttctactctgcttgcatactgcggcatacactcacacatcagtgacaacactggggttggttgggtgtgtgtctatgaattatacctaaatggtacacangcaccacactcnantgtttgtcttcatttatctatctctaatgtgtgacctgctcactggtggtggttgtggcgtgtggtgcgtgccctgtgatcaccgtggatcacatgtgtgcggtggctgggtcgtggatcacacgtgtctcctggtcacacacggacaccatgtgggtgg

SEQ ID NO: 7795 - DNA, 930 bp, Homo sapiens
aacacaggcaatcgtagggcgacgaattaatacgcttactcatcaagataacacgaagtgatattgttgctactaagtattggtcacaagaccacttgctaactcacccctcacataaatacagcgaacaacacgtataattgtcaggctaaagaacgaaacacacaggatgcggtgaggaagatattatagtatcaacacaattacgcgagtaaatataaatatcataagggaaacataaaggataaagaacatataagacaagtaaggcgcactacgtaccataataaaaataacaagaccacgcaatactatactacgaggtacgagataagcaaagcagagagtaaccagaaatatgtaacatattaagaccagtaatacagacgggaaacgaaacgacactatccgaacagatgaggacacacatgaagaaataaatgataaagagatgagtgcagccgacaatagaagcctgcaaatgtatgagaatcaacacgaagcatacatagaaccacacacacaaaacaaatcctagccatacgcaaaagaatacaatattcatagaaagcttaaaaaggacaaaagttttcatacagcgtatctagtaggccaaaatgcatgacacgttgtcctgatcatattaacgcacaaaagcacattcatagacacagtttaaggcatttcaagacaacacagcagaacataaagccaagcaagatcccctctgagtaaaggtccctgagcaattgcaagaggttgcacatccgaagtcatcttaatcttcactggattttgctgaaatcgggcccttttattatttctccctttcctactacctctagctccttattggtttctcctggcagttatccttaataatcgcgagcgaaagccacaacgccaagcgctctgaaacagcacacgtca

SEQ ID NO: 7796 - DNA, 352 bp, Homo sapiens
  misc_feature (1)...(352): n = A,T,C or G
ccagaagcgggggccccgccggcccccccgcnccgggggcggcaggagcaggcaaggcaagcaaaggcccagccccnccccngaggacccgcccgccanggncncagcccccttcccctgtgagtgctgctctgctgcctcggggngggngcggccccgnggggggcaaagagcgccgcccccgggggggggggcggggggcgggggggggagncacgcacggccggaggggcggcaggnncanccagacaagaggtttccccccccgngnnagaggcnnncncnngcgnnnnnncgncggggcggnngggtanncggcnnaaaggggcggaggcngggcacacaaaggttt

SEQ ID NO: 7797 - DNA, 224 bp, Homo sapiens
  misc_feature (1)...(224): n = A,T,C or G
cccactcgcggccgcttgtccatggggcgtaagactcataaaccccaaaacacctcgggccatgttcattacagtctattcaagcacggaagtgcgactacacggtcttggataatggtcctatgacccatagttcacaagcggctaaaaggttctcccagatgcctttggcgtaaaaaaacgngggcaaacccagtaattttgtggccatagagggcctctcg

SEQ ID NO: 7798 - DNA, 1248 bp, Homo sapiens
  misc_feature (1)...(1248): n = A,T,C or G
actagcgacgtacattggttgtgcaatctgagtatgcatactccagatcgtagatgttgacatcctcatgcgtaccatagacataacgagagatatgctacgactttctactagacagaaacccaccgcgtactcatgtccctctcctcacacttcccccgtggtctattaatctccgtcttnctttcttatttattatccgctccccgagcgcactcttcccaccaccagctactcgcacttcacacgtatctactatatattctaccgtatctcctcctccattatagcgactccattatggtgtacatagacgtacggatagagcgttgtatccctcacaacaaactatctctccacctctgttnacgaccacgtactcatacccctgtcaaccgctaccctacagcacccacccctcgctccatcgttcatctgcgccgacatattagtacgaatcatcatacactacatagattgacaacattgtctctttactcatccacccccacatctcccaacaccgaccccatcattcgtcccacacgcggtggctctcccgttgctcactactactcttctctggatcatcgaatatatgattttgaatacaaactagtatccacatcaatctgtgcgccctcacacttgtacactgactcgcactcacgtgctttcccacncacgtactactacaccgaaatcaattcttcatctcccgcacctgtatatctaggtctcttgtttctttatcgtacaaacaacacgttttgatatagcttccagccccataccatctcccgtttcttccgacatccattctaaccgctcttcgtgtgaccgtcgcgcaaacacctacccacatatgatctctctaacgtaaaccgcccgtggggcgattgagtaccctcatctatggttggtcccctacccttcactccccctctaactcactaacttgttaatgtactgatacaattgtaagcaaacccctagcatgtccgacagtagctcgtctttcaaagtaactcacacctcgcgcgctctatctttctcttacactgcacttgctcggcagtgttgcattgcgaactgcgaaccatacctctcttccttgatcttgctcctatacaacataagagccactagtcacagcagcgttccaattcccgaacgcctnccctccccatctctgcccacccgatgcacgtacccacgcacacagatcacacgccccaccaccatcat

SEQ ID NO: 7799 - DNA, 1458 bp, Homo sapiens
  misc_feature (1)...(1458): n = A,T,C or G
acttatcacgagagctgatctgaggtgagcagacaggccacgagagcgttacggagncctaagaagagagtgacangcgtggcggtgggaggcttcgacagggcgtagaagccatgagctcgacgctgntatcgttaggtgacgcagatgagagagtatgtattaggctcatattcgtntgagtgaggatcttaaagaatcgcaagcgtaantagataatatatcaatggaagcagaagtcgcggaatgactatctctacagtatgcaacattgctctcganatgcagccagcttagngnacacagatcgatactgtgcgtctggactcttctggtgccagagctgcaagnacaatgagtgagatcagaatgtctctagtctgcgccggcgtcgcgccatattgatgactgtgaatcgagtgctggtaatcgctttctaagtacctaacntntagactcgtctaagcgtctaccgcgtgcgacgcacgatctcgtttgactagagtgagtatatgcagtagtttacatatattgtatatgtcggtgctcgcatacgagtcgaatacaggcgacacgccagagcagcgatacancgncgcttctagacgcgtagtagattttattactgataaaacggtaatgagatcagtagtgactnagagantcataaccacatctgctatcgaaccgatattaacactcgattatagtcgctgtttcagacgagcgagcatgagactatacatagacgtgctcgtagcaagcgcgctcgaaagcgtctcagttgatnactatgctagtcgatgagtatgagtactaggaggtctcgcgtctctatgctagtacgagagacctctccagatgagacggtacactgcagccggagaatcgngtagtatatagtagagtagtgaatcagnacgacgctcgctctgatcagtgcgcacatagtgactntngacgttacgagtcattaatagtctgtacctggcgagnactgctgcgttgcgtagatgtagttgtataatgtatcactacgctccacacactgtcaggtcgcgtgtctggcgtcgtcaggctagcatgacagatcactccgngtgagcacncacnctccatggatcgatggttaccatcgcgtctgacataggcaggacnggtctantctcggcgcataggctctgcggactcttatcgctggattgtatcgcactctagctgtatatataataagtaccacacgtncatctgaacntgcacgcgcctcgnctagcgatagcataataatcgatgtcccanctccgccacgagtagcatctaaaagcgtcgcagacagtgagtagcgaacaatgagttaaacagaccagaagatgggcatctctctctcccggtggtgaggtctgatcactcgccgcagcgacgcagagcgggggagtgaggcgcttatagaggacatgg

SEQ ID NO: 7800 - DNA, 1106 bp, Homo sapiens
  misc_feature (1)...(1106): n = A,T,C or G
aaaagaaagagagaaggaagannnnncnnncccaanannaanaaaaaaaagnngttctttttgaagaaaacaacaccaaaacttccaccccggccgaacacgcgaaaacagacagggggcgccatttccaggggaatctacacgggcgcgcccggaggaggccaccgcgcagacaaaagacgcgcagaggcgccccgatcccaaaccacataacaaaaaaacaagagaccaataataacaaaacaagacgagcgacaaagatcaatcacaaaaacaacacgacacacagagaagcgggggcgcgccgcacgctgagcaacaaccacacacaccgacagacgaaacagacaaatcttttttcttggggggggggccggacccggcaacgggaaggcacaacacagcgactgataaggttgccgaaccacgaaggggggcgggagnaaccccccccccccaagcaagagcgatgaggagagacacagcccacataccggctgaaagtccaccatgaacgtaacagccgcggcgcccgccacaaagtgccacgcaagtaatagggcgcacggagaagacgaaacaacccacccagccacccccgccccgaccgcgccggggatacacacgccgcggacacaaaagggagcaagaagaacgaagaggacacccgaacggaaaaacgggaagcaagccgacgggcaaagaaacaagccgagcgcgagaccaccgcaaacaccccgagagacatagaagcagaacacgaccaccaagaatcccaccgagtgaacacaaccacacagtgacggcccccaaaagacccgacaaagctacaaccaagagagaaacaaaacacgggaagagcacaacgcacgcgcccanagcgatcccacacgcaggcgcgcgccgccgcacacgaaccacaaccggnggcacacaggaagaaacacaaagagacgagacaccccgcgacaacccatacacggacacacagccacccacgccccaagaaacacagaaagacaacacatcccaaacactacgaagagtacagacgacaaagcggcagggacagacaacaccgcacacgagacaaaagagagaagcgg

SEQ ID NO: 7801 - DNA, 1580 bp, Homo sapiens
  misc_feature (1)...(1580): n = A,T,C or G
gcggtactgtcatcgcgttgcgcttcacgatgctcggcgcggagtcgagagagagagagtgacgccgttcgctgggcgcgcaacaccgcggcagggccgcagcgcctctccgctggctatccgtaaccgccggtgcttctgcacgcgacgcaggaagagagtcctncactgcgatcttcgatcgtngagtacacgcagagcatggggtggtctggtcatgatagcgtccgcgtggcggactggtgaatgcggcgtgtcgcgcgtatttcatcgcctgccggacgcgccgacgtcatcacgctgtcctctgcgagtgatcgtcgtaccggccagctcctctatataccgacgcgccgccacctggtcgccaaggcgagtacatccgtcgttcctactagtcaccttcagatgctagtacggccggccatcgccgcgatacctcatacaagcacacngtgaccatgcacactagttaccacgacatcgagcacgagaatatgttgtgagttcgccatctcccactcgctccttnctaacgcggaccgcgcatacagatagcgccctgtcgacccattcatgccgcgcgcgtcggatngtggtgacctgcacagtgatggtagcacagtgttcgcaacgtatgagtanatcgngagagagcgtagagatatgatnggtaaatgagagtaatagtgtggcaggtacaatacacgcattagtgtgtgacatacttcctacactacgccgcgtcgacgtcgctcttcatgattgggcgtgcgtgatatangactcggctcagtctgatgtatgtacatatcacanaaacnatgatactggctgcgcgcgaggagactgtgtgtcgtagcgnagtgattgaagcagacgattagatatacagacatatgagaatgagtgtcatgcgagagaggcacgcgtcgtgctacanagagtgatcagaggagacgtgcagtgagcgtcgcgataatataatagtgtgatcgatgtatgagaggcctataataactatatctgagtagcttgaatgtcatacatctctngctcggagntagagcggcacgcgtacagacgctgagatgatatcgctacgtctctntttctgctcactacgagancgtgtcagtcccgtcgcctcacgcatcactcgcggnagcgtcgcagcgtctacggtctgtctcattatctactcgcggcgcgcgcatgtctcnacctctacagctgtctcgtagcgtcgtgtgctcacacagtgtntagatcagtcggtgctcgtagcgtcctgcgatttctgcctgcgctactctgtcttaatacctttacatcacactcaatcgtctgtatgtcgcgatactgaattantcgcataaccatcacatntacatctgtcacgacntctcgcntcagtcctgtcgtcgcagtgtgacgtgggctagtgtactcctagcgtacggcagctnactngcntgcgtctcgatncgcgaatcatgtagtntatcgcgcgacacccaactagtnctacgctcngttctngcgtgcagatatcacgtacgctctgcgcgcgtacatgg

SEQ ID NO: 7802 - DNA, 780 bp, Homo sapiens
aaaatagtctaggagagaaggggcccaaaccatgctacataagcaaaattagaacgcgggggaaaggctagactaactgaaaggacggctcgcaggtcatatataaatttggggcagagcgccaatatccgtccgtcgcgcatactctggtgcctctcgagtccgcccatcgaatgcctccggtcgtgccacatgcagacatcaccccacataaaggacagcatggagccacagtataattaaatgatttacgccgctcgcaataaacttgtattcccattaaataaatgtttgcaattcggaaatggtctgtctcacttgagtcatgtctctcgaattattttcaggtcaggctttacacatctggaatagaacgtcagaactcaggcatgattcatccagcctccaggtatgactcagccttcagcgatgattcaaccccactgatgattcagtctttactgacgcaaaagtctttttaacgcacattttattttctttttaatggtgttctaaattgagtcagctcctgtacagaagtcatagtttactacatagttagaaatcagagtttactacctggattctgggcaaatgttagtgcgggtacatcttatttaatttatactttgactatagtttattcctctggcagaatttacatgctggagctgaaaaaacctgcatgttctgcatatgtatcccagaacttaaagtaaaatttaaaaatatttaataataaatacataaataaaacagaagaaagtgaaaaaagtaaat

SEQ ID NO: 7803 - DNA, 188 bp, Homo sapiens
  misc_feature (1)...(188): n = A,T,C or G
tgacgacataaaaagcccattgtaactcttcaagaggctgatgtttggctcgagcgtacgagcaatgtcctagatataggcttctgatcagcctgggtcctggcggggagatgacaccgagcagagccaccattgagctgcactggataatgtagtatgagagagaaataaatcccgtatcngtcagg

SEQ ID NO: 7804 - DNA, 601 bp, Homo sapiens
ctccgtgaggcagtggacaccagtgctgcaaccctcatgccccgaaatgcacctgacatatgggacatggatggagctggaagccacgatcctcagcaaactaacacaggaatacaaaacaaaacaccacatgtctcataagtgggagctgaataataagaacacatggacacagtggaaaccacaataaagggtgttgcctgcattctcctcatcattccctctgcctcctgactgaccctggtgcgtgaccagtggaaacccccactcctggcactttatgccgtcccagtcttgggaactgtgagcaacaaactctcatcaatggcattgccttctcatctgttgacctcaccatacctgaataataaaacctacattttaaaacaacatgccctccatcaaacccatgaaggaaatgatatgaaaaagaaatacatctataaacagatattcatttaaattgggtatttcagcaatttcagaaaactgtcctaactggttgctatacaacaattttgtttttagttttgttttgttttaaatgagaatattcatcaactttgacaagcatgcatgcaaataaatgaggatcggcaag

SEQ ID NO: 7805 - DNA, 738 bp, Homo sapiens
ccccagttaaatggataccgccgcctgtgcttttaacacaacagtgtaaaccgcaagctagaattgactctgcttaataaaccagccgctccagaaaaggcttagtagaaaccaccttgaaacataaaaaaggcatgcgcggctcacataaaatggttgcacagggactggcttaattggatcgctccgaaactggtaaagcatatgagtttcccaaatacaaaaaacttccctaaaaaaaattgcaacattcttttgtgggcccctaggccctggccacaaataggaggattttggcaaccttaaggcaattgccgggggattttctttggccgccataaaaagccccctgaatgaccagagggtttcttaatattcctctttttttgcgcgaagatatggaccccaaaaaagaatgtggcatagtcttttctagaaggatttttgtttttggaaattccattgtttttggaaagcttgaacgtctcttttaattccgttcactggcttcactgtttttgagcgggccattattttgtttgttgcaaggggggttctatttaacccttctttgggaccgcggtttttttaagaaagagattttcctcgggcgtcataccctattctcataaaaaccactaacccgcgcttcgcacttttttagggatatggctgtagtgcccaaaaatctacttgtgttcccactgctctattattctgggagcgaatacaaacatt

SEQ ID NO: 7806 - DNA, 1092 bp, Homo sapiens
  misc_feature (1)...(1092): n = A,T,C or G
caaccctatatccctcatatctctccaaccgttcttccgaaaacacgcctaaattcctctgacacgcccccgggatattcaccgcgtgctaccagcatttttgggctatggcctcccccgctaaaggattcgcccccctgtttttaccacacaggcgcccacccataatatagcgaatatcccaaataaactccccggtcaaaaagcggcttatataaaaccccacgcgtattcaatgaaaatgaataagcggctcccaaagtatatgtcaacaacgggtaatgtcacatctagatccgcgctataactgtgcaaaaattacatgggatatccccatatgagatagcaagcaatcttatgaaaagaggaatactgtttcaataaacttgtattttgttctcccgcctcacacggacctcccccaccgatgataataacaacttcaaccacctgttacactacactagttaactgtagagatgccccactggtatcaaacacactcttatgtgtcgcagccagaaaaatgttctcacagagcagatgatgtaaaagattttgttacacaaatcaccactccccatcttacccagcttgataactcatctaatacacgaaagaggaactgggtgtgaaaagtgactcccactttaggagcggacgcttggtggcgtattgcacaccataacatcacgctacccctgtaagatatttggatgctctatgtgcgaagcagcacccctcatttgcgacaacttctgaatgcgccatgagtgcgcgagtcgccatgtagtccgaaagantgtattggagttttacacgaaacagtcgacatgcgcgcacgttagtgtatgtagatcgacgangcaagttccggcgtgcatggactaagccaagccgtatgtatattacaacaccatctcactccacatagtactcctactctaccggacgacagctcttgttcagtttgcacatacagtcaccacagtatcccctattttatccgcaccgcgcacaccctcctctgttctctggccatgtataattcgcgtcacatagtcgcaccccattatctcctcccaccctccg

SEQ ID NO: 7807 - DNA, 889 bp, Homo sapiens
  misc_feature (1)...(889): n = A,T,C or G
ccccgcgctggtccactggttacatngggcaaaaagagaaaacccccttgtgttcttgggctgatcatctttgtgttagtactaggtgctgacctcaacactgtcccaacgcggtgggggttgcataaccttgttggccagccaggggccccgtgttttgcactttacggcatgaaactgtaggaaaacaaaggaccggggacacacaacactgcccattgaagtggtactgcatacacatacttgtgtggtacgtggggtttgacactcttgctcgttggtctggtgcccctgggccactggcagtgtcttgtggtgggtgggcgtacatggatgttggtattggtggtgtaacaacatctggggtacacggatggcacatgggggatggacagtggaaacacataagggtattgatgtgcaacactgtgggccttgggactgcaccccaccccccctttgaccctcactcacttgttctacactaacacacggtccacaccgtgttggttgtgtttgatcttaattggagggtgccacacggttgtgagtggagaccacgacttactgtgacacctgtgatgccacggggtgggcaacacaggggctggacattggatgggggggtaaactggattcacgaagctgaggggtgcaacatgacacgaacactgggaacggtaacacaacgtggggaggtgcgttggtctcgaacacatcaccctattccactcacggacatccacatgtgtgggtggggcacaatgtggggagctacggggaccggggtgaacgggtacaacacactgacacccacactggcacaaccacttgaacaccctgtgatnggcaccactgtcaccgggcgccggtggggaacgccacccgc

SEQ ID NO: 7808 - DNA, 825 bp, Homo sapiens
caaccagctgaaagcccaagcgcagaagggttcttcaactttaacggcctccaccaggtctgttaatggtgcggggaagctaaagaagtgcattgaaccccatggcagcattgctgatattggatgcctgctctttctctcaagaagctacagtgcgctttcgccaatccaactgattttcagtccacagaccccaagcctgcagtaagctcttcagagactaagtaagcccttgtagcaagcttgaagagcttttgtttaagaattgctgaagatgtttttcagattctgaagtccggtgaaacagctgacgccaaccagtttgaagaccccacataggaacagaatcagcatgaggacagtatcttcatctgtctgtcctatgatttcaccctgcactctttgaccaatcaacaatcttcacacttctgcctgttctaaaactcttataaactttagccccaaactcctcacggaggtggatttgaggtttcctcccatctctttattcggtagccctccaattaaatctctttctcctgcaacttgacatcttggcatattgatttgctgcacatattgggcgctggacctattatggctatagtatcacaaatattgagataaaatgacatcttttgcctcctgatatgatgtattgagaacatgagttacctctctggtagaaacactaaaaaacctcaaattggggggctattctataaaacaactggcctgtgtttttcaagtgtaaatggtcaaaaaaggggcaaaataattgtttatgattagaataaaataaaaataaacacctgatcggcaagg

SEQ ID NO: 7809 - DNA, 818 bp, Homo sapiens
ctccatctagtagaaaagtcggggataagtaaaatagaaactatgtagttaaagcaaaggaatctggaaatgagtattaaacagggaagttgctaatttttgttccttcaagattgtatcagtacaagagaacgatggaagttgttgttgttccttggggaagatcagcgatcttgtttctttttgagaaatgtcagttagactgaagatgatgtaggaaccttaccaaaaattaattctggttattctggatgaaaaaaacaaaaacaaaaacaaaaaaatccatgtcatgtagcactgtccaatggccttactgaatttcggtcactggaaccttcttttggttaaatgttcatagattatgttcactaatccatttttcatgcttaaatctgaagacattatatttgaattgcacagatttatgattatacaataattgatctcatgtacacatgtgatctgtgcaccagcgtgacacattgttgaagcagttgcctatatatgagggattttgtattgctgcagcttgcctgatatgccagagcctgctttgctgtttcaaatgtaataaatgtgaatgtgcatgaacttaataacatgatttgaaacataatgaggaagataatgggttgatcataatgacagggactaatatagggataatacagagtacaccctcactgctgttctcttttagacctccaaaaaaactctaattatgcagttcttatggcacacataggctgagtagattttaggagtggaatgtgcaaattaatgatttattaataaataaataaaggtggatgcgtcag

SEQ ID NO: 7810 - DNA, 1662 bp, Homo sapiens
  misc_feature (1)...(1662): n = A,T,C or G
catatgtacagcttcggcagcttcgtatagtgagtggatagcgaacacaaaggccgaaggcctcanatgtggtggaaantgagggnggagggaggcctcnngnngggcggggagaaaccttcgcgccatgcgtgactcggccgacgctcgatgtatgataatcgccctgtttaananactgacgntgaagcatctcgcccgccgcgcacctgagatatagcgaggatcagacacatggtagctgctaacgcgcaccagcggttcatggtgattgatatatacgtgaccttccgacacgccgctacgtancctccatccacgacgtaantgaagtcagacgcgagtnatcgcgaagcaggctatcgacgcggactccgctagtgcgagaattacagtaagttgagtgtatatactagcagatgtagtgactccgtaccggatagacgagcgtatattgctttntatactatcccgtcacgctgcatcagtgcgcatgacgagctgcgcacggcgcagactattcgccttatctgtantgttcagtatnatgttgagtgagtatacataactcgcgtcngcttgcacagncacaacacgcncngctactcgacgcgcgcgcgcatgtctcgctacataacagctaccagcagatagctcactgtactctcttgcgcgatgagcatccgtncatcatagctcagctcgacacgcgcatactcgaatggagtagcacgagtgcgttgcactcgcgtcagatcagccgcagctacgcgaccagctatgagttgcgtcgatgatgctcgtcagctgatcatatggngagttagtgcgtagggggctgagtatacgcgagagcggatctgatgaggagcgcacgcagagtacaatcaggcgaggtggcgagcgacagctagtggatcgccgcaagctcatcctaacacacgtatgtgatgcnagacagcgccagaagcacgtagaatgatcccgcgttcgatgcgggagcactcacgacagacgacgcaagctcggcggattgctgtattacacagtatgtgactacgagcgtgagaatactgaccgcagncttcacttgctgtcgacgtgtgctgntcatgcgtatangngattacgaacacatcatgcacactatctgacagtatctaccgatgtgagtgacgtatgtatatcgtcacacacatgtgaantcattacatananatntgacgctataatatctagatgctcgcgcagcacagcatntatctatatcagatgattagatnatgattcgcacctgcggactacntagntgatcaganattgagtgcttcgcgactctatntatctcatgattcgcgactactgcggcagctgcgtcatangacgcgtatgagtcntgtgangcacgnatagnacagacnacgctnaggtctaagagctcgantcatgcccagctcgttagcaaatgacacctcgagcgatcacntntntgcgcaactcggctagtnacagctgacgcatcgcgcagcagcacatgatgtctgtatcttactgtcgtcgatatgctgtctcgagcatgactgcatgtgacatacggtctgtcgtgcgacatagctatactncgacccactgcgacgcnagtctacngcgactctcngcgcg

SEQ ID NO: 7811 - DNA, 853 bp, Homo sapiens
ctccacatacctcaactcccaccaccaagacacgcgcccctccccccccgctttaataggcaacacaggcaacaaaattcgaaggcaggaacacaaagaaggaagtaggaaaatcaggatgacataacaggaagaagtttcaaaaatgttataaagattgtatagttgaaattactgtttattcaaaaatgtgccttctgatttgtttgaatataatgaaactttccaaaaaatgtatttaaattgatatcacatttacatacagatattaaaataaattgcatttattaaaaatgaaaaacaaaatggcctacttcgcctcatcggcggagctttgccaccacttccctttaatgatgtgtaattactgctcctctctctctaactagctacaatccccttatctgctccccctaatggcaactcctcactcgaatccatgaatatcgatatcaccattattactgtactaccccttccacccaacctcctcactaaaatacttctcaacattctaccccatacaatctttccatcataaatctcttaacttaataaccccctcgctcctatgacatcccctcagaatatctatttatcctctccatcttaccaatctatattctcccttatcccacctatgttcatacacatatgtaatatacctacatatatcacattaatatccattctactcatctccacattgccttcacaccatctctccattccaaaatccatacacatatacccatcccaaaagccatgatcatccccaacaccccactttcaaccactacacccctcactttaactccaacactcacctcggacccccacatatcaatcccta

SEQ ID NO: 7812 - DNA, 1657 bp, Homo sapiens
  misc_feature (1)...(1657): n = A,T,C or G
gcacgtagagcggttccggttgtatcattataatttcctaataatccaccaccatgagcgccaaccatctgggatatagagataccgganagcccgaataagagttttgggagaaggaggaaaaccatgtaacagatcctgctgtaatatgtcaatgtctataagtcgaactactgctacaccatctcatcatataacattctccacgctattcgctctgtagtgtttagtcgtctctatcgctgtttgatatgacactctcacanagtatctgtagcgagatataatacatatatcctcggttgcaatctgctgntactgtggtcgcggatactcacgagctaccagtagtataagacgatatgtagactgtgcagtcgctagtatctcatattgatgctgtatatctgccacacgcagccgcatgcgacgcatgactagcancngcggatgagagtgtacatacgtgacgcaggtntgcattncacggtgatgcactatntcgcnanatactgaactagtgtagtctgcgcctgtaggcgctggtgtcnatattatacagtacacgcgacgccacgcgcngntncatgatctctgcgctgcactgatagtatatcgcatgagagcgtcagtcgtctctcgtnatcagaganccgtgtatcatgtcnctgtgctatcgtacgcagcgcacactcgatcttacagctncgcncgatgcactgcgtantcatgacgntcgtatgccgctcngtgtatagtntncgctcgncgtcctanctaccgcgncgctcgcntcatcatcatacgatgtctgtcgtgctagcttcgtcacgctcggcgctgtcgngacagtagtgttaggcgttcgagtgtaactgtnanatactgtctctgacttccgctagagtgtcatatncgaggacgtatnttgtagtgctgcagtgggcgcgccgtggttgccgatgactcgctatatagtatgtatcgcagtgtnatggcactatctcccgcgtatcttaatgtaagtatagtatattcaggtgctccgcgtgtcgtcagcacatgatatctcatcgctagtactatcttcntngtgagcgagctgatactatggttggtgatgcgccagcntcggcttcgcacatatgtattccgactacgtcacattaagtcatcgacgtcatgtatgtagatttgcgnagcattaaatatcacataagcctggtcaatnctntagatgctgttgtgggcgatagtgtgtagatagacgcgtcgcatattagccgatcagcgcatcgcacgcgcgcgccgagctntcatgctttactgcacanttctcatgaccgcctgagcgtgtgcgtgtaggatgtcgtnatgctgcttcaatcaataatctgtatatatcgtctattgtatcaacgcgcggcgcaccgcacagttcacgagcatcacgcgcatatccagtccctantnatgatcatntgatgntgtnacgctctactctcctcagagatctcgcacgcagcgactgccatgcgcgtgatgctatgctcgatcgcgtgatgtaaangntgacgcgacagggaganatgatagcgncgnctcatatgtagatataatctcagcgtcacgacacgatataactatgtattagaat

SEQ ID NO: 7813 - DNA, 1440 bp, Homo sapiens
  misc_feature (1)...(1440): n = A,T,C or G
actaacgatcgcaatgataatgagtaaaggcgccgaacctagtctagacattcgtactcttcagttttgcggcgcaaaataaacatccttcacatncacctcttcatcttcaagcagtcgtagctgtaccgccggcttgacaatagtaagtatatccaaccacatccggcaagacagacaattctcgagcacagcccagcatcagttaccttatacaatgcagctagtctacctgttaaagacccctcccgacgaccactatgcacgcgccctcgtctcttgttcctcatcttccatcaaatcacaaacgtcactttgcctgcgcatacgcccactagctactctacncatcgcgccctcttagtctcgctacacccgcnctctctctcactctctccttatcactcccggcatactatcgctctccacgtgcgtctgagtcgccgacagactacccatcaacgacattgcgcactttcctcccctctcatccacatatgctcccccaccctatctcctccttccctcactcacgtgtccgtgagtcaactccgctccacccaacctcgactatatgacctaccaccatncagcgctgcagtcgaacgcacgcacgtctgctcgtctcatgctactgccatccgatgtacnccgtatctattccgtctccctctgcgtcccgacgccacncacattaccaccatcacgcgcncagcgactcagtcctgtcgttcccaccgttcctctcgtgcgtcagcgctcaccacatctgtcacaagattcatgataccatgtccgacttacgaccctcatcactcttactatgccggtctctatcatactggcacntccacatgcgcgcgacgacgttcacacgacgaccgcacctctctgcacatcacgtagttcgccctcgttccacgatgaccaacgncggaccatgagtcacatacacgcactccgtagcaccacgactatatagactatatgcagtggattctacaaagacgaatacacgtcctatagtgttagtgtgcccgtcgcgcgcctcaccgctntcgctgtcgcgtcgcctgccgcacgctacctacgcaccaccttatnctctacttatgtatctctatgtantgnaatgataatataattgcatcnatagctataagatagtcgtccacatncgtcgnttctgtcttcctctctacgactcaacacccntcgcgcgtcacgcgtnctaccgaccgctgtacgtgagaatactctacgcgtcacacacgcgacacggcgagcgtcacgcgnctcacgacgcgcacacgcggcccgtctacgtcgngctctccgcactctatacctcatcttcgtncgtccggcgataatctctgcacactatttctatctctcatacacctcatccctctctcagtgtgcagtatcgtgcactct

SEQ ID NO: 7814 - DNA, 1548 bp, Homo sapiens
  misc_feature (1)...(1548): n = A,T,C or G
agcaacaccgaccgacgagaacgagcgcaagagacaaggcacgcaccggcgcaacggagcacaagacgcgcgacgagcgngtagngnagagcgagaacgncagagcnccgagcacgcctttcagcangagacgcgccaacacccancagaaggagcgagacagggcgcaccagcggagagagcaccnaacaggagagcacgaggacacgaagagcgcgcagacagacacgcaacacacgagcncggcgagcgcgcagcacncagacgagcagaggcagcgagcncaacgnagcggcacgcacagacaaacacgagcgcncacacacgacgagccagcagacgaggcgccacggcacgaacggaccgcagcaacccacgagangaccagagaagccacgaggagcccgacggcgagagnccaccacagcgcgcgaggacngaacacnacgnccagacaggacgagacgancccacgccagcgccacgacttcttcttcgcaacgccgacaccagcgccnacacgcacnacacagcgcgcaacacagcaagacgcgaccgacacgccgcacagagagcgcagcgcgcnagcggcaccaagacacgcaagcccgcacacaggacccaggcgctcggaggcagacccacaaccaccgccgcagacagagcacgcgnagagagaaaagcgacaggaagcgaagagcaccacacgacgacgcgcagctcgccggcgccnccgcaccgcctgaagcgagacgccgcgccgcggctcgcgcggcgccgacggncggcnccagcgagcgaggncgagaccagacagcgcgcgcgagacaagagagatgcggnctcgaccgaggcgcccgcggcagagcggcagacgagagacggcgacgcgcagggacacgccgacgcagcggagacgggccaccgccgccaacntctccgcgcgccggcgccgcggctgtcgcgcggcgccacgcgctgcgncgcgcnacgcgnccgntcgcttccgagagcagntacggcgnagcgcacgcgccacgcacggccgcagccggcgcgtgcgcccgcggagctcgtcgagcggcggcnntgtcgtcgggcacaagcagtggagaggncngacgtctcgagnggcgtgcgcgcaagcggagcgcagagnacgaggagcgcacgcggtgcgtgcncacgcacaggaggacgaggccacgcgcagngctgtcacacagagcaggcgacagacacgtcacgaacgcagagacacgacgcctccncatctacagagcacggccacacacagtactcgcacactcgaccctgcaagaccgcccggcncacgagcccgcacctcaccgcgcgncgcnccgcgcaagacgcgcgagcgggttnacagaacgtggcgtggtaggcgagcgagagagnacgcgcgnggcgncactcactcgcagcgcgcggccgcgcacagacgagacgccgacgccagcgccncaccccagcagcgccaggaccaggggcgcgnnccgcgcggcggagcgcgcgcggaggacagcg

SEQ ID NO: 7815 - DNA, 1439 bp, Homo sapiens
  misc_feature (1)...(1439): n = A,T,C or G
aagcgtcgtacctgcttactctaaaaccatagcagtatgcgtatatcagcgtactgaagatctattatccaaattacnctcttttatctcgtatggtgcgccgggccgccgacccactatttttgataggcgcgccgcgacgctagaagtgacgatctgcaacatgatatagcacacagcaagtatatactatacggtggcttgagtgtaatgtggccccagtttggtgattatacgatcatttcggatttgccggagcatgatcgtgctggcagtgcacattagcatgagacgatatgttatatgccgttgtatatatagagtgtatccgatgtcgccgcatcgtgcaggcagcaggatagttgaacgtgtatccaacatacacttatcgatgtaagtatatattaggcgcagagcacgccagagtaatgatgtagacagacattagccatctatgtccctccctcaatgaacactccggaggactacttgcgctctgcggacgttgactctggcgccgctggcaatctctccgtaatatatacagcaacgacccgatgattatctccttctttaatccgcttgtgaccgaacgagtattcgttactgcatgtcgcatgtatagtgtgcgaggtgcgattactacaggagaagtgatgccgccgcgtaatgcgcatcgttctacgcaattcctataatacctctctccttacacattagtttccctactcacggacacgtctcanactatcgttacggtaggcgtgcgtgccgagagctgagcagactctgtgtattntgcctctgcgtcgtttctaccccgtcgtaccactcagcctctctctcttgtcgttntgtgcgacagntcacagtactatatgcgatgatctgcagtcagtagcgtccgtgttgagtctgagcgcgcgcgtgctgaatgattaacactcgtacacatattcgagtagtgtagcntattgcnatcggacgcatgtngagatcgctgcagtctgatctcgttcgcgcacgcacgccgccatgattatttccgctgagacgtagtcgagtctgatgattattagattgaagtgtacccggtatgctaccataggatcgaaccagcgtaatactattgcgatactcctattctatacatcacanacctctatctactgtcgtccgtacaggatgatcatagattattgtatagtaaccattgcaagtgcgagctcaataagcagttctcggagtaagtattgcatttatgctgcgtcggaccagctgctcttacatcacgtaaccgcgatagtatgatattaggtcgtcgtctacgattcgaggtcgcacaagttaagcaatgttgcttcagatatactcgcgaccagcgaccacaagacccgcgagacggtgtgtctgttagtgctggatgcagtttgttattt

SEQ ID NO: 7816 - DNA, 1762 bp, Homo sapiens
  misc_feature (1)...(1762): n = A,T,C or G
catgtgcttgaacatactggatatcacagtagtcgtggnctancagagagcacgaatgcgtgcgttgntaatatagaacgaagagcaacactaagagaacatatttgtgataacatgaaacactatcctaaanacagagaaagataacnanattgccgcgctgatgnncgacgcgctatacgacagcgantcgtactgctcacattatgtcgcagacanacgaccgcgaanatcacgtcgcgccagacgagtcttgcacgcggnacgccgtacgtcgactgcaggcgagcgggcgaccgtacacgtagcgacaggacctgngacgacgncacgcacactatcgcactcatgtggtatagctgcgtcacgnagcgcatcagatgagtagcatctgaacacctcacatatgtagcnctctctaatatatgacatatagcaatcagtcataagatactanacacgcatactcctagagtntcggaacngataagcgagttcgatgttatatacagtcatcagagacgtgtaacactactnaacgtgtacggactaactttgacacgacagaatgagtgcncnacaatatcancactagagagtagcacacgctcgcacgcgtcaccgacgtacgacagatgagaatggagacgatgcncntcngcgntaacagcgcctnacatgacagtgtgacgaagagnaacacgtgagagacgctcagtgtagcgtagcgcttatatcgacagatgacctcggctcntcgatgctatgcgctcagtgatcgcgcgccgacgtgtctactccacgtttcgnctacagacctccgtctacctaactaccaccatcataccacagccgtaanaactcaccatacatgncaganatatatgtacgatactgtgctcacatgtcgcgcacagggacctcacggantcgattcgcgcgaagtcntctcgtgttagttcatctatagatacactcactagtgtagtacgtcctagacgcgacgacagtcgcactcagcgagcagcgtgctgctgtgatgtgctcacgtatgacgaccactgtgacgagagatattgcacatcganttactcgtcacaacacgcagnactcncgagtgtgtgancgtgtcancgtcgtagctgcactcgcatgacatatagatagtctanacgtctgncgtgacgatcaatagacgacgagcgcactagacgtacacataaccggctcgccgcgtagatgactgcgagacagagcgcgatctatgtcttactctagcgtcgtcgcagagctcgctgccgagagagcatcagcaacatgatgacctcaacacgtacaaccgaagcgtacgtgagtctacgatgcgagagatgcggcagcgcgtcacgctgcagagagcgagacgagaacacgtcacggggcgcacacgaccactcacgaacnctagataagccancgacaggacaatatgacgagagagacacgcgagtgcggacgtcgactacggtgcgactactgtcgctagtgcatcgaatgtgaagatataacgatagtgttgtagatacagcatctagagagatcagatcagtgangagctataccgaggtaccgtctgcgatacggtanttatacgagtcaggcagcgttatatngtccacgcattctgtcctgacctgtcctatatntacgcgtcgcttattattttgagcgatatntatgtagcggtcacgagcagcgcgcacgagtgcgacactcatcagct

SEQ ID NO: 7817 - DNA, 989 bp, Homo sapiens
  misc_feature (1)...(989): n = A,T,C or G
ataatttcctcaccatttcatccatcaccattccaatccttcagngncatactgaacgcttattgcttgaccaacacatccaagtcacaacagattcgggcactgtgtggaagaaggttggatgatgtcattgccacaccctggagaagcacagaaaagggcgtggaccatctgcatcccgagatgatgccagccctcaacgcttctgctcaacctgtgtaccatccctgtagccatcactataagctccgcccactcttcatcccgacatcgcgacgctctgtcaattccccctagaataccaagagctgtccctgatntgacaaacccctatctactggcctgtgagccgcagttccgaactcgctcacccacacccttcttatatactgtttggttcactgctctcctcctgtcactcacgactccgaacatggacacaagaaaattctgttaggtggccatcaaattttactaaccgccctaattctccttaaagaagtatnaagagatgcttgtttttgtcttgcttcatttatgatcctattaaatcttgcccggtacctctcccactacacctatcgcgatccatctcaccgtcatccatggacgggacacgggctctctctcacccagcttcattggnccacgtcacggtnaaatcataaatcgtttctcgtgccgtatctctcaattccctcactttccacctcctcctccgcagtcccgcctcgttcccaacttatatcatcttccccactactaaattcccggtataatgatcaatctctccncgtgtagtagactccgatagatgtgagcagacacatataccccacatagttactcattctcttatacttatggcctatcagctcctatagtctgtgcaggtgtctacatatagtttatgtataagtacattgtaacnccgaatagtaaagcatactataaactaagcaccctttaatgcctattgtcatataatg

SEQ ID NO: 7818 - DNA, 616 bp, Homo sapiens
  misc_feature (1)...(616): n = A,T,C or G
gtccatcagttcgtgcatgccgtgcgttgcagcgcacgagtgcgttncgacctgatcgcagggactcgctggtagagatgtggtcagatacgctctaagcgtagttatgacgatgctatgttactgagctcgccacacactctcgcgcgtatnatncattatatcagccacgaacatagagatggagtgaagcgggctcagtctgtggcgtatgtgcagacagctagactgacgagtcacatgcgcgcaaggcgttgttaggcgacgagacaacaaccacccatcatgaatctagagtcgtcntcgtggctagatgtcgtgagtgttgagtttccggcttagatacgctaattggcagttatcacttgacatgaacagcgagtagctaggagaggactagcagggtgcgtcacgcgaataccgcacntgtcacgtcatgactgtctggcacgattcgcgacgtttctatcacaatcagcgtgtatacctacgcatcacgtccgtgtgcgctatcatcttgctcttattatcatacacgctcgacaagtactacactgtggacgacatcgtgctgtttctatgtgctcgctgacagtctgtcgacgtcgtgngctgt

SEQ ID NO: 7819 - DNA, 556 bp, Homo sapiens
  misc_feature (1)...(556): n = A,T,C or G
cgatgattacgcttcgataccaccatcatctaaacagctatgcggatgatggatgacagccatggaacacatatccactcgtatgtcaacatcatccgccgacggcgccaggcacacgagacagggatgggagtattagacacacgctaatgacacntcaacactagtactatcgtctacacgactcctcgtgtacgcagtgtcgccatctcccacgcttcttaccaactcatccacttcacacacagaatccccgacctccattgcgcgcgccacacgcgcgtgcactcagcgcggcctaaacagcgagtcagatatacgcacatatcatccatgtgctgcctgtgatatgactctctacgtctcgaattgtacgatcggccgcactagtggttagctatctgttactaatatactcatcgccacagatctacaagactcgctccagtcctcgctctccacacatgcactcaacatcatatccaatgacgattcactcatacgcattgcgtccgtatgtgttagtatgaagganagcttgtgcggagtggggnat

SEQ ID NO: 7820 - DNA, 764 bp, Homo sapiens
  misc_feature (1)...(764): n = A,T,C or G
cccctcgcggccgttcttcgttgccgccccccccccgcngccccggacacgcctcagccggcctagtccccgctcctcctccggcccgcgcgggatctcccagccgtgggccccctccgttagcgtggggctcgtccctaacggggggggttttgtgtggtcgcccacgaaacttgagtgggtggtctcctcgtttgcccccccgccccgcggtgccacgccggggccctctcgggcccgcggtgtgtgcggcgccccctagcctgcgtgggcccatctaaacggttgctgggagaacccccccacgcgcgtttgttctcgtggggggacaacttcttttnatgctcttgcgatgcccgccgccgtttttcacactattgttgcgcggggagcttctttccacgccgggggttccctaactttgttctctcccctcctttctttccctgncccttttcttacccttccctattgccagggtggatcggctcgtcgcggcctgatgtcgggggaatttggtagccccccctttcggcgcggtgctcctcggggcccgtggggtggagcggaccttgtgcggggcgcagcgcgggcgcccccccccccgtttgcgttgtttttttccgggcgggttttgcctgcccgggccttattgccggggggtgtaaaaaaaaactttccccccgtgggaattaaacccccccccggggtggggaataaccaagacacagcaaaaaaaaaaaaaacagaacccccccgacccc

SEQ ID NO: 7821 - DNA, 1110 bp, Homo sapiens
  misc_feature (1)...(1110): n = A,T,C or G
ggggggtcggggnnagggggggggggagcgaaggtgggagggtgtggcgaggaggtggtgggtgagtgtggggtgggtgggagggtgggagtgccgtgagcggtgcgccggggcggtccttttggatattgtgccgctctgacgccgattgtgttcccgccccatntgtctaaagatnaaccgcacgggtcgccggcgttaatacctaaagagcggaggcggagaatagcggcgagaganaagactacgggagacgtaataagaaggagaatatgaggaaaaaaaaagaaaaatcaacagaaaaaagtatagaaatttaatatcaatgaaatataataataacggatgccaagaatctgtaattgtaggtgggctgcagcagataggcagtcgcgcgccggatgatgtgagggtgtatgggggtgaggagggaaatcgtagaagactgtaagaggcgcgtgagtacaggagaatggtatatggtggtgctcgcggggttttatttggggtggttgttggagtttcggagcgggaggagggggagagttgggaagaacgccacccgctggggattcgtcgataatgcccggcatcttcctttttctctgtcggttcgtcgcgaatgtacttgttggatgtatttatttacttccgcacgccctcctcgtcgtacgatagttttgtatcagcgtcggcgccgctggcttacgtgttatgttcagctagtcggttgtggtaaggctacgcgcacagctatgattggacctgtagttgcctcggcccatcgaagtgttgcgctctcgtcggcgccgtctcggatgtgaacggatgtgggaactttgaggtatatacaatatagttagttgtatgtggtggtggttgcatagatgtgttgctgcttcttgcgtagcaaggacgcttagtattgtagcgtcttaggcatgtgggaggctcatgtgtgtggcagagacgacgtcaccaggtgtgagctgtccgcatcttcatctcgtacctcatgttgtgtacgatagattatttagttaggaggaggtgcgatagaagagtgcgtatgtangtgactcctctctcgtctgtttgagnaggcgtatc

SEQ ID NO: 7822 - DNA, 1394 bp, Homo sapiens
  misc_feature (1)...(1394): n = A,T,C or G
aanagttaaacatgagatattataaactaactatttttaattttaaattaaagatacattagctattgttaaaattatttatttcttatacttctcgattacgccacttctctttttgtttttttatttaataattttattttttttatttattctctatccgtatttattcttttctattcatatttcattactttttctttatttcttttatccttcctctattcgctctatttatcctacgtcgggcacttagaagtgcatattgacaccaagcataatattcatctaagcaaccggaatcgcacgaacagcccaacctcgacgtagcagcgacccggttaggcgcgcgccgacgatgtggccgtctcgcggcggcggcgcacacggagttgagtggggccgatgcagcggagagcgtgggggcgcgcagccacatgacgcggctcggggcttggttcacccgggtagcaccgcagttatctacgatgcaccgagggccgcgacgcggagacttgtgcatagtatggccccgtactaagcgggcacgctggcggtccacggccatcgtcgtggagtgttatcatgccgtcatccgagatactatacccagtcatactgccccggcaagccgcacatggcggatcgcaatgtctagctcacggttggccgcccaaacgggccacagcgcgcgatcttgcgccgaggcggtcggagtcgcatcagccgcgacgagatgcagacgcgcggcggcacgcctcagtgctgcgcggccgctcgcgtctggattcagattaccgccaccacgcgaccgttatcgctcataattgatcggcttcgntagtcgacagcgtagcttcgtgctacgtcatccaagntagtcgcatgcgggtaggctgcgagattatgcagctccgacatatgtagctcggaggacacggaagacgcgcgagctgcgtcggcgcgcntgtgtgattgaggagcgagagagagcgatagtcgcgacgggaagtgcgatgcggagcgtggaagatgggtgncggccgtgcccactgatggagtgggcttgtgntcgtcatttgatagggtcggcgcacacggtatgcggagagtcggaggtgnaacgcgtaaattgatagtggggtacgtccgaccggancccgccggcattagtcgatgtacgagcatatcagtnaggcgnataacgcgactacgacgcgcttctatacgtatgcggctcgttgatgttatgttggtcgcgcgccgttatgcggtcacaccaccctacatatttcgtnaccacgcacacatggttgagnacatgtctncagcgcacggcagagatatacgtctacgatcgcgctatctacgcgcccatggcacaagcaagaccg

SEQ ID NO: 7823 - DNA, 1146 bp, Homo sapiens
  misc_feature (1)...(1146): n = A,T,C or G
ttatcatattctcatctcatacattatctattacttcccaacaacaatctgcaattccttacccaccagaaccactcattagcaactcatttcgctctccgttacccttctgatctcacgctcaataccacagctaagccatggatattgtgtatcatcaagatctttatctgttcccgctcacgatcttcgtatcgtgtgaatgtagtctcacggttcaagtctcttccctctctggtttatgctttggacggcgctctcacattgacactaacctagctacagactctgtaacaactacaattctgttatgtgcatagcaatacagtaccatctgaagctatcagactcattctatnatatgcaagtcagcgtggcgtagtagcttcctccgcgtgctcccttcttttgttcacttgtttctgatcattgcacaaactaattacaccgctccacactccgtgatactcctcccgcccaccacggtctccctcttgcatgcatggactaaccagaagcgaggccacgtatgcgtccgcttctattgtgccatgtctgttaaacatgtcggacaataatacaagaatcaactaggacagggtgacatcacacagaaacgtagcggggcgtcgtgacaacatttgacgcacaaaacacattgcgagagactccaaatagatgctcgacctagttaggctcaccaatgatccgttgttgtgagcaccactccatcgccactccttctacctccacgcacacaatagcatcgtgcgccaacaaagctgtggcgggcgtcaatcatcttgcgtgagtgcgctcaacgcaaaaatctcnagggtggcacgtcgtcctgatctaccccttctacgaattcttggcggataacttcattatattttcatacaccccacggtgttccgatatggtggcccgcaggactcttgtatatcccaccccccctcaacatctaacaatcgatgtcggtgcctgagtcttcatcgatcacagtacaccactctccatctccccactcatcctcactgccagcataactacgacatgcgcaaatgcacaggcgcggaacatcgcgaaattgtgggcgcatgagggtgactaaccgcacactaaacanacgaaacccgggag

SEQ ID NO: 7824 - DNA, 174 bp, Homo sapiens
  misc_feature (1)...(174): n = A,T,C or G
ttggggnccnttgngggccttgggnttggnacctttgggacattcacccnctttgggggaacttcccaccggccngactaccacgtacnntacataacggctataccaggagggcncnncanctggcccnataccnggaganncaccctcacacncatcgctcacctatcacca

SEQ ID NO: 7825 - DNA, 1740 bp, Homo sapiens
  misc_feature (1)...(1740): n = A,T,C or G
cgagtctgatatatcagtgcgtaagcatactcctcatctcacttacggttcaatcgtcgacacatcgtcgcancgcgtnacgatgtgtgatatactatgcgcgcacctctgcgnagtcgacgctcgtcgctcgtcatatatnagcgcgctcacgaacacgtgacgtagtgactcctcagcgctacgacaatgnggcgtcgtgcagacntacagaggcgcggcggcgtcgatcgtgcgtaacgatagatagctcgatggtctcgctactacgtgcgtgcaggtcacgcagttgtctgtgaccgtcntcgcgcgcactattacgctcgagacatcgatatgacgacagcgcactcataatcgtacctcgtgccatgagagcatgcagccgatgcnctctgcgctacagctcatcgcgggtacacttgtcggtggcantcgtagcgtcgatatactcatgtcatcgatcgancctgtaaacgcgcgtgagacgtgtgcgcgncatcgcactactctgactntacatcngcgcacgcactacagggcgtctacgcgcagtcgctgtcgggcacctatgatctatcagcgtgtacacatcancaggcagtcattggacgagacatactattgccgtgcantnaacacgantgtatagagatacgtcgctacagacgatctcancgcacactgnctgtacactcgcgcacggcgtcgcgtcagtgtgctcgatatctgcagctcncgnacacattcgctgcgcgcggtcgcgcgccgattcagngtcantgtncgcgagcgccctgccgcacgtgtggtgagcgtcgcgacagcatctccgccagctgtctcgcacgcactgcaccagcccgtcgatnctcgtacgtgcggctgcgggagtcgctctcccgtacgcattctgcacctacttactctcgtcctacgtatgttcantgtcgcagtcgactctatcacctaccgatcgctagcgctctcagcctctgtctgggatgaggggcgangagcgnatgtcttatctgcatacgctcgcacgtcctctctcacnctcngtccagcgcatatgtgtcgtacgctacgtgatgacagatcgcacatcatcactgctcctacgtgtccngnanactaccgcttgttgacatgctcggtctcgacgactactccgtcgtagacgaagagctatcacgtacgnttcgtctgacgctcgctcggctcgagacaacaaagcgacatcacgcacgtgattcgactcagatnctgtcgtaagcgactcacgaccctcggcgtgcgcgcgcgacatggcgtacntctcgcagcgtgtcntntcggcgtactgctctcantcgactctgcntcgatgctgcaatagtctgcagtagctgcgtatacgtccgactcgtcgcgctcacttcgccatcgtacacgtgcatgaccgtcttctatccatactccactgctctctgcgatgcttcctaccgtcgtatctactatgntatacgtagtgngtccgatgctggcagctactccacataaacaaacgaagcgataatacccgcacgctgcgtccgtattgtaccatatactggtatcgcgtggggtctcctctctcctataatcaagcgctccctctattgcgcgatgtcgactaatanatacaggagtcctctactcttcgctctttatnatcgacctcgcgcgtcttgtctcagcgctgcttccgtgcttctg

SEQ ID NO: 7826 - DNA, 1549 bp, Homo sapiens
  misc_feature (1)...(1549): n = A,T,C or G
tgtcgcgctctctgctccgatggcgcttccctctcgctcctacttgaggcgctcattgcgttcgcgcatctatcngctgtgatgcggcgagcggctcatgagtcccantgcgcgggtgacatggcagtgcgatagctcctgggtgctgtggagtaccatatatatgtctaccgggtcttacgtacgttcagcggcggtgtcgctgagtggaactcgtcgtactccgcgccttgtccgacttctagccccacgtatgtgggtgcagtgccgacactcgcgtcncacactaaggcatgcggcccacacggtgtaatcgtctgcgctgttcgagtcacgtaatcactacagctggcgtactaacgaggcaagcgatgcgtattagttcgcagcatgagtacgccgccgctcacggcggggagtggcacaccctctcgcgcgttgactcaancgctggcatctcgccgatgcggcgccacgatcagtccgtacacactgtgtgaccatgagtgtcgagctcgcctcacaagtagtggtttggtgcgtatgtcagtctgagtcatagagtgcggactatcgcctcgagtcgcctngcagcacggcgctctctccacgcctccgcgccggtctggtgcaggcgctgcagcgcagcctccacgccgtcggctcggtgtgagagtcttcgcgatgctcgctgtgtgcgctattcgctcgactgtancggtgtagtcggggctcgcntgcacgcacacacatacgcacgcgcctactggtgcgcgcggtgtgctatcgtcctatcgcgacnttgggtcatatatagcgcgttcactacgntggcttcnggcgtgagntttctgatagactttcaagtatgagcgacagctcggcgacatgacactcggtctgtcgtgnggtgtgagcntctcgcggccgcacgacggtcgcgctcacgcgcctgattgtcgntagctaggagtccgagcggggtggtcgcgtacgagtgctctgttcgcagnaccatgcgagagtctgggaagtcgacactcggctcgcgcgcgcgtgcggtgtcaagacacccctccgctttcggtcttctctcgcgcntgtgcgttngccgcctcgtgcgctgtgctagtgcgcgcgcgtcggcactcgctgatccataccatacggtagtatctcgccacgtcactcgccgacttctccagtgcttgtcatcgtgagcgattgcaatttagtctgtctgttgcctgctggatcatcactcaataattgtagtcatcacatctgcggcggatgtcatggttccanttctcggctgccactcttctactatagaggtgctcagatcgctcggcgtgtcgcgccgctgctagaagagtgcggatctctattgcgtcgtcgatacggatactcgatgcttccgtccgtgcggggttcgcctcactaaaaaacccttccttcttgctgtggtcgctcctaaaaaaatctcccctgtcctcgcatcggtgagaagccgtacgtgcgcgtggtctgcgcgttctctcgtcct

SEQ ID NO: 7827 - DNA, 940 bp, Homo sapiens
actcttgagtgtctcactggacgctacacgtaaagagttggttcttcatgagggactgttggggctaatttgcatggggctccttcgatcccttcctacacaccctttcttacgccctttcttgtgtgctcgtattttttgttgcgatcgtcgttattggctattcctcgttctctcggggccggcttgtccactccgcggctcacctctcccattctgttcgtcgcccctcctcctcttctccttgcgcatcgctcccgtgctcccaccgtggggcgcgctccgcgtatgctactacgtcgccgtgcaccattcttcggatccccgcggggcgacacggacgtggggcctctgggggcattctgtgccctccatgcggttcaacagattaacacaatggcactaacccatgacccaccgtgttgggggacacaccaggggatcgggggggggggggaccaacaccggaggcaaaacacaatggctgcagcggactgccgatggtcactgggcagggacaccttggtggggggtgggggccacaagcaaccgaacgaaccgggaccccggcgtccactaagaccgggggggacaacaaaaagtggggatgcaacagaacaggccgggtgggccaaacaccaacacaccggtgtgggcctttgtggtttgttctcccgtgtgctctcctcaatttggggggatacatagtatattcgtataccttacataggtgtgtggttttggtggcggctgtacatgtgattccacatggtgggtcacacacacaaataatggtggcgtcggggggtcggtgaatattgtggcaaatcttcgccataccactcacaacatatgtggtacacaggtggttgggggggtgatgtgcgaaatgcacaagtgggggagggggggaaacacctatctaccacgcccctgtgtg

SEQ ID NO: 7828 - DNA, 905 bp, Homo sapiens
ccgtgcactgactcatcaatttcacactcgctggctcgtgttgccacaagtgttagtgtccgctaaccacatagtgtacctgcaaccatagtactgtccacccattatgttctgataatgtggttaggtcgcacgctctatcttcttcatagccacatgttctagtcagaactgaaccctcggggggaccctgcacctcatagctgtttcatacttgctgtaactgggtctggaatcagtatcctcaggcctcgctggtgcgttctctacgtctcgtgagcaggtggtgtttgttgacactctatcactatatcggccggaatgatggtaacgccctcgtcagttagtccccttcgtctacggtttgccagcgcatgggtttatcacatgagctgaacgcgtctcagtactagagccgatggactacctcccgtggtcaatgaccctccactacttctctgtcccatcatcgcgctcgcggtgtcgctttcctgtctcgcatttatgcatcagtgagctattcatatgtctaataccgtctcgccgccttgtatcctcgtcatgttcaccctcttaggcaagccggttcatgttatgcacaacagtatgttttttctccatcctaagaaaactcccttcatatttgttaatttctctcattcgcacatatactctgagcatattaagtggtgttatgcctgcatacatgatcatcgtatttttgtgtatagaagcacacagtactgcactgatcatcttcacatggtaaaccagtcttgtattagtgaaaaaacttgacaatgtatcactacttttatttattcctgtgtgttttttatagtttgttgattgcaaaaacagcggctttttccttttgacgactgtgcggtttcccttaaatatct

SEQ ID NO: 7829 - DNA, 1093 bp, Homo sapiens
  misc_feature (1)...(1093): n = A,T,C or G
ggtgtgacaacatcgagcgggagtacaagcataggtgtggttcagtggactagacaacaaggtctgataacacagagattagaacgtcggagtgtantcgtgtgcacaccaagctggtgacgtgaaatagataaggagtgacgtanacacgaacatatctgtggacacacaactatgtgtctatcaagtaatcaagttgctgacatgtcgtacgcttgccactgaatatgggcacgtattgtatatcgcaactatactgaactagactcacgtgtggcacgggaggtaattgacgcatggtatatacggaggcgatcggctggcgttttagccacagagcgcggacccagagggggccgtgagagctgactggaaatctacaccatgatacgctcgccacgccacccagtgcgtatattgtagaaacaatgtgtctaaagactgtagggggggaggtacgctacacaactcgggttctgtgtgtatacaccatcaatatctgggggactacccaccagatgtgaccacgcaacacgacggcaggtggcgtctagcgatatcatctagtagatcttgcgccgtggtgcagtgcaagtcttagatctgtgcaatgtatggcactaggggatcttccatctaggcaacacagtagaaagtgagggtcacgcctgagcgcctggtgttagggaagtagtagatatccgatcgcaagtcactacactacctgatgacaagagcacgcgcgcgcatttccgttcaccgagtagtagtctaccgatctcatcgcgactgtcgccactagatagtcactgccgcgatacgacgtacatacacattcagccgcgtagcgtctatctcggcgtcagtcattagcgtggtgatgcgttaaaaagtatgagtatcgcgctttctttggtttgcggcggataatatttataaaagcgtgtgatgggtcggaataaaacacgcataacgtaacgccggatcatatgagtcgcattgggcgctgcttcgtaaagcctacctgcgccgggtacaaagaagacgtgattgttncccgtgttgaccgcacgatccggctcaattcacgatc

SEQ ID NO: 7830 - DNA, 1008 bp, Homo sapiens
caagctggcgagccttgatcttcgcctccgttgacaactgggggggacaccgggacacgcttgggggtgggccgaggcacccgtgggccgcgaccgctggtgtggtttaacaaggccacctgcgggtgtatggctatggttattgagcgctcactagagggtggcgggcgaaaaacgagtagggaccatttgattaaatacggtatcttcggttttcttattcggtgatgacacagggcacgcgacccaactggagggggagcaaaaaaagtgaatggaggggggcccaccacagcgctttcgccgcgcgtagtgaaggcccgcgccaacaacggcggactcgggcccacacctggcggccactaaatgccgatcacacacacacatgtgtaatgtactgtatatgaatacagtgtggggagaacatgtacagccctcccactaacccacccagccacggccacactggcggtcaacataacgttcactgcaacaacaaatacacaccagtggtgttgggcacgtggtcggagaaagacacacaaactcaatcaatcggatgagggtgagcggaagacggactcaataccgccgcgattgggtcgcttaccaacacctgtccgctcaccacgtgtatgatcccacacttgtgtgctggcaaccctaggtgaacagctcaacactgggacactcgctcggccgccatatctatctccactaaaggacataataggtggcaacgcacggtgacaaaaaccgcagtggttaatcaatctccaccactgtggcaaagacacgtattcataaagagtgtcagctcgttggtgcaacggcgtcaaagtaacaccctggttgttacgctgcgatgggaaatctgtgcgtcaacaatgtcttcttaacttgtgggctatactgcgtgggcaaccgcgcatgcaccaccggaacccacacaccagcaactggccacccgcactttggggacaccgtataatccttgcgcgacatcaa

SEQ ID NO: 7831 - DNA, 1409 bp, Homo sapiens
  misc_feature (1)...(1409): n = A,T,C or G
aagaagaaaaagagggaagcgagggaggaagggggggcgggagcnggggcttgggaggangacggaggggggggggcctaagggggggnnaaacacggaccagcggaagggagggggaggagagagaaaaagagctttagagagggaacgcgaagaacccgccccggaacgccggggcagggaagaccaaacaacaaacagaaacacgaaggaagagagagggcgcccgcccggccgagaaagaggcgcgcacgaagcgggcaaagcgggaggaaagaaacaacagacggacagcacggagagacccggagaaaacgaaaaaacaggaagagaagaggaaacgaggggagaaggttcttcttaataaangaagagagacgagacggacgacgaccgcgagacagcaaaaagagaggagaagggagaganggcagaaggaggagacanggagcgcaagacacgaggagcagcacgcacaagaaaagacagacgcgcgaaagcagaacagaacgccggcggccaaacgacaaaaagaaaaacaaacgcacagagcgacacgcgcggagcagagcagagacggcgaagacgcggaacagaaacaaagcacgcgaaatatagcgcgagcgtgaaagaagcagccgggacggaagagaaggcagcagaagaagaggccgaggcggaggagagaagagacgagcagaagagcaaatgagagaagacaaagaaagagccgcagcncgatcgaggcggggcgacagcggaagcgagagagggagggagacggcacgaaacgcagcagccgaaacgaggagaggcgagacaagacacgacaagacgagcaaancaagagcgagaanggacgagatgaaagagaatacaacaattaanaaaccacaagacgacgagagcagaacaacacagcgcatatagagagcagcagcaggcagacacaggcggaccaaaacagcagagagacagagcatgacagcacagaaagccaagacagagcggagagtgaccaacagcgngatagaagacngaggacgagagaagagacgcacggcgcacacagcacgaacacacgacaagaagaagcgagcgaacacgcagcgcaagnacagaacgaacgcagcgcaggagcgaggaagncgcgaagacagcgacanaggagcagcgacggtcacacgtaaggaagnagacaggaagacgacacgcacgagagaaggcacggagtagagngngacgcacaggcgcgcgcacagtgatncaccgacagagagaagagcgcgagacctacacgacgcacacgtcacatcgacgccngagacgcgaaggggacagaagaaagagagacggcaagaggcacacgcccgcagcaagcgaaggacacaggacacaacaatagaacg
